United States Patent 9,328,346 (POLYCOMB-ASSOCIATED NON-CODING RNAS) - sequence listing, part 78

SEQ ID NO: 14581 - RNA, 812731 nt, Homo sapiens
uccugcggggucaaauacagaauuuacgcacccuuggcuuccuuggagccuagcggcucuccccgcguccaagauggcggcagaagcagcuggugggaaauacagaagcacagucagcaaaagcaaagaccccucggggcugcucaucucugugaucaggugagggaggcaggaggcagggucuggggacugggggcagcggcucgaccuccgcuuuggaagggagaaggguuagcugggucccacccugcucuccccuuuccuccuugccucccgcagccccuccccagggcucuaaccccuccccagggccccagcaauucccccuccaccuuuuuuuucugggguuagcuauagagagaggagccccgccucagucuuuucuuuaggggcagcaccuucuauuacagucucgggaccccaaagcacgcuauuuggguuugguagagaaaaccagguguaaagguguguuuauugauuccuaaaaugcuuguuuauuguuugccuguagcagcacucacugagaaaggcgucuuguuuccuggacuuugggguguaaggccuuggaguccggagauuccugucacgaguugcagauuuguguuuucacacucuggauacuuucaaccaccugugcguggccacagccacaaauacaagaaucugcagugagcugguaggaggacuggguuugaaggcacacaucgguuuucaauuuuuugcccugccuccgcauucugguccauuccuuaaaaaacagaaccaaaccaauuucaaauuauccuccaugcacugccccucugcaccucccagaagauuaggguggggguggagugggagcgguggaucuuuuaggagcuuuuuuuuaaaaaagcgaaauauauugaggaugggggaacccuuucaagaaucuuggauaugaugcagguacugacuaaaaccaaucuaaauaaaauuuauuauggcacguuuuuuacguuguuggcauuugaauuucaacucguuuauuuuucauaaacaaacacucuauuuuuccccaccuauacuaaacuuuuguuugaguucuugcaaguuuucuggaauguauugaucaucuuuucaaaacccagggcccaacauuaucugguagguacuaagcacuucaaugaaugcauguaucaaaccauuagaacagcuuaccacucacugacaaagacacaucuuaugggucuuauuuaggaggcuuuaagauuauggccuauuaaaucauuacuuuaauuuucuuuugggcuuaagagaaaaacaucucuguguggaaaugcuuaauauacuugguaggccauacagaggaagugcuguuguauugugaaucuauaggcccacauucucgcugugacaauacgcagguaguguagauguaucucaugauacuaaaauuccaauaagaauguuuguuguuucccaucugaauuuccuguggaauuagaauaccaggacauuauuuggauccuuuuuugaacuuguuuguuuuuucuaccuuauagucaacauuuauuuaaacaauagguauuuagugccaguugacaguauggcgucuggcacguauuacauauugaauaauauuuguugacuuaaugaguaaaugcccugaguuuugcaaagaugaagcaggcacaguguuacccuugaggagaguauaguuuaccugggggauaaaacaugucaguaaaaaugaugacauaagacuacgagagagacaugaaauguuauggaaauccaggaggaguggcuguuucuaaugaaagugaaaugugucaucucaucuguguacuuuugauucuccaggcuguucccauuucuuuuaugcuauuuguauuuuccucagggccaguugaauuuacucuaaaugucauauuuuugaaaacagcaugaaagccaaccuaaagcuuuuuuuacuaaugcuaauucagaacauacauugccuuugcuugaccauuccuuaauauucuccaggaggaacccccuacugcuugauggcuaagauuuugugguuauccauccaucucuuaugccaguuuauuaauauaugaccuucauuuuaucacugugauuuaggccuagguauuuuuuacuuugaucucuguugugcauuauauugcuuuucuuuucuuuucuuuucuuuuuuuuugagacagagucuugcucuguccccaggcuggagugcaguggcgcgaucucggcucacugcaaccuccgccucccagguucaagugauucuucugcuucagcuucccgcauagcugggauuauaggcgugcgccaccacacccaccuaauuuuuguauuuuugguagauacaggguuucaccauauuggccaggauggucucgaucgcuugaccuuguugucugccugccuuggccucccaaaaugcugggauuacaggcaugaaccaccgugcccagcccucauuuuucuacuuuauccuugaccaccucagaucacugcauaacacuuuugugauauaguuuuuacaagcaugguguaagggaaugucuagaccuaguauccugggcaaguuuauuaaggcuugggaugcauuguuauauaugaccuuaagaccgaaugguguugguguuuguauuucaacauuucuuugagucacagggagauuuugguguuggagugaggauguugguagcuauaacuuccuguuauuuccuuccuaauaugcuuuugaacauacccagugguuuaaauuuuauaaacagugguagugaaugagaggacaauggaaguauuacuuugguguuugggauggggaauggggggagaguccugcggguaagagaaccaggaauguauguuucuuguuaguaaauugugcugucacuuggaaguugcuucuuguauuucuguucaauuuauguccuuuguguuucccuucuugcaacauuguauucauuauuccuuuuuuuuuuuuugagacguaguccuggagucucucucugucgcccaggcuggagugcaguggcgcaaucuuggcucacugcaagcuccgccuuccggguucacaccauucuccugccucaaccucccgaguagcugggacuacaggcaugcgccaccauacccgacuaauguuuuguauuuuuaguagaggcaggguuucaccauguuagccaggaugguuuugaucuccugaccuugugauccacccgccuuggccucccaaagugcugggauuacaggcgugagccaccgcgccuggucugcauucauuuuuucuuaauuccucauauaaaacuuugauuaucuccuccuaucuuuaacguuguuuucaaauucucucccaaaggcuauaguuuuccugguugcuuuggcaacaagccacaaaaaggaaaacccauguuaggcucguguuuauaaggucugagcauuccuaacauguaccggguaccugcuagcuccuuucauguuuccauggacuuauuuugucacaaaauaaauuaccgacaguuagagagucuacugucuuuugaaaaguuugaucaguuuagcuuuuuaaaaaauaucuuuuuguaucacugaguaguaguuuuucuuuuuugaauagugaguauuaaaaaugcuccuuuaauucucuugcucagauguguaaaaauguaauuucuguacuacauuauguaucauaaaauuuuguauuuuuucaaugcuuuuccuaacaguugggguagcauuuauuguuagucauuuuuaauauuguauucaaaaaacuacagguggauaaggguuugacuuaaggacagaguauguguaggcauggggaauauccgaaucucaucgcuauuuccagcccuuguacuaaauaguuaaauaacgacucuauuuugcuaguauaaaguauuuaaacuuuaaagcauuuaaaagccaaaaauaaagaugaaguauaguguaauuguaaugcaaguauuauaugauuuuuuaagugcuuugagacucaaauaaaaaugcuuaauuauuuaaaaauuaucgaauaaaaauauuucagggcagucagauguuucaaaggguggacuuccagggcuuuacagaagaggcccuuaggccugugagguggggcuuaggugaggggacagauagugguugggauucaguuugucggaggcuacugccaacugcagcuuuugguuuuaagucuugccacuggcccuuuaaaauggaacuaaccgggggggacagaauccugauuacgugcugaugugugauguaugauuuggacaguuuuacacacacacagacacacaccuacuuuucuguugaccugcugauguacaauuuggaugguuuacacacacgcacacacacacacacacacgugcacacacacaauuuuucuacuuuucuguugauuuccuuugccaaccuuuuguuuggugggaagucagaggaggcagccucucuagaugggaaauaagaaagauggcauuuuggagauauuuuauuucugugaguucuugccagauuuuuaauugggaaaugugucugccacuuacuguuaggugauuugcuuuccaauuaaauguugugucacuuuauaacuuggccuguaauaaccaguuuaauugggaagacaacuuugguugugacuucaggagaccuuauugaaaccuuggagcagagcuuuugaagacacacucugguuacagaugucaaggagguuugaaggcaguggaaggcucacauuuucaucaacuuuuaugucuucacagaaguugaaauuucaaaaacuuagaaaauccuuuacuguagacaccuguuaaauucccuuccuccuuggagaguauuuuggucagcccuguguuuaauucaaaguaaacuuuguugaagggguccaggcuuugaccagggcuuugaacgaacagcuuugagguucgugacacaguuuguggcaggaaaggaaaguagucacucuguucugagccgagucuuggaaguugggugagguguuaauguucuuuccaucaccaucucuucuuuucauuugagcccaucacauaaugguguuugguuucuagcucucuuuguacccugggacaucuuggcccuacugaugcuguguuguuugaaaauuacuacuagaauacccagaaacagugcuuucaggaaguccugggaugucuggcagcauaugugaacguaaggggcaacacaauuaccguacucuggcucagaauuagugucguggacccaugucuuaguguaccucguguaacuguuaacacugggauuuccugaaggcuuugaggccuguaguauugaugguggugguauggucagguuuuuucaagccauuauuuguacauagauguggucacagccuguggugugaauugcugugguuguguguuguaguugaaacuugcuguauuaccuguguaaccuuggaacaguuacuuaaaaccaccgcgucuuaguuuccucauuuggaaagugggcuaauacaaucuguguuuuuuuggaacaucacaugagaugaggguauauaaaagugccuagcacaguuuggcacacgguaggcacucauauguucauuuccuccuuucuaggaucuguagccucuucuguuaagaagauucuuuugauauuaauaaauuugccggauagcaaccaggcuauaauguuaauuuuccaccagaaauaaccuugacgcguugacuggagugauuccauuugucaggauguugucuuuguaaccaggaaaucuuguacagcugaauuaagauaguaauuauuugguaauuugagagucagcugaagaagcuagauuuaaaugcauguaugguuauguguguauguaaaacauguaaaauauaaacacacauaaaauauaaaacauuuauuagauuaaaagacugaaaagacuauaaacaagcaaaucaagggcccaauacucuguugagauaauccuuguuguccuuuauaaaaaggacaacaauauuguguauuguacaaauuuguaaagacgagucauaggaacauuguccagcaaucucauuucccaaaauauuaccuguuuuucagguuuucguauggaucuuguccauguauauacauuuuuuaaaauauugcuauacaguguucauaguuauauauguuuuuuaaguggaggaauuaaacauacagaacaguagggaagaaaaaaucacccauaguuuaauuucuuuuuuuuuuuuuuuuuugaggcagagucuugcuuugucaccuaggcuggagugcaguggcgccaucucagcucucugcagccuccgccuccuggguucaagcgauucuccugccucagccuccugaguagcugggauuacaggcaccaugcccagcuaauugaauguauuuuuaguagagacaggguuucaccauguuggccaggcuggucucaaacuccugaccuuaggugauuggccugccucggccucccaaaguguugggauuacagacgugagccaccguccccggcccacuuguauuuucuucaccagcauuauccacuauuaauacuuuugcuuccaguuuaagaaaaaaaaaaucacucuauuguuuuaaaaauaguacucucaugauaaauaauucaaacagugaaaaugcagaaaaccgugaagaugaaaguaagaaaaauuauuucagauuuuauccuccuaaaguuauuaucauugauauuagaugaaccuaaucccagaccccucccuuuucuaugugaauguauguguguauaugaaauguugauggccagaaauaauuuuuuauuaaauaugggaucuuacucuauauacuaauuuuauuuguccuccuuuuugagguauacauguauaugcuagagugcacaaaucuuaaguauauggcuugaugaauuuuuaccuguguaaccacuguccagcuggaaauacagaacacuuccagcaucccagcuggagauacagaacacuuccagcauccuagaaugauccuucucuaccaguuuuuuccaguacuuuuuuuuuuguguguguaaggauauccauuuccaacaccacuuguuaaaaagacuauccuuucuguauuugcuuucuuuugcaacuuugucaaaaaccaauuuacuuuauauguguggguuuauuucuugacuuucuagucuguuccauucauguuuauauugauaacaauacugcacugucuugauuacugcuuuuuaaaguuaugaagacauaguguaagcccuuuaacuguuuuuuuuuuuuuguuuuuuugagacagagucuugcucugucgcccaugcuggagugcaauggcaccaucuuggcucacugcaaccucugacucccggguucaaacaauucuccugcuucagccuccugaguagcugggauuauaggcgugcgccaccacacccggcuaauuuuuguauuuuugguagagacaggauuucaccauguuggucaggcuggucuugaacuccugaccucaagugacccacuugccucggccucccaaagugcagggauuacaggugugaggcaccgcgccuggccccuuuaacuuuauucuacuuuuucaaaguaguuuugggucuucuagguuguuugcauuuucuuacaaauuuuagaauaagcuagucaguuucugcaauaaaaccugcugggauuuugauugggauuaauauauggaauugacaucuuaauauugagucuucugauccauggauggaugguauaugucuccauuuaauucuucaauugaucucagcaauuguguguguguguguguauagauuuuagugucuagguuuauaugucuuuggucagauuucuauuuuaggccacuucaaguugugcuacaguucauggaauguugauguucauuaaaaaaugcauucuuuuucucuugguguuuuguuuuauauaguuuguguugcuaugcugguucacuagucuuuucugcuauuccuaaucucuugcuaauccuaucuaauauuauuuuuaucuuagauuauacuuuucaaucuaagauacagaagcuuaucuucuuuaucuggaaguuugcuuugggucuuuuucaugucucugcuuacauguuuuaacuuuuccuguagcuuugugaacaaauggaauauagguauuauaacaguuuuaauguccuuguguacuaauuuuaucaucugugucauuucuggguuuccauugauuaauuuuuuuuucccucuuccuuuacaugccuuguaguuuuuuuuuuuuuuucuuuuugagacagagucuagcucucuugcccaggcuggagcgcaguagugugaucucugcucacugcaaccucugccucccaggcucaggugauccuccccacuuagccucccaaguugcugagacuauaguugugugccacugcgcccggcuaauuuucauauauauuuuuagguuuugcuauguugcucaggcuggucuugaauuccuggccucaagcaauccgcaggccucagccugugagccaccacacccgggcaccuuguaguuuuugaguugaugcuagacauugucaguuuuaucuugauggugguugguuuuggauauuuuuguauuccacuauucuugagcuuuguucugagaugugguuaaguuacuuggaagcaauuuggucuucucaggccuuguuuuauguuuugcuaguuaggagcagagcaacauuuagucuagggcuaaguuugucucacuacugugacaaaauucuuuugaguauuccacucaguacccuaagaauuaugaaauuuuuucacucuggccugggggauaggcacuauuuccagcccugugugaguucagaucauuauuuccucuaauccuuucagguuguuauuuuccuggccuuggguaguuaccugucacacgugugcugaucaauacccagcugaugacccucuacagaucugcagacuuccgugugcugcagcucuuucccaucuccauuacugcccugcagauucuaaccaccuuaauaugcaguguuuugaaacggguuuuguuuauuuguuuguucguuacuuuguuagucccuguuguuucuucugggccuaaaguagaaguccaucaguacuucuuauuuuaaaaaaaaucucuaaaaguacuauuuuggauugcaucuucucagagaggaagaauaagauauucagaugugcuguuuaaagcgauggcagcugggugcagugauaugugccuguagucccaacuacaggcugaggugggaggauugcuugagcucaggaguucaagucccauuggggcagcauaguaagccaugaaauaaauuaugaccuugguccuuauaguggccaguuuuuuuuuuuuuaugugcuagggguuuagcuuugaaaaacauagguguguacaguuuaacaggaaguaauaagggaaaauucuuguauuauauuugacacucuugguaagaaaauaaaauauuucaagauucuuaggagacccuuuucugacuuuuauuuauucuuuuaaaaguacagagucuuugucaaaauaaaauagaauauaauuaaaguguuuuuccauuuaaaaccuauucauugugcugaauauuaugggagaauuauacuaaaaauaucacuugagagcuuguuagaaaugcagaaucucagguccuaccugaccuaccugagcugaaucugcauuuaaacaagauucccaggugauuugaaagcacaauaaaguuuagguagccuuagaacaagaaaccccaggcuugaaauguucucaacauauagaaaugauaaauguuagugacgaugaauauccugaauacccugaugguuuggcuguguccucacccaaaucucaucuugaauuguagcucccauaauuuccaugugucaugggagggaccugguaggagguaauuuaaucaugggggcaggucuuuccugugcuguucucaugauagugaauaagucucaugagaucugaugguuuuauaaaugagaguuccccugcacaagcucucucuugccugcugccauguaaaugugacuuugcuccucauucgccuucugccaugauugugaggccuccucagccaugcugaacuguaagucaguuaaaccucuucccuuuauaaauuaccuagucucagguaugucuuuauuggcaucuugagaacagacuaauacaccugacuugaucauuacacagucugugaauauuacaaaaucacaugugugccauaaauauguacaaauauuuugcauuaauuaaaagagauacaagaagccaauuguaauuguuaaaauuuuuuuuucugagauaaacauuauauagauauguuuuuuaaaaaagcauucuuuuuuuuuuuuuuuuuuuuuuuuugagacagggucucacucugucacccaagcuggagugcaguggugugaucucagcucacuucauccucugccucccaagcucaagcaauucuugugccucagccuccggaguagcgaggacuacaggugugugccaccaugcccagcuaguuuuuguauuuuuuguagacagggaguuucaccauguuggccaggcuggucucaaacuccuggccucaagcaaucugccugccuuggccucccaaagugcugggauuacaugagccaccgugccuggccuauuugacagaucuuuuaauuuuuguacaugguugaaaauuccauaaaaauuuauauguguguguguguuuacauauguauauguuggggggagggaagauggugggaaacagguugauugauugauguuuuaauagauuaguauauuacagaagugcuauauauucuuuauguccucuucccucuccccuagacacuuuaacaauaacauauuaaagugucccugauuucugccuuuaagaaaucugcuucaauuuguauaacccagaauuuccaaaauuugaccacauaacaccucuuaauuuuuuguaaaacauuguuucugaggaacucaccagaaaagaagaucacuguggacaaugcuuggagaaggauguggggcugcaaaagaaguagaaaaagagguagaguugggugaaguaagaguaggggguagauuuuaaguugacuuugucaaccuugggcucaguuuuaugccuuaguggggugauuuuacuuaauauuagauaaugaccuuuguugccuaagagauuuauagcuuuugguccccagaaguguucuauaacugaguuaauugaacucuugaaaaacuguauguguuggguguaguaauuggcccuaagugcugucugaagcaagacaccaaugaauuuucaauugacuuuaaagcaaaaauuguuuacugucacuugauacuaaauacaucucuuuguauuguuaggggauguuguuuuuaugcaucagaaaacuuuuucagagggacuugucauugugaauugcuaucaauugggaugggauuaucuuguaguuugugugcucuaauaagacauaauuaagaaauaagcaaucacaauguauaauugaauauaauaaaaugcgauuuaaaaguguaauguagauuugguuaugcuuugagggaagccguaucuuaugugauuauauagugauacacaucuuggacauuucuuuaauguguaauuuuuuacacauuaaacucauaauucugaguaacucagaauuaugaugagggucucuucuuuucauaauucacuggaagcauuuauagacuauuugucauauacaaaauguucugcuuagaauaauaggcuuggaaaacuuauuucuuaacuuguuucuuuagugcuuauauucuuaacuaucucuuuuccucuucaguuuguacuuucacucuauucauacuuaggacaggcuuuuguuucccugaugacauaauagguauaugguacugucagccauuucucagauuggcccuuuaguauuuuaaaggcaaagagaaacugacugucauacugugaaauuagggcugaauagauauaauaacuuaaucuaaugucuucugguuaaaagcaguuugggaaagaaaacaggauuuauguuguaaagaaucacaucagcucuagacucuuuuuuucuugcaucgggaugaguagcaacaggaauauuauguucuggaaagaucaguaagcuaauaauuaccuuuuuuuccaucucggagugagguucugaaacuagugaacucuucagcauuuguugagaguuuaugcuuaguuuuugccuuaugauaauguguuugaauauuuuguaacuaaaucaggauaaccccuucucuaucuaguacucuuuccauuauguaguuuaagaaauuucacuggggccaagaucgcgccacugcacuccagccugagugacagagcuagacucugucuaaaaaaaaaaaaaaauucacuggaauugucccaacaagagagaagguagcacggauugggugguucaggugcuugaugaguagaaaaggcagggauucggugacauaguuuauccacuuaggggcccauuuugaguacuuuuaagaggggucacugagauuugauucuuauuguagauugugcucuguagagcuguugcuuccugauaagugauuuuuggauaugugaagcucuacuuguaauuaguuuuucugaguugcuugaagggauuuccauucauuguuuuguucaucuuuauuauuccuggaggagaagucacuggaugccaacaaggaaugucuuuaguagacaauuaagccgauuaacuguuuucagaaagcaugacuuaaugcuaacuauucugcaggugucgccaaaauucagguguauuacauuaaauauuucuuauagccaguuaauuaguuuaguuaucuggggcuguauuaggcagcuaauucuuguggauuugccaagaaucuguguugcuucugacuaaggagagugacugauaacauuuaucuugaaaaauuaaccaaccaaaaugacacugccuguguuuuaaaguuugguauauuagucugcuugggcugccauaacaaaacaccaaauacuaggugacuaaagcaauagaaauguauuuucucacaguucuggaggcuacaaguucaagaucaaccuaccagggcugguuucuagagaagccucucacucugcuuguaaauggcucccuugcucugcugucacauggccuuugcuguguaaauguguggagagggcuucuccuuccuuuuccuuucuucuaagcacaucaguccuuuuggauuaaggcccacccuuauaaccucacuuaaccuuuauuaccuucuuuguaggcuguguauccaaauacaguaacagugagagucagagauucaacauuugaauuugggagggacacaguucaauuuguaacaggugguacccugggcacucuuauuauuuugauaaaauauccuaaacugcuucuagagugagaaucucucaucaccuacagauagucuugaggcucgggcaagagcccuggucaagcuguuaauuuuucacaauuguuugucaaucuuacugcaugcuuuucuggcuuauauuaaaauuaauaaaacauaauuugaucuauuuaguccuguaaguuccugaaauucuagacuuaaauuaaaaugaauuguuggaaaacuuuguaccugggcuguauucagaucuuucaaaaucucuaggccugaauugaguuuuaauguuauguucuugaaggaacuuacaagaaauggccauguaagauuugugacuuugucuguuuucagaagauuguuaaggacaucuuuuacuauauuaggucuuccauguuuuuuaagugaaagauuucuuuuagaauuuaggacuaguucaaaauuugcuuccuuaaaggaacuggaguccauauuuuuugagaaugagaauuauaucaugugaugugucuccuuuugccugggcugcuaggaagcucagauuuaguuugggggcucacuucauauuaacuuugcuugcccauaugaucugcauaguugucuuuuacauuuauuuggugguguuuagcccugcaucucuuuagucccacuuucucauuuguauuuuacuuuuuauuguuuauauucuugcacaagccaucucacaucuuuuuugggaagaggugggauauaauuaaaaugaaacuugaauguagauauuguuacucaguuucacaauuaaauacugguugaaagguuaucaggcuuuggcugggugcucuuccccgaguaguuucauagaacacucagaguaaaagcucacaaaguugggccuggucuggcucccaguuuucuccuugauucauuuccugucacugucacucuuucucaagucucuaaagccacauugaccuccuugccauuccauguuccuugagcaggcuaaacacacccuguuucagggucuguucucucuggaaucagcuucccagauagugcccuuucucucucacuuucuaguaagcuguauucaaaugccaucuuuauccgagaggcccucccuggccuccuuaugugaaguagccuccuuccuccuugccugucuuggcuuuugcguagcuguuaccucccagcuccccucacuagaacauaagcuucaugagggagggauugguuuuguucauugcuguuauguaucucuaggcccuuagaacugugccugguaaguaauagauacuuagugaauauuuguugaaugaauaagugaauuaaauagggucacgagcaacuauuuguucuuuucuacagauuuuugagcaugcauuucaugugagacaauuuaguugcaauuguuucuuaaggcugggaacuguccuccaugaccucucuagauccugcaucgcacugcugcucauuacuuagcuuuuacuaagcacuuaauguaccaggcacuguaagaauauagagaaaaggucugaucucaguucagaaauaaauauccucaggaacuuuagaaagggauaggcuuuaggggauuugggcuaacaauguugugauucauagauuauuuauuuuguucccaauaauauaucagacaacacuuccgucacacuuuauauuuucaaagcacauucacacauuucuccaguccuaacaauauccuggcaaggcggguauucuuauugucuuaccuguuuuacaaagaaaaaaacagacccagaaaaguuaagucacuuaccaaaggucaagcaacuugaaaguugcagagcuccguuugaaucuggguguuuuaaaauuccagagccuguguuccuuuaauguguauguggauggcucuuguuugauauaguugaugagguaguaagagacuuucuugguguauuccuaaugguaguauucuagauuuggguuuuucuuuuugcauccuuuuauuccacuugagugaugaaucacuuuuggugacugaccuuauuuucacaggugugcuuuuuccuuuauuugaucuuucuuuugucuuuaagaacaauacugacuuuuauguauuuucuccuguccggacuccauuacucuauuaagaccaaagugaaagcaaaauugcuccacagaaggaaccagugauggugacugauuauuuuccuuucaaaacauuugaucgucuacacugaaauacagaggcuaguaugaaaaugggaaacagacaaauucaguuuuagaucuccaguuauuuacccuggguuuuaaugcuuguuuaugggacucacuuggagcucaugguugugaauccacuagaacuuaauaacauauuuguuccuacuagauguuguuaacaguagcuuuacauguguaccgugguccuuuuagcccuuuagguaaauaaauuccuuccugggaauuaauuagucaugguuaagauguaauucaucaugcaaaauaucagagcugucuuaaugaaaaauucuuaaugauccagaaaugucuuugugaccagcuuaacuggaaucuaguuuauucuuuuauguuccuccaugaacuugacaauaauuuauaagucauaaucauuuugagaauaggaauggaaaaaaaaaucuagagugauucaauaacuugaauacaucuuggguuggcaacuuuaugccauuuguccuuugaucaugucuuuuauuuagcucaugcuuuuaaaucuugcccagauucaagacuguuauuacuaaaaaagcugcuuggugcucucuuuccaucccuaacugucugcuguucucuuuacauaugaacuguggcuugaugagaguauguguccugcagcucaggaguugaaggcaggaaagauaggauuuuguaacauguauaguagaaagagcauggauuuuggagucaaauauacuuagcuuuaauuucaacucugauauuaacuaugugcauguguauauuuuacuuuaccucugugagccucugauuccuuaucuguaaaaaggcuggugauaauauuuuauuauacuagacugcuuugaggauugucuuagauuagguaugcaaaauaaccacuguauugccugguguauuauagaugcucaguaguuuuuauccugugucucacuuucaccuuccuuuccaaacauguagaacacagggaugcauguaaauuucugcauuuaguuuuaaaauuucacaaguggaggaugagugagaguugacuugucagcacuuacugucaaagggaucuuggauaauuuuuggacuauauuuuuaaaaauggaauguaguuuuaggcuauauuauuagaaagauaguguucauguugugggauauaaaaccucuuucuguuuggaaguauguuguauucacuucucagcacaucugagaggcagguuagugaagccauuaagagccauauggcccagguuugaggucagacucugcuccuuaaagacugugccuugaauaaaaaacuccaucucuuuaucucuacaaagagggauaaguaugguacugauaugguuuggcuguguccccauccacaucucaucuugaauuuuaacucccacaauucccgcgugucgugggagcaacucaguaggaggugauugaauuaugggggugggucucuccugcgcugcacuguucucgugauagugaaugaguuucaccagaucugaugguuuuagacaggguagucccugcacaagcucuauucucuugucugcugccacgugagaugugccuuucaccuucugccaugauuaugaggccuccccagccauguggaauuguaaguccaguaaaccucuuucuuuuguaaauugcccagucuuggguauguuuuuaucggcagcaugaaaauggauuaauacagguaccuaccucauaaggauguuuuugcaauaaauuaauuauuauguguaagccacuuagauuaaugccuggcacauaguaaguucuaugugaguguuaccuguuuuugaggggacuucagaugaaagcaaaaaagauggugggcugcuggaagucaugguguggaagaaacaguugaagaaacuggagguguuuaacccaagaaagaacuauugaaaguccuuuaccauuuaaagggaaauuuuauggaagaaggaauagacauuuuuuuguguuacagaaaaagaugagacuaggaucaauggguagaaauuagaaagaggcugauuuuauuuuauuuuaauggaaggcuuuauaauaaguaaagcuguucaaaauugcagugaauugcuuugucagcugguagagcucugcauuacacagaggcuuagaaggcugaagagagguucaugaccuggcugguggggugagcucaaugacaaguguugucuucugcacugcuaucuguucagguuaagggacuagugauaaucccacacugaaauuugcugggauuugcuagcaugugugagaacuuucucccuggaauuagucagcucuuucaugcuuugcuuuuuuuuuuuuuuuugagauggagucucucucuguugcccaggcugaagugcaguggcacgaucucggcucacugcaaccuccgccuccuggguucaagugauucucuugccucagccucccgaauaacugggacaacaggcacgggccauugcgccuggcuaauuuuuuauauuuuuaguagagacaggguuucaccauauuggccaggcuggucucgaacuccugaccuugugaucugcccgccccggccucccaaaaugcugggauuacagguaugaaccacugcgccuggccucuuucaugcuuuuauggucuaucauuuauuaauuuuuauugaauauuuaucucagacaaacauuuauugucugagacauuguauuucuggucucauauugcagaaaagaaaacagaacuuggaaauaaauguucaccgccuaccauugcuuggcaucaugcauucaauccuugaaggaacccaaugacuuagauuuuauuauuguugggagaccauucuccucagggcucuuguguuucugaaguucuugugagccaagcacugauugcccuaaguuuuagguuauuuugccaaggauguuuguuuagcaaacagcguuggaagauagagauggucucucacuccagagcaaggggcagauguguuuccaguccagucucugagcuuagauucgguuuucggagcucggaguucuucuccaggagcugccuaugugggcaggcuucucuuugggcccaucugccuaacccuugugggacuugggggcaaggggaacugaugugaacaugcugcgcuuacgccgcuugcugugcugugagugugaucaagucuuuuggacuugaggagcucuaggaguuuugugucuucugccagcaccugugaaacuguggcuaaccucuuagcuuucgaguagaauaaaaucucagccuucaccauucuugacauuaaggaggaauaaggugacaaucagagaguuuaaaccuaaugcccagaguuaagugaucuaguauuugggggcggugggauuuuaacuuuugucuucagaggguguacuuuuuauuauguuauggaaaaacgcuacugucuuugcugcugccauuacuacuguuauuacuggaacaauaauagcuaacgacaacaaccaacauuuguugagugcuagugacauaccaggccuuguuugaucucauuuaauucucacuaacaacccuauguggaagguaucuuaguauuuucacuuuauagaugagcaaaaugagaugccauuacuaaggucaugaguagucaguaggguggagccacaauucuaacccaggcagcuuuacucugccugaagagaccccacucuguagcuguuaggagugcaaucugaaagcagaccaaccugaguuuuaaauccccguacuauuccuaaccuucauugugugaggugguguaaauuaauucaacgucuuuaaaucucagcuguuucaucuguaaaaagaggggagggaauaauaauaggaccuacuccaaaggccuguuaugaggauuaaacauacauucuauaaaaugugcaacacagcuggcuccuggcagcuaguaagccucucuaaauauuaggggcuauuauuauuuuuauuauccuugcugccuuccuuuucucuaauuaaaaaaaaaaagcuuuaaugguuuugcacucugaguucuauaauguaaauauuuuucacuaaagacaaaauauucauccuaguuuacaucaagaggauacauuuuaaauauggggcaaagcuggcacaggguauuucuuacauaaauauuuucuugaaaaaggaaaauaggaggcagaacccccaguaggcccaauuuccucucuaaucuucauuuuaguaacccuuucuauucccuaaauaacuccuaaugauccaguaauguguuaacagugacagcugaugccagaaaagguguucucucugggccugacauuuuccuuaaugguaauucuaacuaguuaagguaaacaaugugaaauguuuggcauauuuuuuccacaaaugguaguggagcggaaaucaugaaaagccuuguaaagauggcaaaccgaucuaguguagcuuugacaauucugugacugcuguuacaaggggaaauaauagaguuaaacaucuaggaacccuuaccuuugggacaguugauaaauugaaggcauuuucugauugugcuuuacuuuagauuaacagucuggaaguuuucagauuuaaagagcaaaguuguguaucauuaaaacaacaagaagacaugauacaugcuaagcugcucuguacccaaauauugcaaguaaucuugguagcucuaucuuugaagcccaguuucguuuacauucuccacucugauuuacuuuaauagucaaacacuugggugguauucucuaccugcaagaaaccuuggaaguagucugguuuagggucaccaguuuacagaugaggaaacaggaucucucauguaaaggcuuuaaaucaagucuugugguucccaguaguguuccuuuccugagcaucccacgcuguccugaguggcuuuugcccuucccuucauugccuuuguuccugccaucccccuacccguauucaugauauagcugaucuuuuggcauuccuaacaccuaacaaaaagaauuguaaaauucuuuuuggagguuagauugaagucaaagacuggccugaauuucccuauaaauuggaaaagaaguuuuauauacuguguggcucaugaauuaagauccuuugcucuaaaugacaguucagagcagacuauuguacaguauuuugcuugcaaauaucuagaaguggauaugugauuaauuugcugacagaccaucucugaaagcaguucuaaugauggacuuauaauugauggcauccaucauugagaaccuaaaauaucccccucccuaaauuaaaaaagauaaaugaaauaaacuaggcugaauguauaagcugacaaaucugagggaauuuaaugaaacucuaaauuaccacagccaacagauaagaggaaaagguuccuuuguuacugauuauaauacuaaauuaaaaaaaaauuauccaagaaagauagugggggaaacaaagaucugugguccauguaucaaacgaaguuauugaaauauuuuuaauaaguauaucuaucucauucccugguuauuguugauucauaucaaucuuguuagugcuguucgaagacuaguaaaugcgggaaccguccuguaggauagcuuagaugacugcuguuguaagagauuuuagaauuaauaugaccuuauuuccagacugcugggggcuccauaccaaauucaggucauucaaaugagcuuuucggaaggugguuccucaguguauaaguaauuguaucaguuacugugcuuucagcuauguaugaaaaagaccaacugaaagugacuuaaacaauggauauuuauuaucuccccuaacaagaaguccugaaguaaggcagcugcagggcuggcugcuuugguggccaaggacauagugguagcuuggcauuccuccuuguuuuuccuuccaugguuguaacauggcugaagugucuuaaguaucuuaucuuuguacagugauaccuaggguugggaaaggcaccuuuucuuguuacuauucuugcagaaaauuguuccuaguacuuccuuaguuuugucucauugaucagacuugucacugauaaggagaauggaacaguucacucaaaucaagaguuacccagucucuugaacaguucaugccugccugcugucugauuaaaaucaguucuaaugccaaugacagaagagaagggccccuuggauaggcaacuacaaauccacuuagaugggcuauugaaauuuacugugaaggaaguuuuguguuuucuguuuguaacuuauuucauuuccuaguuaauaagaugaaugugcuucaccuuccuuuugcauuuuacuuucugcuucaccuuucuuuugcauuuuacuuucaaguuuuacuuagcuugauauacucucugccuucaccaggacucugucuacuagugacgaugucgaagacagggaaaaugaaaagggucgccuugaagaagccuacgagaaaugugaccgugaccuggaugaauugauuguacagcacuacacagaauugacgacagccauucgcacauaccagagcaucacagagcgcaucacuaacucccgaaauaaaauaaagcagguauuccuccuuucuggucugaugguggcagcacuucccaucacuauagguguugcagcuuggagaggagccaugguaguggcuaaugguccuuaacaaagugauucaaaaugccacuuuucaggaguucugcaggugucuggaaaggcugguugggaaagaucacagaaggcauccucggcugauuucuccccuccccugugucuuauccuugguucugccauuauuucucacugcaguguggaaugagacaagcaagauggccuccauuugcuugugucuuacgauccaucccuaacaaaccagaaggcauacuggcccuuguauucuccauucucauucuagcaguuauucuuguauuucacacaucuaaacaauaaagcauaauauucugacuguugauucaaugccuauucugaaucuuaguggcugaccuauugacacucacaugaauuggagggcagccagucgaauacccuuuuaucugaauccaaaccacagaagcgagaaugucuccuacauugaaguugguugugacuugccugcauuuauugugcauucuugguauuuuuugugaagugaagaaaauuuaaccuacaaauuauuuaaacauaaaaugaaauguuuaugagaacaauuuuuuucuuuuuuuuuuuuuuagaguuggagccuugcucuguugccuaggcuggaaugcaguggugcaucacugaagccuugaauuccugggcucaagcaauccuccugccugagucucccaaagugcugggauuauaggugugacccaccaugccuggcaaaaaaccaaaauucuugaauaucaugcuuuaauugugacuaauguguauuaaguuuuauuuuguaguuuucauguuuuggaacaguuuuucuuuuauuuguuauuuuucucucuuuuucucuuccuuccuuucuuccuucccccacguucuuucucccugucucucucuucuccuaccccuccuuucuccccuacuuucuuccuuuugcuguagguccuugagaaaacucuugguucuugggucuaugccuuuaguaccuaaaggauaaaauggguuuguaaggaguauuuucauaauuggccaaaggaugaacugaucaaauaaggguuauguaguauaacauuauaguuaugugguuuuuagcuguauuuuugagaucacuccuuuaauaccauuuaguacuacucugugauaaauaacaauaauugccaccacuuauugaacacugauucuuugcaagggaugauuauguccaaucaucucaaugaauuuagaauuuaaacucuaaucucccagauucuaaagccguuguugcugauuuucaggcauuuuuaaagcagcagaaacuuuuuuuuuuaaugugauauuuugcagaauaccagcaugucagucauuaagagaggcagugcucuccucuucuuugguuuuggggugagagguccaaagcaucauacuugguuccccccaccacugugggacugagugaugcauagacuaugguuuaaaauucacugcccugugcuaugagauugguuaggggacuggcuggccuguaucugcccaguaacagcugugcauauggcaucuucauguuuuguuuucuguccauuagacuuauauuaugauuuuguaagcagauacauaaauuaugcuucuacaaauacugaugauauaugacuuucagcuucuaagaguuuaguuccagaaucaguaugcucuuaaccuuuuggaagccauguguugaccucuuuauauuuuaaaauuaacugggcauuuuuuuuuuuuugagacggaguuuaauucuuguugcccaggcuggagugcaauggcgcgaucuaagcucacugcagccuccgccucccggguucaagcgauucuccugccucagccucccgaguagcugggauuacaggcaugcgccaccacgccuggcuauaacugggcauuuuugaaaggaauacuauaauucuuugccuuuacaagugcugaguucauccuauggauuuaucugugaaacuaguuaaaguuauagaucacuugcucuagauuuaaaguaaacuguaguccauuuugacccaauauacuaagcucaagaggggucaaugaauguauagagcugcugaccuucuggcuuugccucagguaauaacagcaaaggugaaggaccucaugguauuuguauuuucugauuagucugguugacugaaaagacuuuguccuaaucucaugggcaugggaagcaccagcagugauuucugcuuugcuucccaucauucugagucgauaacaucuuagccgcuaacaaagaauguucgccugauauugaaaaagagccuugucuugaucauuucacauuuguuuuaguagccacguuucuuaccauccucauuuucaguaugccagaguuuugagcaaaagaaaauaacaaugaaaacuuuauuauaucugauaauugucacgaaaguaaaugucauauuauucuggguuaugaauuagcuucaauauuggguagagaaauaaagggucagagcucuuuucaaaagagccuuuaauaauugauuaaugggaaaauaaaaggggggagaaugaaaaugaauuuguuuuugacaauuuuguaccaugacaguccauuucuugucaccaaggaaacacugauguuuucucacuaaucuuuuccugucauuuuuggcuuuuaauuacacuuuggauuauauaugaaauauagguguguauuuuuuuuaaagugaaaacauggaugauucaguaacgauugggcuacguuaucucagagccaagcaaaauguugagaauguguagaucugaguugaaauuuucuuucuauuuucugccaaaagaauaaggauucaugcagcaaauaucuguugagugcccgcuauguugcugauuguguuuuaggugcuagggcugcacaaaugggaaacaccaguuccuguccucagggagcuuaugugcaaaugagaggauagaaaacgaacaaauagauaacguugaacaacauuuauguagucucuauguaucgagugucugcuuugugcugaggauuguucuagauuuucagguguagaagugaagaaaacauaaacauuucuguccuuguggaguuaaauucuaaucaggggagacagacuacagacuauaagugaauauauaaguaaagugugguauagcagaugguaagaagugcuacacacacccccacccacucaccagggaggggagacuagggacuugcuguuuuagcuggguuggccagaaagggcuucacugagggcccauaugagccaacaccugaaggagguuaggaagagugucaggaagagcauuccaggaagaaaggaagcaggugcccagaucccaagucaggggcaugauuggagguuuggagcagcagcaaggugguugaugaggcugaagcaaaaugaggcauggggagaguggcaggagagagaugagagagcuagggcauguggugugguggguggguguagggaagucacguagggucuuguaggucacuggaaagacauugauuuuaacuaucgguauaaugggagaaaugauuguaaugcuuugagcacaggaauaacaugauguggcuaacaucuuuuuuuuacuauuauuauacuuuaaguuuuaggguacaugugcacaacgugcagguuuguuacauauguauacaugugccauguuggugugcugcacccauuaacucgucauuuagcauuagguauauauccuaaugcuaucccuccccacuccccccaccccacaacaguccccagugugugauguuccccuuccuguguccauguguucucauuguucaauucccaccuaugagugagaacaugugguguuugguuuuuuguccuugcgauaguuugcugagaaugaugguuuccagcuucauccaugucccuacaaaggacaugaacucaucauuuuuuauggcugcauaguauucccugguauagaugugccacauuuucuuaauccagacuaucauuguugggcauuuggguugguuccaagucuuugcuauugugaauagugccgcaauaaacauacgugugcaugugucuuuauagcagcaugauuuauaauccuuuggguagauacccaguaaugggauggcuggucaaaugguauuucuaguucuagaucccugaggaaucaugauguggcuaacaucuuaaaaggcccacucuagcugcugugcugggaauagauuucauuggagaccaaggcagaugaagauguucauauuugugcauugucaccuuuuaaagcuugagaccacagaacuguuuaugcuugccauuugagagagggucucucuccaucacccgggcuggagugcaguagcacuaucaugaaucgccauagccucgaccucccacacucaggugauccucuugccuuagccuccugaguaguugggaccauagguacauuccaccaugccuggcuaauauuugauuuuuuugcagagacugggucucccuauguuacccaggauggucucaaacuccuggccucaagugauccuccugccuuggucuccuaaagugcugggauuauaggcgugagccgcugugccuggccuacaugucucauuuuuugacauuacuuucauauauugauuuacauuauauugguagauucuauguuuuugaggauaaaagugagcugacagauggauuuaacuuucuucccugaugguccaagcuuuuuuaaaaaaauuaauuauugauuuauuuuagagauaggguuucacucuguuguccagguuggagugcaguggugccaucauagcucacugcagccucaaacuccugggcucaagggauccuccugccucagccucuugaguaggugguauuacaggcacucacaaccaugccuagcuaauuuaaaaaaauuuuuuauagagacgaggucucaacagaaggcucauaggcucagccuugauaccauguacaauugaucaggucaaguaauguggacaauaagcaaaauaacugggcaguucuauuacuuuugaaugcauuguacaauugcucaaaaugagauguuauugcauugguaaaccuccaguuccauagguucugccagugucucucauaauaacaacugaugggcuuauuguagcagcagcaccaaaagaaauggauacgaguugauacaaauuggggaguugggccaaaugaauugguauguuucucugugguguacuaggugaaugagaugaccucagauuucuuuaaaguuacaaaguagucuaaugcuuaucacuggaacaggguagguugaagggagauacuuggcuuuguugagaugugcacacaaacacuuaacauuucaucccaauuuugaccacccuauuggugcuagaucaagcucugaaucucauuuuuuuugccuauaaugagaaauaaggguacacgauuauucaagugaaguuguuagggcuuaaucauugaguaaugaaacauucauuauuugguagauaccuaaaauaauucuggcuuuuaaaugcgauuauaccuugaaagguagaauuagaacgaggaauaaccuuaauauaaaaaaauguccuaguagaacaacaugguuugcuaggaaguuauuuacagcccaaauauaagaugcugcuuguaugagaaagggaagaaggccuuugguuucuagaaauggacaugcuaaacaguggguaauaaugagauauaauuuuaaaugcgugcagcacucuagagcacauuaaugcaguugcuggaaccaugaggugaucuuuccauuaaguucagguguguguguauuuguguaaaggaagguauuggaaaguguugaggggagccucucagaauuucagaacuuagaguggcagcugaaaaaacccggggaaagaaagcacagacaguacaaguuugaagguaauuuaaagaugauuuguaguucuaaaaggcuuuuaaacagaacaaugagugguauuuccaagguucguucuuuccaggugcuuucuaacuaaccugcacaaugugcacauguacccuaaaacuuaaaguguaauaauaaaaaauaaauaaauaaauaaauaaaaagaaaauucaauaaaauacauaauaaaaauguaucauuaaaaguccagaaaaaaaaaaaagacuccauggaaaaaauuggguuggucucuuacggcaggagaaaaccuaugauaguacuuauauguagauuuacuuucgccaacaaaauucaacaaaaacaaagaagacaucucaguauuuuauacuuuuaaaauuaagaaugaugucgacacauuaauuuucauuuacuauccuugacucauagauaacuuuuuaggauauuucuagucuguaguuucaaugaguuguuugcacauuguuguauucuauuacagauaauaugcaugcucagaggcauuuccucccuucuuuaucuuuuccuugauccaaauucaguacuuuucuuuucuauuuuuuuuuuuuuuuuggaaagagucucgcucuguugcccaagcuggagggcaaugauaugaucucggcuuacugcaaccuucgccucccggguucaagugauucuccugccucacccucccaaguagcuaggauuauagguacccaccaccacaccuggcuaauauuucuauuuuuuaguagagaugggguuucaccauguuggccaggcuagucuugaacuccugacuucagguaaucugcccaacuuggccucccaaaguucugggauuacaggcgagagcgaucacgcccagacaaauucaguacuuuucugauuuuaugacuuaaaaguuauggucuuccccaggccuguguccauaagccccucucacuauauagaucucuggucuuccucucacaaaugcuaaggcaguuuuauucaaagccccacuuagcuuuucucaccccuuuaucuuuuccaaaagagggcugcaaaaauuucaacuucucugccgucuguaucaucucacauuucuauucacaguagccucuugggcccuguuuucuuucuuuucucuuuuucuaauagccucuaguuagggugacuugcagauuuugugaaauuguagcuauugcugaauaggugauuaugagcaacugugaaguuacuaaaacucugagaaagcaaaggaaauuugucucugacuugauaucaugguuugaacaaccuuuucacccauuuguuuuaggaagaaacagaguaacauaauuuuucaaucuuaauuauacuuauaaauuaaauagaaugaaaugaaaauacugucaucacauuuauaaaaguagaacagaguuuugagaaauaaauguuucaguguaauuugauacuuuucuaacauuugaauguuauucauugauggguauagcccuguuccuauuaaaaaaaccuuuuuuuuuaauuuuuaaaaauugacaaauaaaaauuacauauguuuguaguagagagcaugauguuuugaaauauguauacacuguggaauggcuaaaccaagcuaauuaacauauacuucaccucacaugcuuaucaguuauuuguggugagaauacuuagaaucuaccuuuucaucaauuuucaggcauacaauacauuguuauuaacuguagucaccauguugugcaauggguuucuugaacuuacuucucuugucuaacugaaguauuguauccuuugaccaacaucuucucaacccguccucucacccugagccccugguaacuacugcucuacuuuaugcuucuaugaguuugacuuucuuagauucuacauguaagggagauaaugccaauauucaucuuucugugucuggcugauuucacuuaacauaauguccuccagguucauauguguuguugcaaaugacaagaguuccuuuuauuuuugagacagggucgcacucuguuguccaggcuggaguaaauggugcagucggcucacuguagccucgacuuacugagcucaggcgauccucccaccucagucucucugcuaucugggaccacagauacuuuuuuguggagauggguuuucaccagguugcccaggcugguuucaaaccccugggcucaagugaucuacccaccucaggcucccaaaguggugggauuacaggugugagccaccaugcccaaacagauuuccuucuuuuuaaaugcugaaugguauuccauugugcuuauaccacauuuucuuuauccauucgucuguugauggacacuuacgcugcagugaucaugggagugcagauaucuuuuugacauauugacuucaauuccuuuugauauagacccuguagugagauuguuggaucauaugguaguucuauuuuuuaauuuuuugaggaaacuccauacuauuuuccacaguggcuguauuuuccaucuuuauugagguauaguuuacguacaguaaaaugccauauuuucagagugcagugcaaugaguuuuggcaaagguauauaucacugaauguguuaccaucaccccagagcucucuccugccuuuuugcggucaguucucucucacauccugcuccaagcaacugcugauuugaauucuggcacuacugauuaguuuucccuauuccggaacuucguacauuauucccucuuuugugucuaguuuuuuuugcuugccauaauguuuuugagauucuucauuguuucuuccuuuuuguggcugacugacccuaucccccaaguucuaaaauaacauuuuucaugacugugacuuucuaaucauaaagcagaaggcucagggcaauuuaguauuaaaaguuccuguaguuucuuuggucuguagcuuuguuaccucgguuuagagaauuuugguguggucauuuucuacacagccugaugcuaauuuuuuaucccccacaaauucuauuucgcuuuuccuuccauguaguaagcaaaagugagaagugagcugauuacauugcacauauccuagugugaagugacacaauugucuuuuuccaaucagauaggaguuugccaagcuuuacugacacccuguaaguuugucccugacucuugaucaggagccuaguuggguguuguauaacauaagauuuauuuuuaacuguuuccauaguaaccguuacacauagaggaaaaagcugagaacuauaguagcaaggugauauaaguaggauaucagaaaucagauucuaacagauuugaacuaagauuuaaaauggaaugauuuaauagcuggaguccuuaacucagagacuaagaacuccaguggaauuuaggaauggcuuugagagauauguuuuauuuuauuuuauuuuauuuuuuugugagacggagugucgcucugucgcccaggcuggagugcaguggcccgaucucggcucacugcaagcuccgccuccuggauucaugcaauucuccugccuuagccucccgaguagcugggacuacaggugcccgccaccaugccuggcuaauuuuauuuuuguauuuuuaguagagaugggguuucacuguguuagccaggauagucuugaucuccugaccucgugaucugcuugccucggccucccgaggugcugggauuacaggcgugagccaccgugcccggccugagagauauguuuaaaagucaaauaaagccacaaaugaugauaaaagacuggacucuccuaccucauccuaccccggucccaguuccaacaucucagagaugcugacuuuuacucuuuuaguuuuucuuuuuuagguauuucuauuucuaauaguaugcuugugcuguguuuuuuauuuugaauguuauauauuaacuuccaacuauggaagaugaggacuuagcccccuucccaaucucuccccaucccacuacauccucuuccuucauccucucuauauaguuguauucuaguuuugguuaaauagaugaucagugcuuaccuuuuuauaacuacacuaauauguacaucuaagccauacagcauacugugauuauguuuugugccauugcguuguuguuuuccuggaguuacugauuggauaguccuguugccuuucuucuguauuguauuuccuggaucccuuguuucuucucuucuguuuucucuuguagugguggaacacauucuucaguaguuugcugagauauggugcauauaaaauugaguuuuugagagcuugcaaaccugaaaauaucuuuauucuuuccucauacuugauugauaguucuucugggaaauacuuaucucuuaaaauuuugaagguauaucauuccuuugucuucuagcuuuuaauguugcugcugagagaaauccgaugucauucugauucacaaggcuuuguauagguccuguuuuuuccuuuuuuucuuugacagcuuuuaugauugucucuuuaucccuuguguucuuacaugucagaauagugugucuuggcuugggucuuuuugacuuccauuuucuugagcacuuggugugccuuuucaaucugaaaacucauguuuuggcauguucuggccuuuuuuuucuuucuucuucuuuuuuguuuuuuuuuuucaaaagagcuggagucuugcuuuuguuguccaggcuggaugcaguggcacuaucaugccucucugcagucucaaccuccugggcuccaguaauccuacugacucagccucuugaauaguugggacuacaggcaugugccacuauacccggcugauuuuuuaauuuaugguggagacagugucucccuguguugccaagguuggucuugaacuccugagcuccagcagcccuccaccuuggccucccaaaguacuaggauuauaguaagacacugcacugagcaggcaguuuuuuaaaaaaauuauuuaauuauuuuuuaacuauuuuucucuacuccauuuguuucgcuuuuccuuccuuggaacuccuaucugguaaguguuggaccuuuuggaucaauccucuugcuuuguuuuaccuccuaucucauuuuuugguguuuuccuguuuggagauuuccucaaggauaccuucuaaccuuucuauuggaguuuuaaaauuucuauuuuaauuucuaauaguuguuuuucauuucuugaaaauguuuauaucguccuguccuugguuaauugauguaauagcuucuguuauuuuuccuaaggauguuaauuauaguuuaacaaaauucuguuuccugcauaguuucuguucccccguguccugcuucaguaauuuucucuguuuugaugccugccauuccauucugcaggcuuucugugcaugucugaugauccuuggcuaaccauuuguguguaagaggcaggcacuacaaaccugauuggaagcucagaacauguuauggagcuuguccauaaugauuggguagggacucagcaguuucuucagugaaaccucaaaugucacuaucuguauaggucuucacuuggaccaguucacuuucccaagggagaagccauaugucucuuguguuggggugaaaagucaagcugucaguguuuuggagccuaacuauugacggagaccgaggguccaugggggcuuuggaucguacuguuuaauaugucccacuuugacuucauccuccuguuuucugugcagugucucaugccucccucucaaccaugccuggcauuuccuugucuagauccuguccaauucaguugcucccaauuuggccaaugcugugggggaggaaauuacccauguguguggcuugauggggauuuggggcucagaauacuccuauagaaacuuuuaacucaguaccccugccauuaguauacuuggugccuccuuuuugguguuaguaaauccuacuccaggcuaagguuuucagauuucucuggccugcuaauuuaguugccuacuguccaucuucuugcuagcuuccacaguuuuguuaccaucccuuauuugcuguucuuccucucuguucucucuuuaugcuucaaaaaauuucuuugguauuaccuuggugggauugcaggaaggaguagaaauaauuggaaucaucuucaucagauuuacaaagaggucuaugaccccccaaauuaauaaucagucuauuauauauauauauauguauauuuuuuuuugagacggagucuugcucugucgcccaggcuggagugcaguggcacgaucucggcucacugcaagcucugccucccagguucaugccauucuucugcuucagccucccaaguagcugggacuauaggcacccgccaccaugcccagcuaauuuucuguguuuuguuuaguagagagaggguuucaccguguuagccaggauggucucgaucuccugaccucgugauccacccgccucggccucccaaagugcugggauuacaggcaugagccacugcgccuggccuacuauacuuauuaagagagguuacaaggucuucuuauuaaagacuuuuuuuuaacaugggagacuuucauagaagcaugauuuagguguugucaugaagucguaggaagggauuagaugcuuucucaagaaaucuuuuaaucuuagcauuuuguccucauauuuuccguacuuguuggaugaauguugaaauuuaguuuuguaaucaccggaggcauagugucagugaauauuuucaucaccacaccaagucuuguagaagaacaauacagauuuucaguuaccaaaaauacgguagacucuuugcacugauggacaugucccauguauugaugaagguuuggauuauacaggugggcgcauuugccaaaacuuaccacgugguacacuugagaugcauucauggguaaauuuuaccucaaacagaagccagaaacaaaacuguaaagaaauauuaaacucaaauuuaaauaaaaauacaugugaggacuaucaaaaauauaugaaaguaguucugugaauuuugaaagaucaugguuuuuaaaauuuuuccauguugaaaaaauggaaaauuuucaauuaggggagcaaauaaaaacuuauuccuaucacaugcaucacagcuaccuccuccauucuucuccucucccuuuuauuuugucauguuuugccuaugcuagucacuauacuaugcagaucuacaggugguggagauugucuuauuuaauaucuaauauucagaaugcaaggcaaaaaagccuugguauguccuuuuauuuucagauuaucucuggaugugccuacuuucuuuuggaagcugggguuacuuuuauuuuaguuagguugagcacucuguuucuugguuuuaaacuuuagcuggaguucuagagcuagaagcuuggaccaagugaccuaucagcuggauaggaaauuugcaagcauuggggaagguauaauagcauggacucucacauugaucauucuccuuuuagauauauuaauauuuaugagguacuucauauuuucagagugcuuucucuuuaguaauguuuucuagauucacucaaagguagguugggaguaguuuucucauuucaugggagugaaauuagagagagguggagaugugcccaagugagucuaugucagaaccaggauuagaauuuuggaggcagaccaaggagaauaaguggcagugggaauuaggaacugcugcauacaguaguaccagugaagacuacuaaccagauuauagguuuagacuggcaagacuuuggacugacccaagaccgaaucuguuuuauuguagguaaaagagaaccugcuuucaugcaagaugcugcugcacugcaaacgggaugagcuucggaaacuguggauugaaggaauugagcauaagcauguccugaacuuguuggaugaaauugagaauaucaagcaagugccucaaaagcuggaacagugcauggccagcaagcacuaucucagugccacugacauguugguaagagaacagccugugcuaagggucauuuuuguuaagauguaaaagcacucucuuuuauucucucugaauccuguaaugcauguagcacauuacaaacugcccucuugggauucaugagcccuugaaggugaagccuggguauuucucuaauuccaguguuugaaaugguagguaauuauuauuuauguauuaucugucuuuguaacaauggcaagaaauauaauaguaagaaaccaguacuuaaaucagguuagaaugguaaugagagguguuuuuuagcuucagaggaagauaguuaaugaaucccauuuuaaacaaugaaaucuacaugagacagaacuucugaagauuuauagacuaguguuccacacauuuuuugaaggaauuuuuacauuagggcuuuguucuuuuccuugaaauugauaagaaauaaaauuuugggagacuaauacuggaagcaacuuuauugaccaagaguacuccacaaucuagccuuuagccuccaucuuaguccauugugugugcuccuuuuugaauugcugaaaguucccagaaggaugcaauuggugguucauguggcugagcgucaagaagaugaauaaaaaguagaaauacagaguuugcucccuaauaauccucuuucccaaggccuguggcucuuagagagggcugcucuuucucccuucccuuuuacccacccagucccacuuccaucucauucagaguugguuaaggaagcucucuauaggagcucugagcagcagaugggcuguauuugaauuguuguuuuuuccuuccccacaguaggugaaaguccuuuaccuuuguuucaccaaauuagauuggcuuuaacacuggaaaaaacacugaggggaauugguagggacacagauuaaaugcucuaagugguucuaauucauucagacuuccaagaagaauuuugcuaaaaguccuucauaagaagcuuuuuaaaggaaauuugguaaccaaggagugagaagugccaugauauucuaucagauauuaaaaccugguuaugugauaagacugaauggucaauuuccacaguggaaggagauuaauaaugguuggcccuuggcugggaguuuaaggcugcagugagucaugaucaggucacuguacuccagccugggcgauagagcaagacucugucucaaaaagaaccccaauaaacaacaaaaaaagauugacucuugggaaugacaaaagaauugguuauuuucagcaucuuauucaaaguggcagcuucuuuaauaauaaugacuauagggugucugauagaaaaaaauuacuuuucaccuuuaguguugauuuaugcauuaugaaugcauacuuguccuauauucucaagauucagcaaucagaauagauaagcaaguauacauuuguguagcaaauauacaucuauuugaaucaugauuuuuuggagugggcuugcuuuuaaguaagugccacagauuaaaauagguuguuagaauuuauuucuguguuaauuauguucauauuaggauuucagauuuuuguguuacggucuuuguucuuaagggcuaauuuauuuacuuaagggcuaaucaauaaugaauacugucccuuuuuuucugacauauuuuccucaagacucauuaaauaacuucuuuaaauucuugguuguaaguuacagaaauucaacucuagcuagcuuaaguaaaaauaauuguuugacucauguaaccagucugccaaaggaauaggcauguauguggaaugucaccuguguguuuucucugcaugcccucuucauuguucugcugaagacuggucucuucaugugugagggaggagguuggguauugagggaaaacagggggcauaggcuaugucuacaucuuuccaccuuuacagaagaaaauaaucuuuuuuuuuuucauaauucagaaaucuaggguuaggagcuagauugagccagguuggguaugauaaucaucaauaaaacuaucugguuggggcagggggcgugguauagggaggaagaacagucauguccagaaaagagugaguuuguaagacacauuuuccggagguuuuguuucguuuucuguuugguuguuuauauauucuagauauuaauucuucuugucuguuagauaucuucucccaauuggggauuugucuuuuuccuuuguuuauagugucuuuguuauaaagaaauuaaaaaucguaaugcaaaacaauuucucaauuucucaguauuuuuuguuaugugauuuuuuuuuuuuuuuuuugagacaggcucacucuguuuuccaggcuggagugcaguggugugaucucagcucaccacaaccuuugccuccuagguucaagugagucuccugccucagccucccaaguaccugggauuacaggugugugccaccacaccuggcuaauuuuugcauuuuuaguagagauggguuuucaccauguugggucaggcuggucuggaauuccugaccucaagugaucugccugccuuggccucccaaagugcugggauuacagccgugagcuacucugcccggccuguuaugugauuuuugaugcaagaaaauuuuuuuuccaucccaguguucuaagagaaucuccuauguuuucuucuuuaacccgucgaaaguccauuuuuauauaugguauuaacugaggaucuaauuuuaucuuucuucuauauagucuguuggcucaggcuguuuauugaauccuuuuucuacugauucaugaugcuauuuuggucacacagcaacuuaucacauaugcauggaucuguuucugagcucuuuauuuuguuuuaaugguguuauuuguaccugcacccaaaccaugcuguuuuaacuccuguaacuuuauaauacaucuugauaggaggugaagagauucucucaucuugcuauucaaaauugucuuuguggccaggcaugguggcccacgccuguaaucccagcacuuugggaggcugaggugggcagaucacgugaggucaggagauugacaccauccuggccaacauggugaaacuccaucucuacuaaaaauacaaaauuagaugggugugguggugcaugccuguaaucccagcuagcucagaggcugaggcuggagaaucacuugaaccuucaauagcuaauugauugaauuuaagagaauuaucuuugcaauguuguguucuuaucugugaaccuaauauuccuuucauuuauuaaaaucuucauuuguguccuuugauaaugcuuagcaauauauauaguccuuagagguaucauauguauuuuguuagauuuauuucuggguauuucauuuuuuuguuguugucuuuuaaaacaguagcuauuuauuuauuaagguuucuaguuacugguugcuggugcauaaggaugugauguauuuuucuuuuuuaauugaccuuguauuucccugaacugauucccaauacugucugccuggaaagugaugacuucuuuuuuaagaccuggcucaaauuucaucaacucucugaaugucccagauauucagauagcuaggugcuuuucuuuauguuuccauaagcucauauguuucauuuuaauauaauuccuuuuguuugugugguaggucauugaggauagugguugugucuuaccuauuuuugucugcccuguucccagcauaguguagcucauacagucagaguucacaaaucauuagcuaaaugggugacuauguggaagacuguaauaccacuacagagagaaaaagguauuucuuuugugggagcuuuguucuguuuuuucuucucugguuauuuauuuguuuauuuauuucuuaauggcaagguucucuagugucuaaccuucccuuuucguaguaauuaaaugaaugacaaugauaacaauagcuaauauguauugagcacuuacuauguccugguacuauuugaaauauguuacauuuguuagcuuauuucuuucaacaacuccacuucugauauuaccauuuuauaacuuugcauguucugaggaguuggcauaucccaauaaacaaugauuuguauaucccaauaugcaaaaauuucguggagguaggauuuaaagugcacuuaaaagguuggagauaucuucaacuuggucuuuuguauauaagauugaguaguaagcucuauaauugcucuuucauuggacuucacaugaaaaacaaucacauuuucuuucuccaugguuauguacuguuagaaguaaaaucuaaggcaucucaaggguccaaaucgaaaucuuugcuaaaagacaucagaggaaagugaagacaaaacaaucuaguccuucaaaacccccugauuuccuuggauuuguuugucagaagauuuugcauuucuauuuuaaggcagaugcagaugcuuaguaauuuaaucccuacucagaauagauuaauaaauccagaguaaauaacuccauggugacccauugcucuuggcagcuccugcuauuccuacugcaccaucagacuggucugguagcuauaggcuuggcuuuuaggugagauauuuguuucuucuuuugauaugauaaccgaguauugcauaaaauaauuaaauugucaugacagggaaugucugcaaauaggucuggccuuuuguuucuuucuucaagguaaacagcugcuguuggcuuaugaaaagcuaaaaaugauccaacaagaagccuguauccgucacauugaaaucagagacuugauuaauauuguagccuguagcuuugugauauguacgguuuaaauuagaccuuugcagucauugugcuggguugaugcaagcacauuaaugacauaauuucugguugcagcaucacauuucugcagucuguccuuuguauuccacucacauuaauugaaguaauuuugccagugaagcguguuucaaaccucugcauuuaaauugaaauuuuaauucccuuauugucuugaaaagacggcugaagaugccuuguuacagguuucauuaucacucaaaacacuccagcugcugguucuaauguacaaagagugauuaauucugggaagaauuauuaauauaagaauagcagcuucuucccaguggcaugagccaaccaggaagguauuucaugauaguuaauauuuucauaaacuuuuuuuaagggaaaauguguguagaagucugcaucaaacuaaaauugcacagaugagcuuugaaaaccacuuacacaaguucugauuuaucaucccauagaagucaauucauaauugcauucaaucaguggaaaccaagccagugcaaauaguuuugaagcacuuuagcugacagucacaaggcuugugacuaaaauaauuucauuucuaagccuuccugagauuguagagauuuugaaugucucuuaaucauuuugucugucuuuauuuauaugccuuuuaaaaagaauccauagcuguauagucagauaaggguuauuaugauaauuauaauaacaacuuauauuuauauaucugccuucuucccagaggaucccagagugcuuugcugagagaaugguguaaugaaauuauuucacuuacacuguguaaauguggccauaucugggauaaagaaauuagggcagcuauuuaauugaauaguuuucuaagaucuuauguaauaaaauaaauauauuuguaguauuuuuaguuaacaagauccuuuggaauuggauaacaugguggguugugaaugucagcaugggucuuaauuuggguuaggucgucugaugcuugaaucccagcuuugacucuuaguagcuggaugacuuaugguuaguaaauuaucuuugcugaaagcuggaguuaagaauaauauguaucuccaaggguugucgaauggauuaagugagauauuaaacuguguacauaaaguauaugcaguauaaaguuuuugaaauguuauuuauaaucgauaaauuuuacugauauuguaggaaaugauaugaugauugcuuccauguuauaaucucaaaaacugccuuugagguggacuucuuuugagcuaguaaaaguugaaguaggguuggauuaagcaguuuugauuccuuuucuucuuggccuaacauggauguaccuaaaugaaaaaccagcccaccuuuuuuaaagguaaaggaacucuuguggguggauaggguuuuucucagaaagcaauucuagucuucucuaacaauucuguguuacauuucuaggauuuggcauggacaaauuucagauuauguguuaucaauuacuuacucggcuuacauuaaaaauauguucauaggguacccauugauuguauaauucugagcaauguaauuuguugguaaaguauccaagaugagcuuguaaaaucuacuuuuagguaaguaaauauguuaauccacuggguaucaucacuagauaaaagccagaucaguacuggaagauguuugucgucagaacauuuuaguguuagaagaguugguguuaagcuguuguuucugugagugcuuagauagcaggaccaguggaccagugagguugcuucuauuugugucaguaaagcugugucauuagcaaauagacugaucuuauuuucucuucuuuaugcgcaaggaaugggugaucaugcauccacugagaaaugauuaaugugcaagcaagaaaaaagggagccaaaacauacauacaucccuuuuaucuggcuugaaaguuucugagaucucacagaacuguuuuuucuuauuacucugggaaaaguaucgaugugaaagcucuguagauaacaggagcuggaauauucuagugagcuuauuggacuaaaccugaaagugguucagugacuguaaaacaauguuccaguauuccguauggauuuuccacaacaugauaaaaauauaucagugaucaauaaugaaauagccauuacuaaaacccaucuguuccuaguguagaagagcagcuugaaagacugaggccaauauucuaagcuaauaauuuaucaggaaagaaucuggcacauauuuugauaaagagacaaaugauugggucuuuaacaugugauaaugccauuguugauaacuucuguuguuuguauguguaugugugaagguggccuuaaccuuggaggauauuacuugcuagugggaagagacagauggugaacaaauagugucucucauauuauguuaaguacuauggagaaagcuacaauaagacagggagacugggaguauugggauuugggguagggauagugugguuugcuauuuaaauagggguggucagcuguagcugcuuuuagccgcauuugagaccccccuucauucuucucuugccuucaaaaagauuuaggaaaagcugaaaacaaaaugaguaauuuuguuuuuuuauaucuacaauuaagugaguagguuugugacaguuuuauuuuucucuuauagaguagaagugcagggguuugugguagcuguuuuucaugcugcucaaggcccuuuuuauuuauauuuguuuuugaaggcugggguuuuuagaaacuagauuguuugauaggcaccugguuauuguauuaguuuuccuuuuuuuuuaaauuuugcuuuuuuaucugcuauucauuugccucuuuuaaagccaauggaaauucuguuuuauugcacuaaagccuacgagguucagcaauuuccauuuggcuugcuuggcuauggggcagugauucccacacugcacauuaggggaucuugcaagaauucuaaauucaggucacaucccagaccgguuaaauaaaagucucuaggggugggccacugacuucaguuauugacauucuccagguaaugccaauaugcaggcaacauuggaacuauugguguaggguauagcuuguucuguggaauucagcaaaacuuauuguccuugucuucauuuagcaacagugguaaguaguuggaaaccaaguauuuauguaagacacacaucacauggugauacucacauuuauguagaaguuuauuguuugaaguugcuuuguggccauacuuuauuguaguuuugggauacagcuaaugaguauuuggcuuuuauucugauuuuauagucugauuauuuggucaaaucgguuuaguaguuaaaugagaugauuuaguaguuaacucacuuaguuuuuaaaugagaugauucuccauguuuggacugacuugcacucuuuagaacugucauuuuguugcucugauuugugcaucuuugcuguggguccugauaugaccuacugcagggauuuaauggauugaaauuagagaauauguuuauuaauuuacaaguggugacuauguauagugugucauaguggaaacaaaguggauuuaaaagcaagaaguucuuaauucuaguccugauucaacaacuuaccaguuccuugagcuuagauaaauaaauuacauuaucucucuguuuuaguauccuuaucuguagaacagauaaacagauacuuaccugucuacuuuauagaaugguuaugagaauaaaagugaaauauaguacaggaaaagugcuuuguaggauauaaagcaguauaaaaauuuaaaaugguguagguaucaucgucgucauuuccccaugccagguaaaaagaaaaugcaggagucugggcuuguuuacacugagcagcauuucuauucuggugcuaccaucauuaaugcauaccgguuuuaaucagauaaaccaagugugacuguguuugcacacuugaguguacaggaagaaugcucuaagucgagaauaauaccuaagucguuugcugccauccuccaucauauuucugguuucaaccucacauacgaccuuucuugaacagauuuuugauuggucagucuguggccagaugggaacuagauguuuguguaaauugcagcugaugacaacccauguuguugauaggggacuucagucugaacuugaugauggucugagaaugcuaaugaguagcuuuugcuuggcuugacaagauaggaggagcuuguuaaagaagucuauuuucucugagauucaucccaauacuaauuacuugugguugccuagcucuugaaaugaaaaacgccauauuccucuaucauuccuuugugggauuuuaauaguucacguuaguaaagagcuguguaagugcugagcauuucuaauggauuuggggcucuugcagagugugggcgaaauugucuugauugaagugcgagccugaagugauucugagaccuccuuugccaacucuuaaaaagagaguuguucuguaacuuuuucuugucccagaguaacaaauaacaugacauggugagugacuuuaggacgcuuguuaaaagagaauggcuuuucuaguggucucuucuauuggauuuuguaguagaaaccuagguuuuaaugcucucuuacagagcacugaugggaacugggaauugaagggaccaugagguuaggaacaaaagagguuuuuuuucuaagcuuuccuaugagcaguuuacaauuaucuuucucuuaccguguuacguauaguuuaauuucuucaggaagguaauugugaacagaucuguuacaaggccuuuuagaagaaauaaggcucucaauguggaauuaugcaucagaaccccuagaacuaugcauagcuuaggacuugagaucuacuucuagaauuuuauuuuaaagaaagaauuaagaauuauaacuguuuuguguuacaaauauguauacaaggauacuuaucacaguaagaucuaugaaaguaaaaagauuagcaaugacuuaaauauggggaauugguuuaagucauuguauagucauacucauggacuaguaugaaaauacuaaauauaauguuuagggauaggcacaugcucccaguguauugccaaauggaaaaaacauguuuaaaaacaaguauuuuugcaaacacuuugcauggaaaaaugauuggaaagaacuagguuaaaauauuauauauuauugcaucagaugagugacaauaugaugauauuuuucuuuuguaauuuucuauguuuuucaaguuuucuugguugaguagguauuauuuuuguaauuugggagaaaugccaagcuuaagaaaaaaauaccauucuaggccugacuuuuuuuuaaucugugaaauuagggugggaccccagucuugaaaaccuuuaaaggucucuuucaauagaaaguucuuaguuuucaucucucagauacugccguucugugaggcucaggcugauaggguauguuagaagacuuggcuguugcuacuuuaggaggggaaaaaaaagauuacuuucgcuuuaauaaaauaugggaauuauuuguggcagaaugcacugauguuuaagggggaaaaacaaaaaacuaacaacaaaagagggaacccugaagaaugcuuaagaauagcuuaauaaaaugguaugcuuuuagaacaaguccgcauuucaugguaguaauagggugaaaucuuucaugaaggaagaagucacauuugauccuguuuucgaguuuuauuuuccgagauagaucugaagauacuuuaaagaauaaauucacaaguaaagggccuuuucuuugacagcacuuuaucuugcaggccccccucccuucauucacuuaucaauaacuucaucuaauuugccuuauccuguaaauuccauuaucucccuggcagucuauugcauuaagcccuuaguaccuaauaucgccucauuuacauugacauaugcuugaccucaguccuucuccucucuuuguuaaugcaccaacaagcacugauaucucucuggagcauuaucauuugcuguuagcucaacuaauaacaaccccucauuugagcugaugaagguuuauuaaauaaaaacaugcaguaacccuggcaguaaugaagggagaagggagguagacaacauccuuuuuuuaauggugagaguacaccaagucugcuuuauagguauuggguuuccuaagggagauagggcaccugaaugggucugaucaauauuauuuuaucagggugauuuaagaaugggcauuuuugauugucuuacuugaucacuguugauuagcauauaggcugaggaguuaggagaaaaaaguauucuugcuccaggcacuuggccuugcuccugaugcagcugucuuuggaacucugucuucaguaccagacugucaauaacccugcagcuuucaggcaguggcaaagcuuggccauagggagccagacacaucaucuuagucuucuccagugaaacugaaaucagagguuguuuuucccauagaucccgcaagagucccugaaaucuucacaauagcccugacccuugaaugaauccccuuuauuuucccuuucacgucccauacucuuauucccccgaccaccauuuguacaugaaguccggucuacuggugucaugcuguaaacaaaaguuacguggaugcuguuauuagguuuguauuaacaguugggaauuuuggguucacuugcuugcacauuuaugucacauacauauauauugugguauauucuacuaguaaaauuguuccuaguuuaucugaugcaguuaaauacauagaguucuauaaaggcuacaauguacugcaaagagugcugugaugucccagaucuaucaaagcuuucagacuugcugcuacagcuguuagguuggaccauaggaaauaaccaauauuugaucauuuuuaacuuguaaaaacaguauuuucuuaugguucaaguuaauaauaugauagauaccauuuuuuuuuucuaagcuucauuguuuguuuuacuaguuucugucugauaaagauaaaaauuuccgacuugggaaaaauaagauguagcaauguagaaauaguuggugaaugaaugaucugggauucuuggcuccugugugauaaauaucuucgcugcuugcuuagacgugagucggaaucauuccacauucacugggagaccuggaggcuucuugugcccacccaggacucccugauccugaagguggacacuugaggguggagggcccucuaggggagcaggcccuaaaaccgcuggagguugccuuccagcagugcaggggcaggcagcggcagguaggugaccugggcacuaaguaaaucuaggcuucagggcauguuucuuuuguucauacagagauuuugugauguucuuauuuauugaauaguugagacugcucaaaaaguuuguuuaacugugucuuauguauauguaggaagggggaagguaucaauucucuggaguagccuaauuuuauaucuuuuuacugcaacuccaagguagaccauggcaacauuuucagaaugguuauguugucuugcuagaaaaaugcuuccuuaagggagauuuacugaccuagugaaaagugauaaaacauuuuagaaccauauaauuuucagaguccucaaagaaauauuuguuuuggauucaacaauggcaauacauuugcuuuccuuagggaacaguguugccaaaauaagcauuuucguuagcuaccagaugguuuaguuaucaguuuuguuuuuuguuuauacagcaguuuuucuucuuuuuuuggcuugaaccuuauuucuauucacaaacaguuacugaugucguuuaucuuugugugucuuacucaccucaacuagaaaaauaaaaagaucaauaguuucuuuuacaacauuucuucaacaaagcagcugcugagaauggccaaguuuaguguuccuccaaaauauuuacagugguucaugucagaacacaaaacuagaucuuuuuacaugauaagcgugauuaagauuggcuaaagacaagcauuaacuaggaaauaauuauuuccuguauuuuacacuaaaaugaaguugagaaauagacauugggaaagaaaauuuaaggguauggugguuccuaauugcaaagauuuuccuuuguuguagacuuauaucucaacucaggcaaauuuuuuugaauucuugauuauauacauuuuaacuguguguucaagcuauucuuuuaguuauagaaacauuuuuuagaauuuuuguuuucauacauggauagguuucuaauagcaaaacaugcuuuccuguucaauaucaugugauaaaacauuuggaaaagguuugcuuaucuucauaauccuaaaggaaauauuuauuuucaauucuaaaacagauuucuauugucuaucugagcaguuuccaacuguguugacuagaacauuaauauucuguuagaugguaauagguguucggugaaaaaauucacugguagucauaucuguuuuccuccaaaaugcauuuaaaaauacuuauaucugucuauauauaugaagaauucuaaauacauuuaggugacucauuauuauauaguaaucuaacuuaaagaaacugugagauauaccugauaauucuaggaggucauauuagagaucauuuggcacaugaaugcgugguguuugauuugugaauaggggaauagacagcauuuaccaauucacuguacuguggauguugucuguuuagucuuucaucugcuauguuuuauccuguaauuuuaauauauauuugugacauuauucaguguugcgugucacacuuaugaaccuguuuuuuuuuauaauuucuuauagcagcuaccuacccugugagacugucuuguugcugucugcauuaauccaacugugucucuuuaauuucuguuaaucuuucaucaguguguuauuuaaaauguacucuguagucauuacauuuggaaaagugcaguaauuuauacaaugaccacuucccauacauuaaaacaaucuuuuuaucauuaauuaugcacauuccuaaauacagacgauuauuuuauuauuucuaguaaaucucaaaucuuaguaaauaccuggaaaccguaccuccccaguacaacagaauugacugucagcgguagucuguuggguugacugcugccucacuaacuuuuccuuuguguguaaaauuuauguuucaaacuccuuaaaaccagauaagauuaauguuagggcugggcgcaguggcucaugccuguaaucccagcacuuugagaggccaagguggguggaucacaaggucaggaguuugagaccagccuggccaacauggugaaacucugucuuuacuaaagauacaaaaaauuagcugggcaugggggcaggcaucuguaaucccagcuccucgggaggcugaggcaggagaaucgcuugaacuuaggagguggagguugcagugagccaugauugugccauugcacucuagccugggcaacacggcaagacuccaucucaaaaaaacaaaaaaaagauaaauguuagguuucuaaacauauauucuagagagcaaauguugcauugacaacuauuuucuuuaaauugguuugaguaccacuuaguaugguuagaguaagggaagacaguggccuuguccagcuuccauaauuauagcuuuauaaauagacuaugaauaagugaaggccagaaaauaaaacacaguguuuucuuauagaaauaagagacuauucucuuuccucuuuugugguaagguuuucaaauuuuugaaguucugagacuaccuuugauaauauauguuauuauguuaucuuguauuuugggucaaggaaauauauucaaaguuugucauuuaaacaguuacaauggcucaaagaaggaaggaacacuuacugaaauugcuucacuaaaacauguugggaauacucucugagguuucuuuacucauggaauaaauagguacuguuaaaaauaauuucagugagcacucaggagcugccaggcacugcgcuaaguguuuuaccugaauuuuuacuuuuaauuuaauuaggugacuuugaaaguugacacuugucauaaaauucuguauuuggaacauguacuguuuggguuaaaaaucuucauguacauuccuacaaacaaaucaaguguggaugugcagugggugguuuuuaagcuuaaauaucucagcuggauuuaauuaccuuaagggauaaggcuacgugaugggccagugguuuaccaaauuauuuuucauuuucuggaucucagugucacugaaaguuaaugcauccucuuucucugcuagagaccugaguuaaaauccauuuuagggcauaaguauaaaugaauuuguuguuguuuuuuccuccuuggggacacuguggucauuuugugaggcugccuuuccauuuggaauugcuggcagcuugcucugggcccaggggcucucauagcaggggcaguugcaagucagcgugaaaaugaacugguaggcuucagagggcagagcuggcccagggcuugucacucucccauuccuugauucuuucuugguuaacuuaaggaaacuuauuugcuacugacauuugauuauagcacaucacaaaacaagugaugugguuguggauaagccaucacauuuucuuuaccauuucaggcugguuuauauuuggcagcuacaaagguuucucuguucacuguccacagacuccuagaugacuccuuagacugcuguaguugugugaucaacauuuuugaucaccaauguguuucauggcuuuaauuaccuauuguuuuaguguaaaugguucauucuuuaggagcguguuuguauccauaauuacauuuaaggguuuuacccugaaguauuauuaguuauuuccuuuaucuguaccuauuaggaauauuuaguauaaccaaagcagggaauaauacgcauagcauuucaucccugagggagcucacuuguguucuuucccucuaagcucauccugucauuucuauuuucucucaaagaauagcaccuagaguaugcucuuuaaguuuucuuugaaaagauacaagaucuuuacacauaaaaacaaacauaauuuuguguacaugaauaaaugggaucauaucaugcaugcugucuuuuuuuuuuuuuuccuuugcagaugucacuuugaguuucaaagugaguugguugcuccagguucccugaauccuucauguucuccauuuauuguaggcauuccuauaccaguuugauuuauccaguccuuuugucuugaaaaucucccaaaccacuuugcaccgggaguaucuuccucuucauguuuugucuuccagucaccauucauaucccguuucuucuaucaaacugaaucaggacaaggagaggugaugacuacuauuguccauuuguagcauucauguaaaaaaauguauuuaccucugugugauguguauuugaaaaagagugagagagagcccgacucuugguaagcacaaagagucaugauugcugugagaacaaguucuuuuuaaaacauuuauauagugugcuuuuuuuuaaagccuuaguuuaaaaaagcuaacuuugaguaaaaguugauuaaaccauuaguacaugggauucuugugagaaugugaaugauaguaucauuuaaauagggaggucuuuuuacacguguccauugacagaugugugugggcauaaauaguuugcuauggugguguguaugcuuucauguuuaucuuugucuagauuguuuuaucauuaccuaaggugagaaaaacucuccccuagccacauuauacucuacgaagucuuuuauaugcugauaaaguucucguaagcucccuuuguuaguaucuuuuuaagacgucuuucuuauuuauaauauugccagguuauuaaguuguacuuaauugucuuucauuuuuuucucuuuucaggugucagcaguugagucuuuggagggcccccugcuccagguggaaggacugagugaccuucgacuagagcuucacagcaagaagaugaaccuucacuugguucucauagaugaacuacaccggcaccuguacaucaaaucgacuagccgaguugugcagcguaacaaggaaaaagggaaaaucagguuaaagaggcucuuugcuauaagugucuuguggcaguguaggauuggaaggaauauuuuuuguuucccagaauguuguuguaauuuauuuuacuuuuccuuuaauggacugucucugaaacuugaagaugguuuuauaauagcaaauacuccauguucugagaggcugacauuugaaguuuguucauucauucauucuacauuuauuaugguccuuuucuguaaggauauauaagaagcauuuacugugggucucauauucugaaucagagacauugguacaucucagaaggaaguagaaaaauucuuaaauuggacugugaagucagccuaauuaagaaauguagauauauuggcugggugcaguggcuuaugcuuguaaucccagcacuaugagaggcugagguggaaggauugcaugagcccaagaguucaagaccagcauggacaacagagcaagacucugucucuacaaaaaaagggccaaaauuagcuggguauaguggugugcaccuguaaucucaacuacuccagaggcugagaugacaggauggcuugagcccaggaguuugagcuucagugagcuaugauuucuccacuguacucuagccugagcaacagcgaggagaccuggucucuuaaaaaaaaaaaagacaaaaagaaauauagauguauugacugaaugauaagauucuuuauuacuuaggguuauguucagcuuuagguuguccuuuuucuggaauaguuuaggaaagguucagagagaacacuuuuauuccuugguugguuguagcauagcccuauauuuaauggccuggguagucucaagaaauucauuagguuaguagaggccugguagggaauaagacuagaucuuaagaugguagaauauuggaauuuuuaacauauguuagauagcugugcauaguacauguccuuccaauauuccuuuagaauagacagaucuuuucagagggcauuucagcacuaucuacugaaauauacauguucaugcuucuucauucagauauagacaagaagagcacuggaagcagugcacgcugggaaugaagucuuucaagucuuauccuguuugaacaaaaaacgccaaauuugcuugugaugcuucaguuuaaucagagauccugacagagaaagagagguuucuaccucuuuucagcagauaggcacuagaaaaacuucugccaggcacacagauuugauauguaccugagacauaacuucaagacuagcucugaauaggguaucugucaguaccucagcagagagugaaguggugaauaggggaagugcuaaggcauucuuucgacaaugccugcugauaaauagcagaucugaagagauuucuucccauacaagguuaaguaauaaaaucacuaugguccugugaaaauauucuguauuauaagggaaaaugagcauuauuugaggucucagaggaagaacauuuauuuuaaaaaaauuucuguaaagcaagcaagaaacauuuaagagacuuaagcucaagguuucucaaaaaauacaagaaacacgauguaguagauuauucagaauaaucacucauuucccuucuacuuuugugggagaggaguauuuccuacgcuuuuuguuggggccuuggcuuuugccaucauuaggguacaugacacaagcaggggcuucaaacgugcuuaugcuguugaguguggccuuucgugccacugccauugccuugcuggcggucccaggagaaggguaagagacacauggaacugacugaagaucagcagaccugccuagccugcaucaaccaaccaccaaaauguaugcuuauuguugaacauuauugagauuuugugguuguauacaguaagcgcauagcuuccaugaaaacaguaaccgggagcuacaagaacagagugaggagagaugcuaacagagcuaacuaaaacaugaauaaaauguaaggaaaccaaaaugaaguagagaaauuuaagucuuuaaagcuucagagagaagaucugaaucacugauguggagggaaaaacuuuucuugaugaagaggaaaaagacaagaugccaaaaggaagaggauaaauaugaaagaugaacaguggucaauccagugauuuuagggguuccagagaaucacacuaaaaugauaguguuuggggcugaauuauguucccccuaaaauucauauauugaaacccuaaucccugguaccucagauuaugacuguauuuggaaauagggucuuuuagaaagugacuaaguugaaaugaggucauuugugugggcucuaauccaguaggacugauguccuuauaaaaaggaaauuugacacacuuggagggaagaccaugugaagacacagggagaagauggucaccuacaagcgaaggagagaggucucagaagaaaccaacuacgcccacaccuugaucacagacuuccagccugcagaacugugagaaaguaaauuucuguugucuaagcuauccagucuguguuacuuuauuauggcagugggagggaacucagacagaggggaucagaagcaauaauuagaguauaaauaaaaaaaccuacuuaaacaggaaaacaagaccuuggucugcaaguugaaagaauuuaagguaaaaugaauaaaaaaaaguuacucuuagauauaaucuggaaauuuuuaugauuuucaaaaacaaauuuuauaaauaccaggaagaaauauuaugugaucugaagugauagagauaauuauuugcccacccaauguccauucuucccuucauuuuuaaugacaaucuuuauuucguuccugguggcuauaggcccagcuaaaaggcugcauuuuccaucuucccauauagcuagaggguguuuagugggacuucauuuugcaagcuguugaauggggaggucauuaauuuuuuaaagauaccaauuaaacugguaugcucacucuuuuacccuucauuugccuuucuuuacuuucuaucugggacauagauuggugccaucgagccguccuagacacaaggugaccuugaggauagaagccacaucugaaacuccaugaucaccuugaacuucuuuucuagcccuggguggggugccucuuuaaugugagaggaagucuuuguuuuacucagaccacuauuauuuggucuucuuuuuauacacuuaaaaccaggucaguuacacagaaaggagcaaaaaucaggcucaccaggauuugcugaauacuaaaugccagaagacaauagaacaaaaucuauaaaguugaauggagaagaguugggaccaaagacuuuucuagccagccaaggggacauugauaugcauagguggccaagagauauucucagauaugaauuuauaauaaaaaaaauuaguauucuuuuuccgagcaaaauucucagagauaaacugugagacguacaaccagagaacaauaaaguuguagguaguuugaaacaacuuugaggaccacauaccauuaaauagguacauguauauauauauguaaguaacugacaaauauguuuuuacaagauugagaauaucagcuaaaaaccauuguggaaaaaaaggucagccgggcguggaggcucacgccuguaaucccagcacuuugggaagccgaggugggaggaucauuugaggucaggaguuugagaccagccuggucaacgugguaaaaccccaucucuacugaaaguguaaaaguuagccaggcauggugguacgugccuguagucccagcuacucaggaggcuguggcaggagacucacuugaacccaggaagugaaaguugcagugagccgagaucacaccacugcauuccagccugggugacagaacaagacuccaucucaaaaaacaaacaaacaaaaaaggcuauguagucaaggaguacucucuaacaguaaacagaauuuauaucccuuuuuacucaguuaauagugacuaggaaauuuggauagguaggagaaaggaaugcugaauucuugcuuaagaugagugugaaguuuuguuuucgacuuuaauaauuagagaaaauguuuaauuuuguuuuuacuaaucuagauauguauauuuaaaaaucaauagagaagacaaaaauauucucuauuacaaaggauauuguacugcagcccuccuuugucagcaggggauauguuccaagacccacaguagguaccugaaacugcagauagugcugaacccugaaucuaccugcacaguaaauccucacuuaaugcccucaauaggcacuuggaaacugugacuuuaagugaaaugaagcuguaacuucaagugaaaugacauacagaagguccuagaauaacauuguguccuucaagguccucugcugaugagagaaaaaaaauucguuucauuauaugccaagauucuugauugcaaauagaggaaaucagucuggguaacuaaaacaggaaaagaauuuauuggaaaguuaucagguuguucacagaaucuaugggaagucuguauaaucaggcucuaaagcccaguaggaaccaacggagauuaagcagcugagcacacacagucuuagacaagccacaggaagggucuguuuggguugcuauuuuugcuggcaccaugcccacaauagcuggauuuuaaacuccucuguaaaugaucucuaaaugucccugcaucuuuccuuuaucucgucaagauucaaacuucuggacucaggcauccaguuugcugagccuggguaaugccuggacuccuucagcuuccauaguaggaaguggggccuucuuuuugcuuugaugcagucaguggggauggacuguucagauguuugguacccaagacaaacacccaacaaauuucuacugcaagagaaaacaaaggaaaucacaugaaggcacuuacguauaaagaagaccagauguuuuugaaguagaagauaggcaguagaauugacaaaugaaagaaagguacaugcucacauacaaaaaauaauaaaaauuuuacuuggaggaaaugaaacaaauaaauggugagacuguccuuguucuuagcucaugaagaugucaguuccaguugaaaauuuugaaacugucaaaugaaaucuaaaguucacauggaugaauacaugcguaagaauuguuuaaaagaauugugaagggagguuaugaggggggcauuucuuaugugauaucaaagcauauuguaaagcuguuuuagucaaaacaguacagacaugcaaaaauaaauuuuuuuaaagaaaacagugcagacaugaaguagaaaaucagaugggugagacaaaauagaguugagaaauagaccccaggaucuauagacuuuaguauuuugaacaauaguucagcugggggguaaugaaggcuauuuaauauauaguguucagacaauugacuguugauuugaagaaaauaaauuuaggugucuaccucuuauguacaaaugauucagccagauuuaaaaaucacauagcacuguauuagcauuaggaaaacguguaggaggauauguguggaggagccuuuuucaagcauaucagaagacauaaagaaauauauuaaaugguuuaaccauuaaaaaacccaaaacuuaucuucaggaaaacagagucaaaggauaaacuauacucugaggaaauauauguaugucauauaacgcuuuaauaucuaaagcaugcagauauuuguaagcucaguaaagcgggauauagacuguucauagauuaaaaauacaaauggcuaauaaauauaagauuguucaauaucaugaguagucagagaaauacacauuugaaaaauuaaaugcaguuuuuuguucauaagaugaucaaaaucaaagacauugauagcauguuaugauagcaaagauggcggaaaugcguagcuuucucuugaugguggaauaaccaauaugccuuuuuggaaaauaaauuugcauauucuuuguccagagaauuuuguuucuaggucuacauccuacaaaaacaguaccaguucauaaaaauauauguaacaagauauucauugugacauuguugguaagaagaacaaaaauauucagcuuaaauguucaucaagaggaguaugguauauugguaccauguaauuacagaauuucagugauaaugaucucuaugugcugauauagaaagguuucuaaggugcauuuuugggucccaaaagcaaguugaaaaauagcauagauaguaugaaccuauuugugaaagauugaaaggauagaaacuuaaauauguauacuuuauauauugguauaaauauuuguauguguauagaaaaugucagacagauaaugucaaaacacugauaaaaggaauuacuugugagaaauggaaaugugagguggggaauagggagguagaaauucuuuuauuuccuguguacaucaugagcauguuuuuuaaaaauaauaauacaauuacugaugauccuuuugaagauuuuuaaaaaugaaaugggaaaauguuuagauuauacccuugaagggaaaaacuagaauucagaucuaugcaggaugaucaaagaauguugaaaaaggagcaugcgugccauuuuuguguugugugacgugggggguggauggacagacacucauuuuuaaauuuuuuuucaagcaguccuuguaccucagccuccuaaguaacuggcauaccacugugcuuggccuugaugcuccuuucuguaagauguuuuggaaggcaguauaccaaaaugaugugaauggauuauuuuuuuuuuaaguauuuucaagaaagaauuuacaccuuuauaaucggauaaaauuaguaaaaaguuguuuaaaaauaauucuuuuauuuauugcaugauccuggauaauacucgguuuaaccuugcuuccucagccauccugggacaucgucuagcucauggaagagaaaauuugguguccauauuugucucugggcauguaaagaauguucuucacugcauuguauucauucccuaacuauuuugucuuuuaaagauuuuuuuucuguuuacauauguugguuuucuuuuuaucuuucaguucuuguuuuuuuuuuuuuucccucuuggcuuagauuuuaaauuuuuagccucacuuuauuuucuguuaccaugucuucacccuuggucugucauuugaaacgauggcucuuuuuuacuuuuauacccuuuaaaucauucuuauucuuucugaguguuccaacagaucuuagaacuauugagaauuauuaugccagccauuccuguuucauuauuuggugaagucuuacuaagggcacguuaucuuugacagauauuucuuagcucaguuugauuuaacaaaauuuuaugagcacuugcucuuugacaaguacugugccagcuguucuggcuauauaagugaauauaucaguuauucgauuuacaacuuaaaguucaacucaccucugucaguuuuuaguuucacaaaauuagccaaaugaguugcaguuguaaauuuuggacauaguugaacccauuuauugugaagugaaggaacagaaauauguuauaauuaaaaaguagauguuuaauaagcugucagcacuucuaaccccucuuaaaaaacuguuuucguaucaugaaaucuugaaaucuaacauuuagaagcagagcuuuacuaguuggauguugguuaauggccaggaaguccuugagguuacaguggcagugguuguugcuuguuuuggguuuaauuuguuguauacuuuuccuguccucuaccauguugcuauuggcaaaaugcauucagucacaauauauaauugguaauuuuggggggaccauuuuauacuagcagggauuacuguacaucagcugucuuuugaucucagcuaugaaugauucugaauggauuuaaaauaaaaauuuguaaucauguauuuaaaaugaaaaauaacugucaguauuuccaaaauaacguuauaauuuuuauuuuauuuuuuguuuucaaaaaaugcuuucucugagggauuaaaaacccguugaagguauuaauuaaucaaucccuucucagcuuuaucucugauauguggugagaagaggucuuuuuuucuguugugaaauggaaacugagguccauauuacuuaaugcaauauucuacaauagcaccuaccuuaugcugagcuucauucaugucuguagucacaaagugagugggugugcccccuuucucuggaacuuuugagacuaaguccuuucauaaaacagcaggagaaaaacuaaagucauuuccagaguuacuugccuuuggguuagugcucaccaaggagaaaauugaagcuuaagggaaaauuuuagagagagagaugaguguaugaaaauaguuuugcaguaaauugacuuucuaaaaguuuauugauggaguuugagggcccuucuggcucugauaauaaaaucagcagguuauauuuuucagaguugaaauggcaagcuguuuaucacccuaaauuuaacugaaauauguuuuuagguuaaaacugagaaaauaauuguaggauuuaaucuagagugaugugcauguacaucuguguucauagaaguguguacuaugauaaauacacauauaaaaauaucagugugcacacacauaguaacaacuguuucaucauuagguguggcaggcaguauuccagcuauauaauugaauuuuccugcugauugauaccuuaauuuaucuguacuuuaaaaguaauuccuccacuuuguucuagaaauauuuaaauauuuagacaauguauuauauuuuuccugucauuuaaaguugaaguuuuuuuuacucuguagcaguaccauaaaccugugucuuuuuuuacaauuaaaacauuuuuauuuuacuuuauucauuuguccauugaagcauuuuauuuguaaauauguauuacauccauagaugaagaaccccaggauuuucucuccuguguguuuuuguguugcuucuucaugguccaugaugugagcugagucaguacaaugaaaccaaacuggugggaugggagcagauuagucugugauuuuucuagauuuuucuagaucuuugaguuggacaucaaaucuggggcugaucacacuugcucacaacaacuuguucacacugugagguucccaauaauuuucccagcucugugaucaucagugauuucaaauucgcucaugugcccaugcuuugucaucacaguugaugaagacacuagacagugacuuuggagcaaggucuaauaagaaccagguguuugccucucuuuucgguauugucgaugcucuggaaagcagcaaacaggacauuuaugcacaccauuaggguggcacggaaagaugguggaaagagcucuuugugucuuugggcaucuguauccagggccuagggggaccugugaaguguuuuguaauugugaguaaaaugcaggugaaagaggaugacgucauugagaggaaaaaaaugagaagacaaaagaagucauaaaacaugaaagaauggacaaaucuauuaucuaauuuauuuuauaaauagauaaaccauuaugaaaaguuauuggauuugaggacuguuggauuuucuuaagauaguuuaggcuaggaacuuacagguuuacauugguagaaaagaguuguugggaggaugccaguucaauuccugguaaaugcuuucuguuacuuuaauaucuuauacuccacuuuucacauuagccugugagugauuuuaacaauuggaaauaugcuguuugguuuaguucauaucuuagucauacucacauucuuagcacugagcacagugccaagcacauaauggaugcugaagaauuguucgaguaaugauucccuguuucccuguaacaagucaaaagggagacguuaaugacugucauagugauccucaaggccuaggacaguggcuccuacauuauuuguacucagugaaaagaauaaaaccuuaugugauaauuucacucuuuaacacagugugaaauuaucacuugaacccgaauuaucacuuaacaaacuuuauuuuucaaagaucucugaaaaaacauguuuguuuuuuauuggauuauaaauacacacauaccuagcacauuuguuccaaaaggagugugugaaggagauggggauauauugcuguggugggggcagauguuguucccaauugcacacauccuuccuuccuuccuuccauuugaagaaaucuuuccuauaggcguggucucuucucugcuuccccuuugccugcucuagccacugcuacugaugauguauuucaguacuaaaaagugagaauuauggcuuccacuucccuacccuuggauuuggcuucgaggggcucuucuguuguagauagugugcgagaugauuccauuucuugagagcagggcauaggguuuaguuggcuuggcauagccugcauucuuucacuuaacagguauuuugagaugggaauuaauuggaaauuuuguuuuuuauaguuuucaugauuuaaaauuaauguguuuauuuugaaggaaguugauuuaugcguuuauuuaaaguuuauuaguuuauuuaaaguuaaucauuaagaugaggggcuuggccuucuuaggaaaggugaaauggguaaauacugaauuaaccuguuugagauccuuaaaucauuuuaauuguugugauuguccacgucaugaaauuuaugagucucuuuuaaagaaaacugaauguaguaaacuuccggcauaugucaaaaacuauagccugaaaaacacaaguaaacacuaguuaaaccuuuauucaguaucauggcauguugucauuugaucuuucuuuguugauaaauuaauauuuaauacagauacaaaggaggacagugaaauugccuggcauaguguuauuacaaggugguuauccaguugauccagaauacacuacacuaauuuuuuaaacagcauugaaugaaaugacaaaauaaaaauuuaaguacuuggaacccuuacaauacauuuuuauaccccugucugugacagucaccucuuuauuggaaauauacuggggagauccaguauaguauauacuggggagauccaguuccaguguaaagagggcucaugacaaaaacaaaagugguaaggguggggcuguagugggaggacuuuaguugguuuugaagaaagugguaacuagugcuucuuuucccguucagcucccucgugaaagaugcuucuguuccucugauugauguuacaaaccucccuacuccucgaaaauuccuugauaccucucacuauucuacugcuggaagcucaagugguaaguauuuaauucuucagccacuaagcuuuuuaguaugucuuaguuccuagguagauaucuggaggagcuuuuugggggcugagcuagguugggcugggcuaggugggccugagcuagguguguuggaaccugugaugagcccuuugcaaccuucagagcaaauaagauguacagugauuuauugggcuguugcauuaucaggguugaaaaguggcagcugaaccuggccugccugcugaauccagcugcaucuguguuuuguuugaccagcacuguuuuucuuucuuucuuucuuucuuuuuuuuugagacggagucucgcucuguugcccaggcuggaguguaguggcacgauuuuggcucucugcaaccucugccuccuggguucaagggauucuccugccuuggccucaagagaagcugggauuacaggugccugccaccaugcccagcuaauuuuuguauuuuuaguagagacaggguuucaccauguuggccaggcuggucucaaacuccugaccucccaaaguguuggcauuacaggcgugagccaccacacccgggcgaccagcacuguuuuucuaaaguugaguuuggaugcuuuuugauagagcauaugcuuuccauugugcuauaaucuuuacuacuccuaguagcuuuuacuuauuuaucucauguauugcauucagugucugguccugggagcuucugagugugugaccucuguccuaugcccucuccacuucuaaaugugcaugcauccacgugugcacucauagucguaccuguaacacacuuugaggaaauaucuacaaacuuaucuuuucuucuuuggagauauccaauauccuauugaauaagacaaagccauuuugggguuauguuuaagguugagggcaggaggguauacuuuggaugcaaagauuuaggggaaucuuguggauugccuuaggcuugccuuugcagaggguucagcucaacugggcuuggagagcuucugggccucugcagagaguuucucugcuuuuguaacuggguuggggaagaagacucgaugucuuuugugggaugccucgcaggugccuucuuguggcagccaaaaucuucauugccuuuuaacgaaauuguaauguuuauuaucauugucuuuucagauaaaaauuaguucuuauaguucuuauuagugcuguagagcuugaaauaaugaaaagguagaaaaaaauagaaaaacaauuuggauucaaucaguacauuuuguguaacuaauuggaaauguuucuguugagagcuuaauauauuguuggggcauauuuuguuaccuuaaaaugccacuuaaaauuguuuuaggauuauuuaggcuuggaaucuucaaguuuauuacuuuaacuacaggaaaguauagaauuugauaauagauuuuccuuuguuuaauuaguagccaaguuuuaaaaaauugcagucauuuauuuuuauuaugauacuuuacaauaguuuguacuccagccucuucuuggagcuagaaagguuuuguuuucucccucuuucugauguaauguugcuuuugaguuuuaacacugcucugagggguuguagacuguggaauuaugaaacaaaauauauuuguaccuuugauauguauuuuaucucugccuuuuauggaaauuaccaguuguuacaucuuugcuuuuuuguaaugugaaucauuacugcuuagccugguuauauuaauuuauguaaauguugccaagucaguggccaagugaaauaaaaaauuuaauuauuuaugaagaaaugacagggcaggcuuugcaaaugaguguuguauaaauauaaaauaagcugaaauaugccaguuacggcaaauuucaguggaagcuaauuuugcuacaucuauuauucuuacuaugauaggccuuacuuuuugauaggcacuuuaucugucagcuucuggaguuugcauucauuacuuaguggaguucauggugacacucugauuuugguauuauuaggaauuacuguugaagaacugcuugguaguugacuggggcuaggagcauuauggagacugcuuguagagauauguauaaaccuuuuauuuauuuauuuauuuauuugagacgguguuucacucuuguggcccgagcuggagugcaguggugcgaucucggcccacugcaaccuccuccuucugggcucaugcgauucuccugccucagccucccaaguagcugggauuacaggcgugcaccaccacacccagcuaauuuuuguagaaacaggguuucacuaugucagcugggcuggucucaaacuccugaccucagguaauuguccgccuuggccucccaaaguguuuggauuacagucaugagcuaccaugccuggccagacguuucuuuuuagauggguucauuuccuugacuauuuugaagacuugaucgugugcuuuuuuuuuuuuuuuuuuuuugugcgugaccaaaaaagaagguaaaaauauuauugauuaaagucaauaauagcagagguuaauauguguuuagugccuaccauaugguaaagcaaugucuuaagugcuuuacaugaauuaacucauuuagucccucaacaauuuuauaacaauuuauuaucagucccauuuuacagaugagaaaacugaggcacagggagguuaauaauugauaaaaguuuacacaguugacaagugguugugauuucagcuuagagccagguucgacuaugcucuucuaaccaguuuguuuugcugaaaacaagcuagguguccucuuuguauuaauuuucuacucacacaaacuuaguggcuuaaacaacauaaauuuauuaucuuacaguuuuguaggugagaagucuaacacaaaucugauagcaguaaaaucaagguguuggcagggcuguguuccuuuuuggaggcucuaggggaaaaucuguuuucuugccuuucuggcuccuggaggccaccauauuccuugguucauucaugguuuccuuccuccaucuucaaaaccagcaauggugggucacauucuucucauguugccucucucugacccacucuucugugccucuuuccucuuuuuaaggacucgugauuagauugauuccaccuggauaauucuggcuaaucuucccaucucaagguccuuaacuuuaauuacaucugcagucuccuuugccaugugacuaaucacagguucuagggauuaggacaugaauaucuuugggcaaccauaauucugcuuaccacacucuacgcugcccauuuugugacuuaaguuaucuuuaggagcaaguguaaaaaauuugacuuucuucaaauuauguagcgaaaucuuuuuaagucauugcaguguagucuuuaggacucuauuaaucuggaucacauuauuaaagggaauuguauaaaugaggaagauguaaauuauguagagaacugcacaaaauguuacuaaguacauauaaaaguauggggcugaugaaauauacuauaauaaaaagcaggaauuuugucuuauucuuaauaauaaacuggaaguccuaagagucuauuugugaagugcucugcaagucagccuagaaaguaauagccguuuucagcugggaauuuaacauaggcucuuaaagcuccucucucauuuugugaaacaguaagauugaggguguaauccauuagaauugacacuuuuauagaggaaguuccauuagggaaucccuggggaguauggcucucccauugggauaccauaaauuaagauuggaggugauuccugagaacuuucagguuauuuuaauuaaauaagaauuuugauugcuuuuaaacaaguuguuuuucacguguccuauuuugagguagaguugugggugacuuuuuuuuuuuaaauuauacuuuaaguucugugguacaugugcagaauguauaguuuuguuacauagguauacacgugccaugguuugcugcacccauaaacacaucaucuauauuagguauuucuccuaaugcuaucccuccccuagccccgcccugaccgaaaggcccaggugugugauguuccucuccuguguccauauguucucauuguucaacucccacuuaugagugagaacaugagguguuugguuuucuguucuuguguuagaggacaugaacucauccuuuuuuauggcugcauaguauuccaugguguauaugugccacauuuucuuuauccagucuaucauugauggacauuuggguugguuccaagucuuugcuauuguguauagugccauaauaaacauacaugugcaugugcuuuauaguaaaacgauuuauaaucuuuggguauauacccaguaaugggauugcagggucaaacgguauuuuugguuccagauccuugaggaauugccacacugucuuccacaaugguuuaacuaauuuacacucccaccaacaguguaaaaguguuccuauuucuccacacccucuccagcaucugucguuuccugacuuuuuaaugaucaccauucuaacuggugugagaugguaucucauugugguuuugauuugcauuucucugaugaccagugaugaugagcauuuucauuauguuggcugcauaaaugucuucuuuugagaagugucuguucauauccuucacccacuuuuugaugggguuguuuguuuuuuucuuguacauuuguuuaaguucuuuguagauucuggauauuagcccuuugucagauggauagauugcaaaaauugucucccauucuguagguugcguguucacucugaugauaguuucuuuugcugugcagaagcucuuuaguuuaauuagaucccauuugucaauuuuggcuuuuguugccauugcuuuugguguuuuagacaaagucuuugcccauuccuauguccugaaugguauugcccagguuuucuucuaggguuuuuaugguuuuaggucuuacguuuaagucuuuaauacaccuugaguuaauuuuuauauaagguguaaggaaaggguccaguuucaguuuucugcauauggcuagugaguuuucccaacaccauuuauuacauagggaauccuuuccccauugcuuguuuuugucagauuugugaaaggucagaugguuguagaugugugguguuauuucugaggcuucuguucuguuccauucuucuguauaucuguuuuguuaccaauaccaugcuguuuugguuacugucgccuucuaguauaguuugaagucagguagugugaugccuccagcuuuguucuguuugcuuaggauuaucuuggcuaugcaggcucuuuuuugguuccauaugaaauuuaaaguaguuuuuuuccaauucugugaagaaagucaaugguagcuugauggggauaguaucgaaucuguaaauuacuuugggcaguauggccauuuucacgacauugauucuuccuauccaugagcauggaauguuuuuccguuuguguccucucuuauuuccuugagcagugguuuguaguucuccuugaagagguccuucacauccuuuguaaguuguaucccuaaguauuuuauucucuuuguagcaauugugaaugggaguucacucaugauuuggcucucugucuguuauugguguauaggaaugcuugugauuuuugcacauugauuuuguauccugagacuuugcugaaguugcuuaucagcuuaaggagaucuugggcugagacagugggguuuucuaaauauacaaucaugucaucugcaaacagagacaauuggacuuccucuuuuccuaauugaauacccuuuauuuccuucucuugccugauugcccuggccagaacuuccaauaguauguugaauaggaguggugagagagggcaucguuuucuugugcugguuuucaaagggaaugcuuccaguuuuugcccauucaguaugauauuggcuguggguuugucauaaauagcucuuacuauuuugagauauguuccaucaauaccuaguuuaucgagaguuuuuagcguaaagggguguugaauuuugucaaaggccuuucuggaucuauugagauacucaugugguuuuugucuuugguucuguuuauaugcuggauuauguuuauugauuuguguauguugaaccagccuugcaucccagggaugaagcccacuugaucaugguggauaagcuuuuugaugugcugcuggauucgguuugccaauauuuuauugaggauuuuugcaucaaguucaucagggauauuggucuaaaauucucuuuuuuuguugcgccucugucaggcuuugguaucaggaugaugcuggccucauaaaaugaguuagggaggauucccucuuuuucuguugauuggaauaguuucagaaggaaugguaccagcuccuccuuguaccucugguagaauuuggcugugaauccaucugauccuggacuuuuuuuucguugguaagcuauuaauuauugccucaauuucagagccuguuauuggucuauucagagauucaacuucuuccugguuuagucuugggaggguguaugugucaaggaauuuauccauuucuucuagauuuucuaguuuauuugcauagagguguuuauaguauucucugaugguaguuuguauuucugugggaucaguggugauauccccuuugucauuuuuuauugcgucuguuugauucuucucucuuuuuuucuuuauuagucuugcuaguggucuaucaauuuuguuggucuuuucaaaaaaucagcuccuggauucauugauuuuugaaggguuuuuuuggucucucuuuucuucaguucugcucugaucuuaguuauuucuugccuucugcuagcuuuugaauguguuuguucuugcuucucuaguucuuuuaauuguguuguuagggugucaauuuuagaucuuuccugcuuucucuugugggcauuuagugcuauacauuucccucuacacacugcuuuaaaugugucccagauauucugguauguugugucuuuguucucauugguuucgaagaacaucuuuauuucugccuucauuuuguuauguacccaguaguauucaggagcagguuguucaguuuccauguaguugugugauuuugagugaguuucuuaauccugaguucuaauucgauugcacuguugucugagagacaguuuguugugauuucuguucuuuuacaauugcugaggagugcuuuacuuccuacuauggggucaauuuuggaauaagugugauguggugcugagaagaaugcauauucuguugauuugugguggagaguucuguagaggucuauuaggucugcuuggugcagagcugaguucaauuccuguauauccuuguuaacuuucugucuuguugaucugucuaauguugacagugggguguuaaagucucccauuauuauugugugggagucuaagccucuuuguaggucucuaaggacuugcuuuaugaaucugggugcuccuguauuggguggauauauguuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagauuuuccuccaucccucuauuuugagccuaugugugucucugcacgugagaugggucuccugaauacagcacacugaugggucuugacucuucauccaauuugucagucuguuucuuuucauuggagcauuuagcccauuuacauucaagggugauauuguuaugugugaauuugguccugucauuaugauguuagcugguuauuuugcuuguuaguugaugcaguugcuuccuagcauugauggucuuuacaguuuggcauguuuuugcagcagcugguacugguuguuccuuuccauguuuagugcuuccuucaggagcucuuguaaggcaggccugguggugacagaaucucucagcauuugcuugucuguaaaggauuuuauuucuccuucacuuuugaagcuuaguuuggcuggauaugaaauucugggcugaaaauucuuuucuuuaagaauguuguauauuggcccccacucucuucuggcuuguagaguuucugccgagagauccgcuguuagucugaugggcuucccuuuguggguaacccgaccuuucucucuggcugcccuuaauauuuuuucccuucauuccaacuuuggugaaucugacaauuauuugccuuggaguugcucuucuugaggauuaucuuuguggcauucucuguauuuccugaauuugaaugugggccugccuugcuagguuggggaaguucuccuguauaauuuccugcagaguguuuuccaacuugguuccauucucccugucgcuuucagguacaccaaucagacauagauuuggucuuuucacauagucccauauuucuuggaggcuuuguucguuucuuuuuacucuuuuuucucuaaacuucucuucuugcuucauuucauucauuugaucuucauucacugauaccucuucuuccaguugaucaaaucggcuacugaagcuugugcauucgucacguaguucucacgccauguuuuucagcuccaucaggucauuuaaggacuucucuacauugguuauucuaguuagccauucgucuaaucuuuuuuuaagguuuuuaacuucuuugcaauggguucgaacuuccuccuuuagcucagagaaguuugaucgucugaagccuucucuaaacucgucaaagucauucuccauccagcuuuguuccguugcuggcgaggagcugcguuccuuuggagggggagaggcgcucugauuuuuagaauuuucagcuuucugcucuguuuuuuccccaucuuugugguuuuaucugccuuuggucuuugaugauggugacguacagaugggguuuugguguggauguccuuucuguuuguuaguuuuccuucuaagagucaggacccugagcugcaggucuauuggaguuugccggaggucuacuccagacccuguuugccuggguaucagcagcagaggcugcagaacagugaauauugcugaacagcaaauguugcugacugaucguuccucuggaagcuucgucucagaggggcagccggcugugugaggugucauucugccccuacuggauggugccucccaguuaggcuacucgggggucagggacccacuugagggggcagucuguccguucucagaucucaaauuccgugcugggagaaccacuacaaacuucaaagcugucagacagggacauuuaagucugcagagguuucugcugccuuucguucggcuaugcccugcccccagaggugcagucuacaaagguaggcaggccuccuugagcuguggugggcuccacccaguucgagcuuccuggccccuuuguuuaccuacucaaggcucagcaauggcaggcgccccuuccccagccuugcugcugccuugcaggucaaucucagacugcugugcuagcaaugagugaggcuccaugggcgugggacucuccaagccaggcgugggauauaaucucccggugugccauuugcuaagacuguuggaaaagcgcaguauuagggugggaguguccugauuuuccaggugccauccaucacugcuuccuuuggcuaggaaagggaauucucugaccccuugugcuucccgagugaggcgaugcuucgcccugcuucagcucacgcuuggugggcugcgcacccacuguccugcccccacuguccgacaagccccagugagaugaacccaguaccucaguuggaaaugcagaaaucacccgucuucugcgucacucaugcugugggcuguagacuggagcuguucuuguucggcuaucuuggaaccaccccuauuuuguuaaacuuuuccaaaaaccagcuccuggauucauugauuuuuuuugaaggguuuuuuugugccuguaucuccuucauuucugcucugaucuuaguuauuucuugucuucugcuagcuuuugaauuuguuugcucuugcuucucuuguucuuucaauugugauguuagagugucaguuuuagaucuuuccugcuuucucuugugggcauuuagugcuauaaauuucccuccaaacacugcuuuaaaugugucccagagauuuuguugcauugugucuuuguucucauugguuucaaggaauaucuuuauuucugccuucauuuuguuauuuacccaguaguuauucaggagcagguuguucaguuuccauguaguugugugauuuugagugaguuucuuaauccugaguucuaauuugauugcacuguggucugagauacuguuuguuaugauuuccguucuuuugcauuugcugaggaguguuuacuuccaauuguguggucacuuuuagaauaagugcuaugaggugcugagaagaauguauauucuguugauuugugguggagaguucuguagaggucuauuaggucugcuuguuccagagcugaguucaaguccugaauauccuuguuaauuuucugucucguugaucugucuaauauuuacagugggguguuaaaaagucuccaacuauuauugugugggagucuaagucucuuccuaagaacuugcuuuaugaaucugagugcuucuguauugggucuguauauauuuaggauaguuagcucuucuuguugaauugaucccuuuaccaauauguacuggccuugucucuuuugaucuuuguugguuuaaagucuguuuuaucugagacuaggauugcaaccccuguuuuuuuuuugcuuuccauuugcuugguaaauauuccugcauccuuuuauuugagccuaugugugucuuugcacgugagauggguuuccugaauacagcacacugcugggucuugacuuuuuauccaauuugccaguuugugccuuuuaauuggggcauuuagccuguuuaaauuuaagguuaauauuguuaugugugaauuugauccugucauuaguaugcuaguugguuauuuugccuguugaugcaguuuuuucauagugucaauggucuuuacaguuugguauguuuuugcagugguugguacugguuauuccuuuccauuuuagugcuuccucuggacuuuuguaaggcaggccugguggugacagaaucucucagcauuugcuuguguguaaaggauuuuauuucuccuucguuuaugaaacuuaguuuggcuggauaugaaauccuagguugaaaauucuuuucuuuaagaauguugaauauuggcccucacugucuucuugcuuauaggguuuugcagagaucugcuguuaguuugaugggcuucccauuguggguaacccagccuuucucucgggcugcccauaacauuuuuucuuuaauuucagccuuggugaaucugaugguuauaugucuugggguugcucuucuugaggaguauuuuugugguguucucuguauuuccugaauuugaauguuggccugucuugcuagguuggggaaguucuccuggauaauauccugaagaauguuuucuaacuugguuccauucucccugucacuuucagguacaccaaucaaauguagauuuggucuuuucacaugguuccauauuucuuggaggcuuuguucauuucuuuucacucuuuucccuccaaucuugucuucuugcuuuauuucauuaauuugaucuucaaucacugauaucauuucuuccacuugaucaaaucagcuauugaagcuuguguaugcuucacaaaguucuuguacugugguuuucagcuccaucaggucauuuaagcucuucucuauacugguucuucuaguuagccauuugucuaacccuuuuucaaggcuuuuagcuuccuugugauggguuagaacauguuccuuuaacuuggagaaguuuguuauuaccgaccuucugaagccuacuuuugucaacucauucaucaaacucauucuccauccaguuuuguucccuugcugcugaggaguugugauccuuaggagaagaggcauucuaguuuuuggaauuuucagccauuuugcauugguuucaccccaucuucguggauuuaucuaccuuuggucuuugaagucggugaccuucagauggggucucugaguggccauccuuuuuguugauguugauacuauuucuuucuauguguuaguuuuccuucuaacagucaggacccucugcuguaggucugcuggaguuugcuggagguacacuccagauuuuguuugccuggguaucaccagcagaggcuacagaacagcaaagauugcugccuguuccuuccucuggaagcuucaucucagaggggcaccagccagaugccagccagagcucuccuuuaugaggugucugucggccccuacugggaggugucuccuagucaggaggcaugggggucagggacccacuugaggcaaucugacccuuagcagagcucaaaugcugugcugggagaucuguugcucucuucagagccgucaggcagggacguuuaagucugcugaagcugugcccacagcugccccuuccccuaggugcucuguuacagggagguggggguuucaucuguaagccccugacuggggcugcugccuuuuuucagagaugcccugcccagagaggaggaaucuagagaggcaaucuggccacagcggccuugcugagcuguggugcacucugcccaguuggaacuuugcaguggcauuguuuacucugugaggguaaaaccuccuauucaagccucagcaauggcagacgccccuccccccaccaagcucaagugucccaggucaaucucagacugcugcuaugcuggcaccgagaauuucaaaccacuagaucuuaaguuaccuaugcuccgugggggugggacccacugagccagaacuucgcucccuggcuucagcaccccuuuccaggggagugaacgguucugucuugcugguguuccaagcaucccugggguuuggaaauaaaaacugcagcuagcucagugucugcccaaaugguugcccaguuuugugcuugaaauccagggcccuggugguguaggcacuggagggaaucuccuggucuguggguugcaaagacugugagaaaaguucaguaucuaguccggagugcacuguuccucacggcacggcacagucccucacagucccucacagucccucacagucccucacagcuucuguuggguagggggagagaauuccuugugcuuccugggugaggcaacaucccaucuugcuuuggcucgcccuuggugggcugcacccacuguccaaccagucccagugagaugaaccggguaccucaguuggaaaugcagaaaucccccuucuucugcgucgaucucacugggagcugcaaaccggagcuguuccuauucggccaucuugccagcaaucugugggugacuuuucugugagagguuuuuuuuuuuuuaaauaauaguuuauaaguuauaguuugcaaaauauaucauuuaaaugaugcaacaggccuaugacguaguuagggcagguacuaugugauuacuguuacaauuauuauauuuagaucauuaaauuuaagugcgaucagauauaaaacauuuacuuauaaaaugcaaagucaaggcacagguuggcaaaagcaagaauccauuaaaagaaaaaugauuagcauccgcuuagcuuuccuacauauuaaugaagaaaagaaaugacauaauaaagaacugagcaaauaauuugcaauucacagacaagucccuguccguggaaaaauuggcauuuaucugauggagauuaaguaucuagaauauguaaagaaucucuauaaaucaauaaaacaagcuaauagaguaauaggcaaaauuaugaacaguuugcauaaggggaauccaaugcuaagaaauauaugaaaaacuacuuauauucugguuaaucagguauuaucuucuuucuuuuuucuuuuuuuuuuuuuuuuuuuuuuugagauggagucucgcugucgcccaggcuggagugcaguggcgcaaucucggcucacugcaggcuccgcccccugggguucaugccauucuccugccucagccuccccaguagcugggacuacaggcgcccgccaccucgcccggcuaauuuuuuguauuuuuaguagagacgggguuucaccguguuagccaggauggucucuaucuccugaccuugugauccgcccgccucggccucccaaagugagguauuaucuuuacaaucacuuuacagauacggaagcugaaugcaggaagguugagugguugguccagguucaaccaagaugauaauuguuggagccuggccucaugcuguucccagucuaaauauguagggcauguauuuugcaagccuuucucuuauucuccucagucacaguauuuuguaaugcacagagaaacuaaugucuaauuuagauguaguaguucaacuauaacuuagguagaaggaugggagaaguguggagaaaagccaauaauuguaguaaaauguugguuuaagcuuuuggacucccaguaugucuuuucauuuggcaaacugccuuuggaacauuuugacugaguaguuacucccagggaacacaggcauuucauuuguggccucuuuauucauuuuauucaugcuucugcugggauuucgugaauaugacuauaaugaaacuggacuucuuaguucuuuucuuuuggguacaagcauagguuaagcaguaaaaaccuaaagagaacacaaauuaaaugauuuuuaugcugcuauuuucuugaugugcauuuuauuccauaaaguguugcucugagacuuuauauauaucuuaagaauuuggaggccgggcacaguggcucaugccuguaaucccagcacuuugagaggccaaggugggcagaucacgaggucaggagaucgagaccauccuggccaacauggugaccaaaauacaaaaauuagcugggcaugguggugcgugccuguaauuccagcuacucaggaggcugaggcaggagaaucucuugaacuugggaggcagagguugcagugaggugagaucuuguaucuaccaauuuuguugcauuauuuucaaaauucuaauagaauauuugaaaaaauauauuuguauauuuuccuggauuuuguauguaaacagucagugucugcaguuaaggcaguguugucuccuuuuuguaaagauucaacaguuauuugcccucuuuuuguuuauuuguuuuuaauuuuugcauagcugggaaccuaucauauaacuugaaugguagaggcaauagugugagucuugcccuuaauggaaaugguucuaaaaugucaucaaguaugauauuuccuuuucauuuuugacugguuauuuacccuucugggugggaaguuauagauuauauuuuuguucuuuuagauuuuaaccuuaauuuuuagcaccuacuuugcuacagagcuauuuuaaaguuaucaaaugucuauuuuucuuuaauauuucaagugcaguacacauuccaagguaugauuauuauucuugccuauagcaauuaucaggcguuggccaaaucaugauuuucuuuuucugucauucuuuuuucauuuacuaauagaauucuacugugaugaagagcugugucuucuucauguauuucuauauucauuaauuguuuaaaucaguaaaaauuuauggauauuuacuuuguucuaugacuuguaaucagguacugucauuauuuaucuuauugcucaaauugucccaaauuuggccacugguagcuccuucagguugguuccuagguuguuuuaacauguccccauccauuguugaaaacuuccuuacauucugguaccacaagacauuucagacucaucuuguacuuccccucccuuugccuuggaauuaaccauuucucuaaggagaucugguuuuuuuuuuauuggagagugauauuuugaaaccuagauuuguauucuaguugaacacauugcugcugguguaauguugcuguagucccucuuagcugacagagcuaggagauauguaugugcaugcuuauguauauuacauguguauauguguguacaccauacacauguauagacagaaacauauacaucuauauguaucuauuucuguauguauuucuacauagaucuguaucuauuuauuucuguaucuguuuauuucuaaccauguguauauaugaguaaaacaugaguucaacuccaaauccaugucaaccacugcaguucagcugagccuucuuuccuuauuucuagcucuuuucaauagugagaaaccugguucuuguaacaagcaacucauuuuuguaaucccaguauauacaugaaaucauuuuacaauugcuaaccaaugaaaaacaauucacggcagugaaaaacaaaucuauaaacuugaguacaauguuugugugcaguucaauuugcauauuagaaggcuuauaauauuuagucaaaauagucaaaauccaguuacuuagguuaguucuuuucgaccccaacccacucacuuaugguuauguuauuuauuugcaauacuuuuagguucauuuguuacuguuuuuauuucauuugaguucuccuagaucucaguugauuuuaauuauuuauuguggggguacaucggaagcauuaucauguuguaagcaucugaacuauaacacaaagcacucaggcaaugucacuuuuccaucucuaucuuuuaucccauucccaguuuccuuccuauuuuuuccgucuaucccuauaggucaucagucacauucauuucugcuuuauccuuccuguaauucuuuuugcaaaagcaaggaguuaaauauaucuuuucuuaaauccuuucucucuuccaugaaggguaaggauacuauagauacuccuuuauacuuugcuguuucacucuacaauauauccuggaaaucauucuguauuaguucauggagauucugcuuauucuucaauguucuuuuuauaucugcauaguacucuguuggguugauuuaucauaggucaaccacucucuguuguugcucuuuuuuauacucuaaguucagggguacaugugcagguuuguuacauagguaaaugugugucauggggguuuguuguauagauuauuucaucacucagguauugagccuaguacccacuaguuauuuuuucugauucucucccuccucccacccuccacccuccacucuccacccuccaaugggccccagugugcauuguuccccucuauauguccauguguucucaucauuuaguuccuacucauuaguugagaacauguguuguuugauuuucuguuccugcguuaguuugcuauggauaauggccuccagcuccauccaugucccugcaaaaggacaugaucucguucuuuuucggugauguaguauucauguuguauauguacuacauuuucuuuaucuggucugucaucguugggaauuuagguugauuucaugucuuugcuauuguaaccacucucuuuugugugaguauuuagauuguuuucaguauuuugccaucaggcaaugguggaauaaauaacaugcacgugcauuuucauguuguuggagguguaucguuaaauuucuagaagagggauagcucaaucaaaagguaagcccauauguaugggaucuuuuuguuuauagcuuaaaaauuuuuuuuaauguuuuaaaaaacucauaaaauuuacugugucaaccauuucuaaguagacaguucagugguguuaaguauauucacacuguugugcagccaaucuccagaaauaucucaucuugcaaagcuggaacugugugcccauuaaacaacuccucuuuguccaccuccaccaaccccuggcggcccccauucuacuuucuguuucuauuaauuugacuacuguggauaccucauauaaguggaaucauauaguauuugucuuuugugacuaguuauuucacuuagcauaauauuuucagcauuuguccauguuguacccuauaccagaauuuccuuccuuuucaaggcugaauaauacuccauuguauauauacuauauuuuguuuauccauucaugugucaauggacauuuggcuauugugauaguggugcugugaacaugagugugccgauauuuccuugagauccugcuuucaauucuucuuaauauauaccuagaauugaaauugccagaucauaugguaauucuauauuuaauuuucuggggaucugccaugcuguuuucacagcagguauaccauuuuauauucucaccaacaguguguaaggguucuacuucucucuauccucaucaacacuugccauuuucuguauuuuuuuucuuuugauaguagcuauccuaauggguaugaggauauaucugauuauuguuuugauuugcauuucuguaaugauuagugaugcuggacaucuuuucaugugcuuguugcucauuuuuaggucaucuuuggagaaauaccuacucaaguccuuugcccauuucaaaauuggauuauuuguuuuuguuuccguugaguggcagaggcucuuuauauauucuguauauuaacacauuuucagaugugugauuuucaaauauuuucuuccauuucauagguugccuuuuagcucuguugacuauguccauugaugcacagaaguuuugaauuuucguguagucuaguuuuacuuuuguugucugugcuuuuucugucauauccuggaaauccuugccaaauccaauguugugaggccuaccccccuguguuuucuucugagaguuuuauaguuuuaggccuuauguuuaggucuugauccauuuuggguuacuuuuuguguaugguauaaggucagggucuaugcucauauauaguuuuauuacaucuugccaaauucuccccccaaagagaaaguaguaccagucugcauucccaccaccaguacaucacagugccuguuuccccacagccuucccaacagaauguguuuucauuuuacaauucuugccaaucugagaaguaaaaaauguuaucaguguuguuuaauuuucauuucuauaauuauguauaaaauuugaacaauuucugguauguuuaagguuuauuuuuaguuauuuuggugaauuauguauuuuuuucaauuuuucuguuuuguuucauuuuuauuuuauuuauuuuauuuuauuuuauuuuauuuuauuuuauuuauuuuauuuuauuuuauuuuacuuagagauggagucuugcucugucgccaggcuggagugcaguggcaccaucuuggcucacugcaaccuccgccucccggguucaagcaauucuccagccucagccuccagaguagcugggacuacaggcacacgccaccaugccuagcuaauuuuuguguuuuuuaguagagacgggguuucacuauguugggcaggauugucuugaucuccugaccucgugauccacccuccucagccucccaaaguguugggauuacaggugugagccaccacuccuggccauguuuuauuuuuaaauguaucaauaugcuauauuaauagauuucuuaguauuuagacaauuuuucacucuugaaauaaaucucucuugacugugguguauuguuuugucaauguuguguugaauucuauuuguuaauauuuuauuuaguauuuuugcauugauguuuacaagugauauuauaugaaugauauuguguagucuaaaccuuaccacauuuugguuucaguguaauaauuugcuuuauaaaagcaaguagaaaguuuccuucauuuucaagacuuggaacaauuuauggagcauugggacuauuuggagucugggaauuuuucugugaaaccauuuguguuugguacuguucaacauuuucacuuuuuuucuuauaauuuuuucuguguuuuuuccuauacaaaauuggucuuuuuaagcauuuuugucucuagugagauguaauuaacaucuguauuuccuuaggaaauuacucauuucaucuaauuuuucaauuuuauuuauauagagaucuacaaagcauuuucuuauggcuuuaaaauuuuucuuguauuuccuuuuugucauuucuuauuuuauuuuccuuccuuccuucccuuuuuuuuuuuuuuuuuuuggagucuugcucugucgcccaggcuggaguacaguggcgcgaucuuggcuuacugcagucucaaccuuccaggcuuaguugauccucccaccucagccucccaaguagcugggacuaggugugugccaucaugcuuggcuaauuuuugcauuuuuuauagaaacagggucuccuuauauuuccuaggcuggucucaaacuccuggauucaaguaauccaccugccuuggcuucccaaagugcuggguuuacagcauugagccaccaugcugagcccauuucuuauuuucuauguuuguauuaucucucuuugugaaaguagcuagcaguuugucuauuuuguuagguuuucuuucuuuuuuuuuuuuuuaaggaaauaacuaggauuuugauuuauugaucaguucuacuaguuuucuguucucugucucauuacuuucugcuuuuaucauuauuucugucuuuaugcuuucuuuugguuuguuacucuuaaaaaauuucgagcuagauauuuaaaucauguauuuaauucuuucauuuuacugguaaaaauguuuagugauacaaaguuuucauucaucacugcuuugaauauaccucauauacacuaauauguaguuuucauuaucauuuuauuuuuaaaaauuuuuuauuucagccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgccagagcgagacuccgucucaaaaaaaaaaaaaaaaaaaaaaaauuuuuauuucauuaguuuuuggggaacaggugguauuugauuacauguauaaauuuuuuaguggugauuucugagauuuuggugcacccacaggagcaguguacacgguacccaaugguguagucuuuuuuuuuuuuuuuuuuuuuucagacagaguuuugcucucguugcccaggcuggagugcaauggggcgaucucagcucacugcaaccucugcuucccgguucaagugauucuccugccucagccuccugaguaucugggaucacaggcaugcaccaccaugccuggcuaauuuuguauuuuuauuagggacuggguuucuccauguuggucaggcuggucucgaacuccagaccucaggucauccgcccuccuugcccucccaaagugcugggauuacaggcgugagccacugugcccagcccauuauaucauucuuaugcuuuuacaucuuuauagcuuagcucccacuuauaagugagaacauaugauguuugguuuuccauucuuguguuacuucacuuagaauaauggaucccaacuccauccagguugcugugaaugccauuauuuuguuccuuuuuauggcugauuaguauuccaugguuuuguguguguguguguuguugaauaggguguccuuucucugcuuuauguuuuuguuugcuuugucaaagaucaguugguuguaaguauuuggguuuauuucuggguucucuagucuguuccauuggucaaugugccuguuuuuauaucaguaccaugcuguuuuggugacuauggcuuuacaguauaguuugaaaucagguaauguaaugccuccagauuuguucuuuuuguauaguauugcuuuggcuacguggguuccauuuuuggugccacgugaauuuuaagauuguuuuuucuaguucugugaagaaugauggugguauuuugaugggaauugcauugaauuuguagaucacuuuugccauauggucauuuucacaauauugauucugcuuauccaugagcgugggauguguuuccauuuguuuguguugccuaugacuucuuucagcaguguuuuguaguuuuccuuguagaggucuuucaccuccuugguuagguauauuucuaagcauuuuauuuuauuuuugcaguuauuguaaaacagguugaguucuugauuugauugucagcuuggucacaguuggcauauagcagugcuacugauuuguguacauugauuuuguacucugaaacuucacugaauuuaucagauauaggagcuuuuuggaugaaucuuugggguuuucuagguaugugaucaucauaucauuggugaacacggacaguuucacuuccucuuuacuaauuuggaugcccuuuauuucuuuuucuugucuaauugcucuggcuaggacuuccaggaguauguugaacagaagacgugaaacuggauauccuugucuuguuccaguucucagggggagugcuuucaacuuuuucccauucagaauuauguuggcuguggguuugucauagauggcuuuuauuacauuaaggcauuuccuuuguaugcugauuuugcagagaguuuuaaucauaaagugaugcuggauuucguccaauguuuuuucugcaucuauugaaaugauccugugauuuuuguuuuuaauucuguucaugugguguaucacauuuauugucuuuuggauguuaaacuauccaagcaucccuucugugaagcccacuugaucacgcuggauuaucuuuuugauaugcuguuggaauucaguuagcuaguauuuuucuuuuuuuuuuuuuuuugaggauuuuuguaucuguguucauuggggauauugguauguacuuuucuuuuucuguuaggcccuuuccugguuuugguaauagggugauacuggcuucauagaaugauuuagggaggauucucucuuuuucuaucuuguggauuagugucaauaggauugguaccaauucuucuuugaaugucugauagaauucagcugugaaucugucuaguccuggacuuuuuuuuguuggcaauuuuuuaauuaccauuucagucucacugcuuguuauugguuuguugugaguuuucauuucuuucugguuuaaucuaggaggguuguauauuuccaggaacuuauccaucuccuguagguuuucuaguuaaugcucauaaagguguucauagccuugaaugaucuuuuguauuucuuugguauugguuguaauaucucccauuucgugucuaauucaguuuauuuggaucuccuucuuuucuugauuaaucuugcuaauggucuauaaauuuuuucuaucuuuucaaagaaccagcuuuuuguuuuauuaauuuuuuuguauuuuauuuauuuuuguuguuguuuguuucaauuuuauuuaguucugcacugaucuugguuguuuucugcagcuggguuuggguuugguuuguucuugauucacugcuuccuuaaggugugaccuuagauugucuauuugugcucuuucagacuuuuugauguagguguucaacgcuaugaaauuugcucuuagcaccacuuuugcuauauugcagaaguuuugauagguuguaucacugucacuguucaguucaaagaauuuucagauuuccaucuugauuuccuuguugaugcaaagaccauucaggagcagguuauuuaauuuccauguauuuguaguguuuugaggguuccuuuuggaguugauuuccaguuuuauuccacuguggucugagagaguacuugauauaauuucgauuuucuuaaacuuguugagacugguuuuguggccuaucauaaggucugucuuggagaauuuuccacguaccagugaauagaauguauauucugcaguuguuggauagaaugagaacauaaauaucuguuauguccauuuguucuaugguaugguuaaguccauuguuucuuuguugaguuucugucuugaugaccugucuagugcugucaguggaguauugaaguccaccacucuuaucguguugcugucuaucucauuucuuaagucuagaaguaaauauuuuauaaauuugggagcuccaggguuagguauauauaauuuaggauugugguauuuuccuguuggauuaguccuuuuaucauuaucuaaugucccucuuugucuguuuuagcugcuguugcuuuaaaguuuguuuugucugauauagaaauagcuauucuugcucacauuuccuguccacaugcauggaauauuuuuuucuaccccuuuaccuuagauuuaugugaguucuuaugugucaggugagucucuugaagacagcagauacuugguugaugaguucuuacccauucugccauucuguaucuuuuacguggagcguuuaggccauuuacauucaacauuaauauugagaugugagguacuguucuauucaucaugcuauuuguugccugaauaccuugguuuuuuuuuuucauuguguuauuguuuuauaggcccugugaaauuuaugauuuaaggagguucuguuuuguuguauuuucaguauuuguuccaagauuuagagcuccuguuagcaguucuugugguggcuuaguaguggcgaauucucuuagcauuuguuugucuggaaaagacuguaucuuuccuucauuuaugaagcuuaguuuugcuggauacgaaauuguuggcugauaauuguuuuguuuaaggaggcuaaauauaguaccucaaucccuuccagcuuguagguuucuguuuagaaaucuccuguuaaucugauagguuaccugaugcuuuugccucacagcuguuaagauucuuuccuuugucuugacuuuagauaaccuaaugacuauaugcccaagcggugaucucuuugcuaugaauuuacuguguguucuuugagcuucuuuuauuuggaugucuagaucucuagcaaggccagggaaauuuuccuugauuauucccucaaguaaguuuuccaaacuuuuagauuuuucuucuuccucaggaacaccaauuaauuuuagguuugguuguuuaacguaauuccaaaucucuuggaagcuuuguucauuuuuuuuuuugauucuuugucuuugucagauuggguuaauuugaaagccuugucuuugagcucugaaguucuuucuucuacuuguuuauuucuauuguugaaacuuuccaguguauuuugcauaucucugagugugucuuuuauuuccagagguugugauugauuguuuuuuauuugugguaucuauuucucucaagauuuuuccauccauagcuuguauuaauuuuuaaauuuaaguuguuugucaccuuuugcuggugccuccuugaguagcuuaauaauugaccuucugaauucuuuuucugucaauucagugauuucugcuugguuuggauccauugcuagugagcuacugugaucuuuugggguguuacagaaccuuguuuugucauauuaccagaauuguuuuucugguuucuucucauuuggauagacuaugucagagaaaggaucugggacucaagggcugcuguuuaaauuuuuuuuggcccccagcaugaucccuugauguggugcucuccccauuccccuaugguuggggcuuccugagagcuggacugcugugauuguuauugcucuucugggucuggccacccagcagagcuacuaggcuaugggcugguacuuggggguuucugcaaagagucuugggaugugaucugucuucaggucucucagcuggucucucagccagcacuugcuccaguuaccaccaccacaccuggcuaauuuuuguauuuuuuguagaaauggggucucccuauguugccuaagcugaauuugaccuccugggcucaagcgaucaucccaccucagccucccaaugugacaggauuacagacaugagccacgcacucgacuuaaucuugucuuuuaguuccguuuuuuuuuuuucugaguuucaucacuuucuucucacucguucauguuuuuuguccgugucuuuucuuaguuuuggaauuucuggcucaagguggcuuuucgcaucccucauccugccuauuucuuuaucuguauuuuauucucuauuuuggugucuuguauuuccucagugcuuccuaugaauuauucauuugagccccucucuugggcauuuaauaauuuauuauuuaucuuugagauuuuuuuuuuuuugguuauccaggcuggagagcaguggugcaaucauaccucucugcagccuugaacccuaggcucaaagggauccugcugccucagccucccagauagcacuacagacgugagcaaccacauuuggccaacuuuuuuauuuuuguuuuuuuguagagauggggucucacuauguugcccagaauggucucaaacuccuggcuucaagaaguucuccuauuuuggccucccaauauacugggauuacaggcaugagccagagcaccuggccuaauuuugucauuuucuuccauuucuuuucugagggucaucauuuucucuucacacuuuccuguuuuuuguccauaucuuuucuuaguuuuugaauuucuggcucaagguagcuuuuccuaucccaaauucuuguuugaguauauugguuccaucuggaauguugccuucuaguuuucuugugcuucaugguuguuuuguugaagggaauuuaccucuguugcuguguguuggauauucugucuuuuuaaaauaauacuucaguaugagucuguucaucauuuuuuuguuuguuuuuaugauauugggguguuuuauaggauuuuuagcucauuggcucccucuucugucacuauagcaaaguccagaucuuuguuuugguagcaucggaagguuuguggucucugaauuuuagcugucuugucaucggguaggauuccaaauuuucccuuuuuuccuguuucucuuuuagccauccaauagccaaagggcauuucucucuacuuuuuguuuccuuuuuuauuucccagaagcuacguguuucaaaaacuggucaagauugugucugcuuuuacaucccaucccuauagucagcucugugaucugucuagauaccuuuuuaguauuuugaaacuuaggguugacuuugucuuuccucugaugguuuuagaucaaccuuaaguucaucacuaauucccuucucucuuuguuauaguuuuucacauucuaccuuuguuugcaauaaggccuucuggcagaucagggacagaggaggagcaugagauaucacuugcugggauuaggugucuuuuucuuauuuuuauuuacaguuguuuuggauuuuggucaguucaguuuucaagugaucccgaggacaugguuuuuguguaguuuugcugcuuauuuuucuuguccucuauugcuucuggaggaaauauugaaagauggagacauaagcaaccaccuuugucagccugagaguuuccaaagcugaauguuuuaaaagugcauuuuuaacuauuuuucuucauuuugaguuuugauguuacauuuugucacauuaucucauuaaauuugcacaucucugagcuacacauacuaucuccauuucaugaaugaagaaaucaagguccagcaagauuaaaugacucaagggagaucacacaaccagaaacugauagagauucuaaucaacucuaaaauuguaugaugccaagcucuuguucuuuccacuacaucuugccaucucccugaguaacugaacuuagaaagcccaugcauuaauuaaauacugcaaccuaaaacauuuuagugauuauaaauguaaacugucaguuuauucaucuguuccuugucccuccuguuaucuugcaguccuguuauauuuuuaguagccucuucuccacuggcuucuacuccuugaccuucuaagguacauuuucuuuccuguaaacgagaucauguacauuaagugcuaucucuugaaaaaaaugauucaacagaugucaauuuuguuuauuuauuuauuuuccuaauagagguuuuuacucuaucuccccuuauagcagaccuaccaucauuucccucuuggcccacuuucacguacgggaggacccgugcacacucaccuugcuuucaaaacucacugcccucccugcgcaaacuccucacuucauggaaaugauagccccaaguagcaguuggcaacaacuuuuggcuccuccuuucuggaguggguguuguauugucuguaguuuucuuuaaaguaauuuaaucugcaccuuaggggugcuuaguuaacauuuuugaaguaccuuaaucaugaaucuacacuccagggguaguuaguuaacauuugaaagacccuaaucaaaauucuauacuccagaggcaaccagugccucagauauugcucucaaccuguaccagugggugcauuaauuagaauaaaagauguaagaaguaauuuuucacggugaaggaaaugcuauuuaagauauguaguuggccaguuuccuacacagagauaagacaugaguggaggcugaggauacagauuuggcaagggcaacagucuuccaaccuagguaggcccuugauuugguccugugcuugcugcuuuuaguggaggauuugguuugguuggcucaccuggccuguggagcgcauuaagucuuuauuacccugcaugggccaaauccagccugcuucugucugcuucuccauccagcgcucauuggaacuguacuccggcuccucuccauguuugcauuucuuguccacagagauguuauucucaaucuugagucagaugauuucuuuuuaauuucuuaauuuacauuuuuaaauuuaauuauauuuugagcauauuggauauguuaagagugugaauuuauagugccauuuugaucagaagcacucacauuauuuuuaaaugguaacuuucuuacuauuuucuacuugagaauauugucaguauucucaggccagguucucaucuguggggcuucuagauaaguaacuuguuugauauucuaguggucuaauuaggcugggugauguuuuugaacauuccuuuuuauauuuaauucuauucaauagugacaguucucaugugauagagggauaauauucuugaauacaugugauuuaaguuacguagauugaaaucauauacgugauuuuuguguaauuuguguaucaugcguaguauaaggaaugacaucuaccaagaguuucuauaguaaacauuacuauuguccuauaucuuaguuaacauguacaaauauaaaugaaauaaugcaguuuaugaaguaaaauacugaaguauaucaccagggcccuuauuuucugggguuuggugacguguaugugugguauggcauauauuacugaucuugucccaucaaauauacugagcaaaggaagcagucaugaugaacugguggucuagauugcuuucuguacucacuaggacacgaaguaauuuuuuaaauaaaauauuuaacuguauaaauagucuauuuagcuuuuuuauauguuauuuuuuaagugagccaucuauaauauagguauacauguaaguagcuguaggcuguguaaucaaggauauauagacguaaacuauacuuuuuuuuuuuuuuugugaggcagaguuuugcucucuugcccaggcuagagugcaguggugcgaucuuggcucacugcaaccuccgccuccuggguucaagcaauucuccugccucaaccucccgaguagcugggacuacaggcgugugccaccacacccagcuaauuuuuguauuuuuaguagagaugggguuucaccauguuggccaggauggucucgaucucuugaccucuugauccgccugccucagccucccaaagugcugggauuacaggcgugagccaccacacccagccuguaaacuauacuuaguggaaucauggaauuguagcgaaugaaaggaccauagauauuaucuagucaaucuuuucaugagucccagagaguuuuagcuaagcccuccuuucaugauuccauucuuagcuucaaucacagagaugauuuauagccauuuagacauacauaccaauauauccauaucuauacauacaauguguguguguguguagggggcugugaucacaagcacuuggggccaauagaauuuuaguagaaauaauugguuaaagggcauuaaaaucuuuuaauauuuagcauuaucagucugugaaagucuucgaaacuagguuugagaaaucuuuacucauuaagacccucagagcagaaaaaucaaggguaagagaacugggaaaggaaguuaaguauuucuaauuuuaaaguguucuaaaaccuacacguugaguacauauuguagcaauauagauacuagggaaugauuuggaguucaguaguuuggaaauacguauauuuuguuauaauucugaugugagacuuuacugaauuccuguuaaauuauuuuugugcagggcuuuuuucauaaagcaccaauaauucuaccugaccucacaggguuuugugauauuagacuagucaugguugauuauauuauccuuuuaaauugccuuuuaauuuucagcugauguaagugaaauagauaauauaaauuaauuaauauuggaucuguucaguguuuaugcucuaggagauuucaggagacaaacagaaagagaagguucuaaacaagugccguuuggggcugugucauuuuauuauucauaccuggcuuauuuguuguucuuuaaugggcuaucuaucauauuaguguguauguaaguggcuacaugugacauaaucucaagucuuauugauuuaaacugcauuuaccucaucacuaaucacucuuguggcagguagcugcaguguucagggggcacuuuguaugugucacguuugugacucauacgugcuuuuuugugaagagcauuuugucucaccuaaauuccuauuacuuuuugguccuaccugaagcucugcuuacaauuuugcguauuucuacccgcaguccccaaacaugcugaauuuaguuggcuuguuggccgcuaaauacuuuucucuccuugcugugggguugguuuugcuggauggaguacuucucuuuccugaaguaucuagcuucuucauguguaaaacaaaaccaguaacugaaaugucaaauuuggaaauauaaaugacuuuuuuugaucugccuucagaguugcguugucaucuuuauaagcuuaagacuuccugguuuuauuccaaguuuuacuaauauucaaaaaguuuauuuguuaaaucccauaucaucaaaugcacuccacauugcaaguaaaaccaaaugaaucuggucauuauaccucuuucuacucauggauuucagggaucuaaugagcuuaguaagauuugcaucauggauaaauagaggacuuauucuuauaagaauaaaaauuguguaagugauuauaucauguauguaauuaaaaugguuuugauucagauuuaaauguuuuuuuuuuuuauugugguaacgucacauaccauaaagccuaccauuuuaaccauuuuggaauguacaguccugcaguguuaaauacauugauaguguugugcaaccaucaccaccaucuauuuccauuacucuuuucauucuuguaaaacugaaacucuguacucauuaaagaccaauuccccauaccccucuucucccagcucuuggcaaccaccauucuacuuucuguuucuauaaauuugacuaaguacggcauauaaguagaaacauacaguauuugucuuucuuuugacugaguuauuucauuuagcauaauguacucaagguucauccauguuguagcaugugucagaauuuccuuccuuuuuaaagcugaauaauauuccauuguauguauauaucacauuuugcuuauccauucguguguugauggacucuugaguugcuuccacauuuuagugauugugaauaaugcugcuaugaaaaugaguguacucuucaagacccugauaucucuucaagacccugccugcaauucuuuaaguguauacucaauuagaauugcuggauauauaguaauuucauuuuuaauuuuuugaggaaccgcaauauggguuuucauaguggcuguaccauuuuacauucccaacagcagugcacaagcguuccaauuucuccacauccuugccaacucuugcuauuuccuguuuuuuuuuggggggggugauauuaauaguagccaucccaaugaguguaggguggcaucucauuuuagcuuugauuugcauuuuccuaaugauuagugauguuaggcaucauuucaagugcauauuggccauuuguauaucuucuuugaaaaaaugucuauucaagucccuugcacauauucaaguugacuuuuuuguugaauuuaggagugcucuauauauuuuguauauuaauaccuuauccgauaugugauuuugaauuuuuuguccuauucuguugguugccuuuuuacuuuguucuuagugucuuuuggugcacaaaaauuuuaaaauuuucaugcaguccaauuugauuuuuucuuuuauugcuuguguuuuugguaucauauccaaaaaaaucauuaccaaauccaaugucauaaagcuuuugcccuguguuuucuucugagaguuuuauuguuuuaggucuuacauuuaggacugugaucuauuuugaguuaauuuuuguauaugguguuagauaaggauccaacuucauuuuuuguauguagauauuguuucccuguacagcauuuguugaaaggccguccuuuccccauugaauggucuugguauucucgccaaaaaucauuugacuguguaugugagguuuuuuccccuagggucucuuuucuguuccauuggucuauauauuugucuuugugccagcaccacaguguuuugauuacuguaacuucuaaguaaguuugaaauuaggaaguaaguuuugaaaugaaguaugagucuucuagauuuguucuucuuuuucaagaugguauuggcuauucuggaucccuugagauucuguaugaauuucaggauggucucucucugcaaaaaaugucauugggauuuugauggggcaguugcauugacuuuguaaacugcuuuagguauaauaguauuggcaucuuaacaguaguaagucuuccaguccgugcacaugggaugcguuuccauucauuuauuuguuuccauuaauuauaauuuuuuaauuuagcaacaauuucauagcuuucauuauauagcuuauauauauuauagcuuucauuauauaaagcuuucauuacauaaguuuuucaucuuuuucguuaauuccugauuauucuuuuuaauguaaacugaauuauuuuuauaauuuccuuuugagauuguucacuguuaguguauagaaaugcaauggacuugaucauaguguauaguccuauaaguaugcugcugaauucaguuuguuaguguuuuguugaggauuuuuacaucuguguucauaagugauauugguuuguaguuuuauuauacugcuuuuaucuggcuuugguaucagggcaaugcuggccucauagaauaacuuaggaaguuuuauuccuuuuucuagaauuuuuuggaaaaguuugguuuucuuuaaauguuugguagaauugaccagugaagccaucaggucuagugcuuuucuuuguuggaagauuuuagacuacuuauuuaaucuccuuacuaguuauagaucuauuuggauuuucuauuucuuugugauuuaguguugauagguuuuauguuuccaggaaauuguacauuucaucuauguuauauaacuugguguuguacgauuauucacaguacucuguuuaauuuauuucucuagaaucaaugguaauguaacuuccauuuaugaauuuagucauuugagucgucucuauuuuuuucuuaguucaccuggcuaaagauuuguuauuuuugaugauguuuucaaagaaccaacuuugauuuaaucaguuuuugguauuguuuuucuauucucuauuuuaucucugcucuaaucuuuauauuuacuuuuuucugcuagcuuugguuaguuuguucuguuuucagauuccuuaagcuguaaaauuaagcuguuguuuugagaucuuuuuuguuuuuuaccguaagcauuuauaacuauaaauuucuccuuuuuugcuguuuuuccugcauccuguaaauuguauuucauauguuguguuuucauuuucauuaaucucuaaguaauuuucuaauuuccuuugagguuucuucuuugauacauugguuuuuaaagaguguguuaauugacauaaguuuguguauuuucccuuuuuaacuuuguuauugauuucuaacuuuaucccuauuuaguuagagaagauacuuugugugauacuuucuacuuaaaucuauugagacuuaauuggcagccuaauauaugguuuguccuggaaaaugucccauguguacuugagaagaguguguguguugcuguuuugggguagaguguucuguaugugucuguuagaucuaguugguugauuguguuaagucuucuguuuccuuauuucugucugguuguucuaucaauuaucgagaguaggguauugaagucuucaacuguuguagaacugcguauuucugccuucaauucugucaguuuuugcuucauauauuuugauagucauuagguguauaaauguuuauaaugguuauaucuucuuacuguguugagccuuuauuaauauauaauguccuucuuugucucuuguaaucuuuuuuugauuuaaagucuauuuuuucugcucuuguuuugcugcuguuuucauggaauaucuuuuuccagccuuuuacuuucagccuauuugugccuuugaaucgauuugugccuuuguagacagcauauaauuggaucaugaauuuuuauucauucuaccagucucugucuuuugguuggacaguuuaacccauuuacauuuaaaauaauuacugauaaggaaugacuuauuucagacauuuugcuauuuuuuucuauaugcauuauuuuuuuuaccccucauguucuacauuacuguauuauuuuguguuuaguugacuuuuuauagugaaauguuuaaauuccuuucucauuucccgaugguaugcauucuguagcauuuuucuuugugcuuaccauaggaauuacauuuaacauucuaaaguuauaacucucuaacuugaauuuauaccaguuuaacuucaauaaaauacaaaaccuccacuccuuuaauggcucugucccuaccacuuuugguuguugaugucacagaauuauaucuuuauacauugugugcucaaaaacauaaacuaguaauucuuuuaaaugcauuagccucuuaaaugauguaaaaaacaaaauguggauuuauaaaccaaaguuaacaguaauacuagcuuuuagacuaauaauuguguuuuaaaaaucuuuuaauauuuuaaauuauguagaaaacaauaguuagaaauaauugucuuguuguaacacuacuaauuuuuauaauugccuagacguuuaucuuuauugagauauuuauuucuucauaugccuucuaguuacugucuaauguccuuucauuuuaacgugcaggacuuuauaaagcauuucuugcauggcaguccugaugguacugaaauccuguagcuuuuguuuacuuggcaaugucuuaauuuuucccaaucacuuuugaaggacaguuuugugugauacagaauucuugguugacaguuuuuuuauuuguuuguuuguuuguuuuggcacuuugaauuaauccacugccuucuggccucggaaauuucugaugagaaaucuguggauaaucuuauuggggauccuguauaugaugaguaacuucgcucacuacuuucaagauucucucuuuguauuuugaaaauuugauuuuaaugugucaugguguaggucucuuugaguuccucucacuuggaguuuuuugagcuucuuggauguuuauauucauguauuucaucaaauuugagacacuuucuucuauuauuucuuuaaauauucucugcucuuuucucucuuucuucuccuuucagagcucccacaaugucuaaauuguauccugugggcugucuucacuucucuucaaucuuuuuucauucuguucuuagaugauaauuuccauuguccuaucuugacguuugcugauuuuuuuucuucucccugcucacaucugccuuugaaucccucuagugcauuuuucauuccaaguauacuuuucagcucaagaauuucuuauucuuuuuauuuuuuuaguucuuauaucucuuuauugauauugccaguuuguuuauacauuauuuucuugacuuucucuuuauuuuuuguuauuugagcaucuuuaaaacaguuaaaacuuuaaaaaaaacuuuuuaaaaguuuuuuuucuuaauauaucuaccauuaagucuuuuucagggacaguuucuguugauuuauuuuuuuuccuuugaaugggccauauuugccucucuauuucuaugcuuugugauuuuuuguuguuguugaaaacugggcauuugaguuuaaugauguggugacuccagaaaucacauucucccucuuuucccggguucucuggguuuugauguuguuauuguuuuguuuuauaaauuauuguagucagugucuauccuaaggaucagccuggguguuaauuuaagaucuccucaaauaaagcuuuucuaagccugcaccuuuacaugggcaugcacagucaccuuauaauuuuuucaauacaugcauuuguuuuugaauguccuaguccuaauguuuggcuuuaaaacggggagcaagagaaaaauaaaggcaguaggggaaggcuacuggcuguuuaacuucccuggaauuuacuucagcaagaguaggaggggcuugaaaaauuggaggaggugcaacaacaauugucacgugccucuuuguaccucugugauuagaggaagcaaucagcgaucagagcauagauucuugauacuuggcaggcaggguucuuuuugcccacccugucuucccaccaggugugugcaagguacuccaggaacagguacagggaugucugccacagugcuagguagcuacuuugguaagagcuguaauugaaaucgaccacaauuuaccauccaaguguucccuuggaaguugcaagccuuccauagacuccagaguuacaaaauaguuacaucagacagauucugccaguacaaucguguagguggggagauuccuggugccuccuacucugcagucuucccagaauccuccuuaagagcguuuuauaagcugggaacccccaaaauagggacugaggagaaugcccuacaguggauuucacaucaucugaaguagagguuuuauggacuuuguguagcaguuacaagaacucauuccauauacugggauguuuucuuucuucccuaguagauuucaguaccauucuaguagugcugaauaacuuagaauggcuuguagucugaguuuaaaucuacuaaggaagaauguauucauucuuucaggauauugcagauuuuuaaaaucuugcauuuguuuugagagauggaggacagagguggauggggaaaacuuuugacuauuaggcuccaucuucagcucuguacucacuuuugcuuuuguauaucuuaauccagccauuuguaaaaugaggcaguuacuuuuaagucagagauuuguaacguccuguuuuuuuuggcaguugcgaaacccggaauuccuaugugaaguuuugcauauguauauucauacuuuggagagcaaggccuguggcuuucaguagauaacagagaucuccuaucagcaguucuccccucucuccaacuugccacagggguuaaaaacuaaaguuuugguuauuucuuccauuucagugccaaauuguuugaaagaaugcuguauucuaaagaucuacagaggcuuuugacauauaacauuacuucucagaagccuuucauggauuauuagcaagaucugucuccuauagauaauuauguuguagcagacauauguuuaaagaaaaauagguuguucuuuuguauuuaugaaauaccucuucguuacccuauuuccucaaagucuugucucacuuguauguauuguuuucccuuaaucuuuuuaaaaaauuuauuauaauuuuaauuuauuuaucacucuucccccuguguguauucaugaugucuuuuucuccagcgacuuaccacuuuuaacuaacaaauacaaaccugaggcuaggauccagcucuucagaauucucuugcagcgccacauauggcauuuuauaaacagcgagugccuaauaaaugucaugagccaguggacucauggcagaaguaguagucuguggaaaacuucccauggugauuuguuuacuaauuuuuauugcaucugccucuuauuacuaacugauggguaugauuugaggaauauaaauguuauuuugugacuuuuggaugguuacugugcaaauauaauuuaauugaaaaauccucuuuaauucuuuaagagaguaaucaaggcagugauuucguuuauuagacugcucuguuuugggguuuuugaguggagucuguaucuauuauuguuauuauuuaauuuuucagugagggagauaaaucugcaggacaucaaggaagauuuagaauuggauccagaggaaaacagcacccuguuuauggguauccucauuaagggcuuggcgaaacugaagaagaucccagaaacaguuaaggcaaucauagagcgcuuggagcaggaguugaagcaaauugugaagaggucuacaacccagguggcagacaguggcuaucagcggggggagaacguuacuguggagaaccaaccaagguaggugggaguguauuuuguauuuuugacaacucuauuuauugcacauuuucuaggguggggcguaaguaacuuaccuucuguugauguuguuuucuugaacuuaggauacuauagcccauacaggccaggcgcaguggcucacgccuguuaucccagcacuuugggaggcugaggcaggcagaucacuugaggucagaaguuugagaccagccuguacuaguagugaaacccugucucuacuaaaaauacagaaauuagcugggcaugguagugcaugccuguaaucccagcuguucuggaggcugaggcaggagaacugcuugaacgcaggaggcggagguugcagugagccgagauugcaccauugcucuccggccuaggugacagagcgagacuccgucuuaaaaaauaaaaaggauacuauagcccauacaaacuuugauugguaaaacagcuugacuaggcauaauucagcugucuguuuuuuaauguuguugaaaaauucaaagcauauugucacucaaugaaaaauauggacauauuuauaguagagauugucgauauuuaaacauuuaaagaauaaauugaaucaaauaauguagcagcuauuguacacauacuaaguacucagcaauguucaaggcaauuuauguauauuaucucacuuaauuaucacuacaacuguaugaccuaguuauuaguauccacauauugcaguuaggagaacuggagcucagagauugaauaauuagcaagcucuuagaaaaagucuugguguugaauacuaguccauuugauucuaaaauccauggucuuuccugugucucaugcuuucuucuuuaauguguaaugauauuuccaauagacaaaucagucucaggaauuuuuaaaacaauaagauuugaauuucauaauucuuauuucauauggagaguacggaaauugaauucagauucuaacuuugugacuaucauauacuaacagaucaugugugacaaacaagaagaaaucauaaucuuguagauacguuguuaaggaaauaucuacuguuuauaccuagggcucaaaguuuuuuuaaaagaagauaaaauuaaggagaaauaauaacucauuuaguauagaguucucuauagacuuauuuaaauuuuuuggaaaaauuaauacuguauuucuguguucuuuugcauauguaaauaacauugauuucaauuauacuuuaacauuucaaaaauuaauuuccuuguaaacuugauucaaaaguacuauguuuggugaauggaacuacccuuuauccuucuccugccacagaauguuucaaaguaaauauuuggccaggcacaguggcucaugccuauaaucccagcacuuugggaggcugaggugggcagauugcuugaggucaggaguucgagagcagccuggccaacauagugaaacgccaacucuacuaaaaauacaaaaauuagcugggcaugguggugcaugccuguagucccagcuacuugggagucugaggcacaagaauugcuugaaccggggaggcgaagguugcagugagccgagcacacuacugcacuccagccugguugacagagugaaacuucaucucaaacaaacaaacaaacaaacaccccaaaaaaccaaaaccaaacaaacaaaaacaccaaaaguaaauauuugauggguuuuggagaacagaccugacuuuguauccccacuuugugauuugcaaaaauuaaccugucuuacaguguugcuugcuuuagaugagguuauaugguuguggugcuuaguggaauagcaccaguaaguacuauaacaugcaugccugcuuguauaaaaugcguguguauaugaauauauguuuauuaucggugccuuccccaaauuccauguucuaugaucacuuacaucaugauccagagaagcuggagaaugguucuuugaacuuuugccuuucuucuuucuuugccuggcaccuggauuuucgugaagaccuuuugacuccuuacugaugaauacucuaaaauucugguuugcucuuugccuguugcugcaaguuccuagaugaauacagugaacuuuccuagggaaauaacauugcuguaguauauauuggaaauaaaagggcauggauuaauaacuuuucugcagaucucauuauaguaccuuuaaaagcacugugucuuucauaggaguuucaucuuuuuuuuuuuccccuugccuaaaccccuuccagaauucacgaguggaaauuauagcacuagaaguauaauagaaauucagcacacugcccugggaaauacuaaauguuucucuaugaggaaugagucagcagcaggauuuuuuucccuguuaagugucuuucguuuguccguauuuuagaaagcuuuuguaggcaggauauauuggacacuaacaagugaaugagcuguuugccuuggcuguauguauaaacauaaucccauuuuauaaaacauacaaauucaagauuugggacccaaacuguuuauuaugagacaaaauaguacagagaaagcaaguauuuagaguaaaccacuuuguuagaagaucaaagauuaaauuuuggggcugggauuccaaaggacugauaauuuugagcuagucucuagugguuaugugcugucaaaugcuuuaaaacuuucaaggaauuaauucucuugaauuaagcagagucauucaaaaaugaucagcauuguugcuucuagaggauuggaauuuuagaagcaauauugucaaauuaucauuugaagcuuguggugcuuuugugcauugacucuuacuuaggaagguauuaguggcauuuauuucagagagaaguaaaaucacaauacuuggcauuauuuauuauuguuuaccauucaaggaauuuuauggcuaaagauauaugaauuuauuuuuuuaaagaaaguuggaacagagaccaaaaaauccaugaauccuguuucccaacaugaaaauuuucucccccacccuccagugaaauauccuguuccaaaacauuaguuauucugagacaagauacccauacuguaauuuucccuaaaaguuucaucaucuuauuaaauauauucugguugugaugcauugcaggcuuguuuucauuugucuuuauauaaagagaauuaauguugugugcuauuuugcuagaaauguagaaggaaacaaacuagugaauucuuucuugcuuuuaauuccuacagagccaggauacuuucccagccaguuuuuuaaaaaaucacuuuggugaccuacuuauuauuuuauuuuauuuuguuuuugaucucccaaacuaucuguugucuauuuauaggagaaauauuuugucuuuucuguucauucauaaucuaucagugucuuuaagccuccacuuacuauuaaaugaaaauauucaaccacaauuauugccaacuugauaaacauuaggguaacaugugccuugcuaauuuaccagaaccaccugcuacccauuauuucucuagaaagacaggcagcgucuucaacuucagauggugacuguggccugaagccucugcauuucagaaucaauuucuucaacuccugcugccuaauuguugauucuuucccaaaaucugauucaugaguauuuuuauauuauuuuuauuugaaagaagcuggaaggaguucuguacuuaacaaauaagaaaagcauaaggaagagauggaagaaaaacuucucaaagaugugguaucuugucaagaauauggaagaaaagaaugugggaaaagagaaugguugguaugugugagggaaauggaccuguuuaaaugcaaaggcaaaaauucauugcaggaagggaugguggaggucagcuucacuuagguagagcuguagguccuagagagugcagaaggcguugagugaguuggagccguugcuuccagggagaccuuucucucuuuuggaaggaaaccauuuuaaaagguucauugacuucuguuaugaagaaaaagauuaaaugucagaugugaaaagcagagaacuuuguggguuuugggcuuguuguaauauugaagaaagcuucauggaaaacaugggaaagaaauauacuuuaaugcuaaaaguaguuguguuugguuaguaggguuguagucuuugcuuuuucaucucuguuuugcaccucaaguuauagugaaaauaauucauugucaaaaaauuaaauuauuacucagguuauuuuaaucacaagaaauuauuagaaauaaaaaugccuguggggguaugaauguucauaaaacuaaauuuuaauauugaaaaauauaauaccuguuuuuaaaccaacuugacaucauucauuaauuuuauuauauauguguaucuuuauauauauuugguuauuuauuggcugccucuagaauggaagagaagagagcacuaguuugucuuguucaguacugguguaucuccagaaucuagcacagugcccaccugacccauaauaaauauuuguugauugcaagaauaaauuccacauuuaugaaauaucugccauggaccagacauuggguaaaaugcccaacaaauuauauguggucccuguccucauggaguuuaaagcaggaaggaaggcguuacucaaagaacgcuaagaugugagaaugaaagcagccagauucuugauaugccauuuucacuguuuuugcuuaccucuguauugauuaaauuuuuucuuuuuuuuggagacggagucuugcucuguugcccaggcugaagugcaguggugugaucuuggcucacugcaagcuccgccuccuggguucacaccauucuccugccucagccucccaaguaacugggacuacaggugccugccaccacgcccggcuaauuuuuuguauuuuuuguagagacgggguuucaccguguuagccaggauggucuccaucuccugaccuugugaucugccugccucggccucccgaguguugauuaaauuuuaacuguugccaacugugcuuugcuuagagaugauaccaauuuuucauguaauggauaauguuugagaguuccuauauccccuugccaacagauuguauuaucaaauacuuuuauccuugccaaucugagagguaaaaaaugguauuuuuggauuugcauuuuuauuguaagguuacacuucuuuucguuuguauaaaaguaacuugucaugauaucuggguuauauauggauguauuacuucaaaauaaaaugaguugcaaaugagugaagauauagauacaauaagccaugaaaugauacugaagcagggugauagguacaaggugguucauuauccuauuaucuucacuuuuuuaauguuugaaauuuucaacaguacaauguuuaaaguguuuauuuccuuuucaaugaauuauuuuucuaacauguuugucucauugauuuguaggaacucuuuacauauauaggaaauuuguucuuugggauuuauuuuguaauuuucugccaguuucuuucucuuuugacuucaugauguuucugggcauguagacauuuguuuuaauuuuuuaugaggguauauuuaucagguuuuauagcuucuggguuuugugucauacuuagagcuucccuacucuuagauuauaauaaaauuuucaacacuuuucuaguacuuauauagucucauucuuaauauuuauaucuuugauacaucugggaucugaaggagugaccaaacgacuuuugagcacaccugacacauacuauacuguauuguaagggguuguacacccuuuucuuuucugucauccaugugucugucauguaauuguccauguuagcugcauaauugcugaauaauucuaacgcugagucguuuaucauauggugaugguucuucucaagguugguauuugccacauuuucuaaaacucuuuuuuuccuccugguuucucagucugugaagacuauagauuuucagaaauacguugaauuauugcucuaaaauuggaaaaauauacuuuugaaauauuuuuuauaauuuggaggccagaauucagaaugagggcauacugcuguaauagaacuuucuuauaaaaugguuuuaucugugaggaagacuaaaggcucaggccucaaggauaguuuuauaguaugaauacaauguuuauggaaggagaaauaaaugaaauauugcucaugauuuuuuuuagaccuguggcuagauucaggcaugaguuucuauuucacauaaauagcauuucguuuuaucucuucuuucuauauuaguuacccuucuucuaaguauccgaaaugcaggacaugguggaauuggucauuuuauuuuacagaaaagucauucaagagcagcuuugaagcaaggucaggcauuuuccuuguggcuucuuauagccauucccaggcaccgcauguagcaccuggacaugcuuggaaucaggaagggccuccguguaauuuagaugaguaguuaauucgaaucaaagcaagcgggaagcaaguaaauuuaacuucagugauuaugauuccauuugauuaaaucucuacuuuugauuacacauaucaugagaacaugcuuuaaauauacccaacuauuuaauauugaaggggaugaauaggaugaaccagggacauauagaagaaauuccacuauucuucaacuaggauauguccccugcagcuuaacugaaauauuuuuagaacaaaugaaaggauaauuuuuuuuacauaugggacuuguuacuccaauuguuaacuaaaauauauaacucauuaccaugaaaggucccaagucuauauacuuucuaguaagacuuaaauaaauuaauggauaauagcuccaucacauauacagugucugagaaaugucaauaauguucauaguucuuuuguaaacaugaguuuggacagcuaucauucugguuguguauuguccuuugguuauagucauuagagaaaggcuucuuggcugaauaggccagagauguuacucaauauuacauuucuuaaaccuuuguguuuuauguggcaaaguuaaaaaaaaaaaaaaaaaaaaccuacucucgauuucucuuguuuuacauauuauaguagguucaaauuaaagaucugaccagucaaagaaauagagacaaucuguuucauggacuguaauaacuuuauuuagauggcagccaucaugcuguaucaaggccacuucucuguuugcuagagugggagcugccuuagguuuugucauuuuugugcacuugcuauuguuauaauaggaaaggcacuccaaguucaaaauaauacuggaucuuuucauugcaaaaaugaacuaacaaaccuaugucaaaagaaauucuuacguugaugauguguagggguggugucauauaugauuaaagcaccuucaugugucucucaggcuguauuucaaauugucugggucuucuagcuccugccccauccucuugcuauagucucuaaucagauuggacugugaguuuauaaggggagguaacuuuguguuugcagccugauuuagggcugggcacauacgaaaugccuacaaguuuauuuuuauggagauguggucucacucugucgcugaggcuggaauguagaggcccaaucaucauggcucacuguagccuugacccccccugggcucaagagauccuccugcuuuagccuccugaguaguugggacuacaguuauaugacacgaugccuagcuauuuaaaguauuuuuuuuuuuuuuuuaagagauagugucucacagugauugcccaggcuggccuugaacucccggucucaagagucuuuccacuuuagccucccaaaauacugggauuacaggugugagccaccaugccuggccaguuuuaaugaaugaaugaauaagaaaaagaugcaaauaaggucauuuaguggaaguuauuauuauuauuuucagcacuacucacagugggucuauggacccacaucaccagugucacuagagaguuggaaaugcaaauuuccccaagaagcagugguuauuaaauuggaauguuuggaugcagggcccacaggacucuaugccuuaguugauucuuaugcacacugaaguuugagaacacucuuuagauaacaucacaaacaucauagaauuuugcaguuuuguaguauucacgcuuugcaaagccaucugccaucugguaucucaccugagugagccucaccacuugccuccucacaggcaggggcauuauuauuaaucccagauuuacccagagaaaugugaaagcugaaauaauuugacaguucacaaagcuuguucguggugcaauuaagauuagaaguagucuuuuuccaccauguaaguuugcuuucuggcuuauauaaacaugauguuuccaacccaugucaugggccugauuuuguuuguccucagaaggacgauaucuguacuaaauauccauuuuccugcccauaccucacacuguggucaguggcaggccucagagauagcuggacauguugagaagcgugaaaagcagccacagagugccuggauuuuaauuaggucacuugagaaucaaauuuuauuaucuaaacaauuccucuaggggcauucuuguacuaggaacaauauaguacuaagaacaacaaagcacuuguacuaagaacaacaaagcacuaagaauaugcaccuaaaaucuuaacuuuuguuaucccugggaaguggauuuauggaucauuuuucuaauauuccacuaugaugaaauguuauuuuuggaaugggggaaaggauuucaaaagaaugauacugauacuuuaauucaaagaaauagggccuggguuuauuuucuaauuuuagccacaaauuuggcauacaucaggauuagacguuugaggucaucucuccagaacucagaaaccugacuugacaaggagggaguaacacaggaaggaagugacuagcaccaggccccacuucaguauucuuguuauuuuuacuguguuucauucuauauuacuacuaauuuuuucuugcucuuuucauagagcagauggagaauuagucagcacucuuuaaauaguaaccccuuuuuacaugaagacuuauuaauaagugguaaaacguauuucuaucccuuagaaguagguauuagauaaccuugaagauuaaaugggcuccauguccuauuugaaaugaaaaauaguagcucagccaggcuuauuaaggaaauguguaugagagauaugggcagguaaaacaaagaccauuuuuaucuaauuauacguuucuuuuuauaaaauuauaaaguuuuuauauaaagucuacgcucugaguucacuacuuucuuaccuuuuagagcauaaucguagggaaauaaacauucuaugguuauugcuuuugucaguggggaaaagcauaacccugauauuaaagucucagcagacaaguaauagaacagaacuaauucuucuaucuugugugugucuuugcuucgugaccaaguaaggcagcuucuuggcugcaaacguggguuuuccagccaaaugacuaauucaagguucccuggauguuaaauuuagauucagauagucuuaucucaccuuaaauauugagcauuuuucacagcuugaugauguagcuuuacacuguugaugcuucuugccuucugcaacugugacuguuccuuaauaugugccucuucuuagccuucugccuuuuuucaugguagcacuugaagaugagauaccuagggaucacuuggggcuggaaguuaauagaugaucugggagaauaaguaacauuuuacuucucuaggaagucugguuuuaaaaccugcuggguaauuagaaguguguuuaaagaauaaacacuuucuucauccuguuacuuuucuguuuuuuaaauauaaaauagauuuuauugccauauuauuaaaguuggcucuuaaaguuuguaucuuucaguucguaacuguacuucauguucucauguuuagcuugguaagguuaccuuuuugagagcaugguuuugugugaaauauuuuuuauugugggcuucuaaaaucaggagguuauaaucuauaacacuuacuuucuuaccaccucuuaucuguaaucaggccucucucccauuuugcuggagcccacuuuuucauuccuuuaucaacaaauauuuauugccuaucauaugcuauuuugccaaucagugucaugccaaauauuggaauacaguaauaaaucagaaacucauacccacagugagcuuacaguagaggggaagaggaaaggacuggagggaaggagagacuaguuugaagacaguuuuaauaauccuggcaaaaggcaacauggccggcaugagcaagguaaccguggcaauggagugaaggaggccuauuugagagagaguaaagagguagcaguaaagagacuuggugauggcuuggguaugagggaggaggggagguaaggauuuuuugcuggggcaagcauuaccauuuacugauguagagaacaugaagaaguagauuuggggaagaauaugaugaguuccauuuaagucauauuaaguuagcggucuacagcucaggggaguaaucuggcuaagggauaugugugugaguugauagcagguagauaauugaagauuaggggcaaaugagcucagcuagagagaguaugaggggguugagaagaguuuaccgcauuuaaggaacaggcugaggaugagguuccugagaaggaauaacuggagagguggcaggaaagcagaagaguggaggguuguggagccaguggaagacaguguuucaaggaggcacaagugggcaguagaaacaagugccgcggcuauuugauuagaggccaaaguggguuucuuggauggagcaaaauaauuauuugggacuuuuagcaacagcuguuuuaguagggucccaggggugaaaaccuguuugcagugagaaggaagaggcaguacagacaguucuguuggcucucuuucuagccuuggcuucccuagcauuauagaguacuaauaucacuuuggccucucuucuaaaauacuuucccuguuuucuaacgccccuaaaaagggacagucuccagaacuguguccuuuguucucuuaucuuugaacuucaguuuccuugucuauaaaauggcgauaaaguaguaccuuccuuauagggcugcccuaaggaugaaaugagauaauccaaguaaaguacuuaacacagugcucggcauguugugaguaauuaggaaagaguggcuguuaugaccauaguucuccuuuuuguugcugucaugauuucauugucauugucacugauacuucauuucagucuuacuuucuuagggaucuccuccauuaugacagguagcuaacuaccugccccuuguagaagaaggaccccagaucaucaucuuucaucccagacuucugcuuauauugccauccugcauugcucauucuuuuacucaugaacucguuugcccucaaaauuugacuguuuucuccauucuggacauugguccauguguuguaggagagauguguuuacaaagaaccauaaaauagggauucugccuacacuuucuggcccaggaggccaugcauaccuguuuugucacuucucucaguucauuguaauaguuuguuuggagggacuguagaaucacagaggaaagagagaauugguucuuacucuguggauuaggccucuuuugguuauaagugccaggaauugaaaucaccuaacuuaaucaaagaggggcuuuuuauuagaaugauacagaauuauuauuauggaauauaagcaggacuuuacuaaucaagcuguaagaaggagagagaugcagcugggccuuaggaacauccagaguaucuauuaucuccuuuccuucccucuagaugguaaauguuaaagauacaggaauuaauucauuguuacuuuuaauuugcuuuuuuuuaaguguuacauucauauauauuuuuguauguagcucucacagucaauuucugaggaacgugaaauuuggagaagucuaugaugucuugaaagucccaugucuauuuaauagagagcugguauucaaguccagguuucuaacugguauuuauaccacauugccaucuaggauuaauauuuucuuucacuaacugugaugcugcauugaguauuacuacauacuguuuuguggcuuuagaaauaacuugugagagagggguauguguguuauuuuuuucugaaggguagaaauugcaauuaauugaaauuaaaaucucuaaaguucuugggccuuuacuaauucaauucagcuuaaggaauccugagguaauuuaaugaucuugccugcucuuuugucuuuuuuagaucaguggugaaaaccuuuauccuagcaguauguaagcaacugagcuagcugcaacauaauguuuuauuucuuuuauuuaauauuuucuguugggaguugggcagggaaugauuucacuggggcauuguguuuucauccuuagugugucugcagcuaaaggcaaacaacucuuucucaaucuuguguugugggcagucagagaguguauauaaauauuaacaacauauuucaguuuauuucugguagcuuuaaauugggacaagcuagugcagauuuacauccuguuuaugugaaugauuccuaaucucuuauucuuugcugcaucagaggagcgucgucuuccuuucuccuuuucuuuuuaaaggaguguacgugcuggugagggacaacauaugauugacuuugguuucuuuuuccuuauuagucauucacugcuuaucccacuacugaguuccacucaaugauccacugaaacccuucuugucaaggucacuggggaccuuaaguuguaaauuucucucucuuagccuuaccauagccuuugacucugcugguauucucuucucuuugguccucugcaauguucccuggcuuccuucuuccucucuaguuacuuucuaaccaucuuuuuaaugauacucuuuccuggaguguugguccuggaccucacuugcuuuucuuauucugcauauuauccccgagugaucucaucuccucaaauauuuaucacuuuuaaaauuuccaguaucauucucucugcugagcuccagacuugcauaucugacucccuaaggauauaacaccuuaaacuuaacauauccagauaaaaacccagcaucucuccuucuacuagauuuccuuuuuuuuuuuuuuuuuuuuuuugagacggaguuucgcucuuauugcccaggcuggagugcaauggcgcaauuuggcucacccaaccuuugccugccggguucaagcgauucuucugccucagccucccgaguagcugggauuacaggcaugcaccaugacgcccagcuaauuuuguacuuuuaguagagaugggguuucuccauguuggucaggcucccgaccucaggugauccgccaccucggccucccgaagugcugggauuacaggcgugagccacugugccuggccuccuuccagauuucuaauuucacuuuaauucucucucccccccgcccacccucccccccaaaagcauaaaccaaagaguaucugagacaggucucaaucaguuuaggaaguuuauuuugccaagguuaaggacgcagccaugacauagccucagguccuuacgaaaugugcccaagguggucagggcacagcuaguuuuuuaauuuuaauuuuaauuuuuauauuuuuauuuuauacauuuuagggaggcaugagacaucaaccaguauguguaaaauauacauugguuucguccggaaagguggggcaagucaagcgaggaggggcuucugggucauagauagauagagacaaacaguugcauucuuuugaguuucugauuagccuuuccaaaggaagcaaucagauacaaauuaaucucagugaccagagggaugacguugaguucugucuguucuuuguccaugaggaauuuccguguggacaaaaugugagggagguauguagcuuuuuaaaaaaaucuugguagcuacuuuuuuaaggacuagaaugggaggcagguuugcacuaagcaguucccagcuugacuuuucccuuuggcuuagugauuuuggggucgcaagauuuauuuuccuuucacacaggaaagguaaccauucuccucaguguugcucaagccagaaauuuagacgaaggaaacuugaaccuuucccugucuuuagaauuguaccauuaccucagcuaguucugugcauuuccuaauucgauuuuuccagcaguguugugagucucuuagaacaguuauuaauuaauacuuucacuuugcagacggggacacuuggagaaguugggagaauuuuuuucauaacgaaagauguaggcagugucagugcugggaaagaauggaaaucuauuguuucuuacauguuacuuaagaaagagaaagaaaaaaccaagugaacuaaaagagaaaaguugauguccuccugguaguaagaauguaaaggaaucagcuuucacaacaccucgcuuuuugagaugccagguuucauuuuucacuguuucauguauuuccucuucagugcuagagagguguuggaucuucacucuccccacucagagccauagcugcuguucuuuuaacagcuaauugagguauaauucacugcugcacgauucaccuauugaaaguauacaauucauugguuuuuaguacauucauagaguuuugcacccgucaccacuaccugguuccagcacguuuauguccucccuaaaacaaaucccguauacuuaucagucaguucccacccacccccagccuaaguaaccacuaauauauuuugugucucuauaaauuugccuauccugaauauuuuauauaacuauaaucauauaguauauggucuucugugaccuuuuuucacuuaccauaguaauuucaagguuaauuccaguuguaccauguaucaguacuucauuccuuuuuguggccaaauaauauucuauuguaugaauauaccgcauuuuauccauuuaucaguugauggauauuuggauuguuuccaccuuuggguuguugcgcauaacacugcuaaggacauuuguguacaaguuuuugugugcacguauguuuucauuucucuugggcauauagcuaggaauggaaucacuggcuccauaugguaacuauguuuaaugucuugaggaacugccaaacuguuuuccaaagcggcugcaccauuuuacauucccacuggcacuguuugagaguuccaauuucucugcauccuuacugauacuuuuuauugcuuuuguuuuugauuguaaccauccuaguggaccgaaauucuagcucauugugauuuugauuugcauaucucugauggcuaaagauguuaagcaucuuuuuguuugcuuauuggccauucauauauuuucuuuggagcaauggauauuuaaauccuuuguccauuuuuaaguucaguugucuuuuuauuaugaguguaagauuuuagauuugucuuuuaucagauuaaugauuuacaaauauuuucucucauuuuauguauugccuuuuuacuuucuugaugauaucauuugaagcacaaacauuuuaaauuuuggugucagagcuguggguuuuauuaaauaauaugacaccguugugcuucgguaaggcggaagagagcuuuccucucguuaaaauggcuggaggucucaaaaaagguagagcugcaaguuccuagcuacuauuacaccuccuuuccuuccucccuguguagccuguccuguggcuaugauggccacacuauaggaacaggccuguuuuggcuuugagccuccaggaguggcagaaacuggaacugugucagcauuuuauuaagagauugcuauuuccaagauguuaauagauacugugaaucucaucuuacaccucuauucucuacugguuuuuuuuuucucuaaauguagcgcuguuccuggcugcugagcagcucuuguccuugacugacaggcaagguaugcaguuguggcacucauuggcccuggagauaaccagauaacagcaccccuaacaagaggagccacuuuucuguuaaaacuuugcugcugguucacaauccuguaucuagaacuucaugccauugggacauuagacaccagugugccucaggcaucugaaugucauggaucaauaugguuucaaaccauauuuugaauaccccaauauuuaccuuaacauacauuaaguuuuaauuuucuccgguaaggacauuuggcaacauaacugccauucauggcagaaaauaacuaagauuuuccuaucaagagaguacaaaagauauaauguuaaauaaauuuaccuuugugaagagucaauauauuauucauacuuugcuaucuaccacucaaaaacauauuacagucuguagauucauauuugagaacuacagucuuacauaccuaggauaaaucuuuguuggaaaaggagaaccuucacuuaaucagguauuuacugauuaaguuacugaucuguaugaugccagauaccaguuuuauaccgauuauuucccugcaccacauuaaguguuucaguugguauguuuagacacauguuucuguauuuuguauguaucuuugcuaauauuugaguaguucuucaguaacacagaugagaaagaagaauuauuuuagauauaugugaguauaaauaugaauuugaccuuuaaggauuaaaaagaaucaucaaucaaaagguagaauggcuucuauuuauaaauacaauguguaacuucuggauuauauauguauagucuaggcugggaguacuacauaaauucuauugauuuugucucaucugaauuacaaugucaaauagauacuaggguuuuaccauaagauaguuaugggcugucucauugucacauuaauuacaauaauuaggcaguaaagaagccauaggaauagauaauauguuguauguuuggaugagauuguaguuauaaccccuuauuuaugguaauaaaaccuuguuaauugacacugcugacaagcucuuuugcuuuccuuuucaacuuuccaaguugguuuaucagucuauuuaggaauuacaagcugagagccacaaaauauacaauaaagcucacauugcaagauuuucuguacuuguucaugcuauacacauuaaauucauucagcaguauuugcuaauuauuguucuaagugcucuuaaguauucagagauguauaaagcagugccuacucugaaagauuaauaauggagaagugagguaaaguaucuauauauaaagaaauaugacugacauuuauugagcagcauaugugaggcucaugugauaaguuccuuaaaagcagacaaaagaguauacaaguucagaggaagaaaagaugauuccaggccugugugaucauugaaacuauaagucucagugguagaggaauuauuuugcaucuaugccauaaaucuuugagcuaucuauucuagagcuguagugaaagguagguggcuaaauguacugacauggaaaucaacuuuuguucuaggcuuagcugcacugcaaccuuauuuuguguccuugaguauauaaaauugauguaauaauauguguccagcauaucucacugugaugaaugagauaauguggaugccugagcuucucccuguggugaaagucagauugcuuggcagguguauguuuuuuuuuucaggcaacucaggcuguacauuuggaugguaguaagcauagcuuuccaugacuaaauggauuaauauccuuaucaaagugccuaauuuauugcuagggaauagcauauucuguguaacaucugagcuguugucugaaaaaauuacaugaauuccuuggagaagcugccuguaugaauacauaguaguaguauuguaauccgugaacuauguuaaaacggcaacauauguuuauugagaugcuauugcugguuuaggggcuuuacaauugcuuuuaaaauucuuacaucauuuacauguuauagcagaggaaacugaggcuuagauaaguuuuuaaaaguugcuuagauaauacaguuguuugaauucacaucugcugaaaucuaacguuaaugcuguuuacauuguagaaugcuacuuuaguuugauguuuuucuugcaggucacuguaagccauuuaucugcguguacguauguguaaauguuauuuauuuguuuaugccacuagguugcuucuagaacugcuggaguuacuguuugacaaguuuaaugcuguagccgcugcacacucugugguccugggauaccugcaggacacuguagugacuccacugacucagcaggaagauaucaaacuguaugauauggcagauguaugggugaagauccaagauguucuacagguaagagccuuuuacaaagggugucaucuugauucagaguaacaguuuagaauaacaacaacaacagcaacaacaagccaccuaaaacacuaucuuaagagucauaaacagggugagaaaguaaugcuugcauuugaaugugauguugcugauggcauuaacuucuacuaucuucaaaaaacuuuuuaacaggcugugugcaguggcucauuccuguaaucccaguacuuugggaggccaaggcggguggaucaccugaggucaggagucugagaccagucuggccaacauggugaaaccuugucucuacuaaaaauacaaaaauuagcugggcgugguggcgggcgccuguaaucucaguuaccugggaggcugaggcaggagaguugcuugaacucgggaggcagaguuugcagugagccauuguaccacugcacuccagccuggguaacagagugagacuccgucuaaacaaaaaaaaccuuuuaacagacuucuuuuuuuuuuggcagacuuuaaaaauagaagcauauucucaauauguauagugucuggcuuucugucguaguauacuuuacuugacuggaauuagucauauauuaagguaaaaaacauuaaaauauucuuaagcauuauuuuauaaacauguacauagcuuaauuuuguugacuauuuccuuacagucaacuuuugcauauauuggguuauaugacagaacaagagcuuauuuugagagaugagaauagaucugugagguauaaauguaucacuuugcuugauuuguugaagauuagaggaauaauauuauucuuugguaugaugcugcugaaaugauauuuagaaauuguauuauacuuuuucuccauaugugagcaaaauauauuugauuuagccagauggaaauuagaaauauaauuaagaguuagcugaagcaagcuuugacauaacuaaauagaaguaacuuaguuagauaguuucugcuaauaugaaaaaaauuaaguauauguggggaauuggaaaauggaacuguguaggaaugaaauuacuugcauggcaaauaagagucuuugcagaaaaaaguaaaucaugaauguaaauuauagucauuuuuuagaauguagacaugcucuugguggauugaauggauugauuccugguuuuucauucauuagacaacuuuugguacaguguauaugcuuuacuggugguucaguagaaauaauauugguugaaacuuuuuacugcuuugucaauugccaugccuguaguacaugcuuggugaauauuuuuguauugaauaaaauaucuuuauggguuggaggcugguuauuuaacauuuugcauguugauauguuuauccgucuuauguaaauaaugugugccuuucguauccauguuuaaguaugaaauaauagauucuaaagcuagauaaaaaauaauuagaaauagggacuucuguuucucaucuugaugaaguuacccuuugcuguaagcaacuuagguagucagcacagucagcugagaaaaaagaacacacuaggugagcuuuaccuucaucccugcaucuuccucgugaauacuuuccaaacuauuagcccuuuggucagauaugaagcuguguacaccacaaggcuuggcaggaaacaacuacugugggacugugagcugaaugaagauuucagaaguuggaaacuucucagcaguguuggagcucagaccagccaguguggggaaagcuugcugaacauacugugcuuucagcugugaccucagaaaggucacaccuuaugaguagggcuauucuaggaguagaagacaggcuacuauagaucucauacagcaaagccccaaaccaagccucuauuuuaucaucuugauccaccuguaaauuuauugucugauagaacaaaacucucucuaaaguaagacaacauaauucaguuucucaauaacaaagcaccugcaaugucuagcauagaauuauuaugcuuguuaaaaagcaggaaaaugugacucuuaaccagaaugaaaaaguugauagaaauaaauaucuaaaaugaaaaauccaccagggagugguggcucacgccuguaaucucagcacuuugggaggcugagguagguggaucauuugagggcaggaguucaagaccagccugaccaaaauggugaaacccugucucuacuaaaaauacaaaaaaauuagcugggcgugguggcaggcaccuguaaucccagcuacucaggaagcugaggcagcagaauugcuugaaccuaggagguggagguugcagugagccaagauugugccucugcacugcagccugggugacagugugagacucaaucucaaauaaauaaauaaauaaauaaauaaaaugaaaaauucaccagauggauuuagcugcagauaacauacuguggaagaaaggaucagugaauuugaggauagaucaauguaaaccauccaaaucaaagcacagagaaaaaauagacaaaaggaaaaugaacaaagcuauaauaucuucaaggauauuaugcagcuuaacaauuaugugguuuacagguacagaaggagagaggacagagagauugggguagaaaaauaucaggagaaauggugaccaaaaaguuuugaaauuuguugagaaacauaaacccacagaugcaagaaacguaacaaaucccaagcaagauaaacacaaagaaaaucaacacauacgcacauuaugaaaaccaaagaaaaaauucuuaaaaauagccagaggaagaaagacacauugccuacaagcaaacagugauaaaaauuaucagugacaucucaucagaaacaaugcaagccagaaaucaauguaugucaaucuaagaaugcugaaaagaaacaaaaauugucaaucuagaauuuuguguuaccgaaaauauucuuuaaaaugaagcugaaauagagacauuuucaaaugaacuaaaacuuaaagaauuugucaccacuagacuuucacuuaaagaaauguuauagaaaguuuuucagccaugcgcgauggcucaugccuguaaugccagcacuuugggaacccgaggcggguggaucacgaggucaggaguucaagaccagccuggccaagauggugaaacccugucucuaugaaaaauacaaaagaauuaacuggguguggugucuggcgccuguaaucccagcuacuccggaagcugaggcagagaauugcuugaacuggggagguggagguuguagugagcugcgaucgcgccacugcacuccagccugggcggcagagugagacuccaucucaaaaaaaaaaaaaaaagaguuuuucaggcugaaggaaaauaauaccagaugguaacuuagaucuacagaaaaaaguaaauagggccagaaauggugaauauguggacaaaaaaaaaaaaugcuuuucccccccacauuucuugauuuauuuuuauuaaaagaauuuuuaaaauuucuaagucaaaaacaaucauaguguauguggguuuuauaauauauuuuggaaggcaauauaugacaauaauuagacaaaagaugggaguaggguaaaugauacuaugcuguugugaauuucuuauauaauucaugaagagguauaauguuuaggguagccuaugauaaguuaaggaugcauauuucaaucccuagagcaaacauuaaaauucuaagauagauacguagcugagaagccaguugaggggauaaaauugaacagugaauaaauauuugauuaauccagaagaaaggaaaggaggaaaaagaacaaggaagaaagaaacaauaaaaaacaaagauaggaugaauagaacccaaaagcaagaugauagacuuagcaccaaccauaucaauaauuacauuagacauaaaucgaccagauacuccaguugaaagacagagaucauacuggauuuaaaaaaaaccaagacccaaccaugcuguuucaagagaugcauuuuaugauauuuuauuacuuuaaaaauuuuuaaauaauuuuaaaauuguagaaaaguugugagaauaagaauaguacaaagagccauauaccucuuuauuuggauucagcuguucuuaacguuuuaccacuuuuuuccuguuuucucucuguauauauggacacacacaugcauuuuucuuugaaaaaugggcagcaaguuaucuacucugcugucuauauucuuguuuuguuaacugacccaguaauguucuauauagcaguauuuuugccccuccaguagagaaaccaguuuagaaucagguguuucauuuaguugucuuuaaacuugaacauuuauagucuuuuuuuucucuuuucugauaguggcacuuuugaaaaauauguaucucuccccuuuuaauacaaguuugucauuuuggguuuaaaagauacacuuuaaacauaaaauuaaauguaugagaauggaaagagauaaccaugaaauacuaauaaaaauagcuaguauuacacaaauacaucagacauuuuuagaauauauaaauguaauuauuuguauuauacuacuaugacauuuagaacuugaauacaucaaggccuagauaguauguuauggacuauguaauuuuacuuauggcaaggucauaaaauacuuugugaauaaguuuuuaugacccccccccaucuuuggcuuuuacuuauguucugaacugaaaacaauuauuaaaucuguuaggauccuauuuagaauacuaccaugaggaauuaguuaugauaauaaacaaaguaagauaucaugucuucccuaacucugcuuacuuuguaauugucagauguauauaauuccuguacggcugaaaacgaaacccauuauuucauaauaaagaugauuguaaugaacuaagcaacuuuaaauuccaucaguuauuaacaggugaaauuuacagauuaaaaauagguuuuucuggcauauuaaaugaguuauacguuucauacauguaguuucaaaugagugauuuggccacauguucucacucauaggugggaauugaacaaugagaacacuuguucacaggaaggggaacaucacacaccagagccuguugugggguggggggaugggggagggauagcauuaggagauauaccuaauguaaaugacgaguuaaugggugcagcacaccaacaugucacauguauacauauguaacaaaccugcacguugugcacauguacccuagaacuuaaaguauaauaaaaauaaaauaaaauaaaauaaaauaaaauaaaauaaaauaaaauaaaauaaaaugagugauuuggggauucugucuuuaaguuacggaaugaguuguuuaaacagcuuuauugaaauauaauuuacaugcuauaaaguuuaccuauuuaaaguauagauuucagugguuuuuuaauuauauuuauggaguuguacaaccaucacaaucauaucauuuuagaacauuuucaucuaugccaaaagaaaccuuguaucuauuagcagucacuccucauaucccacucccuuuaccucuaggccuagccuguuagguacugaucuacuuuuuggaaaugacuuauuuuuaucauagaucuaugaucuuuauuuuuuuauuuuucuaaaauauggguccuuggaaauuuuauaguuuaagagaaaguagacaagaugaauuuaagacacuaaaagagguaucaauuauguguuauaucucucagaaacuuguagucuccacauuaauuauacacuuggcagugcuguugcuguuccacguuaaugcauacauguaccaauggcauaagcuauuugacagagaaagaacauagaacugaaaccguucuaaugaaaggugagaggucugacauagaaauaacauuuuauuucauguauuuuguuuaauugcucugaggccaagauauggcaguguucuuugcauuuuugcuugcuuucucuuuccgcacuuuucuucgccucuuaacuaucuaccuuucugcccuuaucuuuuuucuuaagcauguuguggaagaauggccuuagucaugaguugaguuaaucuguugauuguuucuuaacuauguauucuacucaucuuuauuauugcccuauaaauuugagcauagagcauuuuugaauaagagguucauauaaauauuuuaauuuguaauugcuaugcaauaaaaauuguuauauaacuuuuaaauuauuuuuagauuuccauguuuucuaguucucucagaauucuuucagguuauacaguacugaguauuaagcuauauacccaucaauaaccuagauggcuaauggcacagacacacagacagacuaauguugcugaauguaagaagaguaguagauguaauauguaauguuauuauucugagacauguugaauggcccaagaaagguuuuggagauugaugaugaguugauccuuggaggauuuguagagguagaggagaugggaaauggcacuccaggcagauggaaaggcucaugagauaguauuugcaaguggcaaaaaaggaaugaauagacaaggauauucagggauagguaagaagaagaguuuagcauaaaugaagguuuauuuuguggaucugaugaaaagcuuggauagguagauuugggugcagguugugaaaaccuguuaggguuaucuaagugguuugugauuuaucuuuacaguaauaguuucugaaccugguuacacauuugacuuaucuagggauugauucuuagcuccaucuuacaccuuaugacagucacuguggauaaggacuacauucuguuuuucagcuccuaaggugauucugauauauuuguuuaggaucuuguauuuggaagucuuuguguuggguaagugguucucaauguauaccucuuggaccaucaucagcauuaugugggaacauauuaaaaaaugcagauuuguauccccaccuuugauugacugaaacaagaacucugggggcgggaccuucaggugauucuuaugcacacugaaguuugaggaccuuugcuguagguaauaugggaacuuuggagauuuauauuggagugugaugagaugaaggaagauuaaugugguagcaaugaaaaggacugaguagagaggguagagacuaagacaggcaaacuauuuuguaggcuaguggagagucuaugcauauauuacuugagguauuguuuaguagagaaguaaacaagacaggcuuugguguaugcuaaaggaauacaaagaagggagaagaagauuucuaaaccuuuucagagucuuuuagaaaaucuguaagaugauaugguccaucugccagccuaguuuccaguaugacagauauuuuaaugaugguuuaguguuaaauuauugggaccaacuauguacugaguacuggggaauagaaaaaaauacaugaacaccagagaccccuggcugggaaauauuuaauguucauuuauauggaggguuuaggaugaagauuuuugguuaaguuucuauguacaguuuuacacauggggcugauuuaguuuucauguacuuguuggaggaguguucuuuagguuagaaaucauuccuggagaacaaaauaauucaacagaauacuagaagccuuuaguuaaauauguaacagcaugaaugaagaugaugggauauuaugaugaauagaguuauaaguguuuagaguucaaauuucuguauuucuuugaauggaaaacauuuccugcugaaaaguugaaauguuccuuguauauuaaauucuuuguauaguaaauuaauucuuggaagagagaauacuuuuugaucuuuuaaugacuucagcaguuuuuuuccacugcaacuugggcuuucccuggcagccagaacccauccuuuaguuggaaggcucauuugucucagcguguuuuugucuggagacagacagugaggagacaaggcuauagcuaucauaguaacgggguguuauaguuuuucccuggugucagcccugugaccacacaccauugcacuccuuuuucaguuuucacucuuuuugaaacugugauaauagaaauacauguuuuugcccuuuugagcagcggcaguaccuuccaaaaugacaccuacuuggugacaagugugucauauuguuggcuguguguuuucaaguguauaaaagacugagguacacuagaaauacaaaauauucaaucuuguugaauucugcauagcaaaggaagaggaucacuuugaacaaacccauccuccagacguuaugauucuguaaaaaaucuaaauuuuuuucacaucucauuucaaaacacaacugucgauuuagccauuguugacuuaaauguguaacuccuuggcaugcuaagcagugucuacagauggggacaguggguucugauuauacuguuuaccacuagcagugacaccuagaacaagucacuuuacuuuuuuuagugccuugauuucuuuuuucuggagauuaauggagacagaauguaaaaucguuuuacuuuuguuaacugccauauaaauguuuagugauaaaauuaaccucuugcagagagagcuugaaguuugcugucagguaagagaauccacaaaauuauuaguacugauccuugaccuggaggggauuuucaaggagacagauguaauuucuauuuugaauucaggucugaaacuagguuauucuuagguucugucgacuuugauauuuugguuaccugaggauucuauaccuuaaaguaaaacaaaccuauuuuaguauuucaggccagaaaacguaugagaguauucucgcagaaauaguuuuucgucauuucucagccuauaaaacuuuuugauaaccucuauuuugcguggcaucgugaagucauguuguuggccaggccauugaaucuccacaaaagugcuugcuccuagaauguuucuucugucucgucaguggauaauaugcugccaaaugaacagaauauaauuaacauuuacaaguuaaauuaaaaaucuucuaaauucgaguuuguuucuguagcaccaggacucucccuguguuguuuuauguucacuacuaauucuucaagcaggaacugaugagcagccagggagauuccucuggcuucuaguacagacguagcaaaugcccaaaucagagugcuagggugucuaaugcauagugaagugugaugucaaugucauggacaucugaauacauugcggcaaacuuuagaaaauaguagcuuggcaggggauaccccagaauagguugaucugguaggaaggcuguucuccuuaaauuuucacauaccuaggaugggccugcucgggccucauuacgucuuggccuagagaacacagguguagaaauggcaggucuuccuucucccucacugccuccaaagcuuaucucugucugguuuugucugauauuuuagagggugaacuguuaaaagccaaguguccgucagacucaugcugcuaccgcuccuuuaagugugcucaucaagauuuggugcaccugggccaaggcaagaauguugcuaggauccaagaggccauaauaaguuguggugauuaauagcaugaagugaaauagugugauguagaaagugucauucugugauuugagugaaauuaaagcuacuggcaugaccuucacugacauauugcucuugccuacuugagaagguuuuagagcaaagguaauuacauuuuccugaauuggucuuuuuuuuuuuuuuaagcguauuuaaaaaaaaaaaacguuuucugauuguggaagcaaugaguaugucugaauccuugaguauagcgauaguucuucugauuuuuuuuuuuuucuguaugccaaauucuucagaaacuugguggcuuaagacaucaaccauuuuauuucucauaguuuugugagucaggaauucaugaaggcuccaaugcacagugcuucuacuugacauggcauuggcugagaacauucacuuggccacgcaucugcagcauggacugguuagaagguccaagaagacuuuauuauguaucuggcaccaucacgcuucuccacguggcuucuguuucaccauaugaccuugcagcagcguugucucaggguaguuggacuucauacaugauugcuagcuuuaacuagagagcauucuaaagggugaaggcugcaggucuuuuaaggccuggccuuggggcauuacuugguaucacgucuacuguguucuuuuggucaauuggguagcucagauuuaaauggagggaaaauagaauuuauuuagugugaagaguggcaaggaauuuccagcuauuuuuuucugccacuucguuguggacuuuguaaguuugccuuuauagacccaccagucagacacuggcaugaagucauugucuuuggguuugugucacaagauagaggccgguauuucauugucuacugcucuuaauuuguuagagaauauuuacgugauuaccggauucagcaacauuucaccaguuugaucacauuaaagaccauucaagauacauuuaggaaaauacaagucuuucacagaacuccuuuguucaagugaguuaauucuuggaguaguuacacuuugucacuuuacacucaaguacugaaaugauuuuuuauauguuauuaaucccuuugaucuuucuguuguuacaguuugucguauugcuccccauuuuagagauggagaaacugugauggguuuuaaaucauguuuuuuagcaccaaagagucaaauauggaagucggcuugcccuagcuuucuuuugcaauuuuuaagucauugauuuaaaagccuacuuuggcuuauacuuuggcaucuugacauuuuacuugagaauccgugauaacuuucaacugauucauuuaauugaaauuauuucaguucacauauuuuuaaaaucaaggcuuuguguugaggaauauggccaaccagggauuuguuuguauauauagaaguguguuuaccacuauacauguguuuauguauucauguaugauuguuuucuaauugugaauauucaggauuucaaguuuuuuuuuuuuacauugacagauauaauuauacauauuuacuguguggauuucaaguuuaaaagaauagccaucucugcauagagauuugucuuuuccucuuuuaaaauaccaaauauuuugauaaaggcacugagauuggucuaagccuuugcauuacccuauacagucaagaaaggugaggcuaugucuuuuuuguuuuugguaguggcuucagauuagaucaacugaauguucugaauauuuugcuaauuacggcuauuccaguggucacugggccucccaccauuccucuccagagcugaugguaauugcaauagcugugacuuccucucucccuguuuuuagaagguguugcuuucucuuguauaucuugcuuuuaugaaguggcugucagcagggagcacaaagagcucucuggcaguugcuguuccuucgagagcaugcuucuuuugccuguuugucacuccacugaguacugcauucugguagugaagggagcaauccuucaccacuuuaguuugugcugcuuauacucuuguucaggguugaaggcuggaauauagaauggagggauauuacugauacguguaccauaacguguaugcaaagcuuaauuuaaaaacugaguggaagugaaauuguaggauauuaauauuuuaugcccuugacuuuaaaccuucugugguaaaaggugauguagaaacuguuauugcaccauuucuucuaaucuuggcuuguaagaucuccauuaguuggaauucugcaaaugaaagacguaaugaaaggagaguuuuuuuuuuugugaaucuuugcuguccugggcaagacucaguuguucugguaaagagguggcaauaaacaccaaugcagaagucagacagugcacuauaauguauugaaccccauuauuuggucuauuuuaaauguauguauaaucugguugaugaagucuucuggauucuguuauccuauucauggucagucuuaguuuuguuaucuuuacuaucuuaaagcagcaaaucucuuuugggaugcacaauuagaauggccuguggaccccacaucucuagagcaugcuucaguaggauucuaacugauucuaaugcacacuccugguuaagaggcaggauuaguaagugauacaggauuggucauacuaaaaucaaauccauuaaagucuuaagggguugaagagguuuacagaaggcaaauuuugauucauuuugaaagauaugucauguuuaggagaguguuuguguucugcaacauauaguaaaugaagauagaauuaugaaacuucauaaauaugggaaggugcuuuaauguacauuacuauaaagggaaaagaaaaacuagacaucggugcucuaacugaucuccauuuacagauuuuggucaguuuuauuuagaguagcagcccaaaguuggcaaacauagauaauuccuauuucugacuugaacaguugagaauguugacaaaugcauuauuucauccaauaauuucuuggacuggaaacaauuauaucaucauguuaauugucuguuauuaagaaggggguuuucuagguugcuucccgcccccauuuguuacuuguaugaauuuuuaaggcuuauauugaugagauuuucauguaauggaggggagaaauuuuuuccuuuuuaacauguucauguaaaaggaauuuaggaaauuauuuuaaucuugcugggagcuaagacaaaacacaaaacaaaaacacugcagaacaguuuauggucccauggacaaauguucagucugaacacaaguacuagagaagaccuuggaaggcugaggucagaauggguuaaaguaguugaguucaugggcaaagggggacuuggcauguuuucacacaguuaaguauaaauguauaauaugaacagcacuauaaagaccugggggagaugggcuuugggggguuuguuuguuuucuuagaacauguuaccaaaaacaaaaaaaaaagauugaauacuuuuggaugauagggagaccuuugaagaagagauuggguggcuuggacuuugccuuuuaagccacgggcugcgauuauauuuuuguuuuguuuuuacuauggaaaauuucaaacauguucagaaauugaaccaguagaaugguuccccauguauucauuauccaguuugaucaguuucagcauuaucaauuuaugacugauacuguuuucuaucccuccguauuucccucuccuuuauuauuuugaaacaauccuagaaaucauacuguuuuaucuauauuuuaauauguaucucuaaaaaauaagaacucucuuuuuaaaauuauaccuaaaaauuggccggguaugguggcucgcgucuguaaucccagcacuuugggaggccggggugggcagaucacuugaggucaggaguucgagaccauccuggccaauguggugaaacccuguuucuacuaaaaguacaaaaauuagccaggaaugguggccugugucuguagucucagcuacuugggaggcugaggcaggagaaucgcuugaaccggggagguggaggcugcagugagccgagauugugccacugcacucuagcaugggugacagagugagacucugucucaaaaauaaaauaauaccuaaaaacuuaauuucuuuaucaucaaauauccagucaguguucacauuuccaguugucucaaauauuauaauuauuuuuuacauuuuguuugaaucaggauccaaauaagguuuaaauauugcaauuugauuaauacauuaagauucuuuuaaucuauaaguuccugcuccaucugucauuuuauuuuuaucccuugaaauuuauuuauugaagaaacuauauccuuugcuuuguaaaauuuuccacaguguggcuggcuuuggcugauugcuagcgucauuugcuauuuauuuuuguccuguaucuuggaucuggcgccuugaucagauuuaaguugauuuuuggggacguaauuacuucauagguauuaugcauuuuuggauagaggaguaaaguagugaaaguaauguuuuuaggaugguuugucuggcagcagugugcaaaaugaauugguagaggagaaauggagagcugcgaauuagaaggcagguucaaucagugcaggaaggaaaggcuacaguaaggcagaggcagggaaaagaaaggcaauagagaugagagagauuuugaaagaaggaauuuucaauaccuuuuaggcuuaacuauaagaaauggagagucggcugggcaugguggcucaugccuguaaucccagcacuuuggaaggccaaggccaguggaucaccugaggucaggaguucaagaccaaccuggccaacauggugaaacccugucucuacuaaaaauacaaaaaaacuagccgggugugguggugggugccuguaaucccagcuacuugggaggcugaggcaggagaaucgcuugaacccaggaggcggagcuugcagugagcugacauugcaccauugcacuccagucugggcaacaagagugaaacuccucaaaaaaaaaaaaaaaaaaaaaaaaagagagucuuaagucagguugaaguugugaaccugagugauugggaguuggggucaggaagauggugcuuugugcauguugaauugaaggucuguguauugguagacuauccuugcagaauuguguuauaggaaguguauuagucuguuuucacacugcugauaaagacauacuccaaacugggcaauuuacaaagaaagagguuuaauuggaaucacaguuccauguggcugggcagccucacaaucauggcggaacgcaaggaggaguaagucacaucuuacauggauggcagcaggccaaaaaaaaaaaaaaaaugcaugugcagggaaauucccauuuuuaaaaccaucaggucucaugagacuuaucacuaucaugagaacagcacaggaaagaccugcuccuaugauucagucaccucccacuggguccuucccacaacacgugggaauucaagaugagaucuggguggggacacagcgaagccauaucaggcagcuagauugaucaugggggaccaggggagagguaagggcaggaaauagaaauuuagggauucucugucugccugggaauagcugaagccauacaaauggaccagcucagaaacucgugagugaacugaggagcacuuuccuuaaguaguucgucagcuuaaucggcuuucuauaguugucacagcaaaauauuacacugucuuuagagacuggaguuucucaugaugaugccacauuuugccuuucuuugcuucugcgguuuuucgucauuuauaggugauauggcagcagauuuuugagcagaauccagcugcuuuccgaagcuggagauuccacuggggauguagacagcuugggaggaaauaaaagccgaguccauaagugagccugggaggagugaagaagcagagcaagcaggacagaaagugggcggggccagcuauagggaaagaccuugggguugaagggauuugauagacuugccuuagugucuuuuaguuccuucagaagcccagccugaccuccaucaugagagaacuaguuagugaggguggggcaccaacaguucccuuguguccucuccugcuguuucucucuuauauccagagacuacagagaaugugguuaaugggaaacuacaaaacuuauauguaaucauuucaaaaguccucccuagcugaaaggauuuuaagaaaaugugcuauucagaaauaucccuuaaccuguuuaacagcaucuuauuuacucaucuguguuuuaugaauacuuuucccuaguugcagaaggauggcaaaauaaauguuugcuaucaaaucuauaccuguaauucagugaagcauugaacacaggugauguacccuucuucacaggggaauuguguucaaaaucauuuuaauuuuuuauccucaguaagauuauauagaaaaucuuauagcucucaaaggugcagauuauauuuuucuguaauaguucugggcuucccaaaaauuuuuguugguguugccaaagaguugugucacauaagugaguggcacaaacauuuuuugacuagccaccugaaaguugugaaggguuuugaaaauauaaaguaaaauauaaagugaacaccaccacugucaacaaaauccacugcuuuggauaugauuucacaggaagaugacggcugucaccaauugaacuacagcaaaugacgaaagcucagcacgaauuagccagucucauuggggugauaaacgacagcacauuaaauauguguuagcaacgugauauggcagugaaaaaagccaacgcuauuuuuggcugugcugcacaaaacagcaucucgucaccgagcugggcugaucauuacuuucuacccaguacuugugaggcagcaucugggaugcugucuugaguguaggacacgugcguacuggaaggauagacaaacggguaggagucccaagcagagcaucugcugugacuaaggacuuuagaugagacaaguuuuagaaguggcauguuuaggaaugagcauggaaguaaagagauguuaaccuuuucagagauaggaugauguugaggaaauacaucauagacuccucauuaguuggcauuaguuuaguacagugcacuuuagaggaauuacccaaauacuuucacagacagcauaucagcaaaaaggggcucuaaagcaaaauuaagcaaggacuuauuuauggucaacuauguuuuaaucaagagauuaacauuggcagugcuugcuauaaugugagaaggaauagaaaguaauagauuacauaagucaggugcuuuugauuggaaauucaaaugcaaauauuaaaccugggaacaaugggggugagacuuuauaguuaucuuuagaaauucaaguaacaaauaaaggaauuacuuacuuuccgcaguaguauaggcaagcacaacagaaagaaauaauuuaagaaauacauaguauaaacugaaugucagggaacauuucugcagugagaacuaucggaccauaggauauuccccuaggaaaauuggguugaauuucauuggacauuugauccugacagaauugaauguguaucaguagggaaauagacugaauaucccuguaggcauuuuucauuucucucuucucugauucugggcccuguugaugaucuguucaccugcugugauuaggaagaaauuuuaucucuuguuuuucuacacccaggcacauuuuagaugcuuuccugauugacauaggcuaaaaauggagcuucauugcccugagguugaccugguaccaucccuccugguguuguagaaauuucuccuuucuguuugggaggcaguguuaggguccuuuaccuaaggugaauacauguaauauaaaaugggcccauguguauagggucagugucuucuucagauauaucuaguaaccuaacagggcugcaagcuggccucuuugggagugaaugaugguuuuauuuuccccucuucccccaggacuugacuuugaagaaaaaggauauuuagcagacuaggagaccacagacuuuuacuguguccuguagaaaugugaaaaauuucagguuccuggaugggaaagggcuacuggagaagagcuugacuccuuaugcugugacagugguguguaugccagucuuucccuguaguaguaucauuguauaaucaaagaaguaaacuaaaaaugcaaauuuaauuucagguucauuacaaauggucuguauuuccuuguuauaaacuagucuauuggauaagauuguuagauagauuguuauccaaucuuagucuauuggauaagauuguuuucuuagcuuggcauucaaauaccuguacaauucggacaaagucucugcuuuuccaggcuuaguuuacccuuuucuauaguaaugcuguauuccaguuaaaucagccuuucuuucuguccucuaaauaugacucuguccuuuccuacaguaguaguuuuguuuauuccauacaucuuuccuacuguccuugcccucaucucugaauaccuucucugauaugcuccaguccucugucuuaccuaugaagcauccauugaucauuucccuucaagaacucauugcauuucuuguuuuuaccacucauuugacauaucuaauaguuauauuuuucuuccucuacugaauccacaucuuuccuuuuuaaucagauuaaaaaggcucucuugaggaccauuucuuacaugucuuuaaauuucucacaacuagucuuuaagccuuuggagagaaggaacuauggcuuauuuauggugccugucucuuccccuaaacucacagaguuuggcaguaugcacuuaauaaauauguuuugaacaaaugaguaguagauacucuauacauaucuauugauugauuuaagauuugcuauagacugaauguuuauguccccccuaccccauauucauauguugaaagccaguccccaaugugaugguauuuggagauggaggcuuugggaaguaauuaagucaugauagcagagcccucaugaauggaauuagugcccuuguaaaagaggccccagagagcucccucgacaguucugccacgugggguuacagcaagaauauggccaucuaugaaacaggacagggguccucaccagacauuaaauuugcugaugccuuuaucuuggacuucccagccucuggaaaugugaggaauacauuucucuuguuuauaagcuacucaaucuguggcauuuuguuguagugguuugaacuaagacaagguugaauuuuaaaugcuuuguaaauguguugaacuuuguagauuuaaaaaucauguagcagaagacucauaaagcuacgaagguuugcuauauucccaggagaccaguuccuccugcuuucuccuagaccagccugcacuuaaaucaucccuauaugaagaguuucuguuggccaggcagauuguuagcucagguuuccagauaugaaaugaugucaugaaauaaugggcaugaaauaauguuggcaagagaaaccauuaauaauugggacugucauaguauuacuauuauauagccaaugcucgugcauagauaauaucauuucuaucaugggugugacaauaauagauuuggaagaauggugaaaaauuugauaauagguuaagugaaauuaaacuauacaaacuuguccuuuauucuuugaaaacgauuuaaauuuuugauuuuucauuuuaauuuucuuacucguauuuaaaaauuuuuccuucaugucuugcuagugaaauguacuugcugcaaauuaaauccauuucuuucagugauagcuuugguuuguaauuaccuucuuuaaguguuaagucuguccuuagaaucaucagagcuucuauuauguaauucuuuggaguaaacccuaguuaaucagagcaugcauuucacuggaggggcagcucagugagugaugugaagguguuuccucugagaaacggaaacaguuaugaaguguuuugugguccuuugggaguugaggugcuauagaaauguaaggcuuuuauuacaacuccugaccuacuauacagaaccaugcuaacaucauugaugauucuuuugcauaaucaaagaauuaaacauaaaagucauauuaauuuucagcuucauuagagaugcaagaaucaaaagagauguuugccaaaugggaaggcacuaaauugguaggagaaagaauuuuaauuucaagcuucaagugaauguuauaaauaaccuagcauaaaaaagacacuaccaaaagcgccugacaauguccuuuuuaaagaucagcaacauuaaaaaggggaaaauguaaaaaagaaaaaaaaagggaaaaaagaaacuauaaaaauaugaaauuaaaauugcuguauuugagucaguuuaugguaguaaauuacuucugagagccucaauuugaagaucaccagguagucuaugguaauuaguauaauuuugcuguggucaccaaaucuuuauauuauuuuugcuggucaaacagcaauacuuuugccuuuuuuuuuuuuuuuuuaacuuggucgcaguugaagaugaugaaaaauccauuuacucgugaaaggguaaaugcaacuuccugaugugaaauaggggcauuuaaagcacucacauuaaggaaaguuugcauuuuaaauauaaaguagucuuaaaauuuuucucuacccacauauaaacaccauuccaauaugugugaagagcuguuguucaucuuguaggaucacuaaucacaggauuaaagcgaugaggaaguauauacagugaagaaugaugcccuuuucuuuaaaacaaaaaucuggaggcagccagaagagcuugggaaaauucuuguauuuuauaucuauuaugcucuugauuuuauaucuacuguaucucccugaucuguggccagcugggaugcaaauacggcacaagaaguucacaguaucaaaggagcaagugaauaggaccccagaaugugauuguuaugaaaguacugagauuauuacauuuaggcccuaugugauucuggaggaagugaguuuuacugcucaguagaaaauuauauauauauacacuguauauauaaaacacacacacacacuguauuuagaaagaaaaagaccaucuguucauucugucuguauuucuguggggauuuaaucugacagugaaucacuugggauuuguacagaauaaacuugugcuaacauuuuuaugaaaaaggguagggaagacaaccaaaauuuucucuuuagggauuguuuagcucugcuuuuuuuguuuuuuuucuuuacagcauacgaacauggcaauaugaugauugauuuuuuuuuuaauuuguuuuauguuagccuuuucugauucuacaggagagguucauuccuuugucuuagcaugaaaauuucucaggauagacaguagcaucaggaaugaucuuuaauagaguagugguuuucaaagagugguucccagaccagcagcaucagcaucacuuaggaacuaguuagaaaugcagauucuagugcuguaucccagaucuccugauugagaaacuuggaggauggagcucugcagucuguguuuaguaagcccuccugguuuuucugauaugcaggagaaccauggaauuagacacagacuguaauaaugaaacgcuaguguuauuucaagaaacuucaacacucagacucacuuaugcugaugaauaugaccugggccaaaccuuaaauaucuuauuuccuuccacccucauaacacuucggagagccugccaucauuauucuuccguucagaugaugacacuguucaugcucauuugauugguaagcagugaaccaggcuuugaaucuuggucugguuucaaaauuuauuuucuuaacugcuguagaauaggaagauuuaaaaaggaaugauuuucaaguggcuauucuugugacuuuuuacaacuaaguaugucaucaauuaggaaaguaccugagggguugaguggcaaguugggugccaagagcaaaccagauuauaaucuagaacucaguucuaguccugacucugccuuuacucucucucauucauuuaguuggccuaauguccucugaacaggcuuccuccugggacacuugauucguuagaugacuauacuuuuccugugaagugugccuauuuuacagagaagcuucccacuucgaacuggaaaaaauaagcauaguggagugacuuuuucaaggucauuauccccuuucaaugggagagcuauaguuugcuucuauucaguaccauccuguuguaauggaaaaagaaauacaaaccaaccaagaugcugaaguuugcuuuuaccugcauuauauuuagggguucauuugcaaaccugaaguauuucauugacuuguaccuuugcuguuugucacaacaauaaucaugauucuuucaucucaagccuugauuugaaacagccuggagcugguccagacaaagcccaucuagucauuguaucuaggccugucgauauccucuuguuuguuuuuguuucauuugguuuucuuuucuuuuuuuuuuugagacggaauuucgcucuuguugcccaggcuggagugcaauggcgugaucuucggcucaccgcaacuuccaccuucuggguucaagcgauucuccugcuucagccuccugaagcagcuggauuacaggccaccacacccagccaaauuuuuuuuuuuuuuguauuuuuaguagagaagggguuucuccauguuggucaggguggucucgaaaucccaaccucagguggucugccugcgucggccucccaaagugcugggauuacaggugugagccacugcgcccggcucauuugguuuucuuaccugucaccuaaaguugcagucuccuuaacugaauuauuaguucuuaggcauuaaggacagcuucuuugcuuuuugucuguaaacuauugcugugucauuuucacaguacaugcucaauaaugucauaaagaauuaauauuuugccucuuccuuauuuuauuguccuuucccauaauuuuccagccuaucuucuguauauuauuccauuuaacuuuucuguuugugauuuuuuuccucuguucccucugagcauuuguacuugccauuccuguacugcagauacaccuuuguuuucuucucucuccauuuauucucuccauuaauaacaaaauuaaaaaauuacagcuaacauuugauaagcauuuaccacauaccacugugcuuaguacuuuauauguauuaucuaauuuaacccccacauuuauaaugccauuauuauucuuaguuuguaggugacaaaaaugaaauuuggagagguuaagugccuugccucggcuauuaaguggugagacugagauucaaauucagcuguaucuuaauuccaguuaaacuuuuaauuauaguauuuugccuccauuguuuucaaaagacauaaaaaaaccuuuauggcuuugucugcuuugcuuugguaugacgucuuauucauguauuaggcuuaaccugcuuauuguaaucuggaaaaaaaauaugcagagaccucuaggcugacaggcaccuauaccuagaauaaggauuuucugcuagagggaacugaaugucauauggggcugugaugggcuacagccucccagguuaagacuuauuucacauggaucaagcuaucuccucacuccagcaaugacacaguuaguauauauguucauaacuaagcuuaaaugccauuuuuaauaaauauuaauaccaguauaagguaaggacaaggaugcacauacaguccuauuaugaaauagggcuguagcagcauuuuucuaguuuaguuacuuccuuccaguauuucaauuccuuucaauccaggaucuuagugauuuugcauguaaaccuuuuuccuauuucaugcucucucuuugcauuugcuuuauucaguuguauugaauuucuaauguggauuagagcacacaguagggcugguucuucauuuuaauaacuuuccuuuccaggcacuucucaguaauccuuucuuuuuuuaagccagguuuagagagggagcuaaaagcagaacaagacauuugaguuuguauuguucugcuuuauuuucauaaguuccacauucucaacugaauuucuagggacgaaagagaacucgauuacuuuuaguuccuuucagugccacucuaacuuagugacuugacuuccauuucucuaaguggaaauauuuacauguauuucaaaggaugcucucuggcuuaguuaguaucucuacacugauuagagaauguaaagcgauguuuaagugcuuauuauuuuuuaauuacauuuauaaagguuaaaauauagauaacucaaccauuauuauuauccucauuuagaauuuguauaccauuuacauuuccaaagugcuuuguucauguaaauuaguugguccuccugccauuccuauaaauuaugucaguacuauccucugaaauguugccauuuucaguuuauaguuauuauuuuuauuucagacaacuacaccuuguucaaagggugaaagugauuaauagcuuuaaaaccacuaaagguaaacauucuuaaauacccuugaaguuaaguagaugccggaauugcugagauggcugccaagccaauguuggagaauuuauuuuuuuguacagauuauauauauaucuuugauuuucuucuucuccucucuguuuauuuuguauuuuuuauucauauaggaaugugcacacauuguauauuuuucacaaaauuucaugaacuaaaccuacccacuaaacacuugugucagggaacaacacaguaccagcaucacucguucauugaaucucgauuugagugcgcgauucugucuuacagacugaaucugucuaaacaucagcauagcuggaauuauggacacaaugaguauucaugcucagauguugcuuccauuauaaaacuaauuucuguauguuccaaaaguguuaucuuacuggguuaaaauaacacugaguagucacaguaagagaugcacacaagaugugccucaugagugguguagacaagauauacuguuggacaucacaggagcaaaguuguaccuuuucagaaaugcuucacauggaggugaaauuagagcuggacugcccacuagggauagagggcuuagacauaaguguaggcuuugguaagagaaacaaagaagagggaguagugguggcaugugucccaagcagggaagauagcuaugucuugcauaugacauguuuugaugcagggagaguuccaguuuguuuggaguaaggguucauguauguguuuagucaccauucaaauuugagaguuaaguagaggucagauaucuaaggacuuugaaugcuagcuaaggacucauagugaacuaaacacuuacugaauaccaucuauguguuaggcacaaugcucagcacuuuuauaugcauuuugaauuuaugcucaagacacuuggaucugcgggggcaggaguuaguggcacugagauauaugagcagccuggguagaaauggagagaccagagauagaaaucgcagaagacuauuaggguugaugacaccuuggauuacgguugguccuaaaauuuauaauuucagcuacuaaagaccugguucuagaggacugaaacuucaucuuuucuugguuauucuacauauaaucuaaugcaauaagaaccugaaugaugaguacuuaguuggcagauauuuaucaguugccuacucuauauacaucucuuuguuagauuugaugggcugcucacucugucccucugcccaccugauguuaguuaaucugggggacaaccauguaauaaguuacuuccuaguaucuauagugaccaguuauuugggagucaccugauugaccaaagacuguguuuuuacaguguugucuccuuuauuuuuuucuuaggauucuuuuugcuuuucuuuuuuacaacagccuacugugucgcaucacugaaucuaguuuauaguuuuucguuucucuacauuccaucauuuuagaaacaaaagccacaucucuuugaagaaguacuuuugacuuuuucucccaauuuuagcacuuguccguaacaacuauguaagguuuguuuugggcccuccuuuccuucuaucaccccuuugaggggcucuugugcccuguuuuguguuacgugguagguuaauaaacgagguaaugaggggaugaauguagagauagguggaacauauagauugguagauuaguggauauuuuggaaaaugaauuguguaagagaagacagaauuugaaaacagaaggacagagaaaaugaaaagguaugagaccucagagugggggcacgaggagcuguuuguagccagagguuucugguugaacucagguuccuaaacucugaguuguacaggaaguaguaaaaguuuuuuaaauguccuucuaguucucuuuuaaccaacuagaagaguugccaggauuuuuaauuuccacucuggggugugccuaagaaucuuaguuaccauuaccauuuguauacaguauuauuccuugagaauaauuccagagcccacuuuuuuuuuuuuuuuaaacuuggcagucugaagagauuuggccucuuuguagugguuuuugugcuaauauugauccaaauuuaguuucagugccuguuuucuucucuuuccuauucagucaacuauuuaaccucucagugauuuuaguuguccugaaauuuggucuuucuuagcaaggacaguuuguuuuauguucuuuaauaguuagaggaugacuggguucauucccguaauaccagaacuuugggaggcuugagauaggaggaucaugagcucaggaauucaagaccagccugugcaauauacugagacccccuucucuacaaaaaauaaaaacauuagcugggugugguugcaugggccuguagucccagcuacuugggaguauaaaguggaaggauugcuugaacacaggagguuaaggcugcagugagcuauguugcugccacugcacuccagccugggugacccugucuuaaaaaaaaaaaaagaaaaaaaagauaaaucaucacucugaaucuuuucauugagaauuuuuuuuaauagccuaagaugcuaaguagucuauacagugauuucugcaugauuuuccuuuuuuuuugucuaaaucuugacauaaguuuaccuucuucaaccuuuuaaucuauuccugaaugcauuauuuuaauagaugugcuauuuauuaauauuuuggaacuagaauauuaauuaccccuuuuaaggcaaaucacuacccaaaacacauuaacugugccuucacuaagaaccuugguaacacauuugcaccugacaaaagggagugggcagaaaauuagcuaaugaaauaguuguucuggaguacuauguaauuaagggcuuugcagagagcccuuggggaagcuggaagacugggaaugaguuaaauguauaugaguuuucuagugcuguaguaaauaaaugugugguagaaaugaaaauuuucuugcggaaaguauuuaaaacaaggacaaacuguaguuauauuaguuugccuaaguauucagguguauaggaaauucugaagauacuuuuuguuggcuaauugccauuaaguacccacguguacugcuuuguaagugguaaaauuugaaggcugcuguugaguaacuguuucaaacagguaugaagucagcagugcuuauguuuucauuuuaucuaucgggaauaaguuguggacaagucuccuaauucggugcuucucaagcuuuaacaagcauaugaaucacaaucacugggggaucuucuuaaaauguagacuuuaauucaggauuucuugggugggacuagagaauuugcguuucauucauucauuuauuuauuuuuugagacggagucuugcucuguugcccaggcuggagugcaguggcaccaucuuggcucacugcaaccuccgccuuccagguucaagcaguucuccugccuuagccucccaaauagcugggauuauaggcaugcgcuaccacacccagcuaauuuuguuuuuguauuuuuagcagagaugggguuucaccuuguuggccaggcuguucuugaacucgugaccucaagcgauccaccugccuuggucucccaaagugcugggauugcaggcaugagccaccaugcccgguggagaauuuggauuucuaaaaagcuaucagaugauaccaguggugcauagaccacacuuugaguagcaagagccuaauauuuuuuuuuuuuuuuuuuuuuugagacggagucucacucugucgccaggcuagagagcaguggaacgaucuuggcucacugcaaccucugacucccugguucaagcgauuauccugccucagccucccgaguagcugggauuacaggcacgcaccaccaugcccagcuaauuuuuuuauuuguacuagagacgggguuucaccauauuggcuaggauggucuugaucuccugaccucgugauccacccgccucggccucccaaagugcugggauugcaggcgugagccaucgugcccggcugcaagauccuaauauuucuuagaaggagagaaauccuuuacucacaggaacuguacacacauguucacacauaugcacaagcaugccugcuauccauaagcauuugucaucuuucagaugauggaagcuguuugagacccuuaagggacuguagucaugacuccugucuuuucaguaucccuuuccccuuaucacugugauccuacugcauuuauggaaaaacugcuggcgggccaucauguuugacccagagcugaaguucagaacuuccuuguugauugucaguguuaguaggaaugaauuuagcccauuauagugauuggcaauuagaaugguaccaacauuaucaguuaaauccugucuguuugcuuaacucaguuuugggugcuaaggcagcuguauucuccauuucaguaacuucugaauauuaccauucaggugcucugcaucaaaaagccccacauuggcuggguuuuguggcucauaccuguaaucccagcacuuugggaggccaaggcaggaggauugcuugagccuaggaguucaagaccuaccugggcaauauagcaagaucccaucucuaaaaaauuuuuuuaaaauuagccagguaugauggugcacaccuguaguccuugcugcuugggaggcugagguaggaagguagcuugagcccaggaguuugccgucagaaaagucccacaucaguuacuaaagucuaacaguucuaccucucucugucucuaaaauccucuuaagucucucugucucucucuaagaccacagcuuuaguucagggcacuggucucucucccuggcucaccauaccauccuauuaacugaucuucuggcccuauucugauauauucuccauagugcagcugggaucagcuuucuaaaugacaaaucccuccuuaacuuuuuuuuguuuguuuguuugauacagagucuucucuguugcucaggcuggagugcagaggcacaaucuuggcucacugcaagcuccgcuucccgguuucacgccauucuucugccucagccucccgaguagcugggacuacaggcgcccgccacuacgcccggcuaauuuuuuuuuuguauuuuuaguagagacgggguuucacuguguuagcuaggauggucucgaucuccugaccucgugauccacccgccucagccucccaaagugcugggauuacaggcgugagccaccgcgcccagccccuuaacauuuaaacucugaaaguuaaguccaaauuccuugacauggcacacaaggccuuccuugagucuggccuuggaagcugugcaucucacauuaguuucuuggugggguccuuucuuucuugccuccaaucuuuugcacauauuguacccuuuguuguagaauucccuaaagugcugugcacauuucuuucuugcaguuuucaucuuauguugucauugccuuuucuuggcucaacugggaacuuucuuggggccaugacucugaccugugcacagcugucuuacugccuggcacauuagaaauauuuauugaauaagaggugaaaugaaaagaaaaggcugcgugcaguggcucaugccuguaaucccagcacuuugggaggcuggggugggaggauugcuugaaggccaggaauucaagaccagccugggcaacauagugagacugcgccuccacccccugcgcccccccccccaauacacacacacacacacacgcacacacacacacacacacauuaguugggugugauaaccuacaccuguaguccuagcugcuuggguugcugaagagggaggaucccuugagcucaugaguucaaggcugcaaugaguuaugaucaugcuacucuacuccagcuugagugauagggcaagacccugucucuaaaaaacauuuuuaaaaagagaaaauuaaaacuuagguaaguacuguuucuuuauuuugucugagguagaauuuaaaauguugagguuauggaaaguuuauauuaaaaucauacaacauugauuuaguaauaaagcuuuaaugauguauguagagcaaauaucaauaaaacaaaauuuguaauuuuauauuaguauguaggcaaugauucauauuaaauauggaagaggagggaaaagaucuggaauaauaaucauaaaaccaauaauaaauauuugaguaaagauagagauguuguagaaauuguaaaacguuaaauuuuucccuuuuugugguuucucuauuuagaucaugguaaauggauauaaguauuaucaaaaaauauugauauaauuuuuuauuuucugaauaugauuuuuauuugucuuugguagcaaauguaccacauuaaggugguauuuggauuauaauuuagggcuaguaaacaggaaggaauugccuuaauccaaauauacaguagucuucccuuauuuguggggauaauuuccaggcuccucaguggaugccagaaacugcagauuguaccaaaccuuauauacaccauauuuuuuccuauacauaacuaugauaaacuuuaacuuauaaauuaggcacaguaagagauuaauaacaaugauaguaguaugcuauaauaaaaguuaugugaauaugcgcuugggaacucuuucaugcacacacugucuugcucucucucaaaauauuguacuauauugaagguauguacuguacuguggguaacugaaaacauggaaauugaaacuguggauaaggggggacuauccauuuaccucacuuaguaaauauuugagugccuacugugagccagacacuguguuaggugcugggauuauaagcaagauauacaugaucugaaagauaaacuauguccauuauuugcaaaaacaaguuacaugugaguguucuuugcugucuguagauaacaaauauguguauagugauuuacugcucauagagcucuuuugugcgucuuauugccuuuaauuccacguaacaagcugagggaaacagagacugagaguaauuuguagaaagugacauugcugugugauagagaaaguaaacuugaacccaggauaggcuccaauuccaaaucccaugccauuuucuuacaccauacugcacuacauccaugggcgauuguggaauaccuuacagaaucauaucaaguuuuuaagaacaugguuugaaaaucacuuuuuuuuuguauuuauaacacaaaugcuuaauaauuuuugagcguuggggaugagcacaaccuaacuuauauccauuauauuacuauugcgccucugacacuuuaaaacauuaaaaaccugguuuuacccuuaauguuuucuggaauuguauuuuuuuaaauuagcaguaaagggaagguauguauuuuuugaaauuucuucggauucuuucugccuuuugcaauuuccuugcuaucuugaugaaauacaaagggugaaauucuuauagcuagaaggaacuuuagagaaagaaauauauuauuggaauuacagcacauaaauaaaauacaguucucauaauucaccucgguuuaaauuauucuuuguaucugcuucugcagaaaguuuucauuuaggcaacagucauugauauugacagugucaguugauaaaaaugaauguaacugugguuuauuaaaugcaaugugauguaugaauguaaggugguauuacuauaguccuccacuuggacagagagugagaggggacaguccauugccacugguauugauguccuaaagugugugccaugaaccuuaugcucuuuauuaggaaggcuacucuggcuuguuuacucuuggauuugacaaagacuguuuccuugacagaacuucaguuagguuccucugagcccucuucucaacguggggucaaccuugaguuucuguguuuguccuugcuaaguccagcuuuagcaagaauccugcugugucgguuuaaucagaauccacccuccccuuuauaccugaucacccugaucagauguggaucugaucaaguuccacaucccccaccuuugaucuguaaguccuugaccugccuuuagaaacaauccuguuagguuaguuuaauaagaaucccccuacucuuaauguguuuccucuuaguacuuuuccauccaccauccucuuacuuugcuucuuggcuauaaaucccacaugucuuagcuuaauaugaaguugagcccagcuucucuccccuauuggaauaucuccauuguuguggucucgaauaaaaucuuccuuaccauuuuuaacauguuuugagaaugacuuuuuuucuuuaacagauucucagcagcaaaagcaauucaaguaaucaagucuacgauuggguauagagguuaaggucucuauggccuaaagguaaaagaaggggauaucagccauauucaaauauguaauguuuaaauaagcuaugaaggauagcaaccuuggguaagauaagauguguguaagauguaguccacagcaaacugaaaagcguggccauaaauucuaggagugagauuaauuuaaauaaaaugcugauaauaaauaccaauauuaccaaccuauggaccauuucuccuugaaggaggaugcaaaaacauuuaaaaucaagcuggaauaagcaaaauaagaauuuagguaagaauggaguucuuguugagcuccuagauuucuagaugcacaccuggugacacuuuuuuuuuguccucucaauaauuauggaaagccaggaccauuaauuauuuuucacuuuuagaugauaaaccugugguuaaaaauggucaaauaauuuauuugaagucaacuagaacuuaaaccugacuccaaaacuuguaaaauaaugguggugguaaugaugaaggagaaggggaacuggggagaaguuaguggugauguuggagguguugaugguguaauagaugaugauggugguggcgacgguagccaugguagagauguugguggugauaauggaggugguggugcugguaguggaggaggugguagugaugauggaggucauguuagggugauggugaugauggagguauugguggugaugauggguggggagggaaugauguugguggggugggacuggugaucgugggggucaugguagggugguagugaugauggagguauugguggggaugauagagcuggggaugggguggugauggugggguggauuggugaugguggaggugaugguggugaugauggagagauugguagugaugauggagguggagagagguuggugaugguggagugggauuggugaugguagagaugauggugaugaugaugauggaggucacaguagggugguaaggaugauggagggauugguagugaugauggaguugaggagggggcggugauggugaagaugcugaugguaaugauggaggugaugguguuauggugguggcagcugccacuuacuuaggauuucuuuuguccuaaccucugggaugaucuaauuucaccuacaccucugcauccauaauuuacuacaugccuauuaaguggcagagcuuggauuugaaccuaaguuugucugacaccaaaguccacauacuucacaggaauguugcguugcuucucacguuauuuccaguccaccauaugugaauucuguguauuuucacagaauaaugacaccuguauucugguacugugggacuaguauaagauggucaaacugcuaucaaugauucuauucucuuugcauauuucaguauccaacaauuuauuuauaagaccaaaagaccuuucugaacuaucauagguagccuguguuaggaccaucuuauauaaacaauuuucucuugcuggaacuaucuggagugacugcauaaaaaaagaaguauaaucaaaaucggauaaaccucccaguagguuagucaauagauaaaucaccauuguucuuacuuauaggcuguaccucuguguuguucauaagggauuguacaguaaccagcaaauuuguaaauguuuagcuaaaauucaauaacagaaugaucaaguuuuauugccacuuuauugaggcuuuguuuuccguuagaaagcuaccauuugauagucuacuaaaaaugccagaauuuagcuguauuagguuuauucuuaauucauugccauuauggaauguuccuauagcacaagugacaggagaaauccauguauaaaugucugugcuacaugcuauaagcacagugauucccaccuccacccuccaucuucucaaagcaaucaugugaaguaucaccagcuaugagagacagaauaugcuggaggcuaaauuucuuuaucuuuaaaauguuuccaaaaauggccagaggaguugauuugcuuuuguuuccaugaguauuuucgcuauuaccuuuagagaucacuaacucagagcaguucauaugacuuucugcugucaucauccugaccccugccuaaacuuuucuuacuguggaaaauauuaacaauugaccuuauucagacauuuggcaggcuguggucauuauuaauuccuucuugcuuuucuacauauuuuaauugcccucgggaucugguauucugaagaaugcuacuauuggccagcuugauaaguuugggaaauacucuccucuucauagcucugaguuaguuagccuuauaggacuaguaaugagaguugaaugaaagaacuagaaauuacuagaucuuucuuauaagggaaagcucuucuuagcuaacauuuuaaaauaauuuugcauuuuuuuguuuuucaauaguuaggcuaucuguaugauguucuuaagagaauauucagaauuauuagcuugauuuuaccaauaaagauuagagacugaguauacagauuugcugggagucucuuuuucaugcuaagaaaugaaguuauauuuuacccaggccucccugcuuaucaucuuuucauuuuuucccuuccuccagacagcccauccugcugagccaauacacaguuuugaaaugguuuuaugucuaugagcaccacaugguuagucugcaggaaucauaauaaugucuuggacauguguuucaagauagcucagccuucuuaucaagacuuauaucucacaggauaucagaggagggagggaauaaagcauuauauuagggaaaaaagcauuacauuagggaaauuaagaguuuugugcaggguuaucaaaugaacguuaauauugaggaauguauaucugugugugugauuuuuuuucuccaccuguggcucugcugcgugcauucacauugugcaugcgugggcaucucucugcugccuuauuuuaucugauuuauuuuuuacaacacaaucauuuaauuugacucaccugagggguuauuucauuaucagcauguuguccacuucuauguuaggucuauuuugauugaaaccuuggauuuuucccuucaggauuguguguuggggugggggcauacuggggaugacagagggagaaagaaagauuuuuauuuuuccuucuaauaaauguucauugagaaaguuauagaauauggagaaaaugaaauuuauaacucuccugcgcagaaauacuguuagcugugaguuucuuuucuauauaugcuuauauaguugagauuaugcauguauacaguucugcaucuuagcuuuaaaaauaaugucacaucuugauaauuucccagucauuaaaauuauuugaagauaucauugauguaucaccuuauuuuauauucuauuugaauaauacauccaaggucaccaaaagaugacagugaaauguauuguuuguaaucuacauuagcaucaguaaauauggaccauuuaaauuguguuaagucaaccucucugaucuuauuuuauuaaaguuuaggauaggcacuacauuggaugggacugugaucuuaagagucucuuaagaggcuauaguuacagaggcuaacuaucuuugguuuacuuaacuuuggccgcuuuuuuaauccauauacuauaccccaaauuauggucagccaucuuaaaaguauccaucuuuuguaucaaaaggaauuuagcaaauagauguauguagauuagugcaaacucauucucacuuuuguaaaaaauaguuaaacuugaugucuuacaucuguagacucauuuuuggauacaaagucuuaaauaguuuguguuagucaaauauaaagaaguugaagcaucuuuguauauucuguagaucauagauccucauugaaucauuuuacuauaguguagucuuuaauaguuuguaaugucauuagaaguaaacucaauaauucuuauuacuauagaauaaacaugcuauuaauaagaauagaaauauuguuagucauuuaugcguugaaaagacauuuccauuuccugugcuuuuccugaccucagccaguacauuagcacauucguacacuggcagaaugcuaacuagauguuaucacagauuauguaucuguagauuuaaucuuuucaggacuuagcaucagcaaaaguaggacaguuuuuuuuuagucuuuguauuccaucuaaacauguauugacauucucaagaaagucauuugaacaaaaaucccaacaucaaauacuccagagaaggcaucuccaggugcaaauuaugaucagauuaugggagauuuaucuucaaggucacaaaaguaugcuagcuuugggggaagcugugucauagugucaaguggaacaugcuuguuuauuugguacucacgcaguguuguuuauacugaaauacuugaauguaugugcucaccugcuguuuuucuucugccuuuuaaaagucuuggaguacaucauuauaacaaagcaauuuuuuuuugauuuugcauugcaaguuuuuguuucucucuaauaaugcaguuuacuucuaaguguggcuuugauaggaagaugucagaccuucgaguggaucacuaaauaauaaucacuugucuaucagugagcuuguuauaagguguguugcuuuugaugggcuauuaccugacugcugggucaaaguuagucuugcucuguauugggcaaucuaaauuuaagccuugaagaguguccagauuguacagaauuucugauuuguaucuggucaauacugucagaauucaguuuuuuuuuuuuuuuuuuuuuuugccaguauuugguugaugggcauuaguuagcugauaaaagugguauguugugguggggcauugugggagauuagacauacuuuuauuggaauauauuuggguauuuuaauauucccaucuuuauuugggauaauguccaauuauuuuuuucacuuucagguauaaaguguuguguuuuucuucagcauuugucuaaugguagcccagcucugcaaccacacaauuaaucccaaaccgccaugaaaaaucaaauauucuuuuuagcuguggucccaauuaugcuggagacugaggcaggagaauugcuugagucuaguugaguccagccugggcaacauagugagacucuaucucuaaaaaaaucagaacaaaacaaaagaacaggaccgggucauaagccuaauucaugugacaccaucaagcaucagaaaaaaguaguaaucauagagaaguuuuucauaaauaaauucugaaucauauuaaaauuuaaugggagaaaugaaguuugagguuuucuuuuuuucccaugaaaauaaaauucagaagauguuuacaauuacucugcuaucuuucucaaaauagugguuuaauggcaaaccucucggaaggacucuguaucuuucuuagaggugcugaaggcauugcuggugcucaguucauguuuaauaauaauguuauucuggauugaaguguggcuaguauaccaggguuaaugcuggugcuuuaaggagaagggugauuggcauuuuaaucaguggaaauguucagaaccuuugucugaacgacuguauuuccagcuguucagauuucucaguucugguucaguaccaauucaaagcggagagcuccaucuacugaagaccuauuucggaaugauuucuucuguugaguucagugauuuucuguuugcacaggucauugaauuuuuuucugauuuaugagcuccaaugaagguuaugaugaaacuggcaauuuggucauuucaaaaccaaauuccuugucauuuugcuuagugccuaaauccaaaggacuuaccagggggcauucuuaauuaacuguauuuaauagucagguuuucuugggaccaauguagauaguaagacugcucuuaagaaacuguugcuauagauggucuuucuuuagucuuccguagcugaauccccuuucauagacucacauugggauuuuauugacgaugucauagaacugcagugacuuuggugucaaauuuaggcuugacuuucagucuugcuacuuuggauggcucaagugauggaagugcaagugacucaauuuuuauaaaccucagauuccuuuuggggacuuauagccauguuuaaucagucuggacuuugcuggaagcgcagaagaaucuucgaaggguuuuaaauaggagaucauucauauuugcacuauaggucaaaccagagauuuugguacccagaacuuuagcugucacuucauuuagagauuaccaaagcugcugagagcuauguuguccaagaucauauacuuuccugguuuggcccauagugacugaucagugaaggggguauaaaguccaggccaucucagacagacucugaauaacuuuaaagggacauacuuucaugacaguguaacagagaagacacuugaagcagauauaaaaaucacaagcccuaaaagacugacuuaaaaaaauacauuaacuuaaaaaucuuaaauauaacaaaagacauuaaaacaaaacaaaaugauagaccacagacugguuguauguauuuguaacucuucuaaguggucaaagagaaguauccaggauuugaaagaagucauacaauucaauaagaaaaagauaaacaacucaauggaaaauggauaaagaauaugacuaggcaauucacauaggugaaugcuugaaugaccaauuauaaaagaugcuuaacuuugcuaauagggaaaugaaaaguaaaacccuggugagauuccauuuuacaccuauugauugacaauaccuaauaagcuugauaacaccaaguguuggcaaggaugagaagaaacaggaacucuuguauauuacugaugagaauaaauuacuacaaucuuuuaagcaagcaaucuagaaauaucugguaaaguugaagauguccauauucugcaacucagccauucugccuuuauguguuagccuaggaaauugucacacauagaaauaaaagagacauguacaaggguguucauuguagcacugucuacuucaaauagaaagaaagcagaggaaugcauaaauguagggugauguuuccuccauacaguagagcaguuaaaauaaacuaguugcacauguauccacauggauacaucucagaaacauacuaaggguaauguaaacuguaaaagaguauauaauauauguaauguaacuauuauauaugugauauagugauugucuauauucuguauuauagauaaaccuuuuuugagauauaaguuugauaccauacaguuuaccaauucaaaguauacaauucaauggcuuuaaacauguucacagaguuguguaucugucacugcagucaauuuuagaaaauuaucauuacuccacaaagaaaguccguucucuuagccaucagcccccuacccccaaccgcugccagccugucauauucuccagcccuaggcaaccacaaaucuacucucugucucuauguauuugccuacugacauuucauauaaaugaaaucauauaauauguggucuuuaaugacaggcuucuuucaguuagauaauguuuuugagguucaucaguguuguagcauguaucaguacuucuuuuuuuauugcuggauaauauuucauuguauagauauaccacauucuguguauccauucauuaguugaacauuuggguuguuuucacuuuguagcuauuaugaauaauguugcuaugagcauuuauguuuaaguuuuuguguagacauguguuuucauuucucuuggguauauaccuaggaguggaauuacuggauuccugguaacccuauguuggaauagccaaauuguuuucuaaaguggcugcaugcuuuuacauucccaccagcagcaucagagggcuccaguuucuccauauccuuguugauacuuguuacuguucaucuuugauuauaaacauuuuagugggugugagguaguaucucauuguaguuuugauuugcauuucucugguggcuaaugauguugaucaucuuuuucaugugcacauugacuguauauagauuuguaaagcauguaaaacauuggcauauauuguuucucgauacacacauguaugaucaaaguauaaaaaaaugggaagagauggugaguggagcuuuagcuauauuugugucauuuuauuucuuaaauaacaaagggcauuaagcaaauaaggcaaaauauuagcauuuguuaaaauuguggugcuauauacauagcuguuauauuauuuucuaaaauauagauauguauaguuguagucaacaaccucaaaauaauaguuguuguaaugagaguagaaaauuuugccaaggaacaauuaaaacauaauacaaguugcagaaaugcuuuggugcaugcuuacauuuuguugagaucugacaaacgggaaguaaaauuuggucauaaaagucuaaguuggagaaucauuuauuaguacagauacuaaggaaagguugucaaccaugucagaucacacagagagggagcaaauguaguuaaauaaaaaacaacaaaacuuuauauuuggcaauucuuauuaauauccuccuaggaugcaguuuucauuuuaggagcaagguucaaaaucaaauuguagggaguauacaauauaugcucuaugagaaaaaaagacugugguguaaaacacauuaaaaagguugucagugaauugaaggagagaaauagggcuugaaaggaaagauggagcuaagaaguuugccuugugcaucaaauuugguguaguacuugaccaucacccaugugaacaguuugaaauuucaaagugguaccacagcaacauaguucugauuuagauaccuagagugacaaguuuuuuauucauacuuucucucuuuccucucuuuuaaaaagauguaauuugcauauaggguuguuucucuuucuagcacucaaagauccuuugaguaaggaauaaugguuucuauaauagcacugccaaccacagaauauagucagaugcauaaguaaauauaucuugaaaaagaacuuuauccagcauggagagacuuuguaugugggaaagcugugaaaaacaugggaagaugagacaauguguacaaagugccaucaacacuaccucacucaugaucggucaaucuuaguauucccucaugucuccuccacuaucagauauuugagaagaaauaauugaggaaaacguuucagaacacucugaaaggaauggagagaaagggcaacaguacauuuuuuaaagaaggauggaugaaugacucucugcuugcagggagggaagcuaagccgauguuggaguagaggaggagcugaaggaaugcacggugagugcccuccuguugguaggaagagggccugguggugaugaagguagcaaugugggauauuacagggaaggaacaacauuuggagcaucuuuggaugagugaagaaaugaaagacagaugucuaaaugcauugucuaacaacauugaggauucacauggauuuagauaguaugaaugaugaggucuauaugauuaugugauuuuuauaccuuggaagcugggaaugaagaauagcauacaggguguguaauagaagggauuugcagggcugcaaggaaagauuugguggcgacauggcaauuuccuuaauuguuugaacaguucuuuuaugguuaaguaauucuuuuaauucuguuuuaucauaggacagaacuuaggcacuaaagagucuaagaaaggcagguuccugcccagucaaaagaaaucaccaguaauuagagcuaucuaaucauagaauacacugucuuuagagauagggaguuuccuaacaagggaaggauucagagagaggcuaggaugugaagauggaaggucugacugcgugucaacugaaaccuuuuuuacacuuaagguguuaaaugguuuuguacucagaacauugaugggguaaaaaaaucucauuuauaauuaagagcagaauaaauguagugacuauaagaaaccaggcgagguuagaauacauguagugacuauaagaaucaagguuagguucuacuuguacacagaauggagccaaggaucuaagacaauuggggaacaucuaugccauaguuuacguccuuuuuucugccucuguacuagugacaucaaggacagaucauaugaguaauauccccucuugcuugcugugauccuugaccagucuaccucaucaguaccuuuagucaccaugguuuuuuuacccucauuuaaaauuucauuugaaacaagucauuauaauuggcuucuuuaaaauaaaaaaccaaggaguguuaaauuuauuuguagacugugcaugugaaacauuagaauucuuuauagauuucuaguuuuugcaugauuuuuaacccuuggcaucaaucaguagauggauuuuuuauuuuaagugaaagccauaguauuaauaacuaaaugucucuuccauguuuuacuaaaaaaguaauuccuuucuacccuuucuucccacuuucaucuccacuugguaauagaaagaacauagcagauuuauuaguuucacucaucucauaaagauaaugucaucaaacauguuaugaacauaguucaggacaagagacaacuauauguauugauuccuuucuuuguuccgugcuuuacauauuuagacuauaggcuacaaucuuggagaaucccagacucgacacuuuuuuuguugcuguggcacauuagugcccagaaauuuaguauugauuacuguaguuucucuugccucaucugaaugugaaaggaauggcaaaguggcuucauucauaauguuggccaguuagcucuuuuugcuuacugagguuguacauugguuuuggagaauacggaauaaucaggcucagaguuacuuucacauuguacugcuaagauacuguugaauuaaagucacaguguucauggaaaauaaugugucagaaauuacuaagaagaaugucugaaaugugcacagguugugaagugcuggagagaaaaaaaugggucagugcauugauucucuugggguaagggugaggaccacauucuuuaaggggugauaacaggagcucuaguuaaaacguuucuaaauauacacgacccaccuccugagguucugcuguagcugucaccccuaggguuuguuguuuuccuuuauucugcaugcaucacucuguguacucacuacuaguaguuacuuuuaggguuauugugaauauuguuagauauaagaugaauuggugcauauccucugacgcugggagaccauuguaauugauuggucagguauuuuauagcgaacuucuauguagaauauaggauuagauaaagccuuuguauacgguaagcuuucagaauuuaaauuaaaaaugaaaaagucaauggagauuuaugggaauauauuguaaggaugacagauaauuucaguggugagaaaaaggucaucuuugacuauguuucaaagucauaaagugguucaauaugauauuccugguguaagugaauucaaggaguguuguacagcagaggaaauaggggagacauccucugaauaacuguuauuucaagaggcuggguguguaggcagaauuaaagaagguagaaguggagagaugguuucaagaaaauaacaaggugguuucaauuugagagacauuagaugaaucauguaaugaggauuuugggugguuauggacuuguagcaccaccagcagcauaugagcugauguaugguuaguaggacugaaaaaaugucaaggaagaggaggaaaggagacucaugguauggaacagauuaaggacuuauuuacagaugcagugaaggaagacguuugaaaugcuccaauucuucaaguugguauucaugauuaaaauaauuaagaagucaguuuugagaacuaacaguaaaggaauugaccaccugacugguguuuugaugugaagcagauuuaaagggauaaaaucuguaugaugggagaucaggaaggcagcaguggugcauucauacacagccaacacucaaguauuuauuugaguauuguucuggggagccauggaggauaugguuuuuguguuuuaaggggaucauagucugauuggcacagggauaacaucaaaggccaacccaaauagaagacagcaaauguuggugugucaaaugaauguuagugcuguuugaagugugaaucccagaucccaggccccaauccaaaccgacucuuauuauuuuccuauggcugccuacaaauuaccacaaacguaaugauuuaaaauagcacacacuuauuaucucacagucucugugggacaggagucugggacgcugagaugguuccucugcuucagggucucucaccaugcugcagucaagguguuagccagcucuggguucaccugagaggcucaacugaggaagagucugcuucuucuuuuuuuuuuuuuuuuuuauuauacuuuaaguuuuaggguacaugugcacauugugcagguuaguuacauauguauacaugugccaugcuggugcgcugcacccacuaacucgucaucuagcauuagguauaucuccuaaugcuaucccuccccccuccccccaccccaccacaguccccagagugugauauuccccuuccuguguccaugugaucucauuguucaauucccaccuaugagugagaauaugugguguuugguuuuuuguucuugcgauaguuuacugagaaugaugauuuccaauuucauccaugucccuacaaaggacaugaacucaucauuuuuuauggcugcauaguauuccaugguauauaugugccacauuuucuuaauccagucuaucauuguuggacagagucugcuucuaagcuccaguuguuggccaaguucuuuuucuugcugcuccaggauucaugacaacuugcuucuucaaagccagcagugggguuggugggagggguucugcuagcuucagagucuuguauagugucaugugacagccuaucaucuuuuucauauucuguugguuaaaagcaagucacaguucccucccacgccgaaggggagggaaacacacaaaagcguggacaguaggaggugaggaucauggggccaauguaaagucuugucugugacaccugcuggaucagaaucuacauuucagugacauuccuuagacgauuacauuuuaagaaacuguuacagaugguaggugccaaagaagguugauuuagagggagaagaaaguucuuugggcuugaccuggccaggugaauuguuuuauggucagcaaaauaauuuguuguguaaaagcuuauucacaucagggaauuuuugguauucuuucucccugccacuucugcuugaguauaguguuuuucacuuuuguagugcuguuguacucucugagagaguuuguaauuuccuaacuugggcuuaagaaaaaaaaaauuguuccuuucccuuuuacuauuccauuuugaugauagggguugguguaaacuaauggacaugcucugcccuaauagcagaacaaucuugggaaagacauugaacuauccuuugcaucaauucuuuuauauguuaaguucugucauucuucucuuacagggcuguugugugugaauugaaugaguugaaguaaaaguucuugguaaaguguaaagcauuauauaauguugugguggacuuguuuuguuguaaugccuuauucacagagcugcccccuuccuaccaauaguaguguguauccagaagucaugauuguuccuugauugugucuaaccacaguccuucagagaaggcauggauggcugauccaaacugggucacacagauucuccaucuugggaauuuggauuugggaccaaaugaugacaguuuaguccuugcugaccuaacguaaagagauuagaauccaaggaaauugugguacagcugacuucuacuguacgaguagcagagaauguuccuugcagaggacagagggaacucagaucugaagagagaaggaaaguuauggagaaagagggcccacugcugggggccugucugcuuuugauuuccugcuugcuuuucuggguccuugcagcauuuuugccuuuaaguuguauaacacauaauucuaaaucuguauauuaguaauaauuuucccucuuuuguucaagcuauuuugaguuguuuucuguuacuuucaacuagagagcugaaaugggagccaauaaguguguacuuaaaaauuuuuaaaaaucuccuaacuacucauucauuuuucccccaaugccuacauaauuuguuuuuaaaggccaauuauauugcuucauucauugaauagucauugagcauuuuuucaggauacuuuagaaauaccaaaaugaagaauaugauccuugcccugaagcaauuuuuuaauuuacuaagagaaauggacauuuaaaugacuaccuauaauacuaggcagaagaaagaaauaagaacuaugugcaauucauuugagguaauuuuuauguuaugcccaguaaccugauugaaggugauuaaaaauuucauuuuuuugcaaagaacugagcccuuuugucccugauugaugauaagguccugacaugcuuuugggcccaucauuuuugcuuacgccucugaacauugcaaguaggcugggcagucuggccauauauaccuuucuucauuaaguaggcagaggacaauacaaugagauaggcaaaacugaaaacaaaacagaaguuuaaaucggagauuuuuaaaaaacucgcuuagugaaguuauuugauuucuugauuaggucauccuuuagcucugggugauuuccauguuuaagcuugguuuuagagguuuugucuuccuuauagcuuguaucauguauaaaaaggguacuuauauaccuuauauuauacaauaaagaggguauugauauugcuugcauugcauaauaaaaagggugccuaacauaagaguucuguguuuccuauaguuugcauuacauaauaaaaucagugcuuaaauuagaugggagccagugaaauuauagucaaacugcaugaagcugauuuuagaaccacauuuucuuaaaauggagguuauguagguuacauguuuuacuggcucauggagcucuucaaaaugacccaguucagaaugacauucaacuuagagcugauugaaaugggcauugguggaaaaucccuuggggauuuguggagcaauuaaaaauaaccuaggaaucuaauucuuuuuaauaauagaaaaaaaaucuguaguuagaauuuuagagaaguaugugaaaguuuuaucuuacuacagaaauuaugggaaaugcuuacuuuuuaaaaggagaaagggaaagaaucucauguugaaaauugucauuagguaaaguaauagaauuaauggagcaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacuggggaggcugaggcaggagaauggcguugaacccgggaagcggagcuugcagugagccgagauugcgccacugcaguccgcaguccagccugggcgacagagcgagacuccgucuccaaaaaaaaaaaaaaaaaaaaaaaaaauagaauuaauggagcaauccaaaaugagcuaaauaaguuucuuugugagaauucuucuagagauuaauucuagaauucuucuagagacuucauaauauaugguaaaacuaauauugcugcuuagauauucugugucgucuuuuguccucacuuuagguaagcaauauguacgccauagcacucucuaucuuacuuuacaucacuuugcucauuuggugauuguguaggugugaguaugugcauguguguagacuuuugucaguuuccuuccugcuaaauuuuaagcucauugaaaguaagaaccaugugauuagcuuauuauuauuauguacccuguaccuagugcuguucuuggacauaauagugagaggugacaacgugcuagcagcccucggucgcucucugugccuccucagccuuggcauccgcucugggcccucuuuggggcuggcagaggcugaagccggcuuccucugcucguggggagguguggagggagaggcgcggguaggggccagcgcugcgcgcaggccuuguggccggcacgggaucugggugggcacgagcucggagggcccgcacuuggcacagccagcuggcgccugcuggacuugauagggggacgagcucccucugggcugcggagugccugggcuaggugccgcaaaguccuguggcgagugcuagcgagaggugaagccggcugggcuucugggacagguggggacuuggagaacuuuucugucuagcuacaggauuguaaaugcaccaaucagcacucugucaaaauggaccagucagcucucuguaaaauggaccaaucagcucucuguaaaauggaccaaucaguaggauguggguggggccagauuagggaauaaaagcaggccacccgagccaacagcaaccugguggggucaccuuccacgcucugguagcuuucucuuuguaauaaauuuugcugcugcucacucuuugggugccugccgccuuuaugagcuguaacacucuuaugagcuguaacacucacugugaaguugugcaccuucacuccugaggccagcgagaccacgaacccaccagaaggaaugaacaacuccagacgcgccgccuuuaagagcuguaacacucaccgcgaaggucugcagccucacucugaagucagcgagaccacgaacccaccaagaaacuccggacacaucugaacaucugaagcaacaaacuccggacacaccaucuuuaagaacuguaacacucaccgugaggguccguggcuucauucuugaagucagcaagaccaagaacccaccaauuccaacacaauagguguuuaguaacuacucaaugaauaaaugaauauuucucauaaccuuguacccuacaagcguuacucauaaaaagauaugccgggaauauuuagagguaacauuauuuuuauugucagaauauuguauauucgaugugagguuuagcacuaugaauagagucaguaaauaauccauaaaaaugugaucagcuugacucuuguuucuuauauucucucagagagaagcuaaacuuaagagagagggagaucaauagaugagacauuuaaaauguuuagccugugacuugguaaaugacuaccaaaauucucuggaggcaaagccuguauaaacuagguuggcuagcacacagaaaauguuaggggaguucccaaagcuucagacuaaguuagugauggcaaccaguucagugaggaaacaacaguauuuuccuagggccagagcucaggauggggagacacugccaugguacccuaugagggaaggcauggacuccaugaacugcaguuacggugggcagggacaggaacuucaaagacagugagcugagcagccauggaagcuucaggggauagggagauguugguagggaguugcuuuuucaagggaggacagaauuuagaagucgguagucuggggaauguaaaccaaaaauaaaauucuaaggcccccaagucauuugaauggacuuccuccucagccaagacacuuuuuuuguucguuuguuugagauggagucucgcucugucaccuaggcuggagugcaauggcgcaaucuuggcucacugcaaccucugccuaccgguucaagcgauucugcugucucagucuccugaguagcugggauuacaagugcacacugccacgucuggcuaauuuuuuguguuuuaguagagacgggguaucaccauguugcccaggcuggucucgaacuccuaagcucaggcaauccacccgccucagccucccaaagugcugggauuacaggcgugagccaccacgucuggcucaagacacucuuaucauuuaaucugaaagacuggcucaggucaugacgggaacauggggaguuggacaugccccauuauaccucuccagcauuaacaucaacacagacuuuaagucugaggagaaacauuuuacaccuuauucucucucaggccuacaaccugaaggcuuccucugcaaauaggaacuuugaucuccacaguucuuucuccuaaccccgccauucauuucuauugaucccaggucuuuagauaaacucaaccaauugucaaccagaaaaaauuuaaaucuaccuauaaucuggaagacccugcuuugaggugucccaccuuucuggaccaaaccguuauauuuccuaaauguauuugauugacgucugaugccucccugaaauguguaaaaccaaacugcaccucgaccaccuugggcacguguucucaggaucucaugaggguugugccauuggccauggucacuaauauuuggcucagaauauaucucuucaacuguuuuacagaguuugacucuuuuugucuacaggaaggagaugaucagcacccacuucccguagauguuuucuguuucugguaaugauguuuuugguguuagggaauucagccuuggcuauucuauguucauuuuaagguugguaacaucaugccccaguuagggguuaugugucuguaauugccacaggagcagcccuguguguuaugccugcagcuggcucugaaucuguuaaggaaagagcaaguaaauauuuucuuacaaauauaaaaggaagaguuaaacacuuauuguuuggaaaccaagcugaugagcauauuauauugucugaggccccagaaauaagcaaauuaauuacaugcaaauaacuugcucaugaagugugggauaauaauaguaucuguuuggauguuuauggcaaauuuauuuacauggcucaauuuucugcuaauuuuccuguggaaaauaauaaauauugguuccuuuugccuuucuuuuagaaauacaucauugaaauuaugaaaacuguuaccaugucuugcuaucuuugcuuugccaagggcaauuuuaaagacaguauuuguaaauacauggugaagaaagaacuauuaauguauguagguucuuucugcuguaaacagaugguugucaucaccaacaucauuaaauaauacagagguuauuauugaauauuaacauucaguaguucaguugacuuccuguugaucuuuuucaugaacaucuuuugaugucagcuucuugcugagcuucagacauuuccucucuuaagguauaacagggaauugagcaguuuauauugacagugugauccauggucucugucuuuuucauuaaugaguaauuggauucacauugaaaagauggcucuaagcucugccuagugcuccauacacucuaaaggaaccuuagcauccaaugugacucuccugaugcucccauaugugugguuuuuuuuuguuuuugagguauaucaaaggugauucgaugaguuguuuuauuuuuuucaagauaaucauuuuuuugcaguucauuaacuuggauuguaugucaggcgccucauaagcuaggggaugagugugggauugagucuuuaguugggaugaggaguauuuguuuuuguauccaacuuuauaggcugugcugcucgacucccagccuuucucaguagggugauccacagcucuacuagguuacuauuuuauuuguuugcugucuguaugcuaaggcucaggcauugacaucaccucuauacguuuucaucaacaacucugacauuuugacaugacaaccuugaaacuauuaucuuauggaaugccagacacaugaucuguuguucauaaagcaguaaguagaauggaaauggauuuuucuuuuaauuuuugguagagcaggaauuuuaaccuccagucagaaaggaaaacagagcaguuuguaucuuggauuagcuuuuaucagcuacucugcacccucauuuuugccaucuacaagugcguuggggugcagggagaugugggguuggcacaggaagguugagccacccaacucuguacucuguaaauuaauaucuugcuuuugcaugaacucucuuugccgguuuucuccaucaauugccgugguagagaugaggcugguggccaaauauuuucuucuuguauuuccaguggguaagggggugguaccacacacacuuuggguauuccauuguucuuccuuucaguuugagguucccauguagaaaaauuacacuguguuuugauaaucugauuaacagaagggaaaaaaucaauugguagauuuugaagagagaaucaauuuccuuauuacagaaaaagaugagagacauaacuaccuuguguuugcaaauuauuugcuucagucugugaugcuuucaagaguuugagaaauaggguauuuaacuucucaacuuaugccugauaggaucacgguaaaagugcuccagccuaauggaagcuuaaaaaugcagcucuuagaauugcuggaucacacuugacagugauuuguaugucuacggcuuauuaaaccucagcauagagaauguccugauuuaaaauuuuucaauuuuauucacuuggucugaugugaggagcagccauccuuccuguugucuuguguagucgaauguaaauuucucagccacaguuaaauuucuggucaaggccaaccacacugagcguuaaggaguucuuucucccuuggacuucucaaucagagaauugcuaacauuucaccuuugacuuuguucucuauugacaucuaaaugccauuuguuauuccaguagccauaagcauuugccaucaagcagagcacaugccuuagagugaucaggaagaagcaaugucagaacaaaugguaaucacucugugcuaauauucuauucuguucuauucuguucuguucugcucuauucuauucuuauuuuauuauaauccuuggagcauauccagcuuuggcuaguuaugcacagacucaaugcuuagaaauuugcuguuguagaauuuguaaaucaggaaacggauucaauaauuguggcuugaagacuuguuuaguauaauauucggguuccuucaguuauauucuacaucaguguguuuucugguaugccacuugcuuucuuuuaugccacaaacaucuguugcugcuuauuguagauguuagauuuugagccaggguauaccaggacuuacuaaaguuaauuuugguaaaauugccugcaguaaguaucaucauuuuucuuaaauuuuuuucuuuuguguuuuguuuuucccuuuuucucugaucagaaguuaccuuaugaauguuauacauauguguagauuagaaaauucuuauaaugagucagaaguugacuauaggaggauuguggaaauauugaugccuuggaaaggcugaaguugcagggaaaguauuaagcaagagaggcgugguuugagaauagggauugaggugauugacagcacggguuggaagaacaaugaugaaggagaaguagugaggauauugauuuaguaagugaaagggcacugaaagaacgaagucuuagaauauuagagaaagaauugauggaaacaugacuuuuaauuuuuuuuugaaucaaucuugauguuuauuuuggaucuaaaauaaggaaccaaguauaagacugcuuugaaaucauaaucugaacauuauuuuaaacauuucacuagcaaaucaucugcuuucuguuucacuaugccguuuucuaacuuugcuaagaaauugauucuguuacguauuaggaccuaaauuuuuuccauaauuuuuaauuuuuuaaaauuaaaagcauugcgauauaauucacauauaagucaccauuuuaaagaauauaacucaauagguuuuaguauauucacaggguuuugcaacuaucaccacugucuaauuccagaacauguucgucacuccaggaagaaaacuggccuuuagcaaucacucaccauuagcagucacucccauuccugcuucucuucagccuuuggcagucaccagucuacuuucugucucuguagauuugucuauucuggacauuucauguaaauagaaucauacaguauguggccuuucugacuagcuucuuucauuuagcauaauguuuucaagguucauccauguuauagcauggcaguaccuaauuucuuuuuauugcuuaaucaugagacaggagaauucccuugacccccucaugggacuugugauggggguguggcccacuuacugggcugcugcugagcucacaccucuuguggaauggggaacacacaggcaaacgggugccagggcugggacaaacgcuuuugggcuccagccccauggcagugucuagggguguguuaaaauuaaugcucuuuuagcaguugccaucucuggacagccucuuacacccugcccucuugguaccugaguuuuugucuagcauccaggaagaaucaggucacauggacuugaaggauguggagauuuuauugagugauggaaguggcugucagcgggauggggagcuggaaaggagauggaguggaaagaggaucuucccucaucuccaaccguccccagcugaacuccuuucgacauucaguugcuucuucucuuuucuccuucucugcugcaaugcucuguuccucugccaauggaguuugggguuuuuguggguacaagauguggggcauggcgggccagggugguuuuggaaaaagcaacauuugagcgggaaaacgggauaacucuucucauuuagggcugugguuuccaggcuugcggguggggccuuugcuggggaacugcccucuucuaucuaauauuucccugcuucugguccauaucaauaauauuccauuauauggacauuuuguuuauccauucaucaguugguggacaucuggguugauuccauauuuugguucuuauuaauaaugcugcuauaaaaauuuguaugcaagucuuucugugaauauuuguuuacaauuuuacuauaccuaggaauggaauuguuggaucauauaguaacuuuguguuuaacuuuuugaggaacugccaaacuguuuuccaaauuagcuguaccauuuuauauuccaccacgcauauugggcauauuauuugaaauguaacugauuuacuaagaaaaaauaguuuuacccuuucuaucuugccuuuuggacaucaucuauacuggaaugaguuacugucugauacuuugaaaggccauaaaauuguagagcuugagagguucuaaugaauccaucuuucuacuggaauggaaaaucccugaaguuuaggcaccuuguccauuuuguucacuucuguauccacuccaccugugucagcacuguaaauacuaggugcuuagcaaauuuuacugaauaaugaaucuaauccaacccguuuguuucguaaugagaaaagugaugcccagagaugucagguaacuuucuaaaggucacuaagggauuuaaugguagaacaaggacuagaauucugguccugauuuccuugccaaauucuugccuucaaagucaucuugaauucacuguucuuccugaacuucaugguccauugcugaccugauacagaauuuucugacaguuuuauagcugugcuuuggggguuuauugacauuuaaugaguguuuuuguucuugugaagucauuuacauguuuacugcugaggcuagcauucauaacaagaaaaaaacauuuaaauaacugcauuuuacccagggaagauaaauuacaguugccuaucaauaaguagauaacuuucauugcugccaagauuauuagauuguggaaggcaauaaauuuguacccucccuugugagucacuugccuuaaaaaauucacaacuaauuaucugaaagugagacagguuaguacagguuugcuaucuacuaguauuccuuucuuuccuaaucacucuugcagauggaggaauccauuuuaucagccuuuccuccuuauucugcucuuccagaguaauauauguguaaauuaaauguagcauagcuuaaguaagcauagauuacccuguaucugaggcguuguuuuuagagccacauuugcauguuaaguggaguugugugccaugagggauagguuuauagaccggacccguaaugaaguugagaaucauugugcaaaagcugcagacuacagguagacauugagagccuuugaauguggagagcguauauuucacuuccuuuugacaaagacuuuauuuuauaaggcuuuaugggaaacaguguguucaauuaccucaguuaaaacucauuccagggagcagacuauuaaaauacuacuugaaaguacugagauuucccccuuuuuguaacuuuugaucaacugauugauaccugguauuuaaaauaacauguuuaaaaaagauuccugaauuuuguuguaucugugagagauacccuagggaggaucauaagucuacuaugaucauaauuguguuccuggucuagucuaucccuuuaauguugggaguugagaaugggagaauauaaaagaauucuuuugguucagguaaaaaagacauuuuuagaaaguuagcaugggauagugaggaaaaaaaaacaaaacaggcuuuuauuuagaagauuuguguucaaauucuggcucuacaucuaauuaguuauauaacuuuauuaacuuuaccaaggcucacuuuacucauuuguaaaauguggaugauaauaauaaauuccuaccuuacaacacagcuuuguauuuggugagcuaauguaugggacauauaguaggcauuuaauagcugauagugaaaucugaaccugggguucauuggaccuucuuaagaaaauuuugguagauagauauauaaauauaaguaucauguuuauguaauauauguauuccucuccccccuuuauaucugcaucccaugucuuguuuccaguaggauuuaacugguaugugguugauaaguuaacuuuuaaauguauguaauagccagagccuuuuaaaguuaucuuaaaauguucacuguaaagcuucguuaauagcugcuguaaaucuguuugucaagugcuuuccacucucuuccaguuucugcuaaugcuacuacuauugcuuacuacauuauccaaguuggaaaccuugguaugaucuuuccugcuuucucuuuucuuuguaauucugcugucuagcaggcuauuucuaugcaaaacuaauacugcauaaaauauugucaaugccaauguaagguagacagcuuagcaaguacauggacuugaaacaccagaguaugcuaagcagcacucuauagcuguaauguauuacccuuugucaacagauuucugagacaucaaugaaacuccuaaucauguccguuuauacgauauaauaccaauuuuacaguuuuuuucugcuuaauucucauucuuauuuucgaaugguaguaguaucaauggcagacuucuguaaaacuaggacugacauacuuagaugaugagaucuuguuauuccauaagcgguaggauaccagaugugguaaacaaauaaccucuagcagccugaauggaaggaugugguagguuggauuauuguucagcaaauauucauucccuaaccuaccccacucccaauagccccccacccaaccuaugagagcagucuguuucgucauccaauugcuauuggacuuggucgugugacuugauauaaccaauggaauguuagcaaauaugccacuagcaaaggcuugaaauaugcuugugcaguuggacuuggucuuugcacuucuauuguuugccgugagaagaacaugcuucuaguagcugcuaauucaagaaggaugaaaagcacuggcucuggaccugaucugcagcuugguaccaagcccaguguaguccagccuacagccaagucccagauaaugagcauauaugugagcaaggaagauauacuuguuguaugcugcugaauuuugaggugguuuguuacucaguauuguggcgguagcugacaaauacagaaggauacucauuucuuuuaaagaccuucuuuaggcacuguuuuggaagcugcagcuuuccauguagcaucaagaacuuuauuguucaauggcaccuauuuuaaugccaguuuugucucugguuacuggcaaaacuguucaggauugaaagcucacuuuaaagaaaugcuuacaauucagaugggaagaagagugcugguugacccuggcuaucuccacaaaccugucuguacuuggaaguuguuucuaggaaaauauaauggccaguggcuccuuuuuuuguuguuggaucagcuaguuguauguccuuagugguacaaagggcagugaauacacaaagauaguaucuuuaauuauggaaggagccuauuaaaauuccauuuuaucuuaagaaauaaacauguaaaggaaucuggaggaggccaaacaccucuuuaaaauaaugauugucuugggcuaauuccuuuacugugccuucagcaucauuagaugccaauccuacuguguagguucauuugcaaacaaaacugauuagagacuggaggcugugugcaugagaccucccuaaagcagagguuucagaaaccugcacauuguuuaaacugguuacccucagcacuacuuuuauuuauuuucucucuacaugggggggaaaaagaagguuguuuauuucaaaggguauuagaacccauucuucaaaagagaauaccgaaaaagagaaaaaaagauauuguguaaaagcucagaagguuuucagaauuucccuuuuuugcccauuguaaacaugaucuuucccuuugcucugagcuccccccucuggcauuaaugguauauuucucuuucuguuacuacaaacuucaaagcuccccuccaagucauuuugcaaacuguaaaguaauggugggggcugcuuuuauuucccagaguuugugguggggguggacugagaaauguagaggaacuguuggcaacauuuauuaacuuuuaauuuggugcagaaaaaaucggaaaccaaguaccauacaccauugauguugcuucaaagauacuuugagcuuguuuaaccaauuuuuuaaagcuugugugccggacugaaaugaggugccuuuuauacagaccucaggauugugcugucauaauagauaaauccauaugucucuuuguuuuuguaauuaaagcuuuauccuuccucuuuuuugucuucaauggcuaucuuuguucugauagagaccgauugcuuuauuguaaguaaacuccuaacuauugugugauauucucuuuaaaaagaagacuggugaugccuaauuuauuuagcaccaucuaggaaucugauuuucaguguggcuuaauuuuccagaaaauagucucuccccuuuuagcauuaaagauuguauuuuaacaucuuuaauggaaauuuuauaaaauacauuucucagauuugguccuuuugucacaauauacugagcacauucagacuuuuucuggugacugaaggacugucauuuugaaccugguuaaucgaugcuuugguugcacuuuugcacacuacccuuuauugaauguauugugauacgucagaggucaucuugucacaugugaaggcacggacaacguuccaucgugcugaaccagucccagacuuccauuaaaaaaaaaaucauacuuguucacucuucauacccucugucuuuuuuuuccuugcuuuuuggggguagguuaucaugucuagcuauugaucgugucuguuucagacaagcuccucuugcuaaguugcucaacuauugugguauaagcugcaaaggcagagaaccaaggugguuagaauuguguguagaauaagcgaccagaaagcacucuguggcaucaugcacaugaauucucagcuauggauuguauaacauaaggacauuuugccccuggaaaugucccuuuuuucuuaauucucucuuccuuaguuucugcuauucuuagugguccaggcugccagguaaauuagguauucuucuguuaacaauggcagucaaaugauaccuaaaacaccuuuauuguagaauucucuauccuagucccauccaucuguauuuguguuacuuaaguuuuagcuauuccaugaagauccauuucugggaaaaaugcuccguuaucuagugaucuguuaauuucuagaaguaucuagguugaggguaaaguuuuugccguuuauuuugccaccuagauugugcugaauggauaagugaaugaauauguuucuuuugauacugaagcaaguggguuuuuucuuuuauuuuuugugauuaaauauuugguuaguuucuuuuuuccucuuaauuuguucuuacuuguccuuuauuccuuagagccacauaaggaagggcagggggaaagaauuugaauuaucucaguguuuuuuuuuuuuuguuuuuuuaaaggagauagaauuugcucuugcuauucauuucaagaaauuggugaucuugcaucagccggcuuguuuuugaaagauguuuuucuuggcauccaugcaaacuaacgauaugaacuguaucaaacccagaguggcgugggccuuccuuguacugccuucugacuucuucagcugcuaugucuguacuugcccuccuaugugcccugagcucugcccucugacugagaagaucuagaauuugacuguccucuuuaggccagagcuaucauuacucauauaaaugauauucuuuuugagauagcuuucuccuuuccucuucauuuggcaucaaaacuaauaaaugaugaaacuaacuuccuuuccaguaauuagaaccuuucucuuuuucucuuuuuugucucucuuuuccugagugaaggcagugugguguuaaaaaaaaaaaaaacccuaauauuauccauaucuuaugggauacucuacuggcauaauacuucuuuacuaaagccuagaaccauagacuucaguuuuggggaccugaucaaagaaauaagacagaccuaugaaauaaucagccucuuuaaguaucaucacauacccuucguguguacgagccaguggcuuucaauuugauuuaaucaguguaugguuauuaaugugcacuauauggaaugcacuguguucuaugcaaaaaaacuccaaaaaugaaaucuucauacccucccccuuuauuuuagcuuguaggaaaugcauuucuucuguuuugcuuguguggauaauuacuuuagaguaacuuaugaucuuuucccaugagcuuagugucaauuuccuggaggcauauaauuuuauauaaauuuaccuguuugcccugucuauaaauugaggaugaacugauaaaaaaaaaauacaucugagugacuauggauggguuugugugggagugugugaggaugggagaaacuuccaugauucauuaagauauauuauggucauaguaaaggcucauuuuaaaauuuuuugauuucuuuuuaaauuuugcguguuauccaaacauguuagaggauuucauuuuaaagaaaguacugaaaauauuugcccaaauuaauauuuguguucuacuuuuuuucucuuauaguuucucaaauuuacuauauuuguguuacuagaguuuuuagauuuuuauucugauuauggcuuaugauuauccaccagauguuuaaguauuuuaccuuuugcuauuauuuaugagagaaaaaaauggacuguaagcucccugugguacaauuuucuguucagaagaaauggaaaaguuugguggcauucauuuucuagcucauggucuuuucccauuuucgauuaucuggugaucacuuacuauuugcucuaaacuucagacuaaugcuggacaaugaagaagaaugccugugaccucauggagcucacaucuggaugggaaaacagugcuauugguuucaccacuaaaauuuuccguaauauuucuuuguuaccauuuuaagaucgauaggauauuuuauuaucuaaucuuuuuuccacuucacaucuuuuauuuccccguuuuucugugauguuuccauacugauuguaaaugacuccacaagugugugcaugaauucccuuaagcuccucugcuucccaucauccaggccugcugauugguaugaguucaguauugucaaguguuccccaucugcuuuuugucagucgcuauuuuugcaaagucuuccuucucucuaauuauacaaauaugucuuuuucauuuuucuugucaaagacaaauuaaaaagaauuaguucaguuucuuagcuaguuuagucuucauuaauuccaaaccccacuccauuuuuagcaccauuuuucuuuuccuagucuuugucccgcuuuuugguaauuuuaaaagcuccucuucucuugucugacuuauuuaaguagcaugaauuaauuugcuaccucugacucuuuucuauaaguuuuagcuaacucuaacaagauacuuuuucacucuucuccauauuuaguucagaucugucuuugucuguagaucuuugaagagucauuugugaaacuacauuagguguuucuuguucauuaucauuuuccccaagaggaauuuuaauccuauguguguuaauuauuuaauuauccuaaugaugucucauaugguaccccuggccucuugcacacugauggaauuaaucccuuaucccagggcuccucagaguuccugauucuuuaauguuuguacauuuauauuuaaauaguucuuauauuaguuuuuaaguaacuuuccccugguuuuuccuugccaucuugauuuugucucuuauuucucuaaugcccuauguucuuucgauuuaaauauuaugacauuaguuucuuccuuucuguugccuccaauggggguuguuauuaucuaauauacucugguuucaagcuuuaauagccaugagaaucgucuggaaugcuuguuaaaaguccagauuucugagucuuagcccagaaauucuaauucauuugguuugugaagagccuagauaugaagagccaaacaucccaaguuuuaaugagguggucuacugaggcaguccacuaugacuaccaccugcuaacugccauccuuuaucuuaaacgcagcagccagauuuuucaucucagaacauuuauaaaaugccugcucucuguaaggcacuguguugggcacucagaauaucacagugagcaaacuggacauuguuccugaucuugcagugcuuauaguauguugaauuguuuuccuuaucucaaaaacuugauuaccuguugcuuacagaugacaguaggucaguucauuaguauauuuugcugaggugcugauagaacauaagaacaaugacugggaaucaggaaauuugacuuacagguuugguuuuacuucugccucuguacacguguguguuugccuauguauguauauguauguguguguuucacuuguaaaaugaaggagauuggguuggauuaccacuguuccuuucagucaguauuugaaccucgguuuugguuuccaucuucaagauguuauaguuguuuaaaggaaauauaccauauuucaucaguucuuuuuuuuuuuuuuuuuuuuugagauggagucucgcugucucgccaggcuggagugcaguggggcgaucucggcuuacugcaaccuccgccuccuggguucaaguaauucuccugccucagccucccaaguagcugggauuacaggcccccgccaccacgcccagcuaauuuuuguauuuuuaguagagacgggguuucaucauguuggccaggauggucuggaucucuugacuucaugaucugccugucucagccucccaaagugcuggggcuacaggugugagccaccgcacccagcccauauuucaucaguucuaauguaucaucacuuaucagaccccucccaacuucagagauguuaaaaugugaaauaauauguaucauauauccaugaaguauaguguacguauuuaugugugaguguguuuguauuugugaggauaaugauaccacacaaagcuaccuucugacuacugacacaugguuacuugggaccaaaaaagcuguaucacuggucugacacuccugaaagacucaggauuuauuaagaaacauaaagccuguaacacaaaagaagcaaagauguaggaggagauuaucagucucucagcccagaugacccuucccauguuuucccuggaccugccucacuguugaauuguguaauguguagagauuccuaacaaugaagccaucagggagacuauaacucauuggguaacucuuccaucuaucacucagcucugacaucuccaagaaaccaaacucagaugagcacauugcuuauugugaguuauagcuucuuuauuuuuuacuuuuuaauucaauauauucauuuaaaggcauuaaaaaaauaaauuuagugauuacauugaauaaucacuuacuggcaacccucucccacccccacagggacacacaguuuaaccauuucugagucaaggccuugcauagguaacauuaacuacuguuuacacucuucaggaaguugucauaguucuugaacacuacaauggcuuucuuauuucucuucauguuuucacuggaucugagucuuccugggagggacagugacuuauucagggauucagaggaaaguaagguacuggaaucaauucugcauuuuuguaaaagcucucauucuguuauuuuucccaccuuuaucuccacccccacccccccauuaccuauucaauucugucuuccuuccaaguacuuuuagccuuagaauuaacuucucaugcuacaguuggucaucaguguucaugaugugacuggaaaugucagagacauuugaaccagagcaacuccaucuuggguaagggcuggguaaaauaaggcucagacuuacugggcugcauuuccaggugguuuuaagucacaggaugugaucagaggucagcacaagauacaggucauaaagaccuuguugauaaaauagguugcaguaaagaagcugggcaaacccacuaaaaccaagauggcaaugggagugaccucuggugguccucacugcuacacucccaccagcaaugugacaguuuacaaaugccauggcaaugcauucuaacuuccauagaggaaguuacccuauguggaaguuacccuaaaaaggggagagaugaauaaucuaccccuuguuuagcauauaaucaagaaauaaccauggaaguggguagcuaucagcccuuggggcagcucuguggaguagccauucuuuuuauuccuuuacuuucuuaauaaaacuugcuuucacuuuacucuguggacucacccugaauuauuucuugugugagauccaagaacccucucuuggauguggaucaggaccccuuucugguaacagaaauauuuuaguacuauugggagauuuuggcugaggucuucuauuucagaaguuuuaacaucaauagccaguggcaaaugcuaaauaaaugauacagacuguaaguaccaggggaguuacaggaaaguagagaucacugaguuguuggaaaaugcuucaagacgggagagauauuuacagcaaguaagauuuggagaaguaguaccagaaagagaguuaggaagguacacggaauauguggaaggaaggaauguaaugaagggacuagcagaagguagguugggacuggcucauagagggccuagaaauuccaucugaagauuuucaguugcauauuuuauggagcaaggguuucuaauugucuuuuugccuuguuuuugagacauagucucacucugucacccagucuggagagcaguggugcagucucggcuuacugcagucucugucucccagguucaagugauucucaugccucagccucccgaguaccugggauuacagaugugugccaccaugccuggcuaauuuuuguauuuuuuucuguagagaugugguuucaccauguggccaggcuggucuugagcuccuggcaucaagcaauucacccaccucggccucccaaagugcugggauuacaggcaugagccaaugugugccaccgugcuccgccucuaguuaucuugaagaggcauuuaucacuuccucuaagguuccagucaucuucuaagauauauggcuugcaaaugauacaguggggcuaauuuugacucacacuguuaagccuguguguuugugugugggggguguguguguguaugugugcaugcacauacacgcacacauaccuauguaaauacaacaucccugcuggugcuuauuccugagaugggauuccuugagcagaguuggggacagugcauugcugcuggcuggguucuccuccagugaacaauccuggaagacugugaaaugaaauucugaccacuuggucauucagaucuaccaguaacuaaugauugacccacuuacaaggcuugccauaaacaauggcaaaccauuagagguuuuuugguuagcuuauuuuuuuguguauuauguuuguuuucauguauguuuuuuaauaccugccauugaugguuugaaauuauuguuuuagaaaggauauacugggcauagcuggugaauuggaggugauaaaaacuuaagucaaauuaaaaagacccuuuugaaagccuagcgugaagugaggggaacagaauaaggacaaugagaauagaaagaggugguuauuagacaguagaaaggaugaauuacagaaugauuggugggauaauuuauucauuuauuaaacauuuauugaaauuuauuacacuguggagauuuaaagcugaaaaaguuggacuccacuucagagagcccccaagagcgggcagucugacaaguuaaguagugaugguaugcugugcuuaaggaugaagcaggcugaaacacccucgaggcaugaagugaugccucaggcuaguggggauggggaauggacaagagaagagcuuguggggugguauuugagccuauuuauaagcaaaaagaaagaaccuaguagagaaaaagagauuuacauaugaucugggagagagaagggaugauuaauaaagugaguuauggaggaggugggaguagauggauuuugaccacaaggagaagggauuugaaggaaucgaagauuugcuggauacugaagaaaggaaugaaucaaagaugaccaaggaaucaguuuuguguguuuugugugacugaaagaaugguggucccauuuguaauaaagagaagaugaaucuguuuuuaaauacauuugaguuugagauaaugggaguccaauaggaggcuuguacugaagguugauaagguugaccugugaaagaugagggugaacaccauugauuacagaggaguguaaugacaauguaaucuacaauacaaagugccucucugcaggacuuggguguuugugaaguaguggagugagaagccccaguugcugugacgggagccagggagugagauuuacaacaguuuauuucccuguaggggugguguuauagcugcuuuuucuucacaucuucuuccguagucgcauuuguccaggaucucaggcacaggcaugguuguggaggcuagaccucacauggguaauagaagcacuaucagacacagaaauguccuuuucaaggcugggguuggguuccgaggagacccuagcaggagaggcccagggcaaggggaaagaugaacaguugacacaccugccucuugguaaagucucuugcgcaguacagaaugugggcccaucucugcuuucuccaccagagagcaacuggauagccuuggauggagucagaaaucagccuguagaucugugaaaugccuaauaguugucccugagucuauugucacuucagucuggugguagaaacucaaauaccaaaaacuccucagugaccuuccccauggucaagcaccaggguguagaauccagcagaugcuuugggugaguguuugucucugcagcucuacagauucacuuccaugcagguugucuugaccuccugggggcaucaguggguggugugaguggccuuuaucaaagguucucccauuuuccuggcugugaugaggagucagaauuaguuacaguaucuaaggaccccagagcuccaucuuucucucucaaaguuauauucccagaaaggucauuugggaaacacccccucucaaaggggcauguagugcuuaaguguuggcuucuauacacaaaaagcucaaacuguauaagaagcaccuguguuggaagaugaugcccagaugaggaaagcuuggaguguggccuuuauuuuggccauuaugccaggcaggaccagggacaacugacagaccgcaggaacuauguaguucagggaauuaggagcauuuccuauucucuugggucaggagaccuguguguacugauauccuggcccaaaagguaugcugaaaaccagguccucauaagaguggaguguagcucacuuucugauugugcauagccauggguucagucugaguguuucuucaggagaagccaaauuauaaagucagccuagcugaccagaggaauuucaguccaaaggggcaagagagauucugaaugagagccagcagaauggaccaaggagaccagcaaaugaagaaucagagcacaggguagcaaguggggcuuggcguuuucuccaggcucuuuauucuuccugaaucucccuccuuccauaugcaucaauuuggacauauacuuagcuagguggagacuaacauuuauugaggauugacuuuguaacagguaacguuuuauguguuggggccacagcagugaacaagauagaacaagauagacagucuuacaacccccugcuuccugccccacggagcuuaugucuuagugggcauguggagacgguaaacuacacacauaggguaauuccuuacugaugacuuccuaugaaaaagauacaauuagagaaacagcacuguagggugugauuuguucuggagguguuaaagcuaggguggucagcaagccuucuuugaagagauggcauuuggguugaguccugagugaggagaagaagagugccacauuaagauugagggaacggagaagaaaauugggucuuguauuuuggcuauguuaaaugugggaugccugugggacaugagaucaugagcagguuggucgguggugucagcuugucgguguucaggucagaggucugggaugacagauugcagggccuuaccagauagauuguauuuuaaagucacaggacuggaugagauggcguuuucacacuuuuuuggagcucuuuuuaaucauguauauuugccuagagauuaacaacacguaagauucuuauuuuaaauagaacagauuuuuuguugaaugaggcagaacuuugggggcaugaauaugauuuuguguguguauguuuuuuucauguuucuggaccguauguguacugauugacaaguuccuccugucauguacuugauggcuaaaagacagcaauucucaaaguuuucagcuucuauccugacaaauugaaaauuuucugaacucauuauagaaucuacucaaguguacauaugcagucauagguuucugaucuucagauuuauuaagagucccugaaaucuuucuuaguaaauauuguauuugaaagagauggcuggaacgugugucaagugcuuuauaguuaacacacaucugagguuccaaaaccugugugagguaggaagauguuguacucuuuccuuugcaguuguguaggguaggacuuuggaauauaaaaugacucugacgggaaaacacaacucaaaauuguuaggaccaaucuuagaauccaaggcuuugauucauaugccagcgucuuuccacuacuucagugguucucagccuuggccccauguuagauucaucuugggaaguuacaaaauaaaauaaaacaaaaagcccagcaauugugcuuccaccucagaggccuggacaguuacuacaaacaaacaaacaaacaaacaaacaaauaaaucaaccucuccugguaauucuaaugugcagcaguagcugugagucucugcccuauuccacauugccuuaccaggagcugcguuaucugguguguuguuacccuguaaucccagcaguuuggaaggcggaggugggaggauugcuugagcccaggaguuuaagaacagccugggcaacauagcaagaccccaucucuacaaaaaauacacagaaaaauuagccaggcaugguggcgcaugccugcagucccagcuacucaaaagucugaggugggagacucaacugagcccagaaggucgagauuguagugagccgagauuauaauacugcacuucagccugggugacagaacggaacccugucuuaaaaaaaaaaaaaaaagaugacugagccaaccaggauacuucuaaugaccuuguuaaggaagaucucuuuucuuucuuuaagucucaagcagaguccuuccucuuucuugugacuguuucucuuucugguugugaguuugcagguaucccacauucuuucucugguaucaguauucucugugcuuguacaugagaccagugaagcuggacuaaccccuuuauuuccacagccuaauuuaauuacaaccaaaaccucucaauaaaacuguuuucuuauuuacgagggagacuuuauuccauuuuuuggauugagagagaugcuuuuuauuuuucgcccuacucugugcuguaaaauuaucucuggagauuuaauuguguuuuugaaugguuauuccuaguuuuuaacgcagggcugucuguaaaaugaagauagcuucuucucuaguuugcucacuguuagcuagugaaaacaugccagcuuauaacuuggcaagauuacucugagcuacucagggcacgguccucaguccagcgaccugucugcucacuauuacccguccuugaugaaauaaguacagaaaucgagaugaagccauuagaaacuccuagugauuuggaaaacguaacuuuagauuuuguucaucuuugucuuuuuaaaaaauauacuuuuaauguuuuauaaaguaucaaaaacugauaauccucauagguaauuucagaagccauggacuggaucucugaauccaguagucacugagaggacuaauaacuaccgcugcuuuuuucacgaguagaaauaauauucuugauuugcaacuauuuugaggauguaggguaacacaguguaagugguaaauuucaaguucuggcacugggcauuagccuagagcuuagcuuuaaucuacaauaugcauuucucaaccugcuucugauacuuugccaccuguccucucuaggcugcaguuuacauuuacagauguuucuauaaaccuuugaagacucaggaacauuuugguugguuuuuaaccauaagugaaauaauaaaggggauagauuucaguuugcuuuggcagcuuuaguuuucaguuuugagugauucugaccaagucaacuccacaguucaucauuuuauagucacuuguauuuuggcuguacaccaguauguucuauaaaauacaucauuuucuaaaguacauugaggcaugaaaacaucaguguuaauccuuuucuguuacacauuguuuuaggcaaucaaagacuucugcuugcuuuuuccuaacuaggauauauagaucuucuuacauaugagaaaugaacauugcuucacucucuugucuucuguagagucuaccaggcaagugcuccacucuguuuuuguauauuauuauucuuacuguaagaauaaugcaugcuuauuauagaaaauuuggaaaauacagaaaaaugaaagaggagauuuaacuuuuuuauauuccuaguacuuagagaguucacauuuuuauguauuuccuucuucaaauuuugcuucauuaaaaauuauaaaauuuucaacauauugggaguacaaaauucuaugugcuuauuuaaauaagcuuuuuucuguuuaucaauaaauguagauauguauauuauaaaaauauuaagaaaauagagaaaacuuauaaagaagauuuaaaaaucacccagaauccuuuaucccagggauaauuuuuaaccuucauuuauauuuacuuacuuuuuuuauuggauucauaucauaauuauuuuuaaguguaccuaauacaggcauugucacagguuauggaugagagaagaguuaauaaaaaaacuaaugacucaagucauucaguuugaguuucaaagaugugaaaaauuauuucugaaguuccuaagcaaaaaaugucuauuauguugugauauguaauucuucccuuuagagagaaagauguacuuuuuauuuaguaguugucauggaauauugucccaaauguguuuaaaauaguugagccacuauuaguaaagaaagaacaacacugcuguugucuuggguguucaacuaaaauauugugacuguggguuaaaaaguggcucuaggugagggacagagcaggaaaaagcacaguguagugaagcauuucugggucuccuuuugcccuugggcuguggagugugccccacugcacucagucuaguuagauaacuaauacuggagcugggaaaccccaccaguccuauauauugugacuuccuuaugcuuugaauucuaauuuuuacucauucuucauaugucuuuuuuuuuugagacauggucuugcucugucacccagacuggaauacaguggugcgaucauggcuuacugcagccuugaccuccugggcuuaagcaauccucucaccucagcuaccuuagcagcuaggaccacagacacacaccaccaugccugucuaauuuuuaauuaauuuauuuauuuuuguagagacagggucucacuauguugcccaggcuggucucaaacuccuggccucaagugaucuugccacuucacccauccccaagugcugugguuauaggcaugaggcaccaugcccaaccuagagcaggucuuaagccucuuuccuccgcuuaugguggauagaguuguaucaccccaaaaguuauguucaaauccuggcgucugguauaugugaaugugaccucauuuagagauagggucuuugcagaugcagucaaauuaaggugaggucauacugaauuaaauugggucccaaucuaaugauuagugaccuuauaggaagauggaaauuuaggccaggcgugguggcucacaccuguaaucccagcucuuugggaggccgagguggguggaucacuugaggucaagaguucgagaccagccuggccaacauggugaaaccccaucucuacuaaaaauacaaaaauuaucugggugugguggcacaugccuguaaucccagcuauucaguaggaggcugaggcauuagaaucgcuugaaucugggagguggaguuugcagugagcugagaucacaccagugcacuccagccugggugacagugagacucugucucaaaaauaaauaaauaaauaaaaagaauaugggaauuugguuacagagaagacacacaaggaaugccauguaaugauggaggcagagauuagaguaaaacuuguacaugccguagaacgccaaggauugcuggcuaccaccagaagcuaggaaaaggcaaggaagacuccuccccuagagaccccagagggagggugacucugccaacaccuugauuuaagaucugcagcuucuagaacugcaagagaauacauuucuauuguuuuaagccacccaguauguggucauuuguuacuguagcccugggaaacuaacacaccucucaagaacaccuauguucugaacugucucaaguuuuuuucugagcuuucuuaaaugcaaggauaauuucuuuuaauacacuguuuuuucuuuaaaaaucuaucaacauugcuccuuagucuucucacauuuaguguuacaggaaguauauagcuaucgugauuuuuguucuuuuuguaaguuccuuauucuaucuguaucuagauaaguguuauuucauuguuuucccuggaaaaugcgguaaacucuuuugucuuacucaugguguuuuuuucuguaaagcaagaaaauacauuuguguguguguguguguguguguguguacaucucuuuuuacaaacauuauuucuguaauacuuggauugaaucccuguucugaaauuuuuaugucuaucaucucuccuccagcuuuucaaucuuuauuauugcuguuuuucccaucuauauuugggaguauuucucaauuuguuuuuugcaucucugauuuuauuuuauggaauaucaauuguuaguauccuaguuccuuuauuauggcuuucucuucugaaguugcagcauuuuaaccuuccuuacaauucuucucuuucccuuguccccucuuuaaaaaaaaucuuauccugguaucuuuuccuuccagccuguuuucucuuuaaagauuucuuuuacuguugcaagaagcuauguguucuugugugcuacugaggaugccaggauuuacugaaaauuuuuuguuucuaguuuuuggguuauuauuauuuuuuuuuugagacagagucuugcccuguugcccaggcuggagcacagugcagcucacugcagucucaaacucuucggcucaagcaauccuccugccucaggcuccuugaguaguugggacuacaggggugugucaccacacccauuuaauuuuuauuuuuuguagagaugggguuuugcuuucuugcccagucugaucuugaacuccuguccucaagugauccuccuguuuuggccucccaaaguacugggauuacaggcaugagccaccgugccaggccucuaauuucuugaaauguaucuuuuccucacuuuuucuuuucccuguuuacucauucucaaaugagaggaaaucuaccuagaccuugugucugcugacuguuggaauaugaagacugccuuuuagccuauuauuuaaacauaugugcuaaugaaaucauuuucugaguuuuacugcuaguaaucaauuucauguacacauaugccagcucaacuccuuguuaccauauaaugcaaaucuguuuuucugagauggaacuucaaccuguaucacuaucuggcuuccugaaacacauaaaauaauaaaugaauuacuaagguaaacauaaaucguuuuccaugauuauuuuuguauuuacaguauuuuacaaaagaugauucucuuugucagaauuccauuguuaguccucuccacuucuuaguagauuguguaauuuuaaguacuauuucuaauggaugcaggacaagaaguguucaggugggauggugaguucgggagggccagcugccucucaggccagcaacuauguggucgugaacgguugcucacuuugguuuggagaauacagacagugcaagagugggaaaggcuuuuuguaccuacuuccaaguaagcagauuacuuuccuuccacugaugcaacacaaaccauucaguauacguguuaacucucuuccguugaccuuguauuuaguggagauuguuuaaagauucuggcuguauuguguguggguccagauuuuuuuuuggcauugugaagcuuuuuuuuuuuuaaaucuuuugcauucauagauauuugaguggguacgugggagagaucguguuggguauuaccagacaaauaucauuuuaauuuggaagucugacauuuguuccucauuucuacuuguagguuuccuguugacuuguaauuuagggcaguauccucuuuugaucuuauuuucuuuagcucuaaaugggauuucaaauuuaaaugugcuuugguuagcagauuaacauaaacguuuauuaauucagauaauuuacuaauauuuuauuuguuaauaugagaaaauuauuucucuuguauuccugaaugaauuuuuuucuuucauuuguuugauggacucaguacuuaaaauuuuuuacuuucucuucuauuuguauauuuuccucucucauccccaggcauauuuuauuuaaaaaccuugagucagagaaagaguuacacggacuuauuuggggauuugagcugauagccacccauaguucacccagcugaacugccuuccuaggaacacgaugaaauggauucucaauucugauguuucuucacuaaggucuccagcaugauacuaguuuccaguguguugguaggguagaccugcucagcccauagcuaauugauaugauggaaagaggucaaugauuuugaguuggaaacacagcuguaugucaggauaauuacagagaaaccuguugccuugcuauuaccuuuuuaaaaaaaauauuuuaauuguaguaaaaaacauaaaauuuaccaucuuaaccauuuuuaauuguacgguucaguaguguuaacuauauucacauuaguguuaccuuuuauugccuuuaccuuugaaagcuuuuuguccuacucagaagagcugaggcuuugauaauuagccugaugcacugugaauugcuaagaguccaacuuuuuucauggaaggaaccgaagacaaaaugagagaauaaaagcagagaggagggaagaggaauacagcuuagauuagaaauggucccuacagcagcauuauuaguaaauaucucauuuucuggauuccaagacccuaagaaguauaagauuaggaaaaaaaaguaaaacuaccuuaaauguacacaucuaucauaagauaacuguugauuuuuggauaugugaaaaaaugugagcaaauguguaccuuagaaucugagaaauaccaggaagucucccacauggugaugagaagcagcaaauguugugucugaggaggaaguuggugaccagaguagaacagugccacagcacaggcaucaagaagggucacaagccaucuacccccaauagccucugccauccucaugcuccagucaaccuuuagcucucugugcaucucguauguccagaauagcuaaugcucauccauucuagauagcaguuuuauuuuuucuauaaauguuauuuuuaacuaaguuguuugauucucuacuauuauggauuguugagagccccugacagccugacaaauguacccuguggaacaugugcuuagcagugaugacagaauagccaacagaauguuacauauguaaacuacucagcuuuguguucacucugggcaaaugaacaacauauggacauuugaaauauauguguguucaaaauucugucaugugagguuaguuguggaauucgauaguccauuuuguauuuguuccaugugaaaagggccuuauaauggcaucaccaguuguucauuaaucuccuuucccuuauguaaagucuccuuuuguccucccucugccagucuguaaguuuuaucaugacauuuauacauggaauggauuguuaccuuuucugggaggagaauaaaccauaaauaugaacgaggcauuaaaagagcuuaacauaaaucacuaagaaaaaucuguagacugugagaauauaaaaaucgcugugaauuauaaauaauacagcaagguuauauaaaucauuuuauguaaaggcagacauauauuucuacuucucacaguaaggcccagugauuuuaauaucauugguuggccagcgucuauaguaggaauauaggcauggaauauaguagaaaguuccauagugaaaauucugggagaucauugguagcauggaacagugauacuuacuuucuguuggagauugcauuugcuuuauauuguuaucaaaguaucaaaagaaaucuuacauuuucucucuauauuugcucuuggauaauagcacgcagaucuguaaucauuuaaagaaugaaaauguguauugaaaaauuuaaacauuuuguuuuaacuuaauuaaacugucauuucucuuuaauuaguaauuaacuuucagacuacuuuucuagaaaguauccagagaaucuccuuaauuguuuuuuuuccuauuguaucuacuuuaacaauauuuucuagagaaaauuaaucauaaacauauaacuuuauguaaguuugcauaagcuuaugcauaccuuuuaagcauguauuaaagagaguauucuuuuuacuaaaguuaucgucucuugguuaauuacuucuguuuuaauaaacagauuauucuuugcugaagaaaguuuuccuuauaauauguaacucuuacacaguucagaauuauauguuauauguuaagugcauaacuuuauugugacagcuagaugauuuucuuuguauauaaaaaaugcuucauucaugucacuggaauuaagucaccucuauacauaauacaagagauaaagaagaaguguaagacacaauauuguucuuagauugcuuccuaguugagaucaaacuaauauaauuuuaacagcacuggcauuucaagacaauuuaugauuaaguuuuaaauucugugauucagauugcuuuuaauugucaaucuuaaagaaaauuaaagacaugcuacuauuacaguuucaccccuacucacacauaacuagacugaaaacguuauaaauauucaguuuccaguagauaaggaaaucuuuuccuuaauucauuucugaaaggacaucuuuuucauacuaaaagaaccuuuuguuuaguauuauauuuuaaauaauuucuccaacacugcuuucauuuauuuuauuuauuuuauuuuauugagacaaagucuuacuguguugcccagguuggggugcaauggugugaucuuggcucacugcagccauugccuccuggcgaagcgauucuugugccucagccucccaaguagcugggauuacaguugugcgccaccaugccuggcugguuuuuguauuuuuaauagagaugggguuucgccauguuguccaugcaggucucauacuccuggccucaagugaucugcccuccuuggcuucccaaagugcugggauuauaggcgugagccaccacgccugaccacugccuucauuucuucugaggaguagcuuuguuucuuguuaggccaaaguuuaugaaacaaaauuucuuccuugcuaauaauagaacuuauuucuaagauggcaauaugugauuacaguaguccucccuuauccgugugggauaugugccaggacccccaguggaggccugaaacuaaagauaguacagaaccacucuauauacuaugauuaaguuauaggccagacacaguggcaccugucuguaaucccagcacuuugggaugccgaggcagguggaucacuugagcucuggaguucaagacaagccugagcaacguggugaaaaccuaucucuacaaaaaauauaaaaauuagccauguaucguggucacagcuacuugggaggcugaggcgggaggauugcuugagcuggggagguugaggcugcagugagucaagauuuugccauugcacuccagcugggcaacagagugagacccugucuccaaaaaauauauauaaaauaaauaaaaaguuuaaguuauaaauuagagugagaaauuaacaacaauaacuaauaauagaacaaugauagcaauauacuguagugaaaguuaugugaguuauacucuuucuuaagauauuugaggaaggggugaagugggccaguacaagauuucaucacauuacucagagcagcaugcaauuaaaaacuuauuaauuauuucuguaauuuuucauuuaauuuuuuugaacugugguugacuaugggugacuaaaaccguggaaagcaaaaccaugggcccagggguuaggggagguggggaugggacugcuguauuauuuaguaguauuauuuucuuaucaaauuuuaucugacaaaguuuaggaauaccaccaucuagauuuuaaucguagauuuucaguuaaaaugucaugguugauauaugagacaaaauaaguuuauuuucuagauuuguuacuuguagaaccuguuuauuauagagaguucuaggcuucuuugaaagcuguucuagaguugauaaaucugaaaauucaagugguaggaugaaccaauaucauggauaaagcugagcuaaugguuguccaaugaauaagugcugacuagagcuuuaaaacugcauauauaauaugcauaauuggcaguccauagauuuauggguuuuaaguuacugcuauuuugacuuaaagauugaacgaucuaucuguagugcuagugauguuucaaacaucaaaaguaacagaacuucuugcaacauaagcagugcaacucuugccaugucuauuguaucccaaaucauacaccuuuauuauuuauuaacugagaauuauugcaauagguuuacccucugagaaaauaaauuauaaggaauaaauuaugugagcuguuugucuccuuccaccuuggaauaagccagaaugucuuugguugauaugcuucauucuguaaucaauauacguguauucugcuuuuauucauggaggcuauuuuguaaagauaaguacauuuuuaucaguugaagguaaaugcaaaggaggugaaagcaccucuauuccagccauuaucauuauccauuaucauuaaugauccuaauuucuucuugcaaguuacugugacugaauccuagaaucacuguauuuauagggaucaccagauucuagagaggucaccauguggcuggaaaauauuuggguuuuaguuuuaugugcccagaagaaagaauggcugcaccaaggucaacaaaaugggcaauaauuauaucuccacugugugaaagugccacaguaucaggaaucguaaacuuuguugccuuuauggagcacacuaccauaauucacauucaugcgaucauaucauugaauuggcuuaggagggagaaaacuugagauggaacuccccugguauuuugguaaauaacaguaagccacauucuguacuaucuaaucaaugucugauaugagaaaacuuaggaaacaucaugaauugaacucugcaaacuccccugaaugguguggauaaucaucuugaacuugaaggcagguguaccuucccaaguucucugagcucauuuuugggcugcagcuccugccaguauggaaucagguaucacagagcccaggaugaaggacaugauaggugguuuggagaauugagucacuccacagaucaccuaggugacgaagauacuugugguguguagcacacagaaagcacucauaaaugcuguuuaagcuaauaaaggaaauuacaggaauaggccauagaauuugaagaacacagauaacacuucaggauaauuuuauuugcaggauuauuuguauaagccagcagagaaacuaaauguaguucaauggaauggaagaccacugaagaacacugagagcuccuucagagcauaaacuaucuuaaucaucuuuucgugggcaauaccuaacauagugcccugcauucaauaaaugcucgucgaaugaacagaaacuuuagugaaacguuaauauuuguguugggccuugaaaggugguugaauuugauuuagugaagggaaaugacauggcuuuucagaauaguaggacucaaugaauaaaggcacagauguuggaaugagcuuacuuaauuuugugagacacaggagaggucagucugaugagaggcccgugguguauguuguggugguaaugguugauaagagguuguuauugauugaacacacacaaaaagacucagugcaagcuucuuuggggaaauacaaagggaugagacauuuuuguacugagaaauucugucucacagacuagucucauaacuccugaucaauagccuuacuauaggcuguugaucuugaaagggcaccagcaagaagcaagugcaguauauagcucagcacacccaucuuccuuagguagcucgccauauugagugggaucauuuucucaauuagguugcguaucaaaauuuaauacuuguuggauugaaucagauuuaaaacucugaaaugcuauucuuaggaagagggaaccuuucuccuuagaguugguguaucccauuauccuugagaggcaaccagggacucugccggaaggacuucacaaucuggcagagacauuuucugaaaauaaugauuuaaaaauucuucccuucucugcuuccucuucuuuuuucaccuuuaauugaauaaccauuauauuguauuacuuuuucacuuauggauuucuuuaaaccuuagguauuuugguuaguucuguggccaaauuuaaucaucauaguacaguaguagguauagcuucaguaauaaugcuaacaauguaugcuuuucuucuaaagugugcuguugguacuugaauuuagcagacaccgaauuuuucucagacuuuuagaagaaauaaaagaaggaagaauuagaaguauaaucagagaccaauagugggguugacagaagggguguuuuucuuaauaaauguauaccuaaagaaaaguuauuuuuacuggcuagauaucacacuacaaauauuuucugacuuugaguucuguaguuauuuugucuagaccacuacgcagcuauucaucucauucauuauugcacuuauugguuguuuuaccuagcuccucugaagcuggagaaucugagauuaaguauuagagcuggaauaaggaccugacucuggggguugggauugucauuuauccuauugcaggaugcaagcccucgcaaauuuugugaagugcacuccaaagacaugguuuugcuuucaacugugaugacacuauaauugaucaaguauauucuuucaaagaaucauaaauucuuauuggaguuugaggagaugucauauucauuugucaacaugucacuccagggacacaggugcagcaaauuuauggaggaagcaccuuguguuucuccugagucacauaaauaugaagcagaauugauugaaaacgugugguuuuagauuacuccucagguggagagcaauuaagaucucucuguaaaggcauuucacucugcuucucagguuuucuuguagcauaggcagagaucaggucugaggggacaccagagaaauuuuugaagaccugauggugucuucucagaaaagaauacuaagacauuucucuggcagagagaauauugcacauuuuuagucaagugcaugauuaacuuugacauuuggaaauggaacuucacguaaaaauaagcaugguacuucugcauguuuaauuaagauguuuaguucuugucaaggcugauagcccucccucccacccccacacccccgcccugugaagggcaauauauucucaacuucugaaauuucagaaaccuguacuuaaccuuuaauugucacuccauuuacauggaaaucugauuaacaacuuuuaaaguucaugagcuccugguaaaugcaauuaagaccuuuuuggaguuuguuauuaagagcuggcauuuaaagaagacuaggcccuggcuacuguugcugucuucucuguagcaggaugucuuaagcaauuagcagagaacaugagguacaugaauuguaugguauugcuucugcguuaacaugguugguauuuaaauagcaugcugucuuuuuucuuuucuguggcuugcuuuauggugugagcuuguuacugaaugguaggguagagcugagaauaauuagguagagcuguggugguuuucauaaguaccgaguuaggcacaguuccucaucccauuggauguucucuaguuauguuuacaaaugcucacucucaugucauauggagucaaggcuaauccuacugugaugaauuuauuguauccaucuccuggcugugguugucuuuuugagaguuaaaauuaaaagauguaguuauuggagagaaaugauccagguauacaauuaauuucugauaucaggcaugugagcuguucagccauugcccuugccucaugggggcagaagugggggugaaguuuguuggggcagacaugcguaguauaauuuacaaacugagaugugcugugauaaauggaaaauggggaguaaauaguugaaagacaggaucuuaucggaucauaugcugccaaucauacagugugauuuucauuuacugauagaauugggcuguuugauggauguauauaaugcauuucuucgguacuuuauguaugcaggacacugugcuuauuagaaauugaggaaugaugagaaaaauaaugaaaugauaaaucaacagacauaucauuuaaauacauugcauaugauugugcuauuaaaguauacuugaaucuacauauuucuguccucuuugaaauuuuuaugaguauauauugcuuuuaaauaaaagaucaaaauaaagaauuauuugggaaaaaagaaauaggaaagccaaugcaaaagaauuaaauuggaugccagaaauaccagugaaauaguucuccauuuuuguacacuagagcagugguccccaaccuuuuuuggcaucagggaccaguuucauggaagagaguuuuuccauguauggaggguggcuggugaugguuuuggaaugaaacuguuccaccucacaucaucagauauuaguuagauucucguaaggagcacacgaccuagaucccucgcaugugcaguucacaguaggguucacacuccugugaaaaucuaaugcugcugacgggagguggagcucaggugauaaugcuugcuccccugccgcucaccugcuguguggccugguuccuaacaggccaugggcuggugcugguaacaggccacagaccaguaacucuagugcacaggaacccuugcgcuagaauuuucauauuuacuguaaacuuacuuaaaccagcagugcaguucauuugauuaaccuuuuaaauuuuaggcuauccucaaguguagugcguaaauaaaauaguuuaauuccauguuuugaauuaacacauaacauucaguauaaguaauguauaauaaucaaauaccuauuguagauguggaaauuuuuuuuuggcaacaaaacugauaaaauaguauuacuuuuuguuuaaccaagcugucgacagguauuuuucauuaguuuaguagcuugcucaagggacacacacacccacccacacacacaccaucaccuucagacagaagaauuuuccuuauuucauagacagaaucuuguagaugcaagaguuggcgaagucaagaaauuggugauauuaaguuguucuuucagucauaaagcauuuuaauaagauacuucaguggaaauaucauuagacaugaauuuugucuaauacaugcugguauuagauaaaaugccuucugcucaagucguguugggaggugaagagagaaauacaggaaaaguuaaauauccagcaguguaugauuaauugccaaguccaaauaaucaucuguggguccucuaggaauuuaaaagauaacuuuagauagauuggucagagaagguuuugcgcauggguuagaggcugaacugguccuugaaagaaggcuagaauuuagguauuuuggaaagaucauuuuagauagggauaauaugcauauauucagaacagugagcaccuuacugaauuuaaccacauucugaggaggcugcgaugaauucgguugagauguucuuuguggacuccuuaaagaacagaaccacuguauuugucucugcauucuggugccuuguacucucagugcuuccaaacccccuuaucuccuggucuuuacaauguuccccuuaaauuccaaugagaagguauguaacacaguuccuggcacuuaguaauuacaaaguaaaugcugguugaaucugaauuugcaauuguuaucucuaaaaauucuauuuugaaugaacuauaggcaaauauuuuuuuauaagugugacaauauuuacauauuacagauaaacaauauaaaaucaucuuuaguaacugaacugcuaauugaaaaugcugggucuuagccacuuaauugaguaaacugucuccagagaguaauuugggucuuuuccaagaugcauuaacucuuucaggucguuaggguggcacuuaucucauuggagcagaaauguaauaaaugguauuccuauaauguaaguaaauuaauguaccucaaaaagccugaaguuucaccauggguguuguaguuguacuccaaggagcucaucugugaaugugaaacagcaauaaguagcugcuguuuggagcaucuuacuuucaauuuagguaacuuaagacauugugccuagauguugacagagauacaaagaaaagaccuggcugacaggcggcagagaaggcaaauaacugcuaaaugaaauccuugagagauacaaacugcuguauggguuuuaauuagagugagauaucauaguugacagucgagauagaugguaaucucccagaagacaggcaucauggcuuuuuuacacaauaugcuuauucauguuuauucucaguauauagacauguauaaguauaaauauuaauaugaacaaauauauuuguaaauaugaguugaauaaauuguaaacauauuuuacaauuuucauaugugugcuuuuuuuccuugugagaauaugaaauauuaaugucuggcauugaucuaaagugacuauaguaaguagguggaaaccagaaaaaacacacggcaucuuuuagagauauaugcuacucacagguucccuguaaccucaacuugagugucagccuacuggugggggauauugaccuuuagcuagaaaagaauauaagaaugauuuauucuacccaccagcauguuacagauuuacaucugaugggaagauagaggcacauaguugucaucguaagaccaaggggaagugacauaaaaagaccaaugcaaaaagaacuuucaaaagaagaagguagagauaacagcuccaugagaagauaaaacuucaaagcuauaagccccucccucuguuuccucaugcaugggguuggcuucaucuccaugcauguaacucugauuaguaacaucugaauggaggaaaaguaguuugcuaagauccauuaaagucuacuuagauucacuuucuugaucucauaccccaagcuuuaaaaaaauuuuuuauauuuuucccugguaccugauguacagcuaacauuccccauacuugauaaauggaagaguaguuaauggcaggaaaaaaaauuagauaaauuuagacaugauggaaagccuuugggaguuauuuaagaaacaggaaauaaaacuuuaguuuaaucaacugguaaugauauaaaaagaaccaauaggaacucauccuauagagguugauuggggcuguguugugagaggcgcugaauaauaauaagauagagguuuauuuauuuugaaggcauggaggaagccauugaaggacuugucagaggaaugaaaacauuggguuuaaucugguagcagguugugggauagacugucaugagaugcauguggcaggauauggccggugggagacuguuuuaauaaccugcaugaaagauaaugaggaccugauuuagaaagaugaguaugggaaugaaaauauuuagaagagggacuggacaugaaguguguaguauuaaaucuauaggauuuggcaggugauuuggagaacaagacugagaagagccacaacuaacuacacauuuugaucccaggugaucagaagaaugaugacauuaaggagcucccccgcuuuggugcccuuccucccuuugaggagaggugguaauagagaguuuaccuggucagucugaguuuguuggacccauguuuuagcauuuccuaaacaucugcugcauuguuuugaccugcuuacugugauauggaugugagaacccagacauucuuacaagcaauggcaguguaucuuuggagcuugagagaaaguaugauguaagagggauaauugggaaucauucaaaauguagaaauaauaaaaauggaagagagcaggagcaaggguuaggauauuuuacuuccuaauugcauuuuacagccuaacuacuaauacuuaaguaauagucuuaaguauuaguguuaguucuuacagccuaacuacuaauacucaaguaguuagguuguaaaauacaguaaucaaacucauugaagugaaagaaaacauuccaaaaguuuagagaaugaguauuagcagaagccuggauuuaguaauugagaucuuuauuguagcgcaaaggggaagaaggaagaaggagaagaaugauaacuuugaggagaugaugaagauauacagauaauuucauuuacccauucauucacucacuuacacuuauaaagugauugcugugcuucaggcaguguucuaaguggaauacucauuugacccugaugauaguacuagcaaauagauaauauuauuucuguuuuacagaugaaggaacugagguucugaggcacagagagguaauaucauagauauauacuuacuggaauauauuagaaaagaaacagauuucugagccuuauccugauagauaauaauagucuguuauguacuaagcauuuuguaugcguuauuaaaaaaauucucauuuaauucuaugaaguaguucuuuuucuguuuccaacuuuuaaguucaaggguacauuugcaggaugugcagguuuguuacauagguaaacgugugcuucuaugaaguaguucuauuauuaucuuuuauuauuauuuuuguuucacagaugagggaagugaggcuuagaaagauuaaguaacuugaccaaggucacauaacuaguaaguaguagaguugauuucaagcacagacuuucugcguuuuuauaugacucucucauuuuguaguucuaaggcaggcacaugaauuucuauuuuaaaggaguucuccaagugauuccuaugugcagaccagucuucccagaaucuuagcacaaacugagaaggaagaggucuguauuuuuuuggaggagauaaaacauuguggacagagagaacucagaguuggugaccuuauagauggaguauuuccuaaggacacagaauccuaaagaauaguagaguggagguuaucggaaucaaggagacugagaaagacucugugaugauagaaggagucaguauauuaugaugaaacauacuagucuuaaaacagaguaaaauuguguuaguuaauuaguuaauuacagaauuaauuaacacaaccaguagcugaaguuuuuuuuuuuuguugguuggguugguuuuuuuuuuuuuuuuuuuuuuuuuggaguuagggucucacucugucacccagacuggagugcaguagugcagucauagcucacuguagucucgaacuccugggcucaagggaucuuccuaggucagccucccaagaggcugggacuacaggcacaugcaugccuggcuaauuuuuaauuuuuuuuugguagagacacggccucacugcuguuacccaggcuggucuugaauuccuggccucaagcaauccucccaccuuggccucacaaaguguuaggauuauaggcaugugccacugcacccagccugaaguuuuuguaaugguguaagauaauucuagaguuugguagucaaaguugaaaagaaaaggggagaaagcaauguaaauagguagaaugaacuuuaaaauauguuuaaaugaaauggacagagaauauauugaagcuauaguuaggaauauacuuuuggauguugagaccauuuuugugccauccccuagcauugucucuuuuauuugucuuuguuuuuuaagagugaaaguagaaauaacaaacuaucagaauaccaugagauccaaaauacauggaggaaaaauugacugaaaggaguaguggaaaauucagugauuaugguuggugauuuuuuaaauaaugaauacccuuuuuugauaauuaauagaacaacuagaagaaaauacagagaagacuugagcaacacuauuaaccacccugauuuaaacugacauguaugguacacucaacaccaucagaauucagaugaucucaaggucauauagaauauucuccaugugagucuauaugcuagaucaucaaguaagucucaauacauuuaaaagaauugaaaucacauaaaguauauccucugaccgcaacagaauuaaacaaaaaaagggaagaaauuuggagguccccaaauauuuggaaauaagacaacaaacuucugaauauaccauggguaacagaagaaagaccuaaauaaucauauguuuucaucccaagagcuagaaaaaggagaaaacucggccgggggcaguggcucacaccuguaaucccagcacuuugggaggcugagguggguggaucaccagaggucaggaguugaagaucagccuggccaccauggugaaacccugucccuacuaaaaauacaaaaaauuagcugggcuugguggugggcgucuguaaucccaacuacucaggagguugaggcaggagaaucacuugaacccaggaaguggagguugcagugagcugagaucaugccauuguacuccagccugggcaacaagagugaaauucugucuaaaaaaaaaaaauggagaaaacucaaagccaaagcaagcagagguuaggaaauaauaaagguaaagugauaaucaaugaaauaaaaaucaggauaacuguaggaaaaaaaaguggaaccaaauagaggucuuuugaaaagaucaaaaauugauauaucuuuaaguagaccaaccaauuaaaaaagagaagucuaaagaauaccaaaagagagaagucuaaagaauaccaaaaucaggaaaugaaagaggagauauaacuacaggcucuacagaaauuaaaaggauucugagacuacuaugauaugccaaucagacgauguagaugaaacagaccaauuucuacaaagacacaaaguaccaaaacugacucaagaagaaacagaaaaucugaauuguccuauaacaaauaaauuaguaauuaaaaauuuuccugcacauacauaauucacacaaauauucugucaaacauuuaaagaugaaauaauaccaguccuuugcaaacucuuucagaaaauagagaaacaguuuccaaugcauccuacuaggccaguauuacccugauaacaaagccaaaguauuauagaaaacuguagagcagccuuacaaacauaaguguaauaauguugaacaaaauauuagcaaauugaauguaucgacauauaaacuguauuauaccaugauucauugggauuuauuuuaaaagucaauguauuaccauaaaauaaagaaccaaagucacauaaucaucucaauagauauagaaaagcacuugaccuccauugauuauuuaucaaaaaaggaaacauacucaaccuaauaaaaggcacuugugagaaacccgcaacuagcaucaucaaggaacuuuuugaccuaaugcaaauuuauuaauuuauagaucauggaaauaccaucaaucuuaaccuauucacauuauguauuucaaguucacgggcguauauuccaaacaaaauuuauugucgccaugugcuaugaaacccauuuuucaugcauucuuaauuauuguuuauagaaccauaauuuuuaaaaucccucaaaugagcaaucuuuuagccauugcuuuuauuucuccuuuuuuuuuuuuugcagaaugacugauuaaauuuuguucauuuuaucuucucugcauugacucuuaaauuuguccuaauuguauaaucuuauugccacugcuuuaguuuaaaaccuuuuaauuuuuuaaauugagcugucuuggucgguugucucuucuugcucuccuuccuuuauaggauuuuccugaucauucauuuuugccccuaaucccauuuccuuccagucaauaauuuuguauacugucagaucaauuuacauacagcauauuuaucaccauuucauuugccuguuuaaaacucuuuuucauugccucauuuuguauuuggcuucaguucguaauuugucauuacagauucuuuuuuuuuuuuuuuuuuaagauucuuggaaguuugucaguguacucccuuuccaggcuuaccucuuguuggucauuuuaaugucgccugaaauauucguuauuuacugaagaugcccuaaauuuucccaucacuauguauuugcuuguucuguucugugccuucauuuuuuuuuguuuguuuguuuguuuucacacauucuaagauucaauuuauguccuucuauaguuccaugaucuugaaggcuuuuuuuguugcccuaguuaggagccaucuuguccuccuauaaaugcucuuagccauauuuuuguccugauguuuuaccacuuucuccuuuguauuguacucauucaugugugucucaauuaauagauaaauacacugagggaaggacuuauuuuugaguccugguuuuauaucuagcacaauacuuugcauauuuucuguguuaaauaaauauauaauuuaaaaugaaugaaaacauuuggaagcuauuaaacugggcuuucuuugcuaagagcuauucucuugagaaaaagaaaaaaaaucaugaguaguuugaucagauguucgauacaggaccaaaaauacauguguacucuuggaaguuuuugauuuguuuuauucugaacaauaaugaaccauucacaagaccauagcguuagugguuuuaauugugcaacugccauugacaaugaguauaauugagcaggcaucugcuuuauuuucaaaaugaagaauuuuuccuuuccuuuccuuacugcagaauauuuuagguuauacaacggggaaauuagacugcucuauugaaaaaaauaacuuuuucuguuauuuuuucuguuauuaacauucuauucauaguagcucuaugaggaaaacucgauaaguuuuuguaauuuaaaauggacauucuaauuuaaaaauaucauuauauuauuucagucucuuggcuguaauguuuucaggaaucaagguuauaauuugguggguauauuacccugauuuugucuccugcgcuuuucaaauuccuuugagacauccuccauuggguaagacuauacuuucugcuugggcucuucccuugcuccaugaaaaccgggaggcgccuucugggagaaagccagaggaauucgccuacugugcuccguuguuucuuccagggaucauagcugucaguuucugcugaauuugauuccccucuagggucuucaaauucuuauuuuuuaguauuuuuuuuggcuuuuacaguuaucagcauaaggaccaguuaaaugagaacugauuugcuguacccagaauacaaacucuugggcacuugcauuuuaaaagagcaaguuauugaaaauuccauuauuuaauauaggcacauuuaaaauauugcccaagagaaguugagucuuaguucauguugagagcuugagacaauuuuuucauguuacuauuucucaugucaugagaagcagucuauuaucagacucaucaaagaggaccaauauacuauggcuuaauguaaaucacugaauacgugaaguuaguagucaagaaaauuggggcaggacgcaguggcucacgccuguaaucccagcacuuugggaggcugaggcagguggaucacgaggucaggagaucgagaccauccuggcuaacacggugaaaccccaucucuacuaaaaauacaaaaauuagccuggugugguggcaugcaccuguaaucccugccacucgggagagugaggcaggagaaucgcuugaaccugggagguggcggaugcagugagccgagaucgugccacugcacuccagccuggaugacagagugagacuccaucuuaaaaauaaauaaauaaaugaaagaaagaaaaaaacaaaaaggaaaauuggguucauaguuguacagaaugaaauuugugcaaaccacuacuccuguuuuuaugagaugccaguauuuugcaaagacaguaauuuugguauaaaugucaauagauucauauuaguauauacucaucaauccauagguaucuuagugaaggaacaaauacucauuuaagcuauuauaaggaagauauauuagauacuauaaagacauacugcaaacucauaggguagaaaaucuuugacccuaucagcaacuggaugugagaccuauaacacuauggaaaacauuuaaaguuugcaguguucaagucugucuccucuggguuuccuauuucucucucuggccagcuaguucauucuuuauucucccucugcggauugacuucuuugauuuuucuaucuguaaaaggugguugccccaaagaauuuacaucuccuccuuuacauggccaguagagaauguauuccccaacacauuccugagaaagauaauuaacuggcuaauuagggguugguugucucccuggugaacauuuuggcuguggcugagaggguggaaucacagguuauaagcauggcuaccagaguccacuaugugguuggggaauaguucuuagaugaggagaggguuuuguaagcugaaaaguugccugaaagggaucuaccacaucaaauaccucagagaucugaguguuuaauugaguagcugggauaaauggagaagcuaaagacagaagauguguuaauucuaagccuaugacucucauauuuauuuaaaaaaaaccucugcauguauaaccacaaacaguuauaggcaaaagguuaaaggagauuaaaugguaaaugaggaauuaauucagaaugauguuaccaauguuagcaaguuauaaaucucaaaauuuuuguccugcuuuaauaccgugagauugcuaaguaacaucuuaggaacuacuaaucaaauauagcagaagagaugccuaaccaaccuaguuuauauguucuuuaaaacacucuguaucuuuauuuugaccacagagccauucaacguaauagguccucagaaaaaaacagugaaugaugauaucacuggaauauguagacuuccaagugcuuuccaacuguuuuguuguuguuguuguuucuugccuuuaguuuuuacagauuauaccuuuuaaguugacacacccaucaauuuugacuauuauuuuuggggcucuugaugaacaacaaauagaaauucaugguacuuaaaaauaguaaagagauuaguaucuaagauaugaaggaauugagagccaacaagaaugugggauccugcacauuuucuguagacagaauguauuugauauuguaaguaaugcucuuuguuccagaauuucaaucuugggugauuuucuucacgcaaauguuaaucagaauagcuuguuuacuuuuaugaaaauuaaaauuugaacccauaggugugugcuuagaauauauacaauuuggaaggugcaguacauuauccaccaugauguggaaucaucaauaaauuauauaguuauauuuuaauacuaggcaucugauguuugugucaagacuguguaguagaagauuuagcccaauucaaauaaauuucagguauccuagaaauaaaggcuuuuuuguucuuugagauacuaaaaaauucuggccgggugugcuggcucacaccuguaauucuagcacauugggaggcugaggcaggcagauaaccugagaucaggaguucaagaccagccuggccaacauggugaaacccagucucuacuacaaauacaaaaauuagcugggcgugguggcaggugccuguaaucccugcuacucgggaggcugaggcaggagaaucgcuugaaccugggagguggagguugcagugagccaagaucgugccauugcacuccagccuggguuacaagagcaagacuucaucucaaaaaaaaaaaaaaaaucccuuuacuaauuugaauaucaaaauaaaacuuuaccuaaauuuaaaauaguauuuuccagcuggugaugaaugguauuagacaagagaggcaaacaaugaagcaaacaaacacaaauugcaaacauuuagccugugguuaaaaauuacacccauccuuuuucuuuuaaauuuuauuuguauuguagauuuuuguacugaggauuaauuuacagaguucauucuacuuugaagacuuuuuaauuugcauauaacaacauauucauuaaagcuucuuuaugcuuuuuuuaaaaaguucagcaauuuguuguauuuuuuugauuugcuggucuguugcauggcccuaugguggaaguaaagaaauguaaugcuuuaaggaacauauaaauuggggguaguaagaugucuuuauuauuaaauaaggacuaauaauaucaggcaguuuuugaugaauacuuauugaaugauguagaaaauggguguuuuaggaguucaggaaaggguauagccaacuagaguggccuggcaagggcuccuugaagaaaaaacacuggaauuauucuuggaaguauuuguugguauuuauuuaggagagaagguaauccagauuaggccuucuagaaaugagaaugcccacauauauucagggaagaguuaaguaauuuugauugcaguguuggguuuacguuugagagaauaagauacgcuuggaaauauguacuaaagucagaauguuguagaugaugaaaggaguagccuucugaugauagcagcaguguuuuaggacugucagucuguugauauuacgugagaaggacuggaagggaaagagaugagaggcagaaaauuaaaugaaaacuacaugaauugaacuaaguugguggcugucaaaauggacaggagugggcaaacuaauagggaguugaggaacagucauuaaugaucuugaggacuaauucccuuauggacacaaaggauguggaaauguaucaaaagaugguucugaaguuuuaaaccuggaaaguagugaaaauaagaaacuaccaacaaacaaaaaggagacagaaggaauuaauguuuuuaugggaagaugauuuagguuucagaggaguugguuuucuuagugaaauaugugaauauauaucaagcaugcagucacagaugugggacuggagcucaggagagaaaugaggaauaaaucacauugugauaaagggaacaguagauguaaaggcuacuuuuuaaaguuugggacucaaagacagaaggaaaauaagauuacagauaaagcauaaggaccaaugcaagauuuuuguugagaaaguaggaaaaguguguguuugcagauugaaaggagaaguggguggauaggaauagacuaacaaugcugagagguaacaauuaaggggacuuuacugaugauaaggggacuuuacugaugaugagaaaaagaaaaaugaucuuaaaauaccuguguuuugaggucaguauuuuauuauacaaggccccagucauuggauucuagaacagcaagugccucaaaagaguuacuuggauuaguguauuuucaugcuuugguagaaacaucacucugucauguugauguuaaccaucugaaauaugagugaaacaaugcauuuauauacaucuuucuguguuauauuaauuugaaauucuuuucugguuuaccagucuuuuuuugaucacaaauugcugaaaaucuuauuagcagcagugccaaauauacaguauaauuuagucccugaguugaguuguuacuagagacccaacucaauauucucccugaucauuggguaguuugggugauguauuaacagagcuaguacuuaucauuauauuauuucauccacauaccgaauaauacucuaguggcuucauaaauaaauaaaaaauauuuaccagucuguugacauguuuuguauuuuccaagugcaauccuuauuggacagaaaauuaaauaaaguacauuuacugccaccuauagaccugugcuuauuugggugcucuggugucaggugcauauauauuuacuauuguuguauucucuugcaguauugaccccuuuauuaaugaccuuuuuugucuuuuuguacaguuuuugacuuaaagucuauuuugucugguauugguauagcaaauccuacucuguuguguuuuccauuuguauggaauaucuuuuuccauaucuuuacuuuuagucagugugucuuuauaggcgaagugaguuucuugaaugcaccaauauuacugggucuuguuuuuuuuuuuuaaaacggagccucacucugucgcccaggcuggagugcagaggcgcgaucucugcucacugcaagcuccgccuccuggguucacaccauccuccugccucagccuccugaguagcugggacuacaggcaccaaccaccaugcccggcuaauuuuuuguauuuuuaguagagacaggguuucacuguguuagccaggaugcucucgaucuccugaccucgugaucugccugccucggccuccuaaagucccaaagugcugggauuacaggugugagccacugcgccuggccugggucuuguuuuuuaauucauucagcuacuguguguguuuaaucagggaauuuaguucacuuacauuguguuauuauugauagguaaggacuuacugcuggcauuuuguuacuuguuuucuaguuguuuuauaacucuuccuucuuauuaucuuucuuugugguuacaugaucucucugguagcauguuuuaauuugcugccuuuuguuuuuaguguaucuauuauggguuuuugccuugugauaauucuuagauuuuaaauuggauugauuuuauaaguagaaccuauuggcaguaguagauuuuuuaacuuuuuaauuuuuuugagacggagucucacccuguugcccaggcuggagugcaguggcaugaucucggcucacugcaaccucugguucaagugauucuugugccucagccucucaaguagcugggacuacaggugugcaccaucaugcccagccaauuuuuuuuuuuuuuuuaaaguagagaugagcuuucacuauguuggucaggcuggucuugaacuucuggccucaagugauccuccuaccucagccucccaaagugcugggauuacaggcaugagccacugugccuagcuaguaguugauuuuuuaaaaagcagcugcuuuucuuguguugaagcucucaauaugaguaguggcuauggaaauucuuuguaggucaggacuucguagcuuccuguggccuuucuauaucucuuuuugcagguuuguuuuaguauuuauccacuauguguaauagugagugguaacagcaugcacucccuaguacacuagggaucacuuuacaggucuugaaccucuguaagccccauuucuuuaucuauaaucugugaauuuaucugauaaaauuuugugcuuuaaaagagauaauacauuuuacauggauuagcauguugccugcaucauaguaagcccucaguaaauguuauggcauugcugcuaaugcugcuguaguuuggaauaugaggauuaaauugugauuaaagaggaauguugauuaacucacucagcacaauaucuagcacauaguagauacccaauaaaaacguuccuuuuacucccauguucaaaugcccaccccgccucuuccccaugaauaggaacaaguagaugacuuacuagcuauaaugaaucuuuucuuagauccccaacuuggaaaaugaaugaccagguuaauauacuccugaauguugguuuuagaauuagauuugcaugguuuuaaaauaguuuuucuuaauugcacauuaaaaauguguauauuaacauuaacugauuuaucugguuguacagaugcuauuaacugaguacuuggauaugaaaaauacucguacggccucugaaccaucagcucaacuaagcuaugccagcacuggacgagaguuugcagccuuuuuugccaagaagaaaccucaaaggccaaaaaauucucuuuucaaguaaguauuauucugcuguuaauagguuuuaagaauuguuagacugaaguaagaugacuuccuacuuuauuaauagccauaacuuugucuagcuuaaguugauugaaguaauuuagaggaagugaauauauguugaguuuuauuuauuuuuguuuucugucaggugaagugguuguuuuggguacaguuacuggacuaccuggaacuccuaauaaaaauuucuugaacuuguuucaggggaguuuuauuuaaaauuaagagaaaugaaacuccccaauuguuucuggggaauuuuauaugaaaugaaaggaaaugaaauauauuagccuugaaaaggccccaagagccaagaaacaaccuuuguuaauaaaguuaugcaaauguuucuagcuaagcaguauugggccuuaugugguuacuuguuuaauaaaagaacaaucuggguuuuuuuuuaucuaauuauaaccuuaguuaacuccaugaacccaugugcccaaaguguauaucucuuggcaacagcuaauaguuaauaauauugauaauaacuucaauaguaacaacagguaccacugauuaaguguuuccuagguaucaggcacuguacugggugaguuucccaaaauaaucucaguuaaacauacuuuaaauuugaguauacuaaauuuuagcagcagcaguaguagcuaacguuuauugaguucuuacuaagugcuaaucaaggcauuaaauuauucucauagcuuauuuuauuuacuaauuacaacaaccuuauaggcaaggguuguauuuuuaauacuuuuguacauauaaaaaaauagagacaugaaagguuaaguaauuuacagaaggucucauagcuagcaugugguagaaggaggauuuaaauccuggcagucuuacuuuagaucuguuuucuuuugaggauuuaguagauauuuaagaaguugugucuguaaauauaagcauguaaagugaccaccacugaaguaucccaguauauugaauuuauucuuuuucagcaguuggagaucuaauaucuucuguugauucacauuugaggcuuguuuuuaucuuagauuuuuaguguuuuuaauaauuaaagcuucaacaguuuauuuauuuugugaucuagcagagaggagauuuauuuaguauaucccugccagaaaugaaaucuauucuguuuauugaaugcauuccuuuuuaaacaguuuuauucagagaguggaugcaauaucaguuacaaugcuuuaggcugcaaguaacauaaaacuuuaaauacaauagauugaacuauaggaaaguuacuaucucacguaacaaggaugaauguggagguuuccuuaauucaacuguacaauaucauaaaggacucagcccuuuccaucucucugcauugccauccucaacacauuaguaauguuuucuauugcgaucacgagguguauccaucaguuccaguccaguaaagacagugugggcaagaaaauugcaugugauucucccugugaaucucucucuuuaaaaaacauauagacuuuauuuuuuagaacaguuuuagguuuauagaaaaguagagcaggaaguacagagaguuccuuuauauuccccgcuucucugcauuuuacccuauuuaacaucuuguauuagcgucuguuuguuagaauugaugaaccaguauugagaugucauuauuaacuaaauuccauaguuuacauuagaguucacucuuuguguuguacaguucuaauggguuuugacaaggcauaaguucccaccauuacagugucauacagaacaguuucacugcucuaaacaucuuccauucaccacauauucaucccuccacccucccuaaccccuggcaaccucugaucuuuugacuaucuccauaaguuuugcuuuuuccagaauguuguauagucagaaucaguguguagccuuuucagaauggcuucuuucacuuagcaauaugcauuuaucuuucuuccacaucuuuuuguggcuugauaggugucucuuuguauugcugaguaacauuccuuuguguggauaugccauagcuugcuuauuuaccuauugaaggacaucuugcuugcuuccagcuucuggcaaucacgaauaaagcugcuuuaaacacucauaugcagguuuugguguggacauaaauuuucaacucauuuuuguaaauaccugggagcaacauuacuggaucauucagugauacuauguuuagcuucauaagacacugucaaacugucuucuaaaguggcugcaccauuuuaaaucuuuuuaaauuaguacuuacgaauuaucaguuuauuaaucauuucugcuaaugacaaaacucuucagcaaguuccuauuaagcucuaggauugggucguaagcccauuccuaaacuagucacuggcaaggggaagcagaucucagugguugucuuaaacuaggcagguuucucucuggugcuagguuuccagcuggagaggaagccacuuuuucugagcacauggcugaguaaagagcaaggaagcagaaugcccagauggaaucagggcuaugccagcaagcacaaagauaguagaaggaaaagguaguugguagaggcaacugacacugucucagaugcgccuaagcaggcccuuuucuuuucuuuuuuuuuuuuucuuuucucuauuucuagcucaauuuaaccuucuaaauauggaaucauugcagaaaacaggcuuuaggguuuaaaguucaugcucucaaccaucaccgcugacuuucaaccucagucagaccacauacacauuuucaaacauuuagccagugcuucugaaguugugguauugggaaaaaaaaaaaaagaaauuguuggaaaugaacaaauuggcuuaaauaauuauuacacauuuuuuauuauugggcaguaaugaaacuuaucacagacacagaauuaggccguuauuacagauuugucuguuuccagucuuggugcuaucauugagcccaugugugucugagcaggucucaguaucucuggauauaaacuaaggaggugagacucaaucucuagugccucuuuuacugcaaaauuauaucagucugugacuuguugcagacauaaaaagaauuccugaguaccaaaaauacaucaagucauaaaggauuaagauuuugacuguuuuuaucacaucuguggaggacuuuauuacccucuuuaauuacccuuagcuaagguuaauuaagucuguuuaaguccugccuuauugugcuaugugugccucucuauucuuugcuuaagaguuuauuuauuuuuuuucuuugccguaucugaucaauagcugucagcaugcuuuuuggaggucaguggcuucuuuucugcacuugacuggcagguggcauguuugaaguacugcacacuuugccuucuuucuggcuguuaguacccucuuaguucuuggcagggugcagagaggggaucacguaacccaaguguuucccucacagacugacauucaucucaguauucauguuccuugucaaggaaaggauaaagaaggcauaauuaagaaaaugauggugugccugccuuguugccagaaaccuaucccauuagcacuguugcucguacuauguugcugcuuuuaccccuuaguggcagucauucuuagaaggauuccuccaucuggcagguuguuauccugccuuugaaaucucaguuugaaaugggaucucuuaucacaucaaaggauuuacuguuugauaugucauaauuuuaucuguuuuuuuucuuacuugcacguuuaucuuaagacugauuuguuuuuguuauuucuuuuuguaguuauuauuuuagguuuuagaaaccuguucuuuaucaugagucucucccuccuucucccuccuucaccaguguuucuaaccucugaaauaguuccuggguaggugugaacaaauauugcguagcuugguauuuuugagaguauuuuauauuguaggcagcacgucaaaaaacuagcagccauuuagaaaagaaacuguuuuuuaggccauuuagggagagauuauagcugccuugcuuuucuggugcuguuauucagccacauuucuaguauguccuuugucuaguccucuaccuguggaaguuaggcaugaguucugcucugaggagccagugugucuguguugguagcuggcagucacuggugacuucugagcuggaugguaacguaauuagaaugacuucauaggaugcuuucguugcugcauguauaaggauccuggcuaaaggcugaugggggucugaaagcaaaaggaaguugggacagaucacaguuguaccaguugaaaugcagaauaagcaaaagauccaaauacgguuguaaaggagccuuagccaggaauaucgcucauaaaucaaggucugcggcagcuggcccuggcccugucaugguauagccaaagugucuucaucacggaacaucggggagcaccacacagaccagaguagaauaauguggaauacagagcuggucagcacuuaauugguuuacaccugcuugucuguuuccccuguguuucucugcagguucgaaucguccucccaugccaucaguaugagcgccuaucugcgagaacagagaagggagcucuauagucggaguggagaacugcaaggugagugauugagcuucucuggaaaaauuaauuuucuggaggaguauuuccuuuauuacacaugaguuuguguccugcauucacacgauccuuucaagguaacaaacacuuagugacuuaauaauuuguuucuucuguaauuucccagcaucugcugccaagcagguaaaacuauuacuguggccauaggacuuguagaccugcuacuguucaagugggaauucaaagcaaaaagagaugaggccaggcucgucuugcuuaaacagaagaccugaguccagucacaaucuaggagaauguuggucuucugcgacugccacuguuacuucuaauuguuguuuuugacaccuucuagaauaugacaggaguaccugagauuugggaaagggaaaaugcaaccacugucauuauuuaaagggaaaaagaugccucuaaauaguauguuauaaucaauauaacugugaugaacaggcuauuugauacccauguauaguuaccaaagaguuguaagcugaagaagaaaauauuuagaaaauaaauuaaauauaaauaaauauauuagacugauaacauuuccuucugugacaaaaagaugcugaucauguaaauguaaugaguuaagaaagguuuggaggucagguguggugacuaacaccuguaaucucagcacuuugggagacugaggcaggcagaucacuugaguccaggaguucaagaccagccugggcgacauggcgaagcccugucucuauaaaaaaauacaaaaauuaguuggacaugguggcacgugcguauucccagcuacucaggaggcugaggugagauugcuugagccugagaggcagagguugcagugagcugagaucaugccacugcacuucagccugugugacaaagugagaccaugucucaaaaaaagaaaaaaaaaaaaacaacaaaaccacauuggugagggccugcuaaguguaagacaucuuagguguuggaaguaguggaaguuggguacaaagaaauauaaagcuuaaagaucuaguuaugaaaguaaaguauacauaugugugugugcauauauacauacacacacagagauacacacacacacacacgucaauaacaauaucaggaaguaaauacuaacaacugagugggugguauggauaaauugcuagagaaauuacaagaaaggagugauuacauaaauuguuuuagaacucugggcuuuucuccaugagggaugggaacgaauacuuuuacugucuugaugcguugggcucacguagcauuuugcagugacuggccuguguaauuaaauauuuagucuuuaagacucauaauucuguaccaaaacacuaugaaguaaccacucaaccuuucuugauuuaaagacuauugccuugucauuccuaacuucaccuuuguuauuaauagaauaaccuguaaguuuuuccaaagaugcugcuguacucucucauauuuauaucacaguaauaguucuacagcccauaaauguggucaccagaaguaaaagccuagaaguauguuuaggguauuaggaagaggagauuagccuaccaacauuuuauuuaauaugaaaggguugucaugcauucuggaagacaugcaaugugcaugucgagagucuugauguagaggaguacagacugucauuagaccuggaacaagugaaaggacagaaaggagugaaggaggagggugacucaugcucuagcaggcuuucucugccucccaggagaagaggcuaggcugccaagagugaaaggaaaugaugauaacagaacauacauuauugcaggagguaggauugugcucgaacugcccuuagcaggcuaucuaaggcuaguguaucuuccacacucacgguauccuaauuuuaauuucucuucagauuugccuuaaggaauaguuuaaauuugccuccauauuuucucuacaccugucuucuaauacacauaaauuuauuugauggugacaaagcaucuccuuucuucuuuuuagguugaguccuaauuauuuucuuucuuaaaaauuaauaaacacuaucuguuagagcaguuauaaggucccagcuaaauugaguggaaagaacagaguuccugugugcccuuguccccacacaugcccaccuuccuccagugucgacauccgucagcacagugcagccuuccauuugacccuucuagugaacaggcagagcaugucccuaugguuacauagggaccgaggaccucucaucgcucacucacacucaagcauaaauagucaacaagggcacaggacuaguggcagauucuuuaugcuuguaugagugagaauggagagcacucugcagcagccgugggaaggcuuuucaguccugccccagugguccacgcucucuugagagacaguauaggguggcagugcagaguagguggcucugggcccaagucaccuccauuuagauaccuagcuccccagcacuugcuuuguaaccuccagcaaguuccauggucucugugccucuuuuuccuuuucucuaaaugggaauaaaaguaacacucccuacuccaugaggugguuaugaaaauuaggugaguuaagcuaggaaguguuucaaaaagugucugacauauagugaaugcuaugccuuucuucuucuccucuauuucuaguacuguggugugacuucagaguauucacacacauucuguuuguccuuucugucaucuuuauauggcuaagcccuccugagcuuuccaaguuaaauuuagguaucgcucauuuggaugggcuucccuguuggucccuccucucucagccugucacaaauacacacacauucugggguuguggccccugcuguguguuacugccacaucuuuaaugauguucuucugaguacuuuccauacugcauuguggaacaaugcucucuuguuugaguuugccacgaaacuauaagcugcaagagcaaaauacuauuuuauuuccugugcuucucacagcaccugguacaauaaauguuugauaaauacugguugacuuagugacagaaugaaugaggacaguuaggaucuaaaauaggauagagagcaccauggagaggcaggaagggccugaaaggaaccacuuucagcuuuauaguuuuccauuagucuuuaaguugaaggcaaaguagaggguauacauauaugguuuuguccucugcaguuauaagcuuuauuaaauagaaauauugcccuugagcucucuggcccaggacaaaacuacuguauguaauugaaaaacauuuuaaaaucuaagugacagaggaauuuuacucugugaggaugguuaauggagaaaucacuacaaucuaacuaggaauuuucccauccuucaaaaaguuaauugaaauaugggcuuucaagcacaagucgauugaacuuaccaguuuucagcaaggaauauuucugguuacaacagaagaaaaguaauaguuagcaaccacauuauguuccuaauaaucauuaaaaauacuuuaggugagcugacauauuacacacuuggugagagaauaaaucaguggaccaguuuuuguaaaagucugaugguguuucauucaggaggaaaaguuucucugaugaaugcuuuuaacauuucaacaggaaaaaagagaagaaaaucauaccugucuuccauuaaaaacggcuguccuuuuucaguuauuccauuaaugacugguccaaggaccacaaugagaucugcauuucagcuugucccugaaaaggcauaauugaauaguucagucaaaccguaagagacuaagggaagauuuuuguuucuucuguuaacaccauauagcggcaggcuuugcuucccaguaauuucgguucauacgucaacuuuuccuuccguugcaggguagcggcgaagaaauccaccagaaagacaaucaaaguaacauuaaaaagcucaaauuuuacaaaaguuaaguuccugccaacauuuucaauuuaucauacaauuagaaaugugacucagucuaacaacacccaagaggauaaaaggauuaaaaaaaugagauuucuuugguguuaucaaugcaucucaauaggcucuaacuguuaugguacagaugguucauuauauagucugcuguuggcaguugggcugcggagaugugggugcugcuucaaaaugugugagauaccagguggagaucuaacuugugggugugucaguguuaaucauaggcuuccugugguuuuagucucugccgcuucauuguacuuagcagugcugggagugaagaaagauacaaguuuuaaugaacauuuuauuugaauauagcuucucagguuuaauguauaauucuucaggggaauagauaauugaugaacacauuaucuggugaggguuaaaaaaaaacaaaaacaaaaaacaaucuaaagacuaccacucaugaccaaaauaagcucacagguuuaucaaugacauucugccucagauuucucauaggaaaaaauuagaacuguuuucaguccugacuacuuuaggggaauguugugacuauuaacuuaaauauuaaauuauuaguauuagaaauuucuaaauuagaaacauuagauuagcaauguugauuuaaaugauaaagugauguuuuaaaaaaucauuuugggccagacacaguggcuuaugccuguaaucccagcacuuugggaggccugaggugcacagaucacuugaggucaggaguuugagaccagccuggccaauauggugaaacccccucucuacuaaaaauacaaaaauuagccuggcgugguggcggacaccuguaaucccagcuacuugggaggcugaggcaggagaaucgcuugaaccuggaagguggagguugcagugagccgagaucgcgccacuguacuccaaccugggagacacagcgagacuccgucucaaaaaauaaauaaauaaauaaauaaauaaauaaauaaauaauuaaauaaaugagucaguaauaaauaaauaaaaauuuaaaaaguaucaucauggaguuaagggugcugcaucuacuucguuacuucccauuuucucuucaacuccaguccacugaguuagcucuccuccaagucaccagugaccucugcuugguagacuuaauauuagcuuuuucugacauucauuucacuugaucuuuccgcuguuuuucuuuucuuauccucauguucuuucugagucuugucaaaagccuguuggaguaucucaugauuugguccugggauuucuucugugcugacuuuguagacucuccccagaugaucucagccaagaccaagcuucacucagugcccgagcacagcugaccuccaugucugugucuccugcccuuuucucauuguugucuaaccuuuucuagcaucccgucucccuacaauauaauucuuuaucacaauauuuaaaaaaauuuucucauuguacuuuucuuaauauguacaugucuuuuuuaacuuuguuaacuuccuucacuucccuugacccagagugcaagccuuauucacggguacauuucaguaccuaggauaaugcuuggcuugaauuaggcgcuuuaagacauauaugaugaacacauaugauucuaucuuuaauaucuccuuauuuguagguacaagccuacuuauuugagaaacccuagugguuguuuaaauaaacagacugggaguccugugauuugucuuuucucauuuuuaaggauaauaaaacucaugaaugaguaagaguauauuaauugccauugauucaaauagaaauguauacucaauuuccauuauguuuucuuuucuaucucggggcuacuuaauacuuuuguuuuuauucaaugauauuaccuuuagagugccauuuuuauuuccauuaguuuaaugaguggccuuucuauagcccugacauuaaaauguucuguaaaucuccaaccacuugagaccucacuucuuuaagaugauuugcauuacauaguaaauauggacauacuggcauagguaaaaaagcucuuauacuggccuaaccugaauuuucugaguuuuucucucuaauggguugucggugacugggauugugaauacuuguauguaauuaaucucuucgggggugucuugccuuaagaaaagacaguauuugagauagauucacucugaguugauuauccauuucuacuaaaaggauuuauaauaggagucucuuauauagcaagcuguucuauaauggagcauuuaaggcaauauuucacuuuugcacacauuuucagggucacuuugauugaagugaggugcauuauuuuguauagcaauauuaugcuuaugacauauauuuguucugcagccuuaaauauaagaagcacuuucaaaacuuuauacccugaaguuugauuagaaaauucuuuguugccuucuagaauuugcuuaaugacuucauuaauaacuaugcaacaauaugcagggaacaugaaaaaaaguacauuuuucuucugaaaauugcauauaauuauuacaaaauaacuuuuaaucuuucauagucaucuuuucuguuuuagccucuaaaauaguguuuaaaaauugauuccccuuuucuucauggauuuauauucuugcuuuuuuuuaaaagaaugaccuuaacuuacuuauauguaagauuugucuuauaauaaaguuauaauagaauuuuuacaaaugcucauuucuuugucuaucccuaagacauuguaacuaauaaauauacuuuccucaagucaugaacagauugcauuauuucaaaucauuuaggaaauaaaaauauucuuaugccaagauuguuaucaaguguacuacuuuuuagccuuaauugauguagacauuuauuuaaaaauauucuuuaguuauggauuuacuuuauauaaguuggauuuguuuucugaauaaaucugauccaugcaguauuuugucuagccaguagacaaaccaugcauagcugaaccauauggaagagccuggaauuuaugguaaaauggaucuugagaauacaaaauaaccaucacaaagccgauuacucagugaagccuaagaaccucgcucuugagauaugauacuuggucaucacacagaaccaguugaugacaucuaaccuuauuucuaaaaauauucuauucauucauacagaugugagaaaagaaggaaugcugguaaaugaaacguaauguauuugaguuuuaaaaguugaacaaaugcauuucucuacauuuauauuauaugguuuuuuaaaaaagccaaauuuauggcugcgcaugguggcucacuccuguaauccccucucuuugggaggccaagguggguggaucaccugaggucaguaguucgugaccagccugaccaauauggugaaacucugucucuacuaaaaauacaaaaaucagcuggguguggugguauguaccuguaguccuagcuagucaggaggcugagacaggagaauugcuugaaccuaggagguggagguugcagugagucaagaucguaccacugugcuccagccugggcgacagagugagacuccaucucaaaaaacaaacaaacaaacaaaaaaaacgaaauuuguguaaaaaguuuuuguuuucagaacaaaaacuucugaaaugaugcaacagggaaauuuaaaaguuaacuuauaucucauauuuucaauuauuugguucacauugguuuuuuaauaagguaaaaauaacagcuuugcucaucuuauuagacauuuuuuaggcccacaagaaaguauauuuuuggcuauucuaauaguuuauauaauaccacucauuaugaguuaagccuuguuaaaauauggagaagaccacaaacauuuauggcauaugguaaagaaaguaauuauuagaaacagaugaaaauacuaaauaaugaauuuauuauugucccaauaaacacaauucauaagauaauuuuauauuugaaaaugaaguuuggauccuuuuaggaauacuaauaguaucaauagaaauuuuccuuuaugaagggagcuauuaauuaacaaaauucagaagaaauuuauguaaacaugcagguaaugugauaucuggaaaauaaaacaguagauuuuagugcuagaaagugcuuuagaacucauagucuagugcuuuuuaaauucauuuuuaguuauagaacucuucuucuauuuaaucuuauuucacaguucaagguagacaacagguaaaaguggagauaguuuaacaaagugggggugaggauucaaccucacuucaucuuuuucuuuuuccuuccucugugugggcacccaggguacuauuuaaaacacuaaagacucagaggcagacauauggaaauauuauaugagggagaaaugacuuuacaaaguuuaggaagaggacagaccagucaauaaagaauggugagacaauugaucaugcauauaggaaaaaaacaaagaaauuggauuuguaccucauaucauuuagggaaauaaauuuccaauagguugauaacucaaaugugaaaggcaaaccuauucagaauguucauagcaacauuguuuuaguagcaaaaaccgagaaacagcucaaaugcccauagaaagaaggauggauauguaaguuguuguagagucacaaaguagaauacuauguagcaaugaaaaugaaugaacuaugcuauacauugaguugguugaaucucaaagguagucauauaagaaaauauuagauaauauauuagaaauuagauuauauauagaaauguaaacauuuauaauguaauauauauaaaaucucuauauaaagucuaauauaaaucuaauaucuuacacauguaaacuuaauauguaauauauaugaaucuaauauauaauaucuaauauauuuaauauauauaaaaucuaaugucauuuguaugaaggucagaagcaggcagaacugaauagccuauuucauaggaauauauccugugugauaaaaaaaugaagaagguaagggcauaaauauaaaagucaaggaaaacaucaccucuggagaggauggaggaggguuguaaccaaagagaggaucucguggggauucaaagauccuaguaauguucucuuucuuaagcuguuacagaaauacuguuguuuuauucuuuuaaaaacuguacaaaugucauaugcacucauacauuucauaaaauguacagauauaaacaauuuuuuaagaagccucuuaaagcuuuagagacaaaaccauguauguaguuuaauguuccuguuuagaaaucgagaacaaauguggaguuuucuggacagcagcacuuuuguugcaacuccugguaugugccaaagcugugaacuaccccugaacgaguacuguaccuuaagucguccaugagaaggcaucuuugugguuagaagaguuuccucccaacuuaccugcucccuccaucauccuccaucugggaugucagacaccuaacauuaauuggagucagcagcgauuauacuuuuguuuccuguguuaagggacuuucuguuuauuuguuaauccuguauagguuuauuguauguuuacuugugcuggauacuucacuaggcccucaggauaaaauaaugaacaggacugccuuugaaggccaaaagaaaagaaagggaccauaaaugugucacuuauauggucaccugccucccagcauuuguucucccuuuccuccaaauucauagagucccugauauuucgcuagucacagggccacccaaaauaggaacauuucuaacuugccuugcagccaacauggacguguaauuuaauucuggcuaauaggaugugauugaaaguaauguguguaacuuugggucauucucuuauugggaagaaagaggcugucuuucucucccagcccagccugugugugaagguguggauaugaauggaaugugguaaguccuccuagaccaugcaggugaggcagcacugaaggaaagcuacaacaacaagacagagggggccuggguuucugauacuguguagugccauaccucaguaacuuccuggaccagagucaccgcaucaucccggacuucugcaugagagaugaguaaacucugacuuguuaauucacuaguguuuugauucauguuacaugcagcccuacuuauaucccaguuaauucagcaggaacacaagugaucacagcucugugauacacacuaucacggaguuguguguauguauauagacaacugggaugcauauacaaguucugggaaaggcagggaggcaucuauaaguauuuaaagcuuaaacucgguuauaacagaugaagagaaguuuuccagguaaagaaauugaggcaagcauuucaggcaucaggcacaguauggguaaauguaugaaaguaugagaguauaggcucuucucucaucagaguuucacaacaugaaucggauauuuuucuacuaauuaaggaacucaguuuauauauacagauuuuuacugauuauaauuuguuacuuucaggagucagaugaaaguacaucaaagcuauuaugaauggcuuuggccauuguucauccuaguaagagauuaagaauugauaagaaccaaugguguacuggugauaugggaaaauaaaggucauuauuauaccugagcaaagaauaaauguaaucacauacaggauuuuccgaguauuguucaaguguuguagcuaugcagcuuuauuauuaaaaauucuauaggaaaaaauaacuuuguuuuaaaugcacuuauuauagcauauuauauuagacucugcaugguagcugaggcuggaaauauugguagggcccacggcacaaccuauuucuaaaguaccuugcguuaaaaauagaauguucagcuugaacugcaagugaucaugauggcagccugguucuauauggagauugcagagcucugugugcucacaucugauuuccagcuuguaauuuugguguggaugaaaauaugcauuaaguuacuuuuggcuucuccacaauuuuaaacuggaaaagcccauauuacaguaauauaugauaguauguaugaaugcgacaugaauauuguaauagucauaauauaggauguucauuccuagaauugugaugacaucuacugaauugcagccaguaauuugcauauucaugcccacuuagcucaaauaagucccuguuuguuugcacauuaaugucugauuucagcaccagcuaacucauuuacauauccuguucaguugguuagugauguucauauguggaauauuggugcagcucuguuugggcuuugaguagcuugggguuuaguagaaggaucaccuguuacucauccuagcuuuucuaggcaaggcacuuuacuuuucugagcucuagguuauucaucuguguaaugaaguuaaugcugguuaguucuuagggcugucauaucaguugacacacuggagguuaugguguacagucaacauuucuaggccaacuauauucuggggccuguuccuggaacauuuucugcgugcagagggguucuagaugcuguagaagauaagacaugcaaacagucacaguuucagugaauauuagaaguacuuuggggaguacagaagagaaaacacuuaacauuuucaagggaagucauaggagguauuacaaagguggaauucuuacgccgaacugguaagaugaguugaccacacugaacaaaggaagggaacucgcggcaaguagggagaagauguggaugaacacacagauguuugagaaucucauggaacuggaaauauuuuauugugguuaagcauaaaguguauggggaagauugaacauagacauggaagacugguaggcagaucucaaaagaccugguaugccauagcaagaagguucgguuuuuguccugcgggugauaaggaguccuccaaagguuuaaaguaggagagucgcauaaugaaaugugcauuuuagaaaauguuuucugaugacuguguggagaaugaauugaguggaaugagaguguagacaaagaggcaaguuuuguuauuucaggugagagcucauagaagaauucuuaggugaggugggaagugacccagaaccuauuuuggagguacaaucaguuggacauggugacucauucugugugguguuucagcaagaagagauguauuuuggugucuuggguagguaaugaugucauuuguuaagacaggaaauauaaaaagaggaguaguuuuuauggaguguuagauagggguaaagauagcauuucauuauguaugcuuuuaugguucucuuuugguuguguuuaguucugucuaaucuaaucuagcccaauauaauuuuacuacauagucuaaucuuuuaucuuucccucaaguguaaggcuuucagcaguuugugauuacucauaaccauuccucuucucaaguucagaguaauggaguuacgguuuucuuccaucccuuuuccucuuuuuauuuuuuaauugcaaauacuacuuucuuuuuuuucuaggcuuucguugauguauuaguuuuagugcccacuuuagucucuuaagaauaugaauucuuuaauuuuuauuccuugauguacccuguauuuuuauuauuaaaaucaaacuauuagcgaugucucuugauaacuugcucugacuuugugcaagucacuuaaccaguuuucucaguuguaaaaggaagaagguaagugauuuuuuuuuuuggaaucucauuuaucuccaaagcucuagguucuuggauuaucagucacuggcccacuauauguuccucacagcagagucuggggacuaguuagagguucggaguggugggucucuggaauugggcuuacuaccuaggugacuuugggcacaguaacuccuucuaugugucacauucauuuucuuaaacugugaauauaauauaccuaaccucauagggccauagugaugacgaaaugaguuaacacauguaaaauguuuaaaacugugccuugggccuggcacggugacucaugccuguaaucccagcacuuugggaggccgagguggguggaucaccugaggucagcaguuugagaccaaccuggccaacauggugaaguccugucucuacuaaaaauacugaacucuacuaaaaaauuagcuggacaugguggcacacgccucuagucccagcuacucaggaggcugaggcaggagaauuacgugaacccaggaggcagagguugcagugagccaagauugcaccauugcacuccggccugggcgacaaagcgauacucugucucaaagcaaaacaaaacaaaaaacugugccuggcacauauuaaguacagauaaauguuaacaacuauuauuuuacccguaaccuguagcaccuggcaucauucgucacacauaggaggcacucaguaaauguuuuuuuaaauuaaugaaccaauaagccuguuagugaacaaguaaguucuaguaguaucucuuagaauggucccuagaaacuccuccccccacccccauuuuuccuguuuucuucucugacagaagucuuucuagacuguugagaaaauguguuuaccucagagauugucccaaucuuguaauguuaagugacauccauuuugagaauguaguugugauucacauauaccucuaacuaagagggccacacuuggugaccuuuagugaauuugucuuucuggccuauauucaccccagagauaaauauuaauggccaugaugaacguggccauuuuucuucaaaaccauuuggucugcaguggcacgaacucuaaauuuuacuacacaaauaauuuaggacgguuggaauauggcuaguaaagagguuaaaagggaaaggacagcccuucuauuuaugaauuaauggcagcugaaaauuuggcauuguuuuauguacauuauuguuuugccuuccucuugccuccaguuugacaucacuuucuugcugcuugugaaaacaaaaauaaaaaugcaguuguaauccuuuaacggauuggguaauacguuggugagggagagcuucuuucuucaagucuaucuacagauuggaaagcugaccucuucagaaguacccuuauagacacacucagaaauaaugcuuuacuagcucugugagcgucccuagcacagucaaguugacauauaaagguaaccaucacagaaacaaaguuugaaaaaaaaagguuacagcugaucugaaagggaaauuuuugacuuggcuuagaaagcaagcaauaaauuguuuauggauaucauuccccacagcaugucugcugaaagaggacugauaaaagcaaggcaauugaugggaugaaucauucgcucauuuaugauuaucuaccauuucuagauuauaggaauguuauugaggaccauuaacuccauauccacuuaaauaugucaugaaucauuuuuuaaaauuucucaagacaagaacuuuuuccauaagaauucuuuaacauguaaauugagugguugacuaucauuucuaaauuaugguauucacccuaacacaauagauguaguugcccuaaaauagauacagaauuuggucuaacuuauucuaaccaauugaaauccuuugucauccccaaauuauaaucaguaugaucuucuuuuuacugucacuuccaggacauuuuuuaggcaaguauaaugcccaagaggaauaauuagcucuuuuuaaguaacgucuacuuuucuaucuguuuuagaugguuucuguuuaguuauuagccauauuuguugcauuuuacacuuugaaauuuguaguuccuauaauacuuuuagaaguaauaauaauauacauuauauuaaaaaaauugggcguggcaugguggcucacgccuguaaucccagcacagugggaggccgagcugggcagaucacgugagaucaggaguucgagaccaaccuggccaacauggugaauauaaaauuaguugaguauaguggcacauaucuguaaucccagcuacuagggaggcugaggcaggagaaucgcuugaggcugggaaacggagauugcagugagcugagaucacgccauugcacuccagccugggugacaagagcgaaacugucuccaauaaaaaaaaaaaaauugugcguaacacuggaguuuuagaugccuguacacugaaucuuuucuguucuuucuccccuuuuuuaaccuuaguuuauuuauuaauauuauuauuacacuuuaauuagauuucacuuauuauugaggugaauguaccugcagugaaguguguaaugugcacucaucuuaaauguacagcuaaauucuugcacauauguauucccauauaacuaccacccagaagauuuccuaugcuucuuaacacucccugagggucaacacuauucugauuucuaacucuaucucuuaguuuuaccuauucuuuaaauaaauagaaucauacucuguuuuguguuucuggcuucuguaacucaacaaaaugucuggcacauucauucuuguggauuugcauaucaguuuuuauuauugcauaguauuuuauucuaugacuauaggacaauucauucauucaccuuuuaauggacuuucaucguuuccacuuuggggcuacuauagauaauucuccuaugaacaguuguauuacaaaugcacuaauuucucgugggaauauaccuaggaauggaauuguugguucauaacauaggcauguguuuggcuuuaggagauacaaggauuuuaccauuauagaaauugauaagaaauuguaugacaauaucaguugcuuuacauucucacuaauguauuuuuaugggcucaaauuuuuaccauucucuugaguguguaguauaccuucuuuuuuuuuaaagaaaaagagucuaagcuuuccuuacuucugcuacucuuccccugcccccauacuggcaggaauuucuggauaugauuauuugcuauacagacuaucugccaauuuacugauuuacaguacagcauuuuuuguuguuguuguugguuuuuuuugagaugcggucuugcucugucccccaggcuggagugcagugcaccggugugaucauaacucacugcagccuugaucuccuggacaucaggugaucuuccugccuuagccucccaaguagcuaggaacacaggugugcaccaccgcaugcaccaucacaccuggccaauuuuagcuuuuuuauugagacaaggucucacuuuuuugcugaggcuggucucaagcuccuggccucaaacaguccuccugccucagcuucccaaagcacugggguuauaggcuugagccacugcacccagccaauauaguuuuucauaguucagugaucuuguauuccuucuagaagaaguccugaucauguucauacaguuucuacccagaauucuuuagcggcuuuucuuacuagaaaucaccuaccauauuucuucgcaccuucgagguggaagauaaagguaucuccucucuuucaacuuuuuguaauuuuuuggccagugguuuucuauuuugaaugaucuuuuuauugcauguuucuuacugauauucccacugguaguaggcagaauucuagaaugaccccaaugaccagacccaugcccauguauuuauaauuuuuccccuuugggugguauccaugauucugacagacugucacucucgggguuaguuuuuuauauggcaacacugaauggauuuugcaagugugauuaaaaucccuaauaauuuaaauuugagucaaucaaaagggagauuacccugguugggccucacaugacauuugaacccuuaaaagagacaaaaagcagcagaaggugcucuucuguuagccucaaaguaguaauucuugugaauagauuaggccauguuguaaggaccuggggucaucucugucuaacagccaacagaaaaauaggaccuccauccuacaaccaaaaggaacagaauucucccaacaaucagaaugagcuaggagcaggucccuaugccuuagauaagauugugaccuugccugacaccuugauuucagcauaguaaaacccuaaacauaggacucagcuaauccaugucuggacuucugacccacagaaauugugagaucaucaauuuuuguuuuucugagcuguuaaauuugugaaauugucccuuugagacucccauguaguuccuaagacugauggauggaaguugcuaggcuagcucucuuguuguaagaaaggcaaacaacucuuuucccuaccuuaaauuuauuccaacucucugucaguguuuuuuuuuuuuuuuugagacggagucuugcuguguugcccaggcuggagugcgguggcaugauugcggcucacucacuacaaccuccaccuccuggguucaagcgauucuucugccucagccuccugaguagcugggacugcaggugccugccaacaagcccagcuaacuuuuguauuuuuaguagagaugguguuucaccaugcuggccaggcuggucucaaaccccugaccucguguuccgcccaccucagccucccaaaguguugggauuacaggggugagccaccacgcccuggccaaaguaacacuuugccuccuugucugggaaucgaacccuggucucccgcgugacaggcagggauaucacuauacuaaugaggaagacaugucuaucagucuuaaaauaucuccuugccccuccaguucucuauggcuuuuauuuaauuuggaagcugaaaggggcuuugggaaagaauggaggucuaauagguuuucuguguuacugugggcuuuauaguaugagauacccauuuugaaaacguuuguaguuauagguauaguaaagacaucguugugaugauagcccccugaggaaagcagcacagauuaucauguuaccuuucugggcugucucaugagaaccaggcacugaacaugcccaaaucagacucaugauuccuccucccuaccacucccaagcccgcuuuucuuucggugcaccugauuuuguuaaauggcacuauugauaaaccugaaaggcauccuugacuccuccuucuuugccauagacaaucugucaccagauccuacugaugcugccuccuaagugccuuacaaacccauuuacuguuucuuuuuaaaaugucccuugcggcugggcacgguggcucacgccuguaaucccagcacuuugggaggcugagauggguggaucacgaggugaggagauugagaccauccuggcuaacacggugaaaccccgucucuacuaaaaauacaaaaaguuagcugggugugguggcaggcaccuguagucccagcuacucgggaggcugaggcaggagaguggugugaaucugggagguggagcuugcagugagccgagaucaugcuacugcacuccagccuaggcgacagagcgagacuccgucucaaaaacaaacaaacaaacaaacaaaaauaaaaugucccuugcuucuacccagguucuaacugccaucaucucuugguuguuccugcuucuaucucuaaucccuccaaaccauucuuuauaccagaacuagagugaguuaaagguauuuaauaauuucguauguacuaguacuaaaccccauguccucaauaugccuaauaaaguucugcaugauuuagccaccacuacgugcagcagcuucuuggccucuuuugaaaaucauaaccuugugggcuucucagaacaugcugugcuuguucaggccuuggaggcuccuugcaugcugcugucuauacauggaauuggcuuccuuucauauucuugauaauuaaugccaucuuuaagauaacguucucuguauaauaagaauuuuauaucgugcuuauuaaguacuuaccaugugucaaucaguauucuaaaacauuuuaccgguaguaugucuucuucuuuuauucucuuaaccauuauuuucuugggggagcuuuuugaaaaaaaaaaaaaaaauuaccccagaccaggucaacuuccuucuuuguagcacauggcauacuuacaauuauucaguuggcauacuuaguaauuuaauuauuugcuguuguuuaaaauguguguuuaucauucauuuuaaguuccuugcagucagggaccaagucaguauauaccaaucacugguauaguaagcaccuaauaaauaaucaugcuuauuaaaaguaaaagaaguucaauauuauuaaacaaaugccugauuuagacaguagcuuagguauuuucccuucaaguuuagagcuuuuuuccauaagcggauaauauuuggggauauuuaggaauguaucauagauuaaauuauauuaagaaggaagcuaagagaaacuaauguuacuugagagaagaggaugcagugacugagauggaauuauuuaggguauguauauaauuauuuuguuuucauaaucauuuugucaaguaggccuuaugauaugguuuagauaugugucccugcccaaaucucaugucaaauugucaucuccagugugggagguggggccugaugggggugguuggaucacggggcggaguucucguguaagcuuuagcaccauccccucugugcugcucuugugauaggguucuccugagauuuuucucuugcucaugccauguaagaagcgccugccuccucuuuacccucugccauaauuauacauuuccuggggccuucccagaagcagaagccgcuaugcuuccugcacagccuccagaacugugagccaguuaaaccucuuuucuuuguaaauuacccagucucggguauuucuugauagcggugugagaacagacuaauaugccuuauuauuucauuucuauuauagcuaaggaaaaaaaaaacauggcucauggagguuaaguuacuugauuauagucacaaaaccaauaaaggacaaagauguuacauaauaguuuuauuauauaggguuugcaaaauaacuugcauuugaaauggcuuguguauuuuccacuuuauugagauaauuucuauauaauccacauuuauuuaaaaugaacaguuugaugaguuuuggaggauauauacaccugugaaaauaaugucacuauuaagauacagaacauuuucauuaccuagaaguuucuuuguauccuuuucagucuguuucucccucaauuucaagcccuuggucacugguaaaaugcuuuaugucauaauagaugagcuuacaacuucuauaauuugauauaacuggaaucauacaauagacaauuuugugaucagcuucuuucacuccacauaaugauguugacauucauccgcaguguugcauucuucaguaguuguuccuuucacugcugaguaggacucuguuguauggagauacugcuuauugcuuaucccugcaguuguugauauacauuuggguuguuuccaguuuuuacuuauugugaauaaugcugcccugaacauuugugugcaggucucugugugggacaguauucccugaggaacacauacgagugggauucuuagguuauaugguuaguguauguuuaacuuuuaaagaaauucccaguuuuguaaaauaaauguauuauuuuauauucccagcaacaaugugugucagcacuugguauugucaguucuuuuaauuuuagacauuacucuggguguguagugguaucucauuauggugguuuauauuuaauauaacaucuuauugauguaggaggccacacaaauguggauucaggccuuggaaguuagaaucaaccucaaauccuuuuucucuugugagaauucaucuagaccucuuauuauaugucaugucuuuuagaauaacuugugucuaccuccaugaaguuuuuaaauacagagaaaauacauguaacuauuuuacaagucaacuggaaagccauacauguauguauauguucguguguguauggcauauauguauauauaauuauucauuaaaaauaaugcuuacuaaaacuacucauacucauuauuguauauaucuauauuuccagcaucuucugaaaguuuguaaguucugaauaaauccugcuuugaagcuaaaaauucuaaauuguugcuuuauuaguaaucacagggcuaaugcaaagcucugauaauuaagacuuuauguuuuucuuugagugccaccauggcagcaaaugguaucugaaacugacagacuguagauuaaaacuuucagaauguaaggccuagucuagggaaaaugaaguuauguauaggugacuuguuccauuugaauuaaucaaagggcugcugguguagaccagcuguguucucugaugacaaaaacgaaucuugacauuuuagauaaugaaauucaguucagcaccucuuagagauaugugugauaauauaugucagucagaaacagagagaaggggagaagcucaaaccuugucuuauuaaaauagacauugugacaaguggacauugcugaaucucugguuucuaggggaaaaaaugucaagggaaaccucuuuaaaaaaaugaugggaauggcuguuuuauggaagcugggugaaaagauuugacuucugaugcaugaccucuuugacaguugccuuuguucaugauuccuaguuuccugguuuauuuuauugggguacagggugaggucuggaagaccuggaaaggaaacucacuuuuuugguuugacaguauuaaugcaaucaucuaguucauaccuuguaagcccacuuauuauuuccucugcguguguuuuuucugguuuagcggauuagcugcacugucucuucaaaggcuauccaaucaaggagggguuauuaaaaccagggcgauuuaugacugagaauuaauuagagaagcauuuucaugcacaacauccaauuuuuugauuagcaauggagcagggccgcaauuaacacucgaggaagcuuaaauuuccagcuuuuugauucucaggaaaugagauuaucaaaccagggucagacacuugacagcaaagugggagugggggagugugaaauuauauguaaaaaaaaagaaaaaagagucguuugauuuugauucugagauugcuauuaagacaaugggaaauucagaggagggaaagaacaaaaaaucugaaauggaagaaccugaaaggacugauucuuugguggccuauuugcuaugcacaauaucuguuguaaauguuugcuggaaguauguuuuagaagcacagcaauauuguuguguuccuucauuguuacuuauuauucaguuuuucucucauaaauuuuucuuggauauucaguggcugaacaaauauuuaaaauguuuauauauguuggagagaggccaaaauuuuucuuguuagaaaagagagcuucuuuucuaaaugcuaauuugcuuuuuuguguguggggggagucugcuucuuuucauugguguuuuuaauuuuuucaagucacucaagacacaguuuagguagugaguuaugucaagccauagaugaccacuuauugcuaaguggccuugucaagcuuaggugccugagauaagaaguaaggcaaccgcagguuugcuguaaaacaaaguguauucugucaucaguguaauuggugcuccccaaggaaugcaacauaaugaaaauucauuuguucuggaaaauauuuuucaucuugucuccucuuaauuuggacaucuaauuuucauggagaaauagcagagcagcaaaucuuuuaauucauucugccaaguuaaaacucauaugcaucucuucuuuauucaguagauucuaagauuuuuaagagaccuugucaguauuuuugaaucauccaacccucucuucauugcccuguuuucauauuugcauguaugaugaauugccuaucuauaaauaguguaagacuaguacaaucuaaauauuaaaauaguaauauguacuauuuauagauugcuugccuauuggucuuagggaaauuguuggcauccaguucuaagaggaaacacaagugaucaaugugucuuuggcccagggugggagagggacugagaauugguugauagucuugugugacucugguuucucucauauucuccuagcauugguuucucuauuuaaauaaggguggggcuuuuuguuacaaucuggggaguuauuuuaaaaaacaucuucauaagcagauuccagaauacaccaaaaaugaauggaagagaccauacgucauuuauauaaucagagauuguugcuauggcauuuuucucucuaaagccccucugguuuaggaacaugauccauugaucuagccuaucauucuugcaauccuacuauggauucucagcuuuauuugucagucuugcuuaauccuccuuccuuuguugaugaagaguaucuaucacuggcuggaugaaaauuggcugcaguuuaaucuuggggaaaaaggaagaaaacugccagucagaggcugaagaguugaucuugucagauuuauagucaucaguuaucagugcugaucuucauguucuuagauguugaugauuacaugcuuuucggcauccaauaaacauuugcggaaauaauuuauaguuauauuuauggauauuuccuuuguugggaaauguuccugcauuuccagguccauagcaaagggagccuaagcguaugaauuagggauucuuaaccuauguguguuauguguugggugguuugggggaggguacguggguagccuucagggaaucugugacacccagcagugucuucagauuagagggguggggagcaggaagaaguuaccaaguuuucauuagguuuacaaaaugcuauuguuacauguguguguguauacauagacacacguauguauauguguguauauauauauauguauacauacacacacguauacacacacacacacucacaaauacguguacaaauacaguucccgacuuggagagccuuauuaucaacagaggaaaacaauguaacaacuuuaguaaaagcauaugaaaugauauccuuuuguaauaaaugugaaugaaauacaucuaaccuauauuuaaaugcuuaguaacauuuaauauuaauuauauuaacaucacagguaggcagaaaaguugaauuuauaaaaauugagaaaauuaaucaagagaggcauaguaauuaagugugaaucauuuuaaagaaagcaaggauuauuuaguggaguagaaaaacagaaaagcaaagcuauucuagguugguuuguuuguuuuuucuccuuuaaugugaagauuuuuaaaaguacaguuugauauagcucaauugaucguuuaauuaaggaacuugauuugcuuuaagaggcucgcaauugauaauaaucauauuaucauguugaauucccaguggugaggugagggugucagcuguucuacuggcgcauuuuugcuuugcuugauuugcuguaugcucaguuuauaucgugguagaugacagaugugcaagaaggcuauuuaaaaaucauugcuggugauggguggaaaagaaugccuuuaguuuuuaguaugauauaauuaaucuuuaauagugaucgacuaauguauguuuauaugauuauaucugaauagauauuuauuaaauauauauuauugauauuucugccgggguaacuguguuauuauugagucucugggacucuuuuccacuucccaucugaauacuugcuuuaauaagaauauccuacucuagcagaaguaguguagguacaaagaaccccguuuucuuagguuaguggucaaucuaugaaauuagauuuuugugagcaugaaaguagaguguagcccagugaaaugaaauauggaaaccucaggguucaaagcaauggguuggcagagucaggucggagauugaaauguugugagucaucuaugagauagauggaaacacuggaguuguugagcuuuuaaaacaguaauagauggaaagaaaaacucuagacucugcauaaggaaaaggcuacuaguuuguugaagaagaguagcuugugagacucgaggagugucuugaauaaguuaggggaagggcaggcaaauggacacuuaagguuuauagugugaauaucuucuaucugcuuuuugaaaaacacauuuaaaugaguucuuaaugauucccaggaaccacaguccgauuuuggcuuuuguuuccugugcccuccugucaguuuugauaacuguaccuuugucucugagcccauuuuuuucaaaauuaugguuucauuuuaauuguuuaauagucugcucuugucuguaauuuccagaguuugaauuguaugauuuuugcagccucuaugaaaauggucagugaaaaagaauuuuugguuaacuaugacauccuguauuuaauggaaauauuuuguuuuaaugacaugaaaccauagccaugaaaauuuuucuaauguaacaucaagaacuucucuuuguauauuauaugaaccuucugugagguccagcuaauugcaagacguccuaaguuagauaucucgugcccauucugauucuucuaagaauuuacuacuauuuuagaucacauuaagguuuucagauuuuucucuaauugcuugauaauguaacacaagcuuaauaguguaauaacaaaagcuugauguucuguaguuagauucuuuuaaauaauguaaaaaaaaguuauaaaugauuuguagcuuggaugacuuuuuacauuucucucugggaguuucaguugcuaugauuuuguuguuguguucagcuuaauugccauuagcuacugcugaagucuccuccuuacucaccgugcaggcaguguccaucagcagcauuuaguacaggaugaaugaacgauuccuuuuuguuauguucaauggaauauguaaauacuuucaaauggccuucuucaacuagaguuuuuuaaaaaugagagauacgcuggaaaaauacuuugaaaaauauucauauucuauagugguuagcuuauuuguuaguuguauuauauuuggcaguuggaugacaggauauguuuuagaauaccugaauaaauuagggaggauauauuucuuuaauaugauuguuuuaaguuguagauggcacucaugguaauguuuuaguaaucuaaauguacucguguauguaauuaaaguuuggauaaucauuagugauauuaaaccccucaaaaaauuacauucuucccugggucuaggaagcaucuucugaguuaaucuacacuagcaguuuuaaaacuguguauguucccuagaacaguuagaggucuggaaagguauaagaaauugggugaucagaauucucaguucccucuugaaagcuucauccagggaugcuuaauuuuuuugguuuuguauguugggauuucacacagacauauuuucuaauuuugcuauuucaaaaaauguugcaguacagacuuuuaugaacaucugugauacuccuuuaauauagaagaugaaucauuggguaaaaagauagucuuaucuaaaauuugauagacuaccaaauuacuucccgaacaguguuuccuaguuuauacuucuuucaaaaucuauggaaacaucauuucuuuucauccuugacaucauuuaauauuaccauuuuuuuaauuuaaauuuuagaucuuaaaaauuugaaaauuuaccaacuugauuagaguguguaccugauuacuagccagguuuagcauauuuuuugcauuuauuugacauuuguaguuuuucacugaauuauuaucgagucuaaaaauaaucccuaacaccucuuuccuauuuuuauuggacuuuuuuuuauuacugauuuuuagauacucuauauauucuagauacaaauguguucuaaauacuuuuccuccuagucagacauuuagauaagauuuaauuuggggacaaagaugauuuuucuaaaaauaauuucaaagcuauuagaguaguauuuuuugauacuaugauuucuuuuagauggauguuuuuaaaagaccauaaaguaaguagauauuacaguuuuccuuggguaaucuguucuagugucucacaguccuuauuaacuuucucaacuuaaaaaaaauaaauguguuaauuaacauccuacauuagucgauauaccuaucuugcuuauuugguacucuaaaaaaauuuccuauuaacaugaaguuacaagauuucauuaaguuuuuaaauuaaaucucaaaucuuuuguuacuaaguagcaacaugacugcuuuucuucuuaaaauucaucuguuuuauaaacugucagcaucauaguauccuucuggauaauuugugagugggcagcaucuguacuuuucagaagggaagaauagauauuuaauaauuuacucaagguuguaccguugcagaaucagaaauuagaaucucagucuguugagaugugcucucaagauaaaauacaugugccaugcaaauagggcauagcuuucuugucuagcaaugguuggcccaguauguggcccaacauauauuuccuguagaaggaaugagaaucacuccuauguugaugaccauagcugaacaugacuggaagaauuuuagcaugaccaguugacuuuuuuuccuaucaccacuggcuaguucugaaguauaaaguguuaaguuauaaacugcagcguuauaauuccucuucugguaaaaugaaaaaucaguacuguaaucccagcacuuugggaggccgaggcagguggaccaccuaaggucaggaguucaaaaccagcugugccagcauggugaaaccuugugucuacuaaaaauacaaaauuaacugggcaugguagugcaugccuguaauccagcuacucaggaggccaaggcaggagaaucacuugaaccuggaaggcagagguugcagugaaccaagaucgcgccauugcacucucagccugggcaacaagagcaaaacuccgucucaaaaaaaagaaaagaaaagaaaagaaaaaucaguaacaaauacacagauuuuuuuuuuauccaugacuacaaagguaccuaacugaauaauacaucaugauauuucuuauaucauuguccuugagaacuuaagucuuuucaaugaaagaaaugaaauaugaaguauuucccgagacaguguucucuaacuuuggggugcaucaaaugccuggaggucuugugaacacagcuugcaggaccccauuacuugaauuucugacucaguaggucugagauggggucugaaaauuugcauuucuaacaaguccuuuuaugaugcugauggagggaccacacuuugagaaccacuacucuaaaccuugugauaaaaaugaugaaaggugaugcuaaucaggauagccuuguugccugugaccaacuacuucuguuuccucuuuaacacuguagcacuuaggaauuaucuuauuuccccuggagaagaucaaaccuaauagaauuaugcaugcgcuguaagagaucaucaaccuuacaccuuuucccuuggaccuagagcaauuugaaaagagacauuuccaucaaaggacauaaaaccuguagcuacagucacaaguuaacaauuaucaggguguuuguaccugucuccuccauuuggguuuuaugcaugaauuauaaaacuagagaugggaaaguaggaagaggaugaaggaguagcuuccaaacuguuacuccaauagagauuucauacuaauuuugaauugaaaaugauuagucaguuuagauucuuauaaggcauaccacacuauugaaaaauaauaaaaugcuauagagagauauuaucauugugcuacauguuuuguuguacguuacuguugaguuuuuauuccagacuuucuuuugauuauuuuugguccugagcaauuuuaaaaggcacauaguagaaacugcugguugcuuaguauccaauuacccaccuuuucuccuccuuuuuuaccccuucuuauuguauuuaagguggcaguguuuccagugauacauuucucaguguuuucugcaguugggugcaaccauugaaauauaagcagaggggccgggcacuguggcucacgccuguaaucccagcacuuugggaggccgaggugggaggaucaugaggucaggagaucgagaccauccuggcuaacguggugaaaccccauuucuacuaaaaauacaaaaaauuagccgggcgugguggcgggugccuguagucccagcuacucaggaggcugaggcaggagaauggcuugaacccaugagguggagcuugcagugagccgagaucacaccacugcacuccagccugggcaacagagcaagacuccgucuaaaaaaaaaaaaagaaauauaagcagagguaguuggguagggcuucugauaaaauuccuuaaagaaggcucagcuggaagguucucuuuuauaacccuuccucuuccucucucccuggcauuuggaugucuuagugggccaucccggacucuaaggccacuuugaaauuggaagccaagcacuaguagagcaggaaggagccuugaugccaaaugaccacagacgaacauuuccagcccuggacuauguacugucaaauuggagagagaaauaaaugucucucuuguuuaaccaguuuauuuggauuuucuguuauuuguaagcaaaccuugccauuuauguugaagauggcauugucugucuuuguuaaugaggggugucucuuuaaaaccuacgagguguuuucacaggugacuuuguaaguucauuguaaauuauuccacauguaucacuggauccccgucaucuuacaucuuuucuuucuucuucuuuucaccuagugaaauagugugucuuuuggagucagguacaccuguuuuauuuuuaacaaguuuauugaggcguaauuacagaacauaaaauucacugcuuuuaaauuuacaauucagcaguuuuuagugaauuuacugguuuacaaacauuaccgugauucaguuuuagaacaugucaacccauuuacguuaucccuugugccuguuugcaguaaauccccaccucagccucagaagaccaccaaucuaauuuccuucucuauauauuuaacuuuugggacauuucuuauaaauagaaucgugauguggucuuuuguauuaccuuguuuuagugagcauaauguuuugagguuuauuuauaauuuagcacacauccauaguucauuccuuuuuauuauugaacaguauuuuauugaaugaguauacuguauuuuguuuauccauucaucaguuaauggacauuggguugcauccacuuuucagcuauugugaauaugcugcugugaacauugcucuucaaguccuuaacacaccuggcuuugaaucuuagcucugcucaauaggcuggugaccuuuggcaaauugccuaacuacuggucucuaaaaccugugauuuucuuaucucuaaaaggugaucauacagacuuccucauggaguugcugugaggauuaaaugaaauaccuuacgagauccuuuguuuagcaaucuaaacacuggaaacauacgagcaauagaauugucucaaaagcauguauuaaaacaacccucacuguuauagugauuuucaguaaugcacuguggguggugauagugggacccacagggccucaaauaacuacuuaguauugucuugauaguuuauucauucacuaaggacagagugguacauaucacaccagaagcuguagugacuguauugugauaguccugguauugcacaaguugugacuuuuucauugcucauaugguuuggcaaguaagaaccaucuuaaaguucagaauuguagugugccgguacauaauaugcucuuauaacuuauuuauaaaagaaggaaaagccgaaagaguauauccacaagaucugcaucauuuuuuuuuucucuuuucuuuacugguagguaaaauaccuaaaguuuggacauauuauuaauccagaacauuuaggcuccaggcguccuggcuacauaauuuucuauuauacccucuuaggugugugccugaggucugugaauuaaacaauaaaaaagacaaauucacaagauuaaaaaagaagaagcacaccaguuuuauuuuaaauuuuacauguguggaaucagaaaggaagugaaaucucaaguaguuagauuggggggcuuauauacaauuuuaacaaaggguacuaaauuguugagaauugacuagacaaagaggguuuggguuucuaggggcaaaaaaaauauugugggaagaugagauauaugggggaaacuaaugacagguaaggguuauuucguaaggguugauuaugcaaacucauuucaguguucucucugucucuggugauaaggauuguucuucauuugcuggcacgggaguaggagcgggccuucacaagagagaauuaaugcccacuuuuaggcagaugggggagggcagagagcuauuccuguuucuguuuuuucucaguugccuucagcucaaaaucauccuuauuccaauguggcauauuuuggggugacauauucugguucccuuaaguauaaucauuguagagcaaaugcagacacaguaccugugauguaaauauuuagugaaugaauuuaguccugugugaaauccucccuccccucccuucccauuccuucccaccacuucacgcuuaaccacagugcagcauucuuacuuuuuggggugacauauucugguucccuuaaguauaaucauuguagagcaaaugcaggcacaguaccugugauguaaauauuuagugaauguuaguccugugugaaaugcuccucuccccgcccuucucauuccuucccaccacuucacgcuuagccacagcgcagcauucuuacuuuucuccuccugcucagcuuggagaauucagaugucgaugagacaaaauggauccuacucuccuggagauuacagucuagcaggggaaauguauauuaagcaaauaucacacaaauaguuguuaaguugugauaacugcugugaaaggaacguauagagugcuuugaaaaugcccuggcaugguggcucacgccuguaaucccagcacuuugggaggcuguggcagguggaucaccugagggcaggaguucaagaccagccuggccaacauggggaaaccccgucucuacaaagaauacaaaaauuagccaggcgugguggcucgugccuauaaucccagcugcucgggaacuaaggcaguagaaucacuagaacccaggaggcagagguugcagugagccgagauugcgccacugcacuccagccugggcgauagagugagacuccaucuuaaaaaaaaaaaagaaaauacauaguacaggaucuagccuagucuacagagucagaaaucuucucuggggaggaucucugaaggauccuagcaucagggagauggagcagaggcaagaaagggcaugccaaacauagggaagauaguugugaaggcucccagugaagaagaagaucaaugcgcacaagaaauugaaagaagguagcguagugagggagagcuuagcucaaaaccaaaccaaaccaaacaaaaacaaacuggagaguuaacugagcuuaggucauucugcgcugugguuaagcgugguauuagucaucugauuuuuggcaaguuacuccuucuacgccucagucuguuacauuaagguugaucauucucaucuucagggaggcaguuaaaauggaaaauaaaucauaugaaacuggccaggugcgguggcucacgccugcgggcggaucaguugaggccagaaauucgagaccagucuggccaguguggcagaaccccgucucuacuaaaauacaaaaacuagccgggccugguggcacacaccuguaguuucagcuacuugggagacugaggcaggagaaucacuugaaccugggaaauggaggcugcagugagccgagaucgcgccacugcacuccaucuugggugacagagcaagacuucaucucaaaaaaauauauaaauaaauaaaguaugugaaacuuuuaacuguaugucugguauuuuuaaaaauuuuuauuuuuaaauuuuuauauauuuacuuauuuuugagacuuaacuggguuaugagacuggcuaauuuuuguauuuuugguagaaacaggguuucaccauguuguccaggcuggucucaaacuccugagcucaagcgauccaucgccuuggccucccaaagugcugggauuacaggcacaagccaccacacccggcuugauauuauuuuuaucauuaaaaguuuuaccuguuuucuaggaaaagcauucuaagauauuuuacacauuuuucugucuuuuugaacauaauauuuuaaacaugauacaccuuuuauugauaacuucagguugucauuaucagcuucaaacagcauacuauacuaaaguuuaggucugauuguccuugauuuaaaugauccaguauccugucuuuuuguguucuugggucugauuuguauuuaauuuguuauuuguuuccuuauugucaggcauuuucuuccugcucauagcuuacugucuucuaguagucuuuguuuccuucuuucuuuuggaguuagaaauuggauauaagaauguguugcucuuuguaaaguuaaaguaaauagaccugaggugaguaauaaggcuugugaaauuuuaacaucugucuugucccuugagaggccauuuuuguuuacuuucaauucuugguuauuaugaagauucaugaaauugcuggauaugugagcuguaucugcucuccaauuugccggacaguaauuggacagaggagaaaauuggcuguuccauuggguaguguuuuccuagcacauuguggcuggcuggcucagggcgcuauaucaugcuuauuaauuuauguauguaaugugauacuuagcauuuauuguuuguuauacucagacauuguucuaggugcuuuacauguauuaaugguauugauaauauuuuauuucuauuguguaaucaauuugauuaauuuaguucuaauauccaucuuauuggaacaucguuuuuuguuuuuuuuuuucuuuugagacaggagucucgcucugucgcccaggcuggagugcauuggcgcgaucucagcucacugcagccuccaccuccccgguuuaagcgauucucuucccucagccuccugaguagcugggacuacaggcgcaugccaccgcgcccagcuaauuuuauauuuuuaguagagacggaguuucacuguguuagccagcauugucucaaucugcugaccucaugauccgccuuucucagccuuccaaagugcugggauuacaggcgugagccacugugcacggccuggaacaucuuuauacuuaaaacaaguaacuuucuuuuucuccauguaauuucugauaaauccacuccuggaaugaauguuuuagaaaauuugaccaagaggugcuuuugagcagcauuagauaaccccuucaguaucuaaaugauugaugagaggagagacuccuuaaucuagauuuagagacuuuccauacuggcagcaagauguaccagaguucuuaagaggagacuaaugaaaauauaaacauuuguacagaagaauagguuaacauuuuuugaguugauuacauagcaaggaaaacuugagguuuuauacuuaggagugcuaggaacuaggcauuguaaugagaaaaaucugggcccugcaggagaaugugaauuauuuuugauccaguacuuuaugcucauuguacuaugauaaaugauaucauuucauauaagggcauuuuaaucugaugcauuagacuaaggauagucugaacuuuuuuguugcuaccaccacuucagucuuuaucauuaaugagaagcucagauugauaaaguaauauuaaacuauuauucuuaauauauuaaugucaaaauaacaauuuuuuagagcacuuuuuuguauacaucucuacaagauaguuuauuuugcuuacuagcugcucagcuuuuuuauauguggaauauggauuuacuugauuguuuuagauuauuauacugagaggaggauaaagaacuggaccaauauuguuugugcaauuaguuaaugcugaugcacagugcaguauauugcaagaacuucaggacauacuuuuuuagguggguuuguaaaaccuguauaucuuccaaccauggagauuacuccaaucaguagcccaagugugcauacacacacacacacacacacacguauacauauauguguaauuauguauaaauauaugcacauauauacauauauauacacguguauauauguacacacauuuauacguguguauuuuacauauacauauacauauagugagagagaaagagagagagagacuguuucauucuguuaccuuggcuggauuacagugacaaggucauagauuacugcaggguagaacuccugggcucaagugauccucccaccucagccuccccauuagcugggucuguaggcaagagccaacaugucuggcuaauuuucaaauuuuuuguagugacaaggucuugcuacauugcccaggcuggucucaaacuccuggccucaagcgauucuccugccuuggccucccaaagugcugggauuccaggggugagccagaguuccugaccggcacugauuuuuuuaaucaaaucaaguuuuuacagaaguaaaaacagaugcuucacuauagccaguuucuaaagaauucaccaacaacaucucuucuuauauagucauucuuuauagucauuaucaaaauuguguacaaauguauugaagagcuuuauuguaauugugguuucaucaaucugaauagaaaauuugucaccuaguugcucuucaguguuaauugacuuauuaucuguguaucugcgaauugaaccauugcucaauggcagugcuuuaaaauacuggaagacuaucgaugcaucacuauugaaauuacagucucuaagguggauaauaugacagucuuagcaacugugucaccacuacaagguuuuggggacuuuuuuguuuuguuauuuuguuuucacguuuuaaaaagcagcuguauggaaauacaauucacauaccauacuguucacccauuucauauguauaauuuagugguuuuuaggguguucacaaaguauauaaccacaccacagucaauuuaaggacauuuucgucauccucaagagaauuucuguaccugucaacagucacucccucuucuuucuuuucuccucuagucuuaggcagacaaaauuauucugucucuaaaaaauugucuuuucuggacauuucauguaauggaaucuuauaagauguggucuuucgugacuggcuuuuuucacuuaggucuucaaguucaugcauguuguagcauuggucucuauuucauugcugaauaauauucuguuguauggacauuuuauauaucucuucaugaacuguugaugggcauuuguguuuuuuccaauuuuuggguacuaugaauaacauucaugugcaggugcaggauuuuauaugcacauguuuucauucugcuuggguaaacaccuagaaguggaaagucuggaucauauggucauucgggguuuauucuuuugggaaacugccaaacuagcugcucauuuuuuuuuuuuuuacagaauuuauaccacuuauuuacagucgaaaacauuuaguuaagauauuuuuacuuuaggccauugucuucaaggugaguuguuuauucuucccucuuugaugugugaacuuguccauuugugauguagauuagucaucacaucacaaauaguaaauguaaauauaccauuuauacacauccaccuaaaucuauucuuucuaaaaugcauauaucuauuuaucuuucugaugaaccaagggacauaaguaugccauaaccauaaugagauugauacuaauuuggacaaugagaguaaaugaguccuucacagagcaaaaggaauucuauacauuuauuuaaaagacaaauauuugauuuguaaaaauaauauuaagacaguuggaagacauguuugaaacugcaugggagggagugugauuaauagaaaguguaggguugggaaggaggauuaguuauggcaguuccacaaugagucuggaaguuuaauaaaggaagugugcagggaauaacagaaaaaucaaggaaaagguaguaccugcuacuaucaauugucuguugagaugggaaaaugaagccuacaaaucuauuaaucauuugaagauauuaacaaagauaauauauaauuuuuguucucugaguuccuucccccgcuccauguguauuagcucauuuucaugccgcugauaaaggcauaccugugacugggcaauuuacaaaacaaagagguuuaauggagucauaguuccacauggcuggggaggccucacaaucauggcugaaggugaaaggcacaucucacauggccacagaugagagaagagagcuugugcagggaaacuacccuuuauaaaaccaucagaucuugcgagacuuauucacuaucauaagaauagcauggggaagacccgccuccaugauucaauuaccccccacuggauuccucccacaauacgugguaauuaagggagcuacaagucaaggugagauuuggauggugacacagccaaaccauaucaccauguaagaguuuugaaucuugucucuaacuuauuuuggacucaaauuagaaauuagucuuucacugggcauaugcauauaucaguuagcuuuuacuacgugaugaaucaccccauacuuaguggauuaaaacaucaaacauuuuuauuguucauuggucugggacucgacuauguaguucuuaugauuuggacuggcucgauuaggguuggaugaucuaggauggugccagaugggaugcuuaggggcugaggucuucuucucugcauugguuuucauccuugaagaggucagcuggggcuuauucacaugggagcaagccugcugugcucaagcagucuucacguuugggcuugcaucauauuugcuaguauccuguaguuuaacccagauuugauggguggagaaaucggccguauuuuuugaugggagguccugcaaagucaaaguccaaaagcggugugcacgcagagaugguaagaaauuuugccccccacccccuuuuuuuuuucguuacagucuucuauacugucuaaagaauuaagauuauucauucaugcccucuccuauuuuuuuuuuucauucuccuaagguaguuuuauguugagauuauucauucauggccucuccuauuuuuuuuuucuuucuccuaagguagcuuuagguuucuuuccugaggaaauugugugagauauagaagaaauaacuuaaaagaauugaaaacagggacucaaacagauauuuuauacccauguucauagcagcaucauucacauuaguuaaaagacagaagcaacccaaauauccaucaguggauaaauggaaaaauaaaauguaguguauacauagcauagaauguuacucagccuuuaaaaggguggacauucuaacacaugcuacaacauggaugaaccuuggggacauuauaauaauacagucgcgaaaggacaaauauuguaugacuccacuuauagaugguaucuaaaguagucacauucauagaaacagaaagaaugauggcuguaaggggugggauggaggggaauaagggaauggagaguuauuuaauggguaguuucagcuugggaagaugaaaaaaguucuggaaauggaugauggugaugauugcacaacaccaugaauguacuuaauacuacugaacuguauacuuaaaaauaguaaaaaugguaauuuuuauguuauguauauuuuuccucaauuaaaaaaguauauucacugcaacagugaaaaauuggcaacuucuaaauaucuaacaagagagaaaagguagcuaaguaaauauuucauuuaaguuuuaguaaauauugguuauuaauuuagguugggugugauggcucaugcuuguaaucccagcaauuugggaggcugaggugggucaauugcuugauuccaggaguuugagaccagccuaggcaacauagcaaacccuugucucuauaaaaaauacaaaaauuagcuuggcgugguggcauacaccugaaguuccuacucaggagcuacucagguggcugaggugggauaaucgcuugagcccaggaggucgaggcugcaguaagcugagauuaugccagugcgcuccagcccgggcaacagagugagacccuaucuuaaaaaaaaggaaguauuaguuacucauuuaaauguuugugaagacuauuuaauaagagaaaauacaucauaaauaaaaucaaggcauaaauuuaaacacuacagccucaaacauguaaauaaaaugcauaaaaacagguauguacugccuuucaaaccaugagauacaguuauuuaaaaauaggagaaaaaaagccaaagaggaaucaauccauagccuuuuuaauagaaaagaaaaauaugauagaaguugaguacaaccuaauuagccuccaaaugagaauucaaaauaguuuagagaaguugagcauuugucggaagucaaguuguccagccaguaccguuaggaaguuuucagaugaacuucccaguguaaagcagaccaucagaucaauggaaaugaauacacaucucaguuucuauaagaacaguagguucuuacuggaaaggauguagucaguaaaugguacuacagaaauuuggaaaaaucucacagauaaugugugguuuaauucaccucacauuagcugauaaaauuaauuacagauagcuaaguaguaaaauauaacaaaugaaacaaaaaaauuagaagguaaaaguaaauauuuauuaaaugcuuggauauacaaauacuucuugcguaaugaaagaacucuaagaggaaaugauagcuuaauauuaccacaaaaauguaaaacuuuuaauaauccaaacauauaaaauuaaaagccaaaaaauuuaauugaauaauguugccacaaauaugacagaaaggcuaaaguucuuaccagauaaaauccucuuuugggugaaaaccugagcauguaucuuauuccuguucuugccacaauauuuuauaguuacuguuuuuguaucagucucacuuggggugggguguguguguguguaccuuuuagaucuugguauuuucagggacaaacacaaagucuaguccagaaggcauuuuguaaaugucugaguaugaacaaauuggauucuggggcuauuauuuuacugaggucugaaaugcugacaaaugcauuuguuaaucgaugaagcagauuugagaaggggauagaaaaauguucaguuaaguuacugugcaaaugcagcauacauuaacuuucuugguggaaaauauuuuaaaagaugaaauauauauuccaauaaaauauuugguggcuauugaagucacauuacaaaaugcagcuaccacacauuguuaguuuauaugaaucaauuacaggggagaucuuucuggugccauuuuuaauuuuuccuccuuccaguugcugaagcccuaccuucauuccucuugucuuaauuuucccgcucccuucucuuuaccuccuuuuuucucuauucucccuuccuuucuuuuccuuucucuaucgccuucuccacaacagcucaguaaaagagugaaguuuuugaguuucauuuaugccuuucccuguuuugcuauaaaaaucaaccaaggaugcuuuuagauagcaccaguaugaugagggaaauaagcuuucauugcaggaugauuacuguuggugaugauguauaaaauaaagggagggauguuauguggaauguugacccuucagggcuuguaaaugcacauuacguggucuggaugguaaacuaagugaauuuaauauuagcuacuggaaaugacaguguuuauaaauuuucaaaaugacguuuguaucugucaggcuuuagcuuuuauuguaucgaauacacuuacuuuauuuuaauauuuuucuagagcugcuuuaugcuaugggaaacacuaguuggaaauugaaaacccuagacauuagaugauuuuuauuuaacauuaucuuuuguauuaguuguaauuauaauuuucuguuuguaagucacucucccaaagcacaggagaaaaaaacaaauuuuucuuccaugauuuucucacugagaauaauucgucuuaucuacuuaaaaauacguucuuuuaaacaauaaaaguggcucuaucuaaggcuguuacuuuauaaaauuggaaaguauuuauuuguuaacacuuauuuauuucuguagucuuugaaauuuguauucucccccaauguauuuuagcaaaaugggagaaaugaaggauaaccuagaauuacauucccagagcaaaauauacuguauuuauuauuugugauucauuucaguuccguguuuuuuuuuuguucguuuguuugcuuguuuuuugagacggggucucacucugucagcaggcuggagugcaguggugcagucuuggcucacugcaaccucugccuccugggcucaagcaauucuccugccucagccucccgaguagcugggacuacaggcacgugccaccacgcccggcuaauuuuuuguauuuuuaguagagacgugauuucaccauguuagccaggauggucucgaucugcugaccucgugauccgccugccucggucucccaaagugcugggauuacaggugugagccaccaugcccggccccauuucaguucuguuuuauguauguguuuguaacuuuaacaauauaauaauaaugguguggauucaguuuuuuuuuuuaaacuggauuugaguaguuuaugacuccuguuuauuaaaucaaaaucagcaaaaguauuucaucaauauuuguccucuucaaacauuuuaguaaauuuuagaaaguuaaaguggaguugaauaccagucguaaagcuaguaauaccucuuccaaaacaaacauacaaacaaaccccugaacuacaguuguggaccuucauuaucuuucugaguguugugccuuaauguguuugagucucucugagaugcauaauacguguuauuuguuugaguuucagccauaacuuaguagugauuuuucuccauuauagacuuugcacauaaugaauuucaggaaauacacaacaacagcuucuuccgcuuguagauaaagacaguaauaugauggagugaucaaauacaaaugcuccuuuaauuuauuuuaccaagacauuuauccauguuuuauuuauaaggcaauugaagucauucauuuuguauggaacucuuccucuucugaauaacaaauaauauauuaucauauauagcgcauugggggagggagugaugaaagccaaacuugaaaauaaaaguuuaauauuuugggcucauugggcacaauuauaguguuacuaucuuuguuuucaacugaaucauaauugugugugcagauuuugaaaaaaccaggauggcauacggcacagaguaguauggaaaagagaaaauucuuuguuggaagagaggguuuuuuuucccuccaguugaagagcauuuuaaaugcacaaaaucugucucagaaauaucccuuugaaagaucuuugcauacacaagauuuaaaaugcuuucauucugugggugacuagaaugaaaugggagccuacauucccaagaaucucugauaugaccauauaaaaaccaugaccaacugguuuguuuuuaacucuuaccauguacgagcccauuugaagggcaugggcaauacuucguuucugaaccaagucaaguugacugcuggcauuuaacucaccaccuuguguuugcuguugccugaugccaguaagaaauacaucgaaagcuguaauauaaugauaaccauuauuugcccucaguuaaaaaucuagcuaaugggucugaugugcccacagcuucauauugcuugagacugcccccuucuaggauauuuuagaauaaaagaucagaccagaaagaaaaguuuaaagcucaggauaucauagaauaaauggaagauaaccagcuaguucuguuaaagcagacucuauauuuuaaauucaguaaggauuuaaguauauuaaugguuacuaguuuccuauaaauuaguuuggggagguccauguaacauugaagucauaguucacugccauguuuuuccaaaguauguucacagguguuuggaauacguaugaucuaaucugaaaauuaagaguauauauaccuuucaguucuuuuuuuuuuuuuuaauuauacuuuaaguuuuaggguacaugugcacauugugcagguuaguuacauacguauacaugugccaugcuggugcgcugcacccacuaacucgucaucuagcauuagguauaucucccaaugcuaucccuccccccuucccccaccccacaacaguccccagagugugauguuccccuuccuguguacgugugaucucauuguucaguucccaccuaugagugagaauaugugguauuugguuuuuuguucuugcgauaguuuacugagaaugaugauuuccaauuucauccaugucccuacaaaggacaugaacucaucauuuuuuuauggcugcauaguauuccaugguguauaugugacacauuuucuuaauccagucuaucacuguuggacauuuggguugguuccaagucuuugcuauugugaauagugccgcaauaaacauacgugugcaugugucuuuauagcagcaugauuuauagucauuuggguauauacccaguaaugggauggcugggucaaaugguauuucuaguucuagaucccugaggaaucgccacaccgacuuccacaaugguugaacuaguuuacagucccaccaacaguguaaaaguguuccuauuucuccacauccucuccagcaccuguuguuuccugacuuuuuaaugauugccauucuaacugguaugagaugguaucucauugugguuuugauuugcauuucucugauggccagugaugaugagcauuuuuucauguguuuuuuggcugcauaaaugucuucuuuugagaagugucuguucauauccuuugcccacuuuuugaugggguuguuuuuuucuuguaaauuuguuugaguucauuguagauucuggauauuagcccuuugucagaugaguagguggugaaaauuuucucccauguuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacauuuaagucuuuaauccaucuugaauugauuuuuguauaagguguaaggaagggauccaguuucagcuuucuacauauggcuagccauuuucccagcaccauuuauuaaauagggaauccuuuccucauugcuuguuuuucucagguuugucaaagaucagauaguuguagauaugugguguuauuucugagggcucuguucuguuccauugaucuauaucucuguuuugguaccagcaccauaccuuucaguucuuacuauaucuuucaacagugagcucuuccuuaguacuuugaguguaucuggcuuauaaacuacuauuucaagaauaucucuuauauagagauccaagcauaccugauuauuauaaagacucuagguugugauuguuuuaauauccaguuugucuuucacaaaguuacucuauugucagugcauuugaaauccuuucuuuacgaagagucugugacaucuuguaaguguaacauauagcuuucuugaauugucuaccauacuguaagagcuaugguucuuggagugcuucauagugucccuucugggguacguuaggauggaggacgcaggauuuuggauggaggaaaaugugacuccugauauuguguuugcugaauuauuaauaucacugagcugccuuuuucuuagaauagccacugcugguaggcuaauauuucuaaggucaaacugauugcuagaaauuauuccuguugagaucagcuaggccauuucaaccuuuacuuagguuuuauuguaauuuucaagugagaauaauaagcuaguguugcuuccuaacuuuucuguguguguauuucagaacagaacaauugcauauguuucuuggcagauucuuuuucaugaugugguuuaugcuggaguuggugagacugcuucagagcauuuccucuuccccaucuuaugccuuucugaaauagaguuuuuaauacuuuuuaagucauggaccccuuuugaccugucaggauaaugcuguuuacuguguuaaugaaugcaaagaguacaaaaggaaacccacuauauugaaauacagguacaauaaauaagaagaucuagugucaagucuaauaauacuauaauuucaaaguaguuaugaguauagguguaauuuugagauaccugcaacaccuguaauauaguaugaaaguauuuguuauuucuguuggugacagaauugcagguauguuaauacuguuguaguugucuguaaucauaguugaaggaaaugcuaaauuucaguagagguuagugaaauaaaagauacguguuuucccccucuaaggucaugcccuuuuugaauucuuuccauggauuccagauuaagaaguauuuuucuaaugggauuccugguuuucugauuacuauuucuccugagccaauauuccagagagagagacugcgauuugccuuucuuuccuaaagggcugaguuccccaaacauuagugacaaggccuauagugcugcugaggcuccaguaucuuucacuuauucugccagaagagacacuugguugguacauuauuuucuuuuucccagauaauuggcucuuucuguuuugagagaccaauacaauauuguuaccaggcuguugagaaauucuuauuucuuuggaaugguauaaaccaaaggauaaaucaguuuuucagaaaucccuagucuuuuucuuucuaauaugcucaaauguuaaucuuauuuauaaaucuugaugacucuuucuuuauucaaguugauaucagguuaggaauuugcgauaugggauugcuaauuuaaaauacaccaguuauucacuggacuaagaagaaagaucaaauuggcuugcagagaauucuuuaaaaacaaugaaaacaagaacaaacaaagauuuuauaaaauuuuauccauugauccuacauucuguugcucaagagagaagcuuaccaggaugugacuuucugaagccagugaauuuaucaugacuaccugguuuagcacauagauucgcaaaggcauuucaugucccugggcccaguagagagaaucagcaguaagaauacaauuacuuuaauuuuacuguagaaacguaaucaaaaguagauauagccgggcguaguggcuuucgccuauagucccagcacuuugggaggcugagaugggcagaucacgaggucaagagaucgagaccauccuggccaacauggugaaaccucgccuccacuaaaaauacaaaaaaauuagcugggcaugguggcaugugucuguagucccagcuacucgggaggcugaggcaggagaaucacuugaacccaggagguggagguugcagugagccgagauugcgcuacugcacuccagccuggcaacagagcgagacuccgucucaaaaacaaaaacaaaaacaaaaacaagaaguagauauagaugauaauggaaaagggggcaaaguuacaaagggacaauaaccauaauaccaccccuguuaacuggauuuuucuuacaucaaacuguaguuguuuuaaaauaauauguauuuagcugggcccagugguucacgccuguaaucccagcauuuugggaggcugagguggguggaucaccugaggucaggaguucgaguccagccuggccaacauggugaaacccugucucuacuaaaaauacaaaaauuagccgagcauggugaugggugccuguaaucccagcuacuugggaggcugaggcaggagaaucgcaugaaccugggacguggagguugcagugagcugagauugcgccccugcacucuagccugggcuacaggaaugaaauuccaucuccaaaaaaaauaaaauaaaauaaauaaaaauauguauuucagucauccaguugaugggcccucuauguugguuaacuaaagacuagagcauacaguuagaaacuuuuaucugauuuauccaaacaugggaucuuccuaugguaagucugcuguuacuacacucugagcaauagguaaaggaauaauaauuuaaaaauuuugguuaaaaacuaguuagaauaaauuucaaguuguguagaagagaaaaauuguguuuaauuauaacaguagguuucgguucauuuugugaugcauagaaaaugugaauuacauuaaaaaaauggcuguaguugaaagaguuguguucaguaggccacuuuaugaagcccuacaaaacagucaucaguauucccaaauaaaauacaacacugauaaucaagaaucauucuuguuuuuagccaaaacaguuugugugugagagugugauauaguggggagauauuuacuguucaugcuuacuuccuuuuuguacuugaucagacaucuuugaauguaucagucauucucgaacuuuauuugcaucagaaucaccuguaaggcuuguuaaaacacagacuguuggguaccauccucagauuucugauucauuaggucaagaguuggacccaauaauuugcauuucuaauugccacacuuugauaaccacuauauuguccauuuaauuuuuccuagcaguagugaagacucaccugauaaucuuuggcuuaaugacaggugguaucuaugugacaugauagaacaccucauuguauuaaaaacaagaggaagcaguuucacaguugaaagaagcuguauaauaaaccuaaauggaacucugagccuugaucucaggaacauucaaaguccucuagauucgagagaaauuuccuuauagucuuaggaaauaugggggucaaugagauguuaauauuuuuaauugugaaaguucugauuuuacaaauaaacuuaagugcgacaucagugauugugauuuuugaauuuggaauuagugauuccuugauaggagcuauagagaucuacagcuauauauauuuuuucugguggcugaucauuguauucucuucagauuguugucacugucaguugguuuucgggaagaggcuuucaaauuaucuccuauggccuuuuauauguugauucauucaaauacugagugaccauauaauauuuuaagucaaccaggacaugugaaagugcucagagugagagaauauaugaguacuccguguaucaccagcuuaauuuucuauaaaccuaaaacugcucuaaaauuuuaagucaauuaaaaaaaaaguacucagagccaacacauuugucugaacaaaaggagaagaggugagaaaauguacguaaguuuggagaagaaagauccugaaugugcaaggguuuuuuucuucuucuuaaaucucuguucauuuauacaucccaacaucaacagauguaugauuuagcauuugcccugcaccucuggcucuagggacccuggaguuuuguauauggauacccugcugcagugaacucugucauuguucucaacagcugggaauggaauauagcucauuaagacaggagauguuauccaagccuccccuggcauccugaagaguagugaauauguuuugcuuccugagaucuaaaguaucccuuucguuaccaccuaguguucucuuccuuuuauugaaaaacucuauuggccccauugccacuuugaaugauguguacaguuuaugccagcuguuccuuuucuuaauccuuucuccuucuucuuugccuuuuuauuauguuuauggugugugcugugccuuguauuuaaaaaauaaaacccuaguguaauuaguacauaucacuugguuauguaauuaaaagaauauuaaggacagauuuucacaauaaaccccuaucauucagacaucccugcucccuuuuguauaaaaagcaacuuugcuggagagaggguugcaaguuuaaguuucucauacuuaucaggcgagggaacuuauauuugaguuuuuauuuuauaucagaugcuuaguccuauuacuccauuugauuguagcaauaaaucugugagacauaaagauauaagaauuauuaucucauuuuguagauggggcccuaagcaucagaaagaucuaaaacccaauuaguaaauugugaagcagguauucauaucuuugucuuucuggcuccgucaucucucuguacuauuuaugcaaccuguugcugaguuauguauaaauuuagaugucuguauucauuuuuuauguggcaucguugucugcuuauguggcaugauuauuuagggcaaaaagaaagauaagaggaaccauguuaaaaauaucacuuuuaucuggagauucagauuuauaucuaggucaucauuuuucuauucggagaguuauucaggcuuuacaaaugaaauaggcagggauguucaggaauagcaaccaggugcuuucuuugcaacuggagagaagaaaauaccaaccucuccacuaauguauauugggaguuuacuaugugccagccacauacaugcguuauuuuauuuaauccuguagguggugugagaguagauguggaaaaugagguccaaugcauuuaaauaauaugcccaaggucacauagccugcaaguguacagcuggggcuagagcugccaucugauuccagagcucaggcucucaaucacuacgcuacacugccgaggaauggcaguuuaagagguggaagucgugugacauaguaaccuagaaaaagagagguaaguuauuugaacaccuggacauuuuguuuuuccaucaaccaggaagaaauauugagauaauggauauacaaucaugcaucacuuaaugauggagacacacucccagaaguguguugcuaguugauuucauaguugugcaaacaucauagagugcacuuacacaaacccagauggcauagccuacuacacaccuaggcuacaugguuuggccuuuugcuccuagagcacacaccuguacagcauguuauuguacugaauaggguauuuguaacauagugauauuuguguauauaaacauagaaaaggcauaguaaaaauaccauaguauaaucccauggaaccaucacuguauguacagugugauguugauggaaauguuguuaugccgcacacaacuauacauuuauccauccucaaacgcuaaucuccuaaagagaaaugaaagcacauguagaguuacuugguaacuuuuuauuaauccaagaaaguuaguuacaugauuucuaaaucacuccuguucgguauaaguggaaccuagggguuuugagaguaaaaaaaggaaaguuaaagcaguggcagagaaaggcuaaauggguuuggcacguauucaacuuugucaaagggaaugugaaggauugcaguucacuuuucaugccaaggcaucugugaugauggagagagugaugucauaugguuuggcaaauuaacugcauaaccuugaauguagucaaggggcuuauccuacucuuuuuuuucuaguuaaagugucucuaagguuggccuuucugacaucguggccagacucauacaggcaggacuuaacggaggcuaaaaucauuaguauacauauacauacaaauacuucuucagauauguauuuucuguaaggaauccaaacuguaggaaaaggauaaaauaaaguuuuuaguaaggaauauauuuuaauggaaauaauaauauaguacccauuaguauucauuuccuuuaaaauauagaugauauuaucuuuauaagacaugguaucuuuauuuuauugacuauaaauguacuagugaaauguuuccuaaguuaacucuugaaacacagauucuaacacugguauuguacagaacccaaccauccauguuggagagugucugugcugcuuuaauuaguucugauguaauaaaccguuucauguuuagcauuuuagauuuauaauauggucuaguuggcuucugacuacagaucauugagugaauuuauauccaauuuuaaaauuuugacaaguaggugaaaacuggaggaacgacaaaggaacauuuuaguaaaaccaagaaagacuugucuuuagucauggacuguggcacuaccacuuauuugagacccaggcgagacuugcaagcagauuuaccacagucaggguccaaaguuaggaagaaaaaaagacaugagaaaaguucuucuuaugugaaaaguauaguaguccuuagguacauaaauccuccuuggauuugugauugagaauucaguuguacugcuucuuugcaguaaaccuuacuuuuaauaaugugauagcuuuuuuauuuucaaaaaaucuuccuuuugaauuguuuuuagaaauuaguuuuggggacuagaggccugguagaccuacaagcacagauugaauaucccguauccaaaaugcuuuggaccagaagcguuugggauuuuggacuuuuucaaguucuggaauauuugcacauacauauugagguaucuugggaguggaacccaagucuaaacacgaaauucauuuguuuuuuauauacauagccugaagaaauuuuauacaauauuuuaaauaauuuuauacaugaaacggguuuauguuaaguacuuguguagaauucucuacuuguagugucguaacgaugcucaaaaaguuuuggauuuuggagcacuuuagauuuugaauuuuuagauaaggaaugcucagucuguacccaauacuuacuauuucuaauguuggggaagccaguaauuccaaaaauauucuaaacuuuuucuuucuucauuaccuugaacuuaacucuuauauugucauucaucaauauaugacccaucauuuaguaauauuuuagaaacguaaaaggagggaugggcucaaaaagacaagauuuaugauaaauuucuucagugaaacuccucuuaggaaaugaguauuaguuccacucucccacuguaaacaggagcagaguaaccacacugaucaagaguuggugcuucguuuuguagguaauuuauuuuccugggugccaagugguuuuuauauauggagcuauggucauaacuuaauggcaaaaaaugaagcauaaugcuaaaagaaaacauaguucuaggagaaagcuugcuuuuaauaccuguuucuucuagaagugaauaggacuuuggugugggcaguuuaaaaguuggccacaucagguuuuaagcuuggaagccauguuugauuuugaaucuuagcccaagaaaaauaaauaaauuauuuauuccaauauaaagauguuuggaggugucaguaauugacuuauuuagcagcaauaaagcaauucagauaauuuuagaaaauuuacuuuugaggaggaauucuaauaaaggauaauuuaaacaauuacgugugagaaauaacuauuuacugaacaggaaauaggguugcuauaggugguuugaguuuaaaacuagagauuugcuuugaauguaguuuuuucuuugagauuucagggugaaaauugcauggcuggagcaugacccagaaacagcccugccauugauugccacugggaauacaguaauugaagauuugccuguguugauugacuuucaguaucugauuacagaagcucugagcaauguaucuuggucuuuuaucuccuuuguugccuccuuucagaaaugcuucuaaaaugugucugguuuaucuauagauuuuuggauucuuagaaggccacuuaaccauuucuguuuaguauuuaccaguucaaucaauaugaauaguaacaaagaaaaccugaauuaaaauguacuaggauucugagacuguuaugucugguauauaauauacuucucuaauuuauucuuuguagaaccucaucucuauaaacgcuuguguugaaaugcuuuuuggucuuaagugauggaaugacagccugugccaggacauuguagcuuguggaugccuacucuuuucaagugacucaucgguacagguuaauauuuugaguaaaucuuucggaauuaaauucaguacugucaacaaugagaaucuggcuaguuuauguagagcuuaacagaggcagaauauauuaauggacuuuaguguuuuuaaaaaagggacauugguauuguacgcuauucuauaccuagcucuagggguagcaugugcaguauggauuauuuaugguccacuccuugccacaggucuucuguguuaccuuuaaaaagcuaggguagugcucggcugacugugccaucucuguauggauuuucuguuuauuuguuuuauaauuuuguuuuauagaaacuauaguaugaugucagaaacauugguggcuggauuagguacaguauguuggaaaagagaaauguguuaccugcuuaacaggaguacaguuugacucuucuguuuccccgauguguuaaucuaaugauuuguccuugaugguaugggaguagcuggugagaaaaaggaagggaaggaagaugagguaauuguccugaauuguccuuggauaaaggaucuaacuucaagucuuugcaaaugacaaaaugagaaaaguccacaaggcauuugagaauaccucuucugaauaacucaguuuaggucagagaauuuuauuucagcucacguaagaacuucguuuguuuccaguguucccuguauuuucauaaucaaaccguagccucugccuuuugauguuuuguuuuggucagcacuuugguucuauguauucauguuuuuguugccauuuuugauuuaguguaggauuugauuaaugacugcauacauuuuaaaugaugucacauugaaauguacauuugcacaaauuuauguauaaucaguaaacauauguuuuuguucuguuuccaagaugccuguuugguuguaguuguuuccauuuuguccuagguuaaagaaccuuagcuaauuucaaucagcccugaguugucauuccuguucaucacugucacauuaacaucauuccucuucaucaaugucacauuagcagcaaaucugaacuugcugauuaguaaagaggauggaaaucacagcucuguguguguccaaauagcuacucaucagcaaagcuugugauggggccugaugguuuaaugcaggccuuaaucaagggcuaggaaauguuuucucugcaguuuaaccuaguaguauugaauuacauuaacauguauauacacucgcauacacauacauaguaguguuacaucaauguucaaagucaaucaggccaaaucaaacaaaagaaggaaauaaaucuugaagaugacuuuuuuugugauuuuagucagcaaacauaaacagcauauuuuccuuuggucucauugauauccucauauccagcugaagaacugcuugauuaaaaguaugcugucuuuggugacguggacugaaaaaguaugggguaagcggggugaauuuuaugcuuggagcuguuauuaucccaugugguaucuguugcuuacuucucagugauacuuguauagaugugucaacagauuugauguuuugugccuaugaggcagaauacuuaaaagggcaugagagucauuacuuggagacgagaugggcccucauuugugcucacaauaucugugugagcacguggaagaaccguauuuuauuuuuugaaaacaaucuuuuugagugucaaaugcuuaucuguugagagcccacuguaaaacugaaugucuuugugguaguugacauuugagaugauguuuuuuaaugccucauugugggagguuaagugucauuaucccgauuuuacucaugaaguucugagcagguaagugacuuguccaaaguuacccucccgguaaguaaaagccagaccuugaaugcaggccuucugacuucagcuacaguaauuuugucuuucagccguguaacagcugccuuguuuauguggcuaacaugaugcuagauaauuaugagaagaauuucauuuaaaagaauuccucauaccuggaaguuuacaauccuaucugaaugaccacagcugugugaauccuaacuucagucaagauaagcaguaauacuggaaacacuguagaaagcaaggauggcaucacagugucuaccagcauucugugggaggauuagaggauuugcaugcagaccaagagcagccugaguaaucaggacucugguacuguuuuauggaaagcaauuuaaugcauauuuuuaaagcaauaucaacucuuuuauaugauuaaaaaugauuucuaccuuauacguuuuaauuuucuuuuauagauuucagcccuggaaucauacauaucuauccuccacacaugucauuuucuuccucucaaggcuagugguacacguuuaaauauuuccagcauacauuuuguugcuguuagaaacuaugaauaagcaucaucauuuucuuccaagauuucugucacugucaacaucaucucuuucuuuucugauggcucacauuaaugcaggcagugcuaacacauuuguuucuuuugucuuuuaugacagucugaguuuuaaaacuuugcuucuauucugaguuuaguaguuuuuguucagaaaugaaacuuugaggcagcagcaucagguaaugggaagaguguaggcuuuugagacaaagaccugaauuuggauucuugcugcuccacuuacuagcuuuauugaguuacucaaauacuccuagucacacuguccuguucauaaaauagggguugguugugcuauugugaggauuugauagggcaaccuaagagaaaugccugccauggucccuuacucagaauaaauguucaacaaauuacaauucuccuuuauuugcaguacuguuucucaugcuuuuuaauuagauauuuuacucccucuguuugccccucccuccuccucuuuuucuucuucucucucuguuuacagccccgaaguccuaguaauucuugagaucacguacauccacuuugaaguuuacuuugaccaugcucugaucauacaaauaguauguuuccagccagccuucuucaaaauguugcugguagcaauuuuuaucacacuacuuuuuccagucauacccauugucuaccccguuaccuauuuuaucuguucuuguuucuuucuuucuugucaguccauuuuaaaggccuccuuaucuaguugacaggcuuccuuuauccuggcuaugggaguagguuuggcugugaauaacagagacucagcauaauagugauguaacaagacagaauuuuauuucucacauagaagugugggagucaagugcugguguggggacuuugaucugucuuaaugcuucgucacaugugugcuccauuccuaagguccccuccugguccaagguggguacuugaacucuuacuauuguaucuacauauuaggcagcaggaaguagauggggcaggcagcaggaaguagacggggcaaaaguaagacauaugcuucucuuuggaaguugcccacacugacuaacucuuagauuugauucgccagaacuguauuacaugacuaugucuagauacagugaagacucagaaauguauccuguuucaauuaucuacaugccuaaaaggagagaauggcuauuugaggacaacuggcauugucugccuuguugguaauaugugagaugugcuauauccuuagccaagguuucaggaaaccaaauccuuuaaauucacacuguuuauauaucuugauuuuuuuuuuucuuugagauggagucucacucugucgcccaagcuggaguucaguggcgugaucucgacucacugcagccuccgccucccagguucaagugauucuugugccucagccuccuggguaguugggauuacaggcacccccccccccaccacaccugacuaauuuuuuuguauuuuuaguagacaugggguuuccccauauugggccaaccuggucuugaacuccugaccucaagucaucugccugccucggccucccaaauugcugggauuacaggcacgagccaccacgcccggccuaauuucauacuauauaguuaucuauuguugucccauacuuuaucuuucuaaguccacacuaucuauggacauagaauaccaccuguacucuauuuuguucauuuucuugccgagagaaaaguguuucuucuagucagauucuuuguuuucuccugaacuacccaccauggucagugacuguagucuuaagacucagacaaaucuagcagaaugccauauuggauuuuuuucccccacauuccucugaaaguaguccaacauggauuuuacuguuguuuuaaaccaaaauaaugguaguauaacacucuuucauuuauuuuuaucaaagcaucuguggaaauauauuccauuuuucaaauauaucagugcucaagugucaucgugaaagaacaacuaaccaaacuguauugaagaugggguuguaaagaguuuuacauguugaucacaauaauacauauuuuugguucauuuuguuuucuuuuauaaauaaauguuuccuuucuuuaguaggaacaacuacaagagcuuucccuguuuuuuuugguauacuuucuugugacugacagguaucugaggccauaagaguauuuuuauuuuaaagaugaggcaauugaguucagagguuggauaacuugcccaagacccuauaacaggcaagcagcagaucccagaaucaaacccaggccguuugaauucaaauucacuuccuuuuucacuaugguacaagaauuggaaaauaagagcauucuuuugcauauuagagacugaauuaucaaaauucuuuauugcuguucuuucauuaucggucauccuucaugggagagcccucaucucuauacaguaugauucagcugggauagaauuguuucccuuuauuugcuguuaaaugguuuccuuuccauccguagcuugacaaacaucuccuuucugguucuuaaaauauuuuacucuuagaccuuuuccccuuucuucucugauugaaugcauaauauucuuuaacaguuguauauaugcucucaaggaauuuuaaaucucuucagggacacauaauacauguaugaaaaaggauuuguaggaaaggaguggcagcucaugccuguaaucucaguacuaugggaggcugaggcuggagcaucacuugaggcugggaauuugagaccagccugggcaacaaaguaagaccuuuguuucuacaaaaaauaaaaauaaaaaaauaaaaaacucaaucaggugagguagcaugugucuguaccccuagauagccgggaggcugagggaggagaauuauuugaccccaggaguuagaggcugcagugagcugugauccugccacugcacugcagcuugggcuacagagcaagacccugugucuugaaagaaaaagaaagaaagaaagaaagagagagagagagagagagagagagggagggagggagggagggaaggaaggaaggagggaaggaaggaaggauuacacuuagcucugugaaauagcuuggguuuuuuuuuucuuagucuucuuuauugguacauuuuuaauauaaacugcugcugaucugucauucucuauucuggaaauguuuacuucauugucugucuuuaucuuuuacccaggugucuuguaccugugguaugcuuaagccucugcucuaccucauuacuucuagaaagaacaauuuuauaccuagacacacacauacaugucuuauauuacagagagugagacagagggcagugacagaguguccugcccucccugggaauggacagagcagcauucuuucuguccuacuuaagcaaugugaugcuucgauuugguaugagacuuuuuuuuuucuuguauugucuucuuuuuauuguuuuauuauuuuauugucugacaaaaauggccgucucuccuguaucucuuuuuacccuuaaccuuuucugcuggguuguauuuuuuuccuauugcauaacugcaaugucugaaccuuaaauucaacucaaauuauuaacucugaaaugaacuuccuuuggcaagacugauuguuaacagaguucuagaucucaguugcauucucuuccauguugauuuaaguaaagacaggcugucuuaguaccuguuaaucaagaauaggaaagucugugggguggggggguauauauauucucucuaaaagcuaacuauaaaaucaauguaguagcuugcaugauuuaauaacuuggagguuuuuuuuccuuuuuuugugugacuuagcaguuuuuaaguauaggaaaggaaauuauaauaugguuuuauaaaaaugaaaccuguuugaagaucccaucauugauggggccugaauuuuuuaguuggucuuugcgaaggagaucauugcucugugaaguuuaugaaucccuagaccugagaauuucuaccauuaucuuacuaaggaaaugucuauaugcucucccagaagauucuaaggaggcaugcccuaggggcacaugugcuguagagguaaugaguucacuggaggaaaucucacaaucccuucuugcuugaugauuuuuugauaauucuguaauucaggugugaaaaaaaaaucaccaccagcaaccucuaaaaccugggaggagcaguucgcuauuugcugguaguaguuuugaggacuuuagaaggaaggcacuagauaaacauaaggcauuuuuuguuauuacuauugccauuacuuguuaucauuuauguagcaccugcuucacuaaugcaauugcuuauaggagcugcaauuuuacuccugauggcuacuuucugucauuauguaaucugugguaaaccacauaccaucuaaauguugccacuggauuucuuuuuucuucaaacuccagcccuggaauacuguugcuguccuauuugucaacgaaccacuaauagaaauuucuuaggaacauacuguacuagaugccuaggaaaagaaaauauauuaaaaaccaguguaacuccaacugauuaccccaucauaguucuuauuacuucagaaaacuauuaaaagaacacuaauaaguuuuccaugcauggguucauuuuuauaaccaauugcuaaauugcuaaguugccuuuuuauucacuuucaaauuuacaaacaauuuccaagucugugcuuucauuuacuaaugcaaagcucuuugcauauauauauguauguguguguguccugguaaauuguuaugccuuccuuauucaauagcuuugggucucuuauucugaaaaauuccugccagcaguuaucaauuugcauguuauggaacaauguauugaccugauagacuuugccaguuuuacuugcaaagcuaauagcuucccauuauauaguagagaaaggcuuuguuacauagacacaguuauuaauucucuauuuacugcucaucagaaaacuaaaaaaaauuuuguuuugaaauuuggaaucuugauguuuggaauauuuuuacacaaugaaucgaagcacuucuugcuauuuccccuuuuuugacguuauuaacaauuuuguuuuuuuuaauucuaggaaaaggaaagguuuuacauuaagauaugcaauaauaaggaaaaccguggcacaucugaauauuuaugucuacaugaaauaaucuuugagaaaauacauuuuugaguuauuuguaauauaguguccuuagguuuaauuaagcuaauuauagucauuauuuaccuuuuucauauugaaaaugguucuccauauuuuuucaaacaauuugagaaauugugcacuaugcaggaaguaucagcuagaaguauaguuaggaaguaucaguugccguuucugagaaccuaugcccaaauggccuucagcuuaauuuuucacguuugaauauuggucacuguuaccucuccauucuggggcacugugguuagaaucucccugauagcuauagaaacuguuggcuguaaacacuugggaauaacgaugcaugauuucuccuuaaauaguugccucauaaauaacuacuuucaggcaugaaucauccaccaagguauauuuguuuuuauguuauguuacguuacauuacguuauuuauuuuuugagagagcaucucacuuuguugcccaggcuggaguacacuggugugaucauggcucacugcagccucaaccuccugggcacaaaugauccucccaucucagccucacaaguagcugagacuacaggcaggcaccaccaugcguggcuaauuuuuuguauuuuuuuuuuguagacaugggggucuuacuauguugccuagacuggucuucaacuccugggcucaaguauauuugcauauuaaaggaaaauucuuaguggauguuggccucuauuuggugaaugaauaagcagaaugauagauuuaaaaauucgggguaauauugggacuaauuuuuugggaaagaaguuuuccccaggcacuguacccugugucaugagugagggguggguguccagugaggaauuccagcagaggcugaagucccauuugugguggucauacacuuuugcuuuccgguagauucaagguuccagggcucuuguuaggaaucuuuuuuuaggacacaguguaagugcauuuuaagaacuuauuuuaaaaauuauuuugaagcaauguguguacaggccaagacccuuggccuucugaagauucacugaaaauucaacuggcaaaaggcagauuaauuggagaaaaggcagacaaauuuuaucuugugugugugugugugugugugugugugugccuucagaaugaagacccaaagaaauggaggaaauuguccauuuuuauguuuagguucaacaaaguauagacaaucauguauaauuaugauuggacaaaagaguaugauccuaauucucauagaaggaguggggaaauccagcaaggccugugugucucuagauucuuccuauccucucugagcaugcaugccuuccuucuggguguagggcaggacccuuucuggaauugggcaggggaagguuuuaugaccuauagugaaacaagauuggucagauaaguuacuuuuggccaguuuuuacacagaaauguggagagaaaguuaggguaauauuuuuagguuuuaugacuggccuugggguaaagguucuggcuucugugaccagccuugggcaagagggauucuaguuucuguggguagccuugggggagaauaggacugaggaggggagaagaucagagaaaaagcagcuucugaggccacuucugaacccuucauuuuggggguauugucuucugagcccuaauacaugucacuuggagagggcccacuuaaagguguucagaaaaugauuugaaaugguuugaaacugaucuaaugaauggcauuuaauucuauguuugauugucaguaccauuuuaguuuuucuucuauguauucagaaaaauuuuauuuuuuuuuugaauuguuggaugcagaauaaaaacuuacagguuauaaauguuaauaauauuaaguguguuuagacuagaaauaugcuaauugacugccugaagacgaccauagcuaucaaaagaauguuuugcuuauuuucaguuaucccacaaacauaacagcuugaauauauugagaaacuugagcuuuuuagauuuguccuugaacucuugauuggcuuugcaaguuguuuucuggauggugugguaaaggauuuaauacccuuugguauugauuuuaaaagguaaugagaauuuuuuuuuugauauaauccucacaaaauauacuuuguguauaaguugaguguccugacauaaucucaauagccuaagguuuuccccuaaggcaaauuuuuagguuucuguucaauauuuauuuaagcuaauucaagcaucgaugauauaauuuaauuaauucuguuuauuccacccaagcucuuaucaguugauauucccuaguguugagucucagaggaguauuuuuauauuuucaucucuauauuuuauauuuauacugugggcauuuuuuccccucauuuuaccuggucucuuaauuccauuucuccugaguugcugcccccuugaacagccucauccauccuucauacaacaagcuuucauauauuuaauaacuauuauuagguuauccuuaugcugucauuucuucagccacaauaaucccaguuccuuuaagcuuuauuuuuauccugcuuuuaucuagccuuuaauauuuuaguggcuucuucuagaucuucuuuagaaaagaguggugugagauuauaaaacgaaccugcugcuagaagugugcuugucacuucuccucuauagccgucaaauucuuugagauccucaaacugaagcauccaugggaacauuuauuauuuguucaaauauggccauaaaaaucgacuuugcaaucauauugagucaucuugacagugcugugagugacagaaacuaaucuuaucugcuggcuagcauuuuaaaaaugauaaauggacccucagucuuuaguuugccuguaaaugaaauuagguuuaucuuauuucucccagaaauagcauuacuuagaaaauuuugaauuauuucuuucugaacaaaguuaaauggcccaggcuaggggcuaaauuuugauuauuauuacauacauauauuuuuugccuuuuaucagcaaauaauggugcauugggaaaauucaaguauuaagaaaucagcauauauuuucuaaacagaacaaagauuccucaccaucuauacuugcagccugagaaauauauguucaaaguaaauuuuacugaauauuuguucuuugaauuuuuuuuucagaucuaaaauaaaguuccaaaucuugauaaucacagcacguuuaggacuaaugucuucauuguuuuaucugucuuccuuuuaguugccuaaucauuuaaagaucaaauuaaauugaaaucuaauauaauuccugcugguaaagugacuuuuauaguaacuuccaccauuuauuuguuuucuuaguaggaaacugauuuaccuuacuucuacauguguuuuugguaucuuuauucugaaauugucuuuucuuugucaaucaggaucuaggacuucagaacccauuuguaucaacuccuauaagaaacuaaauuaggucaccuaacagugucaaaugccuuuuucuucugcguuuucacugacauuuuagaacuccaauacugucauacugucauuuuuuucuuuccucuauucuuaaucucuaggaccauguuaguaaguuuguuagauauuuugucaaaugugauuuuuaaccaaaucgagggaauuaaagcaauaaccuuuuuauguucuguuucuaaagcaagaggacauugcugugcaggguugauuuuuugaaaaaccuuguugucuuccacuuguagguuuccuucccuuuuuuuuuuuuuuuccccuggucacuguuuuucagggcucuuuguaucuuguacaugaaauaauaugaaaagaagauuugaaugaaugggaggauaacucuucacuuuuugucucgauuauuauguuuuuaaauuucauuucacuuugggccuuuaaaagcauauguguguguacguauguauguguguauguauuuauguguuuaguauuuggaaauuugugagggaugaaaagguuacuucaacaauucccuugucuauguggucgcuauuucucugccaaauacucauaaaugaguuauucuuuuccucccccacucuugcauuauagaagaaaaaaguaaugccucauuuguuaguaucauuaagaaaugaaaugucucucaaaaguuaauuuuccagauaacuaaauccuaccucugggaaucauacuagcuccuccauuuuuagauguugaacaaguuauaaauuucacugacccuccauuucuucuuuucuaaagaugugcauguaauaccuauuuuaaugauuuguucaggggauuaaauaaguguaaaaugccuagaaccgcagaaaacuuaguauuuuugagauaucaagaaaacuggauaccuuauagcugaucaauaaauacuagguucuuucccuuuucccauuaaaugccauaucuugauuuaaauuaucuuuuucuuauuucuuccuacacucauagucauaaaaucaguuagauuuuacauucaaauuuuaaaaaauuuuccuuucuguauuuauuacagauucuccaguucacauucucuuuaucauucacuugaaccauuuucaauauuaaagagucuuagaagcaaucuaguuugacuacugucccaauaguugaauucugucugcauccuuucuucaaguuacuuugcagucuauaucuauugcuuaaaugugcuggugcuaguuugacccuauauaaccacaaagaaugucagaucucaguuucauguggcacccuuccaauacaugaggaugguuggcauguucucacugagccucccuuuuuccaaaugaaaaucccugauuaccaauuuauauuuugggguuuccagugccuugacauucggguuacuauuuccugcugcuucaguugguuuaacuugcucuuggauuggaauggauucuagucuagauaugauuuaaccaauccagaggagagugagaugauuacuucucuucuagauacuucuguuaauguagccugauaucacucuagauaauguuuuauagccagucacucuguugauucauaguaacuuuuaagaauucuuucuuauggguacuguuuuuaaacuauaucuauuuuauuuuuuaagaucagauuuauugauauauaguuuacauacagcaaaauuucacccuuuuuauaauagcuggaaaacuuuuuuuuuuuuuuuuuuuccgagauggagucuugcucugucacccaggcuggagugcaguggcacgaucuuggucacugcagccucugccuccuggguucaagugauucuccugccucagccccccgaguagcugggauuacaggcaugugccaccauacccagcuaauuuuuguauuuuuuguuugagaugagguuuaccauguuggccaggcuggucucaaacuucucaccucaagcgaucugccugccucagccucccagugugcugggauugcaggagugagccacuuuacccggccuuagcuggaaaacuugaagaguuuugacaaauguauacagucauauaacuaucaccacaauugagauauaaauuguuuccuuccuuuucaaaaguucccuaguaucccuuugcagccgguccauuuccccacccccagccucuggcaaccugauuccuguccauauaauuuuguauuuuguagauaccauucuauucuuauaugguuggcuucucugcucugguauaaaacuuuauuuauuuaaaauuucuacaucuuaguuuggauacauagcucuagacugucaugauauuuuuaaucccaauucuguuuuuauuuucuucccuaucucauaacaugcauaaauuugauaugcauuuuagcugauccuccauguuauuggggauaaaaggccaaagauaagagccaacgaggaaaaacccacaaaaauuccuuauuugacacuagacaacauuaucgaaggugacauuuauucauuaaucauucucuuuugauauugugcuuuaauccacuaaacuuuauuauuguucaguucauacuuauauaggcauauguuggagguauuccagguucaguuccagaccaccagaauaaagugaaaaucacuauauagcaagccacaugaauuuuuuaguuucucagugcauauaaaaguuauguuuacacuauaguguaguuuguaaagugugugauagcauuacgucugaaaaacaaaauauauaucuuaauuuauugaucagcuuuauugauaaaaaauacugaugaucaucugagccuucagcaaauugucaucuuuuugcugguggcgggucuugccuugauguuuguggcugcuaacugaucgggauggugguuguugaauguugggguaacugugccaauuucuggaaauaagguaacaaugaagcuugcccuauggauugacucuuccucuuaugaaaaauuucucuguagcaugccaugcuguuugauagcauuuuacucccgguagaacgucuuucaacauuggagucaauccccucaaacgcugucacugcuuuaucaauuaaguuuauauaauucuaaauccuuuguugucauuucaacaguguccacagcaucuucaagaguagauuacaucucaagaaaucacuuucuuugcuugacuauaaaaacuccuuguuuguucaaguuuuaucaugagauuguagcaauuucaucuuuaggcuccacuucuaauucgcuugcuguuucuaccauauuugcaauuacuuccuccacuggagucuugaaccccucugaaucaucgaugagguuuggaaccaacuuccaaacuccuguuaauguugauauuuugaccucuuuccauaaaccagaaauguuuguaauggcaucuagcauggugaauccuuuccaaaagguuuucaauuuacuuugcccggauccaucagaagaaucacuauuuauagcagcuauagucuuaugaaauguguuuuuuaaaauaauaggacuuaagaauccaaaugacuccuugaugcacgggcuguagaacagaugcuguauuagcagacaugaaaacaaucucguuuuuaugucaacaguguugacauuucacuaguguuuacagcaucuucaccagaguagauuccaucucaagaaaccacuuucuuugcuugacuauaaggacucuuuguccguucaaauuuugucaugagauugcagcaauuuaguccaucuuucggcuccacuucuauuuauagagaacaagcagaguagauuuagcauaauucuugggggcccuaggauuuuuagaaugguaaaugagcauuagcuucaacuuuaagucaccagcugcauuagccucuaacaagagaaucagccuguccuuugaagcuuugaagccagccauugacuucucucuagcucugaaaaguucuagauggcaucuucuuccaauagaaggcuguuucaucuacacugaaaaucuguuauguaguguagccaccaucaaugaucuuggcuagaucuucugaauaacuugcuguagcuucuacauuagcacuugcugcuucaccuugcccuuuuauguuauauagauggcuucuuuccuuaaaccuaaugaaccagccucuguuagcuucaagcuuuucuucugcagcuuucucaccucucucagccuucaaagaacugaagagaguagagccuuguucuggauuaggcguuugcuuaagagaauguuuugguugguuugaucuucuauccagaccacuaaaacuuucgccauguaagaaaugaggcuguuuuacuuucuuauccuuuuuucuugguucacuagaguagcacuuguaauuuccuucaagaacuuuucuuugcauucgcaacguggcuguuuggugcaagaggccugucuuggcuuucuacgugccuuccucacuaagcuuaauuauuucuagcuuuucauuaguuaauuaguuaauauguuuucuugagacagagucuugcuuugucacccaggccagagugcaguggcacgaucuuggcucaccguaaccuccaccucccagguucaauugauucucaugcgucagccuccugaguagcugagauuacaggcaugcaucaccaguuugguuuuuuuuaguagagacggguuucacuguguuguuaggcuggucuugaaccccugcccucaagugaucugcccgccuuggccucccaaagugcugggauuacaggcaugagcaaccacgcccguccucuagcuuuuacagugagagacgugugacuuuuccuuucacuugaacacuuagaggccauuguaggguuauuaauugguauauuuucaaaauuguuaugucucugugaauugggaagccggaggagagagagagagaugagggaaugauggccagugaguggggcagucagaaggcacacaugcauugauuaaguuugcagucuuguaugagugugguucguggugccccaaaccauuacaauaguaacaucaaagaucaccaggauagauauaauaauaaugaaaaaguuugaaauguugcaagaauuaucaaaaugugauacagagacauaaagugaacacaggcuguuggaaaaauggcaccuauaaacguucuggguacaggguugccacaaaccuucaauuuguaaaaaaugcaauaaagcaaagcauacuucaaaaaacaugugcugguacauguauuuuaaccaaggacagcacaagaaaucuuggcagaugucauguugaaaucuggaacaugacuuuaagccuagauuuccauuacauaaaagucuaguaaccuuuucugccuacuaaugugacuuugaaaguaucaucuggcacacuguuuauugaaauucacauuuuucuuugucauuuuuguucuuucacauuuuuaaguuugaaauuuaugugccugauacuuuccauagccauaaguuguacaaaaccaguggauuuuguuucucaguuggcuauuucuuaugaaugaaaucuucucuaaaguauauuuuuguauuugaauugaagccaugcuuuuuguuacaaagcccuuguugccuucauuagguauuaaacagcccuacacuggcagggagagguguuacguaggaaaucauuuauauuaaucauuuauauuuacuaaaugagcccucugagagcaggcaccgugucuccuuuguguacuaaugugaccccagaaucaagcacaaugccaaguacauaguagguaccuucaaaucagaaucucugacucuagccuaaaccucuuucauacccgaauguacuguauucuguuguauuaaauaucaggcccuguuuagacuuguuuuauuauacauuuguggcuauuacucacaauagcagaguuauucuuccugcaggaauuuaaauaauaaagauuuucuugaaaaauguaacucuaaguuugagacuauaaaaucuauaucucagagcaaaucuagcauuuaaugacaucuagcuuuugcucaaaaguaauggccuuacuguguuuuauuaccaccaacaguauuauaaguauaaggcuuuuuauacuuuccuuuaucacucauuuuuauuaauaucagaaaauaagagauaagcguaagcaccaaccuuaacugagaugcaguugcaagaauacuguccagaguucccuaacuucacaaaugagggcauguuccuagcuuccacauuagaaccuguaauagccuuuuugauuuaacauugcuggacuaccacccccauuuauucagcaaaacacuaauuuaagugcugcugcaaagguauuuuauagauaugauuaaaauccauaaucaguugacuucauguaugggagauuauacuagauacucuaggugggcccaauucagucagcaaaaaguucuuacacgaagaguuguggcuuucccugaaaaagaaauuucauuuguggacagcaucuucagcugauuuccgagacuuaggccccaccuuccugacagccuguccuaaugauuucguacuugccuacauagcucccacacuauucuaagccaguacccugccguguauuucuuaaucuggaucuccauugguucuccuccucuaguugaacccugacugauauauuacccaaucagaaugauggcuccugauaauuuuauaagaaauagugugaugcuaagcaugauuccuaguuaaucauucuauuccuaugcaacauaucaaaaaagacccuuguugcaugcugaauucuuggacuaaacguacuuuuuaguugcacagcugccacaaaccuuacuauuguauacuugcugauuuugucauuugauuuuuuuuuuaauuucuagguuuuucuaaggauagauucaucauguuauuuuucuugucuagaguacagagaaauaauauuuugauuauuuuaguuguuucaaaauugcucucuuuuuuggaaggagaaacguaacugccgugcauuuuacuguagucaguaguuaaauguauaacauguuagcucaaagauuaaaaugugaauauucuagagcacgaguacagagaguugauacaaagggggaugucaguugcucugaaguuaaauuccaggauucugucacaugcugauauagugccaaagcauauggaucuccauauggugcugcuuuugggguuuauaccaccuguaaucuagcugauuuucauucacuuaaauuuguccaagagguaagcaaacuaaauaaggaaaugaaaauaauaugccuguguuaaaaugccgaaguuugggaugaguuacuguuauuacagugauuaccaagaaaaaaaaagauugauuagaggagugcauuaguaauauagcaguaguguuucuaucaccucauuaacagcagggaacaguguauccauuucugacucguggagagggaaauuaauuuuuuuauuuuauugagucuucgugagaagauggaguuagaucauuuuggacauuuuuaaaaguaauaguaaugaauauaaauauguuuucaugguucaggaauaaugauauugugaauggcacuuggcauuuugauugaauauaaaaaguaauaaaacugguugcauucugacuacaugauauugcaguuguuuuauaucauuaagaaccuuugauuucagaaacagagaaagaaaaacauggcucaauugaaccaugguauucagaccucauaaaaaugcuucucuaagcuugaggcagaguuauugguuuaugugucagcuagcauuguuuuacauugcaucuuaaauauuuuaggcucucuucaaagcagcuguuuuaauagacagggcagaaaucauugaagaugucuuuguguuacugcugucacgcaaaaacaaaaaggugcuacuugucuacagucuagcagacauuugacauuuuuaacugcagguguuuuauuaauauccaacaugugagagaaauugagccauaauuauugauauuugaaauuacuucaaaagccaucuauauuaggcauuaccuccuuucaaccacagccaccucuagggagagauggcagauuggacuguuucugcagacucuguuugcugaaacucaguagugacuuagaaugggaguaaugaggagggauaguuuccuuaacuagugauagaaaugaucauacauguaugaucagcacaguccagcuacauggaaguaucugccacuguauucauagcaucuggcacaguaucuggugcaaaguacaaaacacuguauuuuccugauaauaacaaaucauauuuuuucacacuuaaauguuugccauuaagguguauuuuacccauuaauguguauuuuuacuguuguuuuuggccuccucuuaaauuuuuauuaaauauuugaauaaaaugaguuuggugcauuaauaaaggaaggaggaggacuuaccuuuguaaggucugauccauuugcuuuugguauaauugaaggaucauugacuggguuaacaugcacugagcuccaguacuauccuugccauuuacuaguggguaugugacacugggcaacuuacaauaucucaggcacugauugauucuuuauugauaagguagggguaguauuauauaucccaguuuauaggaugauuaugagaaucaaauaagauaauggauaugaaguguuuuauaaagugugauauacauauaaaggguauuacuaaucacagugugucuguaauuuacgucuuauuuuauucugacugccccaacuaauucaggccuuuugccaucucacacuuggauuguuccuaucuucugcuaaaucaauuccgucucuugcuuuuauaggauguguugaguagcccugaaauaauguucuaaauauguuacuuuccuuuucaaggcuuuuugcuguaccaccugucuacucuuguagccauuaucuucucuuuauacuccuuccuccgauuucauucccugaacuccuugcuauuccugagcucuuuaugcuugccaccuacgugccugugcaugugcuguuauuucuaccuaaaauccuuucucccuucuaaccucauaauguuucuacucaacaaaaucugauuugucucucaagacucaucucagauaugacuuugucccuuaauuuuuuuuccucuuuugccaggccugauguuucuuuuauggaaauggaauagauaaugguaggaauggggauggcagccggggagagaaaguauuaccgaauuugauuuucuguuguucccaacaaagugagaggugauccuagguuuuauuuugcuguuggagaauuuaaaauugugguaaguuuuuaucgcucacguaacaugucaccaguuucucccgccuccacccaugucuauucuuuggugcuuacauuuguacuuuaccgaucaggggauuuuauguagaucuauucuuauuuuauguaauauagauaauaaauuuuuaauacaucauauaauauaaauuccauaggaaauagcuguuuaggggaaugaagaggugagcuaucuagaaagcaaagaaccaguuuuuacauugaaaaaccucacaguuuaucuguuauguagacuccuuuauauuagcuuuucuuaagucgugcuuuaucucagguggaucuuuaggaaaauaguaacuuuacagcccaggccuauuccugagacuauuaaaaucuuuguagacuguacuacuauagauugaugaaauguuuuauuuuauuucucaguaauuuaauacuauucccuagaaaucauucuuaauauuauuugaguaucaaaaauaauguaaaugucaacagaacagccaucuauguuuaaauucuaaguuccuaagcucuuuacacuaaaaauagaauuguuguuauacauuuucucaauuuaaaaauaaauugaggucugaaagaguuguuuauugcucugcucgccaaccuuaaucuagugcuggggcaguaucuguaccuaucugccugaucuguguuucaaaaugcuacuaaauugaugccuuuucuuugacaaaaucaccaugaaucagaauggcaaucacagggcccccuugaguuuuagguuuuguggccauugucauuuccuccucauuauuugaaaccuguccuuuccuaggccugcugcuucaggcaucuuguagccuccugcacgucacuuuucauccauggagccccaccugaccuuuccuaucccaguagcuccuuagauguaacaauuggcacauuguauuauaauuucgcauuuauacauuuaugucuccaacuagacugugagauccuuauggguaagggauuaugauuuauuaauuuucuuuaauccuaugccuugcacauuacauguaguaaauguuuguggaauuaaaagauggauuaacgauuguaagauaccucaucuuguuguuucccuuagguauagcagcaugucaugauuucuauggauagaaaauauuggggaaagcagugaauuagaaaugauuggaaaaauugaaucuagccugugggguguggauuaauuccugugacagagaauggccugggcaaguuauuuaucuaaauaauagugaacaaauauugagucccccucagccuaagggacugugcugcacuugacuauucuuuguauagaccaagacaucuaaauagauggaaaaacuaguaauauuaaaauaccuuuuuuucuuggucacugagcauguaaugguuaagaagaugguaauauguuagcgauguguuaacuauuuucacagguaagacauuuuauguuucaacuucaaagauuaccuauaacuuuauucuuguuagcuauauuuuucuuuauaguaguuuuugaguaauauguauauguuccuguuuuuauuucuuuaauaaaauugaaagucauuuaaguuauuccucuaagaaccuagguuuauauucagaagcccuagggacuauuugaaagacacacagacagaaagagcacagacuugauaaucaaauugcauggguuuaaauuuuggcuuugcuacuccagcuauaugauuuuagaaauacuuacuuuagcaucuuuuugcuauuuuggcaucuacaaaauaauggcaguagugguacucaccucauucugggguaauucugaggguuaaaugagauaaugcccauaagauuguuagcuauuauaacauaugcucgauagacaaguauuuuuaaaauaaaaauuccaguuuggcauacugcuacauagcaugccaaaugcaauuuugaauuuucaaaauuuugaauuuuuguaccuuguauauguaagguaguucugcuuuugugagaagauuggccagauacauuagguuguuucugauagaaauaggaugugugcaucacuuagaaaauuauaaccacuugacgugauuuuucauaaacuucauuuuaccuguuaguuguugccuuuaguuaaguuguugcagugcagcuugguaccuacacccuuuaacuugucaccagcuauguucuucguggauuguuuguuguaacuuuaaugaaaucuagucuugcugaaucacuaaaccuguucucuccuagaaggcucuuuauugggaccugacagaucaccucuccagagccuucagacguccuagcucucuaauucuucuccauaaugaguuuugugcugcaugauaaaauauucauguucaaauagguucuaaacuaauuaucuguggccagcagucgccacugcagucauuugcuguuagcuuggcucaaguuaauggcuuguauuucaguacaaauagucccuucuggcuguuuccuguccugauucuuauccuaaauggaauuuccauacauaucuagaguuaagucuucuucuuuugaaaggagauuuuuugcccuaccuuuuuucaucucauuuuauuaagauuagcuuauuuuaguguucaguuccuuauuguuucuuauccaucuucaaauccuacaucccugccaaauucaugacucccacacuguccaaaaagaaauaguaaagcaccaacuuuaaucaaauauaccaugucagauuuuggaagaaaccaaaaugggguaccgcgguaaggaugggaucuaguuucaguguguaugauaaacauuucugcuuaguugcuagagaccuacacagggaauguuacgauaggaauuaaccacuuugggaagaauuauggggcuggacaugagggagauaaggcacuaauggaauauuuuucuguggguguuguugaaaaugauggaugacuugcugaaggagugggagaguucaauaucagaggacuaagggcuugaucuucggggaaucuguacuuagauguagguaugaaaagagcuggagcccagcuagcaaggagaccuuccugauacccugggacagguccgugccuggggccuucuugaauccuuucugcgucccucuguuucagugagugagugagugacuggauaugaaaggauaagucagagaaagaagauguuauuaggcagauagaggguggaccaccuuuagaaauucuaagugccucucaccucagcaucauuguggucacugagcucuucagaaaacagcagcuaaccuaaagugcuuaacuggaauguuggaccaaggagacagguacccuuuucuuuaacuagcuauuagagcuuuuguuccaccugacuuuuucagaauguuguagucauuaaacucucaaauaccacccugguuucuccucccucccccacaaccccucccuuccuaccuuccccuucaaauaaaccaaacacaaaagucuuagguugcauuuuuuuucauucacuauacucuauauuucaguuuuauuuuguuuuuaauugacauauaauugacacauaauaauuguuaaguuguguauugauucucugccaguuaaaugguauaugccauaugcauucuguuaauggccuagggauuucaugggcccaagguuagugcuuugauuuugaaaucaaaacguucaauuucucaugaacuucaaauuauuuuauuuugaauaaauagagucaauagauucauaguguuagggcuugucagcaugcuggaaucacagauguguggugaauaaaacauaaaugauuuuuauggcauucugaauaguaaaagucuuucugauccuaaaugcacaaauccaacauuuuauucucuauuguacuuaaaacagcacaaauggccgggcgcgguggcucacaccuguaaucccagcacuuugggaggccuagacagacagaucacuugaggucaggaguucaagaccagccuaaccaacauggcgaaaucccaucucuacuuaaaauacaaaaauuggccaggcaugauggcaggugccuguaaucgcagcuacucaagaggcugaggcaggagaaucauuugaacccgggaggcggagguugcagugagccaagaucagcacugcacuccagccuggguaacagagcaagacuucuucucaaaaacaaaaacaaaaaaccccagcaaauaugggaaauuaguaugauaaguguuuuccccucaugcauuguuucugaccugugucauaugugucuuaauuuaucugcuuuuuuauuccuugaucaaagaaacaugccuauuaaaacacccacggugaaauacuuccugaaaggaaaugcuagcugguauuuugguuccuucucuuuucuuuucuuuucuuuucuuuucuuuucuuuucuuuucuuuucuuuucuuuucuuuucuuuucaaauaaaagcacuuuuugcccuguaaucuguuauaaauguaaauccugugaaauauguaagagggaaaucuaauaaaguaucagaauuauggcuucuuugaauucagcuauaacuuggaauuuaaagaguuacauauguugcuuuauauucauucuguauguauaacaccacaauaaucuauuucuuuaauuaaaugcacaaauaauaguuuaaguugaugaaguaccugaggcaccggggagagggguguguuaaacauugacuaauuuaaugagaaacguguuuaaucuacucccuccuuuaauguagagcgauaauuuuggaaauuacaaacaaauguacguauucuucaaaugucuuuuuauuuuuuuuaauuuuaaacauauagauuuuauuuuucuuuuguuaguuuuuuuccguaggcugugacuaugcuuacugaaaggauaugacauagauauaaacuguuuuccauggagucccgaucaucuuaagauaucagaguuaacacuucaaaucauuuaauacacuuucauuugcucagaagagaaaugcuacugaugacugcuuccaagagaagccuaaggggcagaaggaggaaacccugugcccaccuauccuccaggguaaucauaugaccaaccauauuagccuuccuuacuuuuaagacauaggaggagaaauuuccugccuuuuaaggcauaggaggagaaauucuugauaauauaugggggcuauguaaaaugcuucucagguuuaugauuuuaagccguuaaaccaaauacuccaaacuuugaacuuccacuuuggugugcauuugguguuuguuuuuaucuuuccaaauuaccuguucuuaucccuuuaccauauuuccauacuucuuauugauuuguguauauuuguauauauuauggguauccuuuccaagugugacaaaucauuuucucccaguuuguugcuuauauuuuaaacuuuuauguuaucuguuacuaugcaaauguauaauguuugugucgugaauucuuuuuucuuuauagcuucuugguuuuuaaauuuucuuugguuaagcuuucucuacacuaauacugaaaacacacauuuuucuagacuucauuguuuaauuuuucuguauuacaucuaggccuuuaaucuauauagaauuuauuucuuuguaagauauugauuuaauuuuuccugauguaaaaaagggucucaguaucuuuuguuggucaguucuguccauucccagugauuugaaaugcacuguguuucccaauuccaaaugcguaauuagaauuucuugauuucaguuguaaaggacucagcuuaaugagcauaaacaaaguuggguaauuuuuaaggagaguaggcuuuuccucaggaccacagagcagguggcugugccuugggaacaacuauuuacaggaacucaaauaccaucagguuucauucucuuucuuuuuuccuuugucuucauuucucauuucuuuuucauauaucggcuucauuguucuuucucacuguacacuuuuucugagugguuccugaguguuucaucuacucagaaaucacuuuuuugguuaccaguugaaaaaucucagauuugugucaguugaccuucacuguguucuggaaaugaagucauuaaaaacauagccagcccugaccauaaccauguggaugaaaggcuaauucuucuuuagaaaaauuagauagcuuagguacauauaucucauucuggacucucuagaaguuauaucuguuuauccaugccuauuucaguucagugcugugucaauuacgucaauuacuguaguuuuauguuuggcuuagaaaacuguaggacaaguacuuucucauuuuuuuuaacuuucaaaauauuacuggcugguauuuauucuucacaaugaaauguagaaucagcaugucacguuccaguauacaucccauguuuuuugaugggaauauauugaauuuauagcuuucuaaguggaaauuugccuucuuauuuugagauuuuauuuuauuuuauuuauuuauuuuuuuagacagagucuccgucuguggcccaggcuagagugcaguggcgcaaccuuggcucacugcaaccuccaccuccuggauucaauugauucucaugcuucagccacuugaguagcugggauuacaggugugugccaccaugcccagcuaauuuuuauauuuuuaguagagaugggguuucaucauguuggcuaggcugguuggaauuccuggccucaagagauucucccgccuuggccucccaaagugaugggauuauaggcgugagccacugugcugggccaagauuuuuuuuccggaaucauggugugccuuuccauuuaaaaaaaucuuucuuuuaugguaaagugggcugguguggcuguauuucugucaaaugaauucccauuacuaaucucugcuuaauuaaauaaaacuucauugaauaauaauaauuuagaaagcaaagaugaguaaaagaagaaaaaguuuucuuauaaucuugucauuuaaggauaacuguauauacauuuaggcauaucauggugcuauaucuuccacagagauuaaauguuuaggauacaaugaauuggcauuuguaucaggaaugcauucccauuuaagugaaaagaaaccugcuaagaguaugauuuuauuauucauaaucaaagagguuuaaagauacuagaucagugacucaguaaagucaaagaugauucuguacaguucuuuuggccuugcucugguagucacaagaugacugcuacuaggacagucauuauguaccugguugaggcaagagggugacagauguuugacgucaguuuguucccuuguugucaguaaaacgaaagcuguuuuaggguaccucuguuucugccuggucacaugaacucuucuccaugcagguaagguugacaagcaagcacauggcuuuuuaaucucuguugugggaagugggauuggauuggccuuuagguagccagucaacaccaucugccuuugcaaauaaggccagaauuacucuugaucuuaaauuuuacaagccaaguuuuuagacaguggauaaguucuuccacgucuucucaaaccaguguuuuucuaagccccuuaauuuauucauuucuuucccucagugauuuccaggaagccauuaccccuauuugccuggcacuuauacagugcggaaaagguccugaaaacccgaaaaaucauuuauaguguguuuuccuucauuuuuaaaugcuauuucuugauugccuaagacugaauugccuugggcauuccucacugagcuggaaugcugacucuacagcagguucuugaauaacauugcuuugcuauaacguugaugagaaaaagaaauugauuccuggagggccccacugucugugugaaguuaacacauucuccccaugucuaugaauuuucuccagauacuccaguuuccucccacaucccaaagcugugcauguucuuugaauugucaugucuaaauuaucccagucugagugagugugggugcgugcgcgugccccaagauggaaugguguccuguucagggcuagugcccgcuuugcgcccugaacugccgaaauaggcuccugccacccgccacccagagcuggauuaagcagguaaauaucuuacuuggugucauuuaucucaaauguaugcauagcucacauuuauuucaguauuuaauauuaguguuuuugucuucauuuagagguuuggugauguuuuugcaaccagaaauaugccauaacaacucagcucuuguuuaugucaguuagccaguggggaaauugguuuugugguacaucauuuugcuuaaaguugaaguuucuaagaaccuauagaggacauuaagugaagaacuuguugcauuucugcuuauuuauuugcuuuuacugugaagaaauagcugaacuucugugaagggugcaguugcuuuuaguccacugugugcugcucuaggcuauccaagcccagggguugguuucugcuccuaugauaugaaggcaguaugagaauucucacagggcccuagccugaccucuggauuaggguucucaugguguugcucugguuccugguuucugcaaugcuagguuccccggcuugccugaccuugccgccuuuugcuuccgguuagugugguucucucaaucccauucaucugauacuuccagacuugucauuuuuauuaggucucauugcuucagcaguuaugccauucuccugacaaauagaguucuuucuuaccuaggaaaaauauuagcuuuacuuuaacuagagcuguuuucacaagugugugaagaccuggaaauuugcaauuaguuucagauaagcacagcugaaauauucuuguuuuguacuaaggcaacaaauugaaagaaagauugagggcacugagucauuguaguuucuaacgauacaacgaauacauuauuggguucguguaucauacugggaccuuguuacuuacaaaauauaaaauaaaaggaucuuaaugugucuuuaguaauccucaugccucuuaauaagagcuuuuaauuuuuagucccugagucaucacauuuugguauugcuagcccugcuguggccaaacugaauacuauccuaauuaauuuuaauaauagaaagacucauuaggaaugcacuggucugcugggaugacuguggugaugcaugaagucacgaaaggaggaugaaaucauuuugggcauuucagugacauuuuuuauuuaaaauguauauuucaggccaaggagcacuauuguggucagcauuugggaggcugaguguuauauuuuaaacuguuagauuucauuuguuuuauuuguacuaguggguugucacacucuggcauuaguggucauuuuuuaauggccauuucuaauggcauaugaaauugaaagagacugaaguguuggaaagaaggaaaguuagguuuuuuuuuaauuauuaaaguaucccaaauaaaaauggaauuuuaaagaaugucucaagaaauguaugcguuaaagaagucaaucaaaauugggcaaaugagcuucugcucaugaacaucuguaaagcauugacuuuaauugcccugcagcugcuguuggcugugcgguuucuaguuuuacucguuucuccuccaucuuacaugucacuuuauuuccucuuuccaauguugccugggucacaugcauuugcuugugucgaaaaaguaagaugauuuaguuauuuuuaagaucccaaagacaaggaugcuuaucuguuaaagccuuuuccuccaagcaccuguuaagaguugaauuuaaucuacaccagcuguagccuaguuauguguagcucgaguaggaggugucugauacauugucuucucuuuucauugaaauggauugguaaaacuaggcggcauaaguuaguggggaaaauuuagauacaucuuagauuagaugaagaccuuucaaaauagggcuuuaaaacauacaauucaaauauacgugcuuauacuuuuacgugaauuacaaauuggguaaagauagaaauuuguuucuacagaacugccaggaauuauauuacacauugagaccacugauuuuugacacuggccacuuuguccauuugaauuuugcugcugaguuacucuuuugggcauaauucugcagaguggaagucuuuaaagauaaaggaagggcugagaauguuuuauucuuguugacauaugaguaugauucaaauugaguuuuauggaaagaucacucacuucauagaaauuuuuuuauuuuaccuacucaguagcagguuguauuaguccguucucacauuguuguaaaguaauacaugagacugugugauuuauaaagaaaaagagauuuaauuggcucacgguucugcaggcuguaugggaagcauagcagcuucugcuucugggaaggccucaggaaaccuucaaucauggcagaaggcgaaaggaaagcaggccuaucuuacauggccgggguagaagcaagagagagaaggggaaggugccacacacuuucaaacaaccaaaucucaugagaacucacucacuaucaugagaacagcaccacaggagaaauccaccccuacgauccagucaccuccuaccaggcucuaccuccaguacuggggaguaaaauuuuucuacaugagagcuggacgggaacacagauccaaaccauaucacaggucaaauucaagcuccuauuuuuuuuguucuccuucuccacuuauuuuaaauuggaaaugaaaagauggaauauaaguuguuuuagucauuaugaaauacguuuaccaaaccaacuacaccauaccuuaaaccuaaguaaaccucuuuuagugaucaauuuugaagguaaggcccagucaaaugcugaauuuugaugaccaguaggaggcagacuaagauuuuucacuguucccuuaauauuuuuuaagauuuguaauguaugaagcuuuugauauguaauaugagagacaaaaaggagacaucuuaauucuacucuuaaugaguggaaauauuuucuaaccugggaguuacugcaaauugucguggaacugaaccuugaggccugugagcaaagguugcuaaggucaaggucaguagucugaaucacaguguuccagggguuccaggaacucaaaccuaacccagccaaguacagacaaccucggggucuaacaugugagaguggaauugcgauagaaaucgaauuuggugaauagugguguugggaugucgaguuuuaguuagaguuagaauuagaaucccaauuagugaccuugguaaauacuucucccauuuucagaaccauggcaaaauggauugagguucaggggaacuguaaccuaauuaggagccaagggaggagcuaauucccaaggauuggacauguguggugggcucgauagggaagaccauaggcuuaguuugcucuccgaagcaugcugaauccugagcuuaaccgccuccacucuuaguuuucucaucugugaaaugacaguagucaauaauuauagucuccucaugggguuaugaucauuaaaaagaaaauccauaaguaacacguaaaauacugccuugacauauugaguguucaguaaauauguuggcaauuacagaugcuaccuacucaaagguauggguuuuuaccugaggccccagaguuguuuagagaucaccuugaggacucguuaaaacacagauugcuggaacugaccuucagaguuuucgugauucaguagcccuaggguagaguugccagauaaaauacagaugcccaauuaaguuugaauuucagauauacaguaaccaaucuuuuaaauaugucccaugcaauauuuggaacauacuuauacuaaaauaauucacuguuuaucugaaauuuuaauuuaacugugguaaauucauuguuuaucugaaguuugaaucuucuggguuuuuguuuuuguuugacuaaaucuggaaaacugagucuaggguggggcaguuugaauuggcaugucagauguguuccuucccaggugauccuacuggugguucagaacaacacuuugagaaccucuggauaccugcagcuggauggaucugaggaguauguugacaaucauuuacaaauaacuguagcagaaggugucacauucccugggaguucaaaguauacccaagauacaaggcaacaauguuagugucuaaauaguugcacuuuauuggggguuauuauauauuugugguuaagucuuuaaaauaaggaacaugaguuugagaucauuuauaaagguauguaacuaaguguauuggccuauaugaaaauauagauucugucuuuuugucaugauuuuaauugagcuacaccuucaugaauuucaaauuuauagcuuuuuaaugccaggaauuauuuuugggguuaggaaugagagagcccagggugaaaccuuaaacucaucugugcuuuaucuauaaucccuauaagucagaagccaguaauuagagucauacaggaggcaguguagagagugauuauuucaugggcuuuagaguuauuucucauuuguguagugaaaauaauaaugguaccuaucucauaggauuguugugagcaugaugugcaagaguacacauaaaacaugguuuagcauacagugagcacuuaagugcagacuaaaauaggauuaggauuaauaaaacucaaauccucaauuuaguggguaaauuguuaagacauuguuaacaaauccucugagccaaguuuguguuuguuuguuuuguuuuguuuuugugacuaagaaacaucacugauucaugguagaccggaagguacauauuagaacuugguuacuuggucuacuauacacugcaguauuagcuccacaauagcagagacuauucuugcuuuguuguuuguuuuauccuuaaugucuaaaacaguaccuuucauagaauagauacucaauaaauauuuguggaaaaaacaaaaagugacuaccacugguaaaugcuuucaauaaacuguuuuuagaugauuuuaugguuauguguagacaaaguuguuguaucagaagauuauguucccauggauauaacaauagacuaaagguucagaauaucucaaacaaugaaccuggacacauaaacagaaucauacagaaugucaagaaaaauggaaauguuuuagaugucugauguaagaacagucacuugguuuuucuucuccuuuuuuaaccuuuugauauacuaugcuggcuuaagaaaaccagcuuuauuauucuuaaaaguaaauuuaaauaggcaauacauucccaugcuucagaauuuaaaaguauaaaaguauacauguuaaacaucuccuuaaaacuccucuccaauagauacccuguuaccuuucccacagguuaauuuauaucauuaguuucuuauauaucauucuagaaauuuuuuggcauauauaagcaaauauauauauauauucuuuuuuuuccuguuuuacacagaugguaacauuaugaacacuguucugaacaucauuuuuuuuucauuuuguauaucauggaguuuuauuucuucuuucuuuguuauggcaagaguauuacguuguauuguuacaccauaauuuauauaaccaguccuguguugauaugcauucauguuguuucuaguccuuuguuaucacaagcaaugccacaguauaaccauccuugcaugcaugugcuaauaugucuguaagauaaauuucuggcaguggcguuugcaggccaaaccguuauauuccaggguuugugcauuuguaguuuugauggauacugccuuaguucauuuuuugcugcuauaacagaauaucauagacuggauaauuuauaaagaacaaaagcauauuuggcucaugcuucuagagacuggaaagucccagagcauggcacuggcaucuggugagggucauuccguagcagaaaggcaaaaggcagaaaugaacacaggagacagaaauaugggccugaauuuauucuuuuauucugagcucacuccugugauaacuaauucauucccgugauaggaauacuaguucaugcaugaggacucugccucuugaagguucuaccugucaacccucuuacaauggcaauuaaauuucaacaugaguuauggugcagauguucaagccauagcauugccauacugcccaccauaguguaccauuuuacacuuuuaccaaguaauguucuucauucuuuacauucuuaucaauacauuguguuaacaaauucuugacucauucccauucugauauguaaaaauguuuuaguuugaauuuauauuucucuugugagauugcacguuuucauauauugaagaacuuuuuauauuuccuuuucugcaaccugucuccucauauuauuuugaguaauuuucaguugccucuucuuucccccuuacugauuucuaggauuuuuuuuuuuaaucugggaauacagcaauuugagauaugagcuuccaauuuuuuucccauuuauacuuuggcuuuccuuagcauaauuuuugccaugcagaaauauuuaaucuuuauuuuauuuaguauaacaaacuuuucuucgauggauucuacauuugugacacaguuauaaaagacuuccaccagcugagguuauaaaugaggaauuuuaucauaauuuuaaaauaacuuuuauaguuuguuuuacauuuaaauuuucaauuuguuuggcaauuaucuaggcauagguuaugaggaaaucauucgacuucugccuugcguuuguuuuauuuaugacuucacuauuucaaccaguuuucauugaguaucauuuauguaccaggaaauuaggugggugucccucauagagcauauuaaaacuuaguuggaugacuaggauuuccaaaacaaauaaugaaugaaaaagcauaagaaguguuaugguagagauguuugggaaugcauagacaggaaugauucauccuuucuuuguaugggaaagaacaggacucagaauaaggaaauauuuauaccacacucauuuuugaaaucaggaauaucuuaaaacaguuuaguuuuaugaaacugaaggauuuauuuagaagaacagauacagucugaauuagaauguugauguaccgugugaauagaucaacugauaugauucacguuuguuaagacuggcagcuuucuacugauauuuuuuagcaaaguaaaaauaaguaagcaaauaaauagggcuaagaaaacuaauuugagagagucaguuuucaagauguuggagaggguaguaauaugagaacacaaacuucccaacugugugauuuuggaacucccuuugagaaaaaaaagaauaauuaauaaagauuuuuuuuuaaaaggccagauuaauaauuaagcaagaaaagccucagauaacuugaaaggugagagaauaaauugccaggugauaacaauaaagaaauuuaaucauguccacgaauguauaauacuuuguacagccaauaaaagcaaguaagaauuuucaguccuguagaggacuuuaaugcaagggacaacaaauacguuagauaugcccaaaggacaugacuaguaagagaagcgcuucaguuuugaaaguaagauaaaauguguaaguugacauaaucuuuaggaaagugaauacaguucccauguuagguacaagcaggcaguuauuuucaacuagaaagauaugaaagucuuuuaaaaaccaaguguagauauguaacuuuauuauuaaacaugcauucauucaguguuacugagagaguaaagaauuaggaagauaauauugaggaaagauguguggauuauauuucaaauguauauacguagguauguguguguaagacacacacacauaaugguggaguguuggguuuuguuuccagagaaccaaaagaaguauaaaauauuuaacuauccuucaaauuuugacagucuuuugccuuucauucaugaagaugaauauuauucuuuuccuucguaaucaaaugcccagguuuccaggcugcuuccagugaauguguggcuucugcuagagauucuguauuuuacagauucuauauuuuacaucucugucaccguuggaauauguuuaugagaucugggcuuaucaccaguguacauacuugucuuucuguucgccacuaauuuuuauaagauaauggcggaacgcaauaaaauaucacauaguugccuagccccuucuguaccaagaugucagugcugccgaaauugaauugugaguuggcaggagaggcugcuguggauuagcaggaaauauuugacaguucaaauuugguauacagaaguuagcagugucaauauauaauguauaauaguuggcacagugucaauauauaauguauaauagaugaccucaugcauuuagagccucuguacacuuuuaauauugucaggaagaggggcugccggggcuuuuuagacugaagauugggacuuggaggucuuacagucucaccaguuagugaucauccaguuuagucacauuauuuuauaguaggagagugaaaccuaaagaaguaauuuuucuguguguacaaagcaaauuugguggcagagauuaacaggcagguuuucugucuuguuucauugcuuuucuuucagcacaugucgugcucuuucaccaucgugguuuucagcucucaguguaccaugugugauucuugggaaaagugcagauaaccugaucuccaaccucagagauuuugauuuagcuggucugggauaugagcccaagaaucucagaugcagauggcucuuguggcaggcacacuuugagaaggcuagaccaugucaugcgugaaacugaaauacauagaaguuaaauauccaaggucacacauguaggaaauggggaaaccaggacucuuauccacuccucaauauuuuuuuuugauguaugguuuuucgcauucuagaaauugaagugacucacucuaccuagagguuuggaacaagauuuaagaagcaucuaaaaucaacaugaugccaguucuuaggcugauguguguuuauuaauaagaaguaaaauuguccagcaugagccagcuuuaauuaggcauuuuaaagaaguaagacugugcuacuuaauauuugaaaauugauuuaauuuagaacugauuaucaauggugauuuaaguauugguaucccaucuuuacuccuguugagcaaccuggguggccuuaucuuccgugacaguggaauuuacaauuauuucaaacucugccuuuaaguaacuuagaaucuucuagaagauacaacuuauaaacagauuuaaagaacgauauuuuuuaaagugauuauuaaaugauuacuuauguagcucuagaucauguaaugguuuagaggaggagagaaaaguuucagaacuguguugcaauaagccccuuugauggggcuuaacuugaaagggagcccuugucugaucaaaugacaucagacagaagggagccagugaguguggaaauuacuaauaaaaaugaagaaacgugucuucacccuuuugugccaauuucucaaaauaccacagauugaguaauuuauaaaaaagagaaauuuaggccaggcccaguggcuuaugccuguaaucccagcauuuugagagucugaggcaggcggaucaccugaggucaggaguuugagaccauccuggccaacauggugaaucucuacuaaauauacaaaaacuuagccaggcauggugucaugcgccuguaguccuagguacuugggaggcugaggccaggcaugagaaccacuugaacccaggagucagcgguugcagugagccaagauggcaccacugcaugccagccuggaugacagagugagacuuugccucaaagcaaaaaaaaaaaaaaaaagauuaauuuucucacuguuccagaggcuggaaagucugagaccaaggugcugacagguuuggcuguuuggcugucugguaagagcugcauucuccagugaggaggacacucagggguccugacguggugaaaggcagaagaguaaaagagcugaaagcugcaauaauuuuguuuuucuaaguaacauaaucucauucauaagugaggacccucauggccuaaucacuuccgaaaggcacuaggucuuaauaucgucacauuggcaacaccggaauuuuaaaagggauacuuugaaaccauagcagaagguuaaugaaaaauuaguauuugcugggaagguaggcacagggauuuucuuuguuagugaguuacugggugaaaauauacagugguguauacaaaauauacaaugacuguaaugaaagugugguaguguuugugaauaaagaauuuaagugucaauagguaucaaagaaaggaggcaauuauuuggauggucauacuugugcuuagagguucuuuacugcaccaccccagucuguuuacuuuuguuucuacauuguuacagcuuauuggaauaacucagauucuugucugaaaugcuuugucaauuccuccaaauuugcaccaaggcaaacaguaaaucugaaucauaguagugaauaauugaacaggcuaaaacaugaacuggaaaagaugacuggaacugaaaaaucaauaagcuuagggaaaaaaacuuguaaaagcuuauucaauauaaaaaaaauaaaucaagaauaauaaauauccaaguugcuucuauaaucguuuuacuuugaacaauauaauuuuuuuuuaaaaaaauugauagucuuccuguguguacaggaaagauuucuagcauuugaaagguuacagcagaauaaaggaaguacaagcaaaaaaauacauaaaaauaauuccuuccagcauaacaaaaaucgcuuucaugaaaugauaaacuuuaguguagauacauuauugaauugaagagccguuggcauuccagggaagcuuuugggguccuuaaaugucauuccacugaaacagcaugauugugauugcugauuaauaguccaagaauagugauaucugaauauggucuauagugauuuaaaaaggcuuaugaccagcuucucauuugaaacuucuagacaguuuucaauuuaauaaucuuaguuucccacuaugaaaaugaggauugcuuggggaaaagagucuguuauuuuugaauuuuugaguuagacgucuuccauucaccagaaagcacuauccagauucuaagauuauguuucaggauauaaccauauggcaaagcacuuacuauauauagguaauuugaaacuauaccaguucuaaaacaaacaaauaaaaggauguggucauguauagcagugguaauacaugaauaguuagaucuuguguauaguuaauauguuucuguggaguugucugauuaauacaaacaaaaaaauacuaaucugugauauauaggauacuuaccacuuuauguauauuguuagagauggaagcaaccgcauuuuuacagaauggcaaaacuuaguucuggagaggugaauugacuagcuauugacagagauaaauaggcaccagaucuuuugggcaccagugcagauaaaccaugaugcuacuuagaagaauagaggaagaaccaguuucagcgccagauaguaugcuuaggauagcccuucacucaccucauugccuucucugauaagucaucaucucugguccucuacuuaggcccauuuaguugagguaucaccagaggcagcuucuguaauggggagucagguaccuggaaagcugugguaauacgccccaaaguauacaguccuguggaacuuggugcauuuacagucacgucuucuuucuuuccuccuuuccuuccuuccccucucuccccuccccuccucucuuuucuucuuuugaggcaagguuucucucuguuguccaggcucuguugugcaguggcauggucauagcucacucacuacaaccuuccacccccggccucuagugauccucccaccuuggccucacaaagugcugggauuagaggcaugagccauugcaccuugccaagccaggucuuuaacugccagccuacgguuugauucauugcugucagcauuguagguuccuguguuaaguacaaauuaacaauguuggggacuucauguauuucuacuguguagagagauucuucagcuuugugaaaucuuaaaauaccuuugguuacauguuauuuuuuccaguuauuauuuaguauaucuaaaacauuuuguauucucacagugcuucuuaauaucaugaguuauuaaguaagacugcuaauaaguugcugugcuuauuaauaguuuguaauuauuaauuauuuaugacugauaucugauguaaguagaaaguguguaauauauauaagaaguagcucuggcucuugaaaagagaguguguguguauguuugugcacacguauguguguacaugcauguauauguauacaugcauaaucauauacucauguauaauuauauaugauuuauauaaauaugaacucuauauacauacauguuuacacauacaccaaaaugcacacacuuacuugcuuucuuagauauuuagggaaugaauuagauugaaucuagauuauaagcuucuucacuaagggguuugcuucuugaggguagacauuuucucuuguucuuuuuacuuaauagacacugaauaaaacauuuguuacuugcccugauuuugggacuggguaaauuguuauauuucucuaaaggauaauucaggucagcguacuuuguguguguauaagccagucacuuugucuagaggauugcugagcugcaaccacugauagcugccuugacccugaaguaucuguucuuuacacgaaugaagaaugaagcucguggucagcaugaccauugcuucucagaaauguaaauuuucucacucuugugaauaucauacuuacaccucaugcuggcuacucuccucuucuucucuucaugaucuuucucauuauaacuuuguccguugcacccagauacauccgaaaaguugucaccugcagagaugcuauuuggugaagauuugaaaccucuuaacgguuaagaguguccuuuaucuucagcguugaugacaaaccuguuacaaacaaauuuuuggaugggauauuguaauacaaaugaaacuguuugugaaacagaugaccugauuguuucauaugcguuuauauuaucuguauuggugaugugcuccacaggaucagauaauuaugauaauacacacguguugaaaagagaugcauucaauucacagcuauggaaguuuuaaauugauuuuuuuuuccccaaaagaagucagaauguauucauuuuuucucgucauuuccuucuuagcuuagaguuaccccuuguggcuuccuaauuucauugcuaccacauuguccgagucuucaucaccugaaaccugaguuacuguacacuuaaugcuugucucuccuguuucugguucauucuauauacuguauacuucagcacacauuuauuuaccaugguggugauaguggugauaagauuuuaguucuagacuagaaggcauaauccaucaaaaagugcacaagagagguauugguuuguaauuuuuagaacacuaacuuuaaaauagucccccacccaguuaaaaaauaauuguggaccuauaacguauacaauacugcuuuagauggugaaaacauuuaauauauuuauugaauugaaauaguuuguugauuuaaaaauucugcuaugaugguaggauaggguaaugggacaauucuagagaggagcacaucugguauguggcauguucauuguccgaagagaaccaguucugguaaugaguagagcauuucuugaaauuaacauuguaauaagcacagcaaagcaaagaggguuuaaaucauaguggugccucucuccucccuggcuucccugaugcccagugguauacaauucagaaauaucugaugagugguuauaacauuucucugauuuuccccuuucuuuucuucaucuccagguucaucuuaaaugaaccucuccuuggucccauaaggccagucuguuuuugcauuccucaguucugauuucuuuuggcaggaggacuacaugugguugacagauuauaucugaaaagggcuuugguaauugcucguucucuucagugacuguguugcugacagaugggcacagugaauauugaaaguguucuggaccuccgcuuacuccuucagcucaugagugcugagcacugccagcacuuuucuuauuaucuauuagcaaauuuaaaaagaauugcuuggaucuuuacaucuuuuuggaccuauaacuaaaucacauguauggcuagguucuuucccaccucuucuacccccaacccccguuauguauuuuuuggaauagagaaaauucucaagauguuaaugcaggcuggcaugaaugggugccaauaguucuuacagacuuguuaaaagauuuauuuuuugccugagaauuacacauauggccuagaaugauaauauuaggaucuguguugguugagauaauuggcagaucacaccuuaagaaaagugauugguuggcuuguuucuuucauuuuaaucuguugucuccgucacagucaaauuagcauuauguaguauauuacuacacuuaaaaaauuauuuaacccauuuauagagggcaucugucgguugcauuugauuuauuuaaaacguuuucuuacauggccaauuuaguaacagcaagcaaaaccaaaaugagcaaaggagaggaucccaauaaucccagaucuauaaagcggauuucucaaggggguagagauaaccaccuagcuauugcuaaaugugaucucacucaguugaaaaagaaacaaucagaagugagcaaugggagccgugaaaccaucucaaugaagacuuguugccaacauggagauagaggauauuggucuacaggguacuauuggagagguaacugugaggcuuuuacacccagacagcccuucugugcauggcaaguuuuacugaacuccucgagauuuagggccaauuaauucaucuguuuuaagaugaauucaucggguaauguguuuuaagauuaaauuaacuuguuuguucuugcuuuccagaucucuuauucacugcauguguguauguggguaggugagugagagugagaaagauaauaugcccgggguuggaugucuguuuucauuuauuauuaaguagaagaagaugcucacauacuuguagguacagaagcuucaacauagcagucuuucacagugugaguuaugauagacgcaaucuaagagugaauuauaaaagugauagggccggaacagacuuuuauuaaauuuuggguaauauuguagauuagaaaaguaaaauguguuaccucuacuuaucuuuaaacauucacucuauuuaauguauucaucagaccucaggaagcuugcaaguauauucugaaguuacaaauuuguauuuucuuuguaaguaauauuuaguaauauuuuccuuuauaaaaaacuuuuaaagucuaaaaaugccacugugugucaauguccuguaucaccucucucucaauuuucguucucuuucuucuaauaacuauuucuaaggaaacuauuuuuacaaauuauuccaaugauuacuaucaaauuagaagaucucuuaaauagcaucuaaugugauuuauagcagagauaacuaagguccccaaaaguuaaguuacauguuuaagauuacacaacaaguuaagucagaguauggagaggaaccuagauccucucauccuuguucaguccuuuuggcucuaauguugccuccuaucacauucucagucuggaugaguuggcuguaaaauaucaaggguaugcucuuugcagucuaauuuagcaauuaugaucaauguugucauccauguuuuaauaauagaauuguagagauaaaauuuguuuuccguaggucauauauguaaaaaaugcucaauacauauuuauuaacugagugaaugaagcugguaguuuuguuugacauaugcacuuuuucugacuuucaaaaaaaaaguuaaaaucagaaaagaaaccaaaauggauccaucuggcuuauuuggaaggacauuauuguguaaugaaauaccaacgcagucacauuauauaagucaguguucauuaucacagacaaaucagcaugguaaagaugauagauuuucagaauagcauagggauucuuuuaauaacccccuaauaaauagaugcaaauaguuuuccaauugaacauaccuuugaauuauuacccauauuauugucuuaauuuguugaaauuguuguauuuuuguaaugugauugcaacauugcuuuucaggaagaggagauuaugauucuguauccccuuuugguccuauuuaucccuuuuaaaucaguuucaccucucaucuuagacuuaucgggauuuuuaugaauguaccugacuauccuugguacauaaaaagaagacucuuuucacuuuacuuaaugcuacaaaauuuugaguguaguucccagauggcuaauuauuuauuuggugacuaaaaauauagcuucuuguucuccagucacauaugugauuuugggaucuuaagauaaauuuuuauaucucauaugagugaucguagaauuuccagccauuauauuucuuaucacuauggcuagcuugaauauaauaacaugauuuuaaaauauauauaacccugacauggugauguacuuuugaaagcuccuuguauuagcagguuauuuguacagcuguaucaaaaagacuugccucacuucagaggauuaucgauuaauuugcauaaauguauuuaugcuugagaguuaaaguaaugcacuauuaguuuuauaaaacaguuggcauagcugucaaaguucuuaauguucuuugcaguguuacagcuagaauuucccagggcauugaaagaaaaagcaaagaaacaaaucuuuaauaguguuacauucugcuuguucuccugggcuuguauugaagcacagguguuaaggugguguugaaauuagucuggaaucaugaaaaaauaaaauacaacucuuugagguagcuagggcaaaaugacuuugcagugccacgacugcucugccccuaucugagaaaaugcuucuugugcucgguagcucuuguuaacuugaaaaacucuagaauuacauaaauaaugaauggaugcaaaaauucauugguuuuuguaauguagaugaagguaagauguccugucagaacugaaauuugcauaguagaaaaauuuaguuauccuaucuuguucuuuaaagcaauaaaugacuaugaauauucauggucaauuaaaauauuaaugguauacugauacuuuaguuuuaggucucuagccauccauaaagaguuucauuuaaacuugacuaacagugaagggauacuuuagcauaguguauaauauauuggcauuuugucucugaaaugaaaauguaguaccugacaugaguaaauaauuugcuuacucuuauaauucaucauuucuuuugauaagaaaauauucucuucuuguauagacuaaaacagggacacaguauguauaucuuuugguguugaaauacucuaauguuuuuaagcacuaguauuuaucuuuaucauguaguuagaguuucauuuaguugcuucaauugacuuuuagacuuaaaaaaauuuuuaaguguaaaguguacaguacaguguuacuaacuccauccauauuguaguucaaccaucaccaccaucugucuccagaacucuuuuucaucuuacaaaacugaagccauauccauuaaacaauaauuccccauucuccccuuccucaagucccuaauacccuaauaaucacaacuuuacuuuuuuuuuuuuuuuucuugagauggagucucacucugucgccaggcuggaguacaguggcaugaucucagcucucugcaaccuccgccucccggguucaagugauccuccugcuucagccuccugaguagcugggacuacaggcacgcgccaccacgcccagcuaauuuuuuguauuuuuaguugagaugggguuucaccauguuggccaggauggccaggauggucuugaucucuugaccuugugaucugcccgccuuggccucccaaagugcugagauuacaggugugagccacugcgcccggcccacaauauuacuuucuaugaacuggacuccauugauucauauaagugaaauaauacaguguuugccuuuucgugacuggcuuauuucacuuagcguaauguucucaaaguuuauccaugugacacuaugugucagaauucccuuacuuuuuaaggcugcauaauauuccaaaguauguauacaucgcauuuuguuuauucauucuucuauugauggacauauaccuuaaaugugugacuuacauggcguguacauuauuuggguugcuuucagcuuuuggcuuuugugaauaaugcugcuccacgaacauggguauacaaauauuuuuuugagacccugcuuuuaauucuuuuggauaucuacucagaaguggaauuguuggaucauaugguaauuuuuauuuuuauuuuuuugagggaucucccuacuguuuuccauacgacuacagcauuugacuuuuucacaguagugcccauagguuccaauuucucuacaaccucgccaacgcuccuacauuucuguuuaauauauugauuuuuaaguuacaaaaguugcguauuguagagauucaaacgauucagagagguguaaaguaaacuugaaaauccuucuuuauuuucccuuugacucuuaaaacauugauuaacacugauugaaucagauccaagaugagguuucaaauuccucuaaaaaucuuccuaagaaagcuuuuuaauaccucccgcacauauguguagauaacuguccuuucuuuugagcuucucuuuuaagguacugcaucuuaguguagugacuuccauuuagugaaugcuacugaauguggauucgugucagacacuguacuauccauauguuuuucaaccuuauagcaccagcagugccuaagucauugugccuggcaagucauagguguucaauauagguaugauacaugaauacacauguccagucugggaggaacuuuucaggaaguaacuaacauaggccucuuuccuuccgagugcuguauaagcagucucaugcugguguugcuuugagcaugcauuuuccguguuguauaauauauugcuuuaggguacacacugggccugugaagacugggccuauguuuccugcugcuuuugauacaggaucagaaaauguuuggaccccccaacuguucucugauuuauuaacacuggcucagaauuauggaaguuugaaguuggcuggaagcuaugagaugauucacugagaaccuuauuugacagcugaagagacugacauagucaaagacuucuacuguuguuaggaacagcacuuguuuuaaaccuuuauuuuaggucgcggguacauguacagguuugcuagauagguaaauugcuugccacggguguacagauaauuucaucauucagaugauaagcauaguacccacagguacuuuuucauccucacccucuguauuaguuuguuuucacagugcuauaaagaaugaccugaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguggugggcgccuguaaucccagcuacucgggaggcugaggcaggagaauggcaugaacccaagaggcagagcuugcagugagccgggauagcgccacugcaguccagcuugggcgaaagagugagacuccgucucaaaaaaaaaaaaaaaaaaaaaagaaugaccugagacuggguaauuuauaaaggaaaaagguuuaauugacucacaguucugcauggcuggagaggccucaggaaacugaggccucauggcagaaggcaaagggcgaagaaggcacgucuuuucauggcagcaggagagaaggagagcaggggaaacugccacuuuuaaacaaaccaucaggucucgugagaacuccgucacuaucaugagaacagcauggagaaaucugcccccaugauuuaaucacccccuaccaggccccuccccugacauguggggauugcaguuugagaugagauauguguggggacacagagucaaaccauaguaccuuccucccucccucuacccucaaguaggccccagugucucuugggcccuucuuuuuguccacauguacucaguguuuagcucccacugauaagcaagaacauaaugugguauuugguuuucuguuccuguguuaguuccaccuaggguaauggccuccaguucuauccauguugcugcagaggacaugaucuuguucuuucuuauggcuguguaguauucaaagguggauaugaccacauuuucuuuauccagucuacugaagaacagcacuuuuaaacaaugcucuuuauuuuucaaagccuaauuguuaaaguguccuuauagauguuacugaaaccuccauauccaagauaaaagagacugcuuugcgggguuguuaaaaucaguuuuucaaacauaauuaaucaaauaaaauuuaccuaaugacauuucaguaguccuuauggggucacaauugcucuauuuuuuuuuuuauuuuaaauaaggugaaguguaaaugaaaguuuuucguaauguuguuuacaugugcaaaaugauuagauaccuugccauuuuaguauaaauaugaauaaugaucauggggcuaaugauuaaaaauaaaaaaauuaagaaaaagacauuuuaaauggcaaccgaaacaaaucacaaggaccagaauuucccuguuucucaagcaaucagaaauuuuccaaacaauaauuaacauguuaacagaaaaaagaaauggagucuaaagaaauacaaaagaguucauggggguuuugaaaaguugcauucuuugcagaugaauugcauccuuugggaaauaacaguauauguagaaguuaagaaacaucaguauuacguauucuuuaguguuguuuaacagcuuuuugagaaauaauucacaugccaugcaugcuucacauuuaaaguauacuauuuagugguuuuaguauauucacugaguuguacagccacugcuccguucuaauuuuacaauauuuuucuuuuagaguguguuuuuuuucuuuguuucuucauauucucaccaacagccucucuucuucuuuauuuacauuuuauuucuuugagaucuugccuacuuuuuuuggcuguuucaacuguuaacuuggauuuuaaacacuaguccuacacucuagcuuguucuucucacuuccuuaauauuacuccgauaaucucuuauguggccuacuauuuuaugcauucauucagcauuuacugagagccuguugugugcugggcacugaagaauguuggucuagcuggaggacaguuacguaaagaaguaaugguggcaccccagggacugaaaugcuguucaggaugcucugggaacauagaagggcacuugagaggugcaggcaagauuuugcaggagaaagaacucuugagcugaaucucagaguacuggguaagaguuagccagauguacuagauagagaaugccaagcaaauggauuaucauauaugaagcuucuaaaauuugaaagaaccaguuguauuuagaggaaagcaaccaguucauucaguggcaugucuaggagaaaaaaaagugagaggugcagcugaagggagagauggggaaaggccugauuuuugaaaggccuugaaugccauacuaaggaauaucaccauuauccugaaggcagagauagacugaaagauuuuaaguggaggaagaaaugauaaagcugaugauggauuuuaagcagaggauugguaugaugagauguuaggaggucugaagguaaauuugguaagccaaggcaaggagacagggugucuaugaggugauugugguugcuuuaguuagagauaacgaacuguggcugugucuggaggauagugacugugugggucggggaagaagaaggguuauaaaggacaaggaggagugcgagaugacuauggcucagaaaauugcaugcuggagguuuaacuuugguggaagaagggcaggauguagggaacaagagcucagauuuggauuugaacuuguugaauuugggauauaugggcuguuuaggugaaaucuggaguuugggagagaggucugggccacacauggcuuugaguaucauuagcauucagguuuuaauugaguugacaucaugauuguguauuugaucagagauacaguaagaauagcaaagacuugagaacagaaucuuggggaccccugcaggugagggauuuugaagguggaggagauagucaucauuaucugcccaaaacccuuuucuuacuaaauugucuuauucacucaagauugcaucauucucaauguaguuggaagccagaguugggagucuucucugacaauuaacuuugcgucaucucucaucaaauuauuuugcuuuuuuccugugcaguaccuuuuagaucugcccuuucuuauuuuuucccacuugugucacuauuuuucaggccuuuguuuuuuacguauuucaguuuuuuuuuuguuuuuuuuuuugagacagagucucgcucuguugcccaggcuggagugcaguggugugaucuuagcuuaccgaagccucugccucccggguucaagugacucuccugccucagccuccagaguggcugggauuacagauacgcucuaucacacccagcuaauuuuuguauuucuaguagagaugggguuuugccauguuggccaggcuggucucgaacuccugaccucaggcgaucugcccgucuuggccucccgugcugggauuacaggcgugagccaccgugccugguccagacuuuuaucucuguaauauaucagaguuccauauaagauuuccacugacaagaguucugugaaaaaaaaguuugaaaguauucguuuauaaaaauacagauccuggcauucaaggcucuuuggagucucucccuaucuaauuuauuuuuuugaauguaaaucucagcauaaaucuuaggcuucugucauucugugauauucaauuuuccugaauuuuuaugucugccuuuuaaaaugcuguuuccauuacuuucuuuacuccucacacaugcaaaggucaaaugcaauaauucaagucucauuuccucuucgaagaggaagcagugugguauuuuauaaagcuuucugcaaauccuuguguuaucuguguaacuucaagugacggacuuuccuaaacuuuagguuucuuauguguaaacuagaccauguguagguuaaauuaauaaaaugaaguguauagcacaugguuacuuuuucugaucucggucccuuuugugcacucucauucauguauuuauucauuuaagaaguauuuacuuuggcauuacucugggcaguggugauacagcagugaacaaaaugaacaagaaucacugucauuggccaggggugguggcgcacaccuguggucccaguuacucggaaggcuggguggaaggaucacuugagccuggaagauugacacugcagugagcugugaccacaccacuguacaccagccuaggugacagagugagacccugucuuagaaaaaaaaaaaaguagcugucaguauggagcuuauguucuagaagaggagauaaaugauaagaaauacauacuuuucuuuuucugagacagauuuuuguucugucacccaggcuggagugcaguggugcgaucucagcucacuguaaccucugccucccagguucaagugauucuucugccucugccucccuuuuagcugggacuacaggcaugcaccaccacacccagcuaauuuuuuguauuuuuauuagagacaguguuucaccauguuggccaggcuggucucgaacuccugaccucaagugaucugccugccucggccucccagagugcugggauuacacgugugaaccaccacagcuggucuagaaauauauacaguuuuaauaaugguaagugcuaaggagaaaaaggaggaaaggcaggcaugaaguaucaagagggauggcugaaauuuuauuuuuuuaaauuuuagauucagggguacauauacagguuuguuagauagguaaauugugugucauggguguuucaugugcagauuauuucuccaccuagguaauaaauauaguaccugauaggugguuugaugaucuucaccuuccuccuuuccuccacccucaagcaggcccuggugucuguuguucccuuccuugucuccaugugugcuuaguguuuagcucccauuuacaagugaggucaugcaguauucgguuuucuguuccuguguuaguuuacuuaggauaauguccuccauuacuaggauaaugaccuccagcuccauccauguugcuacaaaggaugugaucuuacuuuuuuuauuuuuaauggcugcauaguauuccauggucguguauauguaccacaucuucuuuauccagucuaccauugauggacauuuagguugauuccaggaaugucuuugcuuuugugaauagugcugugaugaccauacaugugcauguaucuuuaugguggaaugauuuauauucuuucggguauauacccaauaaugggauugcuggguugaauagacagauugaaugggaaaggccucucagaaguuuucucuucagaaauugggaaacacaugacauacucauaguacacagucuuugacaugcuguuguuuaucuagauauacucauucugucagcugugcccucaccucuguuaugggcucuuuguauuccuuaucccauuuuuuuuguuuguuuuuugaggcagagucucacuccgucacccaggcuggaguguaauggugcgaucucggcucacugcaaccucugccucccggguucaagugauucuccugccucagccuccugaauagcugggauuacaagugcacgccaccaugccuggcuaauuuuuuuuguauuuuuaguagagacaggauuucaucauauuggccaggcuggucucaaacuccugaccucgagugguccaccugccucggccuccagaagugcugggauuacagcagugagccaccaugccuggcccugaucccauuuuuauugcaguagaaguguagugacaaggaauugguaagguaucaaaauagaacaggaaauaauggaagaggcaagaccuucacaucuaggaagagacugguggaauucuaugaaaguuaaauauuuaauacuuguuuuguccaguuuuuauuaguccagacacuugcaaaaugaaaacgagaagaauaaagacuaccugccucuaccaggcauuauuaauugcccuuuggagauuuugaaugaggauguuagugucuuugaguuucauaaugaaaacuggaacuauggggagaaauugcuugaucucagaacuaacugaagcuccagugcucagagucaaacuaaacuagacgggccuuggacagguggggaguuagcagccaauuuuauucacaucauuugucuuuuauaaaagguguuugcaugucagauugagcaaaaaucauggaaaaugcccaaguuuuaacaucauuguuugaaccuaucagcaaaaucagauggcuugaauauguaauuaacaguuaaauuuguccuccagauuuguuuuagcuucuagcauaccaggcaggaaauuggaauuagaaagaagaacucaggaugugaaacucucauuucugguucaguuuuuuuccaaagaaguuauccagagaagaguuaaauuuccugccaaugaugacaugaaagcuauguuguugcuauugcuuuuguuuugaacuuugcaaaaagaaaaaaaauucaccaaacacuacacuuugauuaguucuagcagguuuuuuuuuccccuuaggggagacuauagacuguaauuucaucacaaaaaacauggugccugagcucuaagcaaaguuugaguuuguuuuucccuugaggauuugacauuuucuguuuccugacauuuuuacuauuguuagacauacuucuuuguauucuugcccuauauucauucccuaagggaaauuguguauuuuaucuacuggaaggcaggaaugccuucuguuuuggacaagccauuuaauuguucaaauaaauucaacuauaguguaauagaccaaucauuaggaacugggccauguggcagcauuuagauucaugagacccagauucucaguucauuccaaaaaaggaauuaaauaccauggacacaaaaugaaugauuuucuuuccucccuucuuucuccccaggguuucccauuucacccuuuaaaaauauuaaaugauauccuaaauacaaaccaaaugcuuuuuguuucaguauuuaugguuugcuuauuugugguuuucuguuuagugguuaauaauuugcuuaccauuaagaaaaauacuagcagauuuuuuuugccacuauucucuauuugcucuauaaaaaugugauguccaaauaaaagggaaaugaagacuuaccacuuuuuggccuucuuuucagcuuuuuggguguaauucuguuuuaacuaauaauuaaauauauggccgggugugguggcucaugccuguaaucgcagcacuuugggaggugguggcgggcagauuaccugaggucaggaguucaagaccagccuggccaacaugguaaaacccugucucuacuaaaaauacaaaaauuagcugggcauggugacuccuacucaggaggcugaagcacgagaaucgcuugaacccaggagcuggagguuguagugagccaagaucccaccauugcaugccagacugggcgacaagagugaaacucagucucaaaaaaguguguguguguguauauauguauguguauauauauguguguauauguguguguguauguauaugugugugugcacauauguguguguguguguauguguauacacacacaaaggggacuucaaaaggucauggauaaaaggaauuaaaagauacaaaauaaaaauauaaacuuuauuucucaacauaagcuccaucaaggucaggacacuuuuauaagugaugguaucagccauuuaguccuucccuaaagaacugaggguacugggaaccuaaccgugucagugccaucuuuuuuacauuacuaacugaagaaaaauggguggccuuuaaagauuuuucaagauuaccuggacauuuuucugcuaaaaguuuggcuaacuuucucaaaacucugucauaauaagcagaugguaucguucuuuggcccucuagaaagcugaugaggagaaugcccugagcaucucaaaaaacuguugcuaugaccugugcucuucaccuguccauuuuugcuuuuacugaaccccuuccaccucuugggaggcauugcuuugugcuuugucuucaggaucacacugguaaagccauguccugucuccugcuacaguucuucagagaagugcuucaggaucuugauuauucuuguuuaaaauuuccauugaaagcucugcucuugucugcagcagaucggagcacaacaguuuugccaugcagaguagaaaguuugcucaacuuuaauuuuccagucaggaguguagguaagcugaaccagaugggaugucuacgauguuggcuauugugugugcuguucauugucggcccucuuuaauuagggcaugaacaagauugaguuuuuccucacaaauggauggggauggucugcugccguaggcaucauccucaagauugucuuuucccuucugaaaacaagucaucuauuuauaaacugcugauuucuuugggacauuaucuccaucaucuuuacauaaagaaucaauaauuuugaugcaggauuuuuuauuccuuaguucagcuaaaauccaaguuauugucucacgaccagaaaaaauuaggcaugcgaacacauuuaaaggugaggagagcggaauuuauuaaaagcaaucugucagcagaaaagaggggguuccugcuaauaggcucccaccucacagauugaauaccaggccaccacacacaagcugaagaccccuggcuccucuccuugucuaagucucgaauuuccgaugucuccacuccauuuucccagugcacaugcaggccccugguccguugugggcaugcucaggcaagaccuugugcagguuccuuucucugccuccugugucuaucaauuucaccacucuuccacccaagcuucacuauauuuuuuuucuauuuuuuaaauuaauuaguauuuuuauuuuagagguagggucucaccuugacaccuaggauggagugcaguguaacaaucauagcuccuuuugauauggacaggaggcagggaaauacuggguagaaaacggcagggucccuggcaaaggcuccacccucaagccugaaccugcagcccaaaguccuguuuucucauccaaaugcugcccuuucuaaaauuacccuagccugcucugccccauccuguacccauaaaaaccccaggcuccacuggcagaggagcagggcagaguggcagagaaggagagaagagaagaagcaaccauaugucggggagaagcagcuugacuucagagggacggcuugauggcgggacuucggggaagaguuuggcuggggauggccgaaccucuggggaagaccaccuuuccacugcauccucuuuccagcucuccaucccucugagagccacuuucgucaguaauaaaaucccuugcaucuaccaucuucaauucauuccugugacuugauucuuccuggaugccaaacgagaccuugggauacagagggcugucacacugagcuguuaaacacuuagccaucgauggacagcaaagcuaagagggcacaguauaacauucccucuggggcaucacagaucaugggcagggaccucccuagacacugcuacauggcugauacagggcucagcccugcuggugcccaaaggcacuugccccagccccugcaccugcugaccugugugcuccccuuccugugagggguugagggcugugggcugaguaaagaagccacccucuuccggagucccacaaaagggccaagggaacuauccuauuucaauugcagcaucucccgaguugcugagaguauaggcauguaccaccacaccuggcuaauuuuuaaaauuuuuuuuggagauggaaucucacuauuuuccccaugcuggccucaaacuccuggacucaaacugucuucccacuucagccucccaaagugcugcugauuacagggugagccuuggcaccccagccuucaccauaauuuugauguucguucuugccucaauuuuaacagaauucauguugcccuguuagaggcucuuuucaaacugauguuuuauccuuuuuagugccucaaacuagauccuguucaggcaugcuauagcaagcuuauuuugauacaaaaauguuugaaacccaugcauaguuuuuucauaugcauuuucugugaacuuuuuaaagaucuggugugugugugugugugugugcguguguguguguguguguguguguguauuuucuagcaacacugucucuuuucuuucauuuugcacucuguauauuuuuuguaaagaauacaucuuuggaucuaaguggccgauaugaauuuguugagacuaacaguuuuucugcagaagugaguuucuucaggucugugcacugcuggucagaagggaccgcucuguaaaaggugacacuuggguuuguggaacgaaugcauguagguuggggaaucaauuaaaaacacuuucauuuucucugugcuguggcaacaagguggauacagguagauacacauggagcagugaugugugcugugauccugagagugcccuuugaaucugcugagcuaaacaguuuuugaauuuuuuuccacucaguacucuaaaauucaccuccugggauuauucuuuggcuaaagaaaaguaugccaacaugugacaaaaucugcacuugaguucuuugcaggcauuucuuuucuuuuuucuuguuuuuuugagacagagucuuugcucucuugcccagacuggagugcagugacaugaucagagcuuacuguagcuucaaacuccugugcucaagugaucuuccugguucggccccaugggaaguugggacuacaggugugugccgccacauccagugaauuuuuuaaaaaaauuucuguauagauggggucuugccauguugccuaggcuggucuugaauuccugggcucaagcaauccuccugccuuggccucccacaauauggaaaacauuuccauuuggcuacuuuagugcauagagaaauguuuauaccugggaauaucuggagaguccuagaaagaucuacccagcaacuaaauugguaguuauuaauuuuuuuaaauuuuauuuuugagacaaauuucacucuguuacccaggcuggacugcaguggugcaaucucggcucacugccaccucugccuccuggguucaagugauucaagugccucagccucuugaguagcaggaauuacaggcgugugccaccauacccggcuauuuuuuuguuuuugacguggagucucacucugucgcuaggcuggaguguaguggcaugaucucagcucacugcaaccuccgacuccuggguucaagcgauucuccugccuuacccucccgaguagcugggauuacagccacgcaccaccaugcccagcuaauuuuuguauuuuuauuagagacgggguuucaccauguuagccaggauggucucgaucuccugaccucaugauccacccgcuuuggccucccaaagugcugggauuacaggcaugagccacugcgcuuggcccaugcccagcuacuuuuuguauuuuuaguagaaacuggguuucaccauguuggccaggcugaucucaaacuccugaccucaaguuaucugcccaccuuggccucccaacauccugggauuacaggcaugagccaccgugccuggccuaaauugguagauauuaaagcuuauacuuucaaaauuaggcaagucuuuuguuuuggugucaguauuucuugucauucuugauuuuuuugugaaagauuggagagcaaaagugguaugaacaguugucaauucuguaccauaguaagcacugugaugcuauuucauuuuguuuuuacaagugaaacaggagaaugaaucacauaucagcaagaagagguuuguuaaggcaagauuggagaugcugcuuccuuguuuugguuguggagucugacguuucuucauuaguucuugguaucucuuguucacuaucugaaauuaacuccaguaauccuuacccagcaggcauaaccuucagagucuagcagaauccagcuagaaaucuuuaagccacaggccaucuugcucccugaaucacuaauguguaauuauaacgugugcgauuauaaaaugggaaucaauguguuuuggggagucuggauugacaagaauaacugaugaaguucaguugucagaucuauauggugaauuaucauaggggauguuuauggaugaaagcucuugaauuauagaacucucuccugauucuagauuccuuuucaguuccauuucccacacaucaaaaggcuuucaaagauaauccuuuccuccacuugucacaacuccugcaccuugcuuuucuacauuuuuggaagaguguuucuauaauagaugagcaagcauauuuugagcaaauauaguaaaauagauaacauucuuaagaauaauaugcaaaauuauuaagcaaacagaaguagaccaguuuuguguuuuauucugauuaaauauuaaaacaagaguuuuguauuggaacacacauuuuauguaguuaugugacaauguggaaaguuuaauuauuuuuaaagaaugaauuuaucaaaaaaaugccugugccuagcuguagauuaaaguaauguucuucuaacaaguaaaauugaagcaauuaaagagacuauccucaaacugagauagucauauugaccauucugaguguuauugaggcaaaacuguguuaagaugaacugagacaguaaucuuagaaucuaagaauugucagaacccuuaaaugugaaccacuuugaugcaaaguaucuguugcuucccauuaaccaaaaagagaguugaugugugagucuuuguauauuagagagacaguggcuaaaaaguaacuggaagaaaauaaaaucagauaaugagagauagaguaaaaaaagaaugaauaauauuuucauuugaagaccuuucucucuucuuuuccuuuggcaaauauuauugagauccuaccaugugcuaaacagugcuuugggcaagggguauaggcccugaauaaaacacacaaggucucugcuuucauggagguuacauuuguuauggagaguugaugagacaagaaauacauaagcuugagucuuuuuuuuuuuuuuuuuuuugagacggagucucgcucuuucaccaggcuggagugcgauggcgugaucuuggcucacugcaaucuccgccuccugguucaagcgauucuccugccucagccucccaaguagcugggacuacaggugcaugccaccacgcccagcuaauuuuuguauuuuuaguagagaugggguuucaccauguuggcaaggauggucucaaucucuugaccucgugauccaccugccucggccucccagagugcugggauuacaggcauguaccagugcucccggccaaguuugagucuuuuuaagccuacucuggcucaagagccugccggaauaaaaaaguaaaaaauaaauuaauaagcagaucugauuaugggaaguauaaugauaaaaaugaagcaguugaggggacagaguaaugaugguaguaggugucaguugcuauuucagauccaauggucagggaaugcuucccugauaaggugagguuugagcaggaacugaaggaagucaaagaaccaugcaaauauagaggcagggguggaggaaguuguugaggacuagcaaggaaaccaguguggauggaggaguguagguaauggggagaguagguggaugaaaucagagagaacuuuuuuccccaucgaggaaaggaagagaaggaggauggaacccagaagacugugcaggaacaugcaggagaaucagagcaagugguauccuggaggccaagagaagaagggaggugaucaauaguaugugucaaaugcugaugauacucccagaaguagugaacaaaguucuugguccuacaaccuagaaagucugucucuaccuuuccccugucuuuugucccuugcuaugagaucuuuaguuucuauaaauaauuugcuuuuauugcauaugcuauucuuaagacuuuucccacaaaugucuauuuugcauacuucauuagauuagcaucugcuuuuaugggaugaauuauuucugaugugcuuauuuuguuuuguguguuuguaugucagaaaaacauuuuuuaguucuuucuaugugucaggcauugugcugagcacuuuaugugcaugaucucauuuaauccuuguuauagccuuaugagcuauaacuccccuuauccccauuuuacugauauggaaaauagugaucagagagguuuagaaaucagugcaaggucacauaauuagucaguggcagaauuauuuuuuuaaacuucagucuuucucauucuaaaauuuucacuccuagcaacaagaaguuccuuccuauaccucgcacugucuucucaccaaauaucucuacucuuagagguuuucuaagaagcugauggaaaggcucagauucuaguaucuccgccuguaucuacccaccuugccucugucuucucuggauucuccuacagagccaaauaccagauucuggcaccccugucugccugucuuuguccuggcuaaguguagcucccaaccagccccaccuuuuccccacacucccauuugcuuugcuccaacaugcuaucuuuguaugaugcuauucacauguuuuccgcuuccgcccuugucuucauaugcauuucaucuguguaauuucuuucucucauuucacagccuaaauggugcauuucuuuggugucucaauccuugaccuaaucuagauuucuuuguugcuauuuagugaaaacucuauuugguuauuuuauuucacauuggaaaaagaaaauguuccauggauuuuugagaauuugugugauuucuggcuguuucuuuauguuucauaaugugcugccucauuuuggagaaaagacaaaaauaggcuaacuuuguuuuacaacuagggaaaaugugcauagaauuguucauauuugcaaaaugaauuaauagaacuacuuaaaauuagauuuuccugcuuuaaacucccguucuuuauccucuguuuccauaacucagcuauguauuuuuguuuguuuauaaucguuuguuuguuguguuuggagcuugguaaaagaaugaaauguuuuuguagagaaauucacucuuccccccaauaauguggcucccccauaagugcaacaagaugucucucaaauagggugagcuuuaguuacaucauaggugguggguuccagcuucauuucccugccaauaucaugguuuuucccuuuuccaaguacaaacuucaucuucagcuugguuccaggaugggcacuagugugcccagcaucauagcucucauagcuauaaaauccacucaagacguucagagccagcaaaggcucaucucuuucucacucuccuuuauaaagcaagugagccuuuacgggaagacccuacgucucauuagccugaauuguagaccuugcuuguaucuauuuauggccaaggacuucgggucggccucccaugaagcauccagcuauccagaagaauacaaucaggguucuuuuuagaggaagcaaucagggaggauaugaaucuagguugacagccaaauuuuuaguuugucgucuucaguauauguggaauauccccucagccagccagauuguccagaucaaguuuggugaauagugcagagauaauucaugucacuggagcagccccccuccucaccuuuauugguguggauuagauucugcugcaaguagcaaagaccuaaacaacggccucuacaagauggaccuuucccuuucuuacuuacaagucagguguaguucagggcugauaugacagccuucuugcauagaauccuuggaggcugggcguggugucucacgccuguaaucccagcacuuugggaggccgaggcggguggaucaccuaagauuaggagauccagaccagccugaaccaacauggagaaaccccgucucuacuaaaaauacaaaauaagccaggcaugguggcacaugccuuuaaucccagcugcucggcaggcugaggcaggagaaucgcuugaacccaggaggcggagauugcggugagcugagaucgcaccauugcacuccagccugggcaagaagagcgaaacucuguuucaaaaaaaaaaaaaaaaaaaaacccaaaaaaaaaaccccgaauccuuggaaaguuaggcuucuucuagaucauucuucggcuauacagugguccaaaaugguggccguugcagcuacugaauggagaaaggaacacaguauuuagguuagugcaaaacuaauugcgguucuugccauuaaaagugaugucaucacaccuguaaucccagcacuuugggaggcugaggugggcagaucaucugaggccaggaguucgagaucagucuggccaacaugaugaaaccccaucucuacuaaaaauacaaaaaauuagccaggcauguuggcggcgggcaccuguaaucaaucccagcuacucuggaggcugaggcaggagaauugcuugaaccugggaggcuuccgccucccaggauccgagauggcgccauuacuccagccugggcaauaagagcaacacucugucucaaauaaagaaaaaaaaaagugaugacaaaaaccucaauuacuuuuugcaccacccuaauggagacaaaaggcuuauaccagcuaucaugucaggaauauucuaagaagcuaccacguaacacuucugcuuaugucucacaggacaaaagccuuaccuaacuacaagggagggccagaaguguagucuuaauucugagaaaaaaucaggggagaauaauuauuggccacagcuaacaguuucugcugcacccucaucuaaucaccugaguuaauuauguuagugaacagaugaucaauuacuuaguauuuggacuuuguuuaucucccuuuguccuuuugaaagcugugccaauaucagcagaaugaugucugauguucuagagacugcagaacuuauuguauguggcuguccugucuggcauagcagccacaagucaccugaagguauugaguucuuaaaauguggcuaaugcaacugaggaaccaaauuuuaaauguaauuuaaauuaaaaacugacacuugauucaguuuuuggaaacuuuuaauugugucuagaacaacuaggguaugugagucuacuuuugcaacuguacauuuuauaaaaucuaaauacagaucagguauuuccgaugaacauuuaacaucugaauuggguuguacucuaaguauaaaaugcaaacugggccggguguggugggucauaccuguaaucccagcacugggaggcugaagcggguggauuaccuggggucaggaguuugugaccagccuggccaacauggugaaaccuugucucuacuaaaaaauacaaaaaauuagcugggcgugguggcaggcaccuguagucccagcuacucuggaggcugaggcaggauaauugcuugaacccacuaggcacagguugcagugagccaagaucgcgccacugcauuccagccugggcgacagagugagacuccaucuccaauaacuaaauuaauuaauuaauuaauuaaaauaaaauaaaaugcaaacuggauuucaaagacuuuaguaugaauaaaauaucucaguuuuaaaaugugacuaccuguuugcaugauauuuuggcuauauuagguuaaaugaaaauauuaaugcaacuaauuucacuuguuucauuuuaccuuuuuaauguggcuacuggaaaauaaagaauuacauaugugacccacguuauaguuccauugguuggcacuguuauaaagccucaucucuuaauagaggacaugacucuguguacaaaugaaaaggcuucuuaguaucuccugauuucagaagaaacaaauuuccaagaugaauacagcugggcauuaucuuuuugucauaauguccuugcugaaugcuacugucuucuucuuucuuuauauuccuguauuucucuacuucuuucacuuuaucauccuuuucucagccuuccccuuaacccugccucugccagaaauaggacuucucuaauggcuguuuaacagaagaugaccauacuguguaaucuucaugugauauacuuugcugaauaugauguaucauugccucuuugaugacaguuaccaaauuagccuuucagacaauaauuuccauagcuagauggaccuuuucuggacauucgucauuucugagaugauaaaugagcagagaccaaaccuuuuauuuuuugaaauuguguggaguauauuguguccagagcauaccuuuuauuuacuauuucauuucuuuugguaucucugguggguaaaguggugugauucuuauucuauaaaguacaaacucauguccaccuugacauuauuacuccaaaauaucacacuacauguuaacuauggagcaaguauuagaaauugaacagaucucugauuuuuuuuuuuuuuuuuuuuuuuugggagacagggucucacuccugucucccaggcuggaguacagugguacagucauggcucacugcauccuaaaccuccuuggcucagguaauccucccaccucagccucccagguagcugggacuacaggugggugcuacugugccuguguaauuuuuuguauuuuuaguagagacaggguuucaccauguugcccaggagauucuugaacuccuggccucaagaaaucuguuggccuuggccucccgaagugcugagauaagucaggcauaagccacucucccgugacuuuugaggucuuugaauguugcuugcauugccuagcacuuuuauuuauuuucaaccaccaaccaucugugaggaucuugggcaagaugcuucaccuuuugguaucuugguuuucucacugguugcuucaguaauauuugcuuuaccucauaauacuuugaggcucagaggagaauauaauugcaaaggcaauuuggacacuuaguagcuacguuauuauaagcuauuauuuacauagaccuauuuucuucuucagugaaauaagagugguguaguuuucuacuuucccaaucaccuaggugcaguguacccucuauuacuugcacuaauggagagaaucgauguugcaaauuuuccagaacgccaaauaauuagaaaaucauucagaaaauaauucagcauuuacauuuacauaugggucucucuuguguuccaagaauucauaauucagaaaagaaaagcaaaauaaauaaauaaauaaauaaagucugacucagaagaaaauaagcuuuacaacuugccaucuuugcccuuuauucccagcggccuuuugugggacagauauguaucuaugucucuaaccggugcagaguucuagcuuacagcauuguuggcuuauuuuuauuuuuauuuuuuaacauuucaaaccuuuagucagacaggaacugacuugugugaagugucuaucuuguuuucucagcuucuauagcaguaucaacuauguauagauuaugcuaagaaaguauguaauuaaauacugucaauguacauuugaaagcaaguuugcagugaaucaccuauccagggaauaauccuggguuguccuguaagaguacuuagaaaugcaacagauguacacugcguugcccagcuuccccuuuguuuauaugcugcuuuuuaaaaaauugaggaauaaguuguuuggcauauucuuuucguagaccucuuugugaucggguuuuuuucaaggguaaaaaucugauugcuuuuuuaauucauugaaaugcuggauuuuguuguuuuauugguguccuuuggcuuggcauacuuacugauaguccuguuauuuuuauuuggagacauagcuuucuguuuauuaguggaaauauauagugaaaaucuuuggaggccuguauguauguauguauguguguguacauguauguguauauauuuauauauauauuuuuggaggaagauacauauuuuucaaaaauuaaggauuaguucauucccuucaauucuaauaggccauaaaucacucugaauuguuaugcaucugucccaccauuauauucacauuuccugguggacaugaucuuuauaaauaaauaaaacauuucaauccagccucucccuccccaucuucauguuccuuucccacugcuacuuucccuacuucuuucauaguuggaaaaagagaaauccccuagaagugggaguggagcagacaggaugggcuagcaguuucugccuuccuucucuuuccuccaucaugacagagaacagcuccccugugcucucaccagccacaguagcagugguugcaccugcuguaucuuaaggugugaauuguggccuuugccauuucaccaggauguugcccaaaaauagagcuacugguggaguuaagucaagccacauggcuuccugaacaucggggcuguguguguguugccagcuuggcacugaaaaugcucuaucccaaauuucuguuuugaagaaggccuccagaacaucucuggggcauggaggcaauccaauccagauccugcaccugcccacccagcuggucaccaauuuuacagguucguauuuuucaguacuuuuguuaacuauauaaccucaguugggugacugcaugccuaaauggcaguguauguguguguauguuuguaaaaauauacaacuccaaauagagagguuguaugugauaucauaaacaaauuuguaucuauagaaggugcauauauguaaaaggguuuuggaauuuugcuaaauugaguccagcaugauacugacacacuggcuuuuaugaaauugguuuuuauuaaaaucugcagguaguucuuguacuggcaauggcuuugauuaagcaguguaguagggucauauccuagaauaacagcauuuccaaaucccugacuguuuuugaaagaauugugauuaaaguucuggcucuuuucccaugauuacuaaugucugcugaggguugaguuucccagguuguuauuggcgauugaguuguguggcagcccguugugcuuucuugucaguaucaguggcauucucuagggggaagugauuucacauugaaaugcgagaacuaaaagcuguaacaaaauuaacacggggucuaggguuucugaugugacuacaaaacuagaaugggaauguuuccuaaagccuaauucaucugugauugaauuucagacuaaacaaagcugccaugaugagaagguagagaaacccuucuaaaagagauuauggaugaacagauugaggaacaugauauggcagggcaaagucuagacaaucauauauuucagcuucagcugggccuuucuucuugacagguguguucugugccuuggcaugagcagcucacuugggaaagcccgugcuguuaggaaugaucucuuugcaugccaaugggaaauggaaaaugaacuccauucuuauauaauauguaggaaaaaauaaguguuguguguguuggguggcaggcauggcucccuagguuuuaagauguauuguggaauuauguuugucugaaaacaauuauuuaaugucuacuacuaccccaguuaaugauaugcucuuuuccacauugaaaaaauaugcaggauuuuagaaaucaagaauauauuagguguuuuuuuguuuuuuaguugcuaccaaauuuaaauuuuacauaauuuuacucuuucaucugcuggucuuuuaccuuggaaauucuagaacuuagguguugauucucuaccucuguagguuaugaagugcuugagguagagcacuguauuuuagacucuuuguuuucucucuaggugccauacucaaaauaguuuuguaaugccugucuggauugauuuagagcugcuucuuugugcucuacaaaaaauaauuuuuaaacucaaaugcaucuucaugcagauaccuaaauacaaucauuucucacucaaagauggggguaucuuuugagaaaugcaucauuaggugauuucaucauuuuaugcacaucauagaguguacuuccacaaacauggaugguauagccuaccauacaccuagguuauaugguauagccugucgcuccugauauaguuuaugauaugccugcugcuuuacaaaccuguacaacauguuacuguacuacaugcacaacguguaggcaauuguaacaaaacggguauuugucuaucuaaacauauguaaacauagaaaagcuacaguaaaaauacaguuuaaaggugaaaaugguccaucuguauggggccuuuacccuuugaauagagcuggcaagacuggaaguucucgagugagugaugagugaaugugaaggccuagggcauuacuauauucuacuguagauguuaugaauaucgugcacuuaggcuacacuuaauuuauagaaaauaauuuauuaauaaacagcuuacuguaacuuuuuuccuuuauaaauuuuuauuuuucaacuuuuuuacucuuguaauaacacagcuuaaaacacaaacacaguguacagcuguacaaaaauauuuucauuauauccuuauucuguaagcuuuuuucuaauuucagaauuuuuuuuuuuuucuuuuuaaacuuuuuuguuaaaaacuaggauauaaacacacacaugagcccaggccuacacagggucaggaucaucaguaucacugucuucuacccccacaucuugucccacuggaagaucuucagggacaauaucaugcauggagcugucagcucuuaugauaacagugccuucuucuggaauaccuccugaaggaccugccugaggcugcauuacaguuaucuuuuuuuauaagugaaaggaguacaaccaaaauaaugauaaaaguguaguauaguaaauacauaaaccauaucauagucauuuauuaucauuaguaaguaauguauaauguuuguaauuguaugugcuauacuuuuauaugacuggugguucaguagguuuguuuuuaccagccucacuacaauauguaaguauugcauugcauugugagauguuagaacagcuaugccaucacuaggugacaggaauuuuucugcuccauuagaauguuacaggaccaucaugguauaugcuguccaucauugucugaaacaucacuguauguauggaacaugacuguaauuaaaaugaucuuuucuuugaguucugaacuugacacacuugguacugcuccuucagcucugguuucaucuuugcuuuaacuuauagcacugauuucuuuuucuuuccuuccuuccuuccuucuuucuuuuuuuuuuuuuuuuuuuuuuuuuuuuuuugaggcagagucucucucuguugcccaggcuggagugcaguggugcaaucuuggcucacugcaacccccaccucccggauuuaaguguuucuccugccucagccuccugaguagcugggauugcaagcaugugccaccacacccagcuaauauuuuuuauuuuucguggagaugagauuucaccaugcuguccaggcuggucaagaacuccugaccucaggugauccacccaccucggccucccaaagugcugggauuacaggcaugagccaccacacccagccucuagcucugauuucaagaugaaacaauggacuucuggccuaaccucuucuugucuuucauagguuguuagguauucauguaggaaugaaagagagcagcgaaauaguaggugugucuguguaugaacauuagagacuaauucaucaauucuucaacaaauguuuucuuaguacacacuauugucagacucugcuuuaggugcuugagauacaagagcaaacaaaacaaaguuccugcaaucuuuuaauuuuuuugaauauuucauugagauaaaauuuauaauauaauauuuuauagaauuguacaauuaucacuacuaucuauuucuaucauuuuuaucaccccuauaggaaaccgcuauucauuaauagucacucugcaucccuuuuucccacagccgcuggcaaccacuaaucuauuuucugucucuauggauuugccuguuuuggacacuaaguauaauggaaccaugaaauguguggccuuuauucugguuuccgccacuuagcauaauguuuuuaaggcuuauccaugguauagcaugagucaguacuuuguuuuuccugaaguaaggaugaccauugaaggagcaagcuggggauugcaggugggucagaguuuguuuuuggacauacuaaguuagagucaugcuuaauggaauucuagugaagauguugagaagcuaguugaaaaccgaagucuggaguucaggagagaggucugggcuggagauaugaguugaggagucauuagcauauagaugguacuuaaagccaccagguuaaaugaaaucugcuagggaguauagguagagcagagggagguucgggaguugagccugggggcacucaaaugcuaaaaggucagaaaaaugagguggaauuagccaggagaccccagaaggacuagcuagugugucaggaggagaaucaagacaguauaagguccuggaagcuaagugagaagguguuucuagaaaggaaugguuaauugugugaagugaugcugcuagauccaauaagaaaauaagaaagauaaggacagggaauuguucauugacuaagaccauuuuaagaagguaguuuccacacuagcauuggcaagagugaaagcgagggccugagagcugugcauauuccugaccauucccaugcuccuaauccccuacaagucuucuggccucaccuuuacagucuguuccaucucaucaugcccuuuaccucauuccuguaagcuaccacagagaguccaggguucacuaguuaucugccauuuucuggccccuuauccccaauauugcucuguacaucucuguuuccuuccagugugcauuacuugaacuucccuguuucaucauugcaaaucccuuauauccugaauaucuucacugaauacuccuuuaaccuacuuccuagagcaguuagaauuaaacacaaucucccucuugagaaacugcuuccuuugcugcuguuuauuauuauuauuauuauuauuuuuuuuuuuuuuugagguggagucucacucucuugcccaggccggagugcaguggugcauucucggcucacugaaaucucugccucccagguucaagcaauucuccuuccucagccuccugaguagcuaggauuauaggugugcaccaucacaccuggcuaauuuuuuguauuuuuaguaggggcuggguuuuaccauguuggccaggcuagucucgaacucccgaccucaggugaucugcccaccuuagccucccaaagugcuaggauuauaggugugagccacugugccuggcccuuugcuacuguuuuaaaugguggcucgucuccagcacauuggugugauaggugucuuccuugucucuuacaaaucgcuuucuuucucuucucccuaaaaauucccauacuuucggauuauuccaucuguuauuauuucuuguacucauuuauagacccuaggauugucccuagcuguagauccuuuuucuagcuguagauccuacaaugcguauuugcuaauaguaauuuauuuuccgaguuuuggcaagcaucauugucacagccuggcuucuaugugguuuacaauagugaggauauguuucuagagcaguuuuucugagacacuaguaaauauggaagaugacaaaugcauuaaucaggcuccugccauacggcccugauuuuuaaaaaaugcaugaauuuuaaaugguuuguauaguugaaaggagaacuuaacacaugugucugacaagcugaucaaaugauaaagugaaggaaaauugagccucaaccuuuugggcagccagugaaaguaaaggcacauugcaguuuuccgaggcagauggaaugugaacaacuaauaaaucagguuuugaaacauugaagaacaacuuauuucaaugcauaugguguuggaucucagacaagauaguauuggaaauaaaaauagauucggcagcaucaaaaggacauuguaccuaagcauuaucugcauaacaauauuuaaaugcauuucccagcaucaagcuccaauauguaguaaauaaauaauuauagggcaacaaaaagagccuucaagaucucuacagaguuguacauaaaagagaucagagugaauuggcacuaucacaagcauucugugaucauucuaauuucuccaucucucucgugcuuuaagaagaucagaagacuguaaaucgauuuauagacuucucauaagaaauacuaaaaguagaagugcggguuauuauaauggagaaauuugcauuagugccugcuauaugcuaugugauauaaaauggaccauugcauaaaacuacauaccccuuaaguauaaaaacagauuucagaaaagcaaagaagcacggcucugaaauuugaauuucaucuucaccaagugaagggguaguggggggagcaagccaaaauugcuaucaguaagucauuuuuaagucauccuuuauugacuuuuucaguuguaaauagaguuagaaaauuuucuuuugaaauuuuguuuugaaauccggcauuuguuaguagaauauacuucaacucaaaguuguucagaauuucauaauagaauuuuccuggggguuuauuguuaagcuagauucugggauauugguuuaauauagaacaauuuaaucugaguuugggacuuauuuuuuguuagguaaaucgaaaacagcaauggaaauacauuuucccuugaaaaaacaggaugaggaguaaagugaauauuuucucuuauauuccuuuaagauauuuagguuaacaguuuguuugauuaccccauuugaguuugugguaauuucuuucugccuucucagaauagaucuauauuuguuaugaucaucaacuacugaacacuauuagagauuuaggcguuauacugaaauaggauuaaaaaaagaaugugguauucaaacuugcugcaacaguguuuaggagugcauuguacuaaagacccuaguggauguggggaaaauuaauaaaugguuguuaucugaaguaaauaugcuguauuucuuuuuuuuuuuuuuuuuuuuuuuggagauggaaucuugcucuguugccaggcaagagugcaguggcaaucuuggcuuacugcagccucuuacucccugguucaagcgauucuccugccccagcuccugaguagcugggauuacaggcacgugccaccacgcccagcuaauuuuucuauuuuuaguagagacaggguuuuaccauguuggccaggauggucucgaucuccugaccucaugaucugccugccucggccucucaaacugcugggauuacaggcaugagccaucacccccaaccuuaaccgguguauuucugguaguuuuauuuacuuauuuuggaagaauuucaaauaaacacaaaauuugggaaaauaguauaaauauaacuuauauguucauuucucacauuuaagugucauauuguuaucaagauuuuaccauauuggguucaucuauuuuauuuuauuucuuuucuuuuuggagguauuuuaaagcaacuuccagucauuuugucauuuuaccccugcuugccugaauucacaucuuuaaaaccuaagagcaccuucuuagauagccacaaauccaucaauugggauaucugaguguggggaacuguaauuauacauuuugccuccauuuaggguuuacugauuuaaaggagguaauaaaaaaggaauaauuuuuguuguguggaauccaguaugacaguacagaacuucuuccuauuauuuuauguguggacuguuuccauacuuaaauugaacuuguagcuguuccaggucuugauucagauguuuaugccaaaugaguuuuuggcuauugugaauauagcauauuccaauuacauguauauugugacugcagugaguuggaaaauaauuuucugauauuacuaauucauaauagcuauguggcaauugcccucuucucucgauugugugauaagcacagggaauacguagaagucagcugagaagaaacauuaaaggaggaauauuuuccaucaacugcaacucucauauugacacauaaguaaacauuuauauguguaaagcauaguuauaacuaaacugggaaaaaucuguauuuaaacaucauugccuuacaugugauuuuauccuggggaugggggagugauaaaauuauaagaaucaugagaauagugauagacacggugggccagguggggucgagcugacucgcuggagccaauggugcacaucucuucccacugaacauucugcuuucagugacaucauguugguagcuuagaauuggccacgauggguguaguuacacaacagaaaucagcaaaugcuacaacaggacucuagccucucucacagagcugguuauuaaacauugaccaagacaucaguaguuauaguccaugaacaacuuuuuacccauaggaugagaggcucaaaugcugcuuuauuguucuguaaucuuagucuucuaaaacacuauucuuauuguuucauaaucaccuguuccuuaaugugugcaauauuccuuuuuguucuugauagacauaacuagauguaauuaaacuuguuauaaauuuaauuuccuuuccaugauccuccaugacugggacagagaauucuuuagggaaguugacaccugcugcagaagccuugguaaugguuccugacuuaauauuuauggauguaaucccaggguauuuugaugaauucccagaaucucacuguuggaauugauucuuaacauucuaaucaaugcuuuaaaucuccuuuaugagaccacaacaaguggacuuucagcuuuucuuaggaaaaacaaacaaaagacugaaguuucagggaagaaacugucucauaagaaagucauuacuuuuucaugcccuucuuaguaaguuuuugcuuuuauaaagucagaucugccuucuugaaaguuccaaccuguuuauuuuaauacugucuucuaggaccacagaauauaauuuuaacuccuuuuucaucauguagcuuuucacaugucacaagauacuaaucauauuccuccccacaccuccauuucucucaccuaaacauuccccauuucuuccacuuuuuuuuauauucuugaauagagcucuaaaucuuaaaccugcuuuccucugaggauucaacucuugugauugccucacagcagggauuagcaaaacacacaaguguuuccauguuacaguaacuagcauuuauaauguccuuuauaaaaauuuuacuaagaacuuaacaccaauauauuuguucuuuuuuacuuuuuuuuuuuuuuuaagacaggaucucacucugucacccagguugccgugcagugacgugauuagggcucacugcagcugugaucuccugggcucaaguaguccucccaccucagccucccaaggagcugggaucacaggcaugcaccacgauuccuggcuguuuucucuauuuuuuuuuuuuuuuuuguagagauggaguuucaccugaacucccgggcucaaaugaucugccugccucagccucccaaaggcugggauuacaggcaugagcccucaugccuggccuuuauuuguucauuuaaugagagaauugugagagagauuauagacugguaauuguuagauuguuacuccccaagaaaauaagccagugaaauaggaaugagaagugugaugggcuuugguguaguggcagagguuuugucacuuuagcgugguugaugauggucucagaagguauagaccuugugugcugcuuggcagggagaauaggagacauuucagauaacuuugcuuuggagcagauaggaaaagcauuuugaagcuagacuuuauaucaggguaaaaauuaaggaaaagauugugucagagguuacucugaguuuuuaaagacaugaucuucugacauuuucauugugucacucgccugcucuaaaucuuuaauagcuuuucauuguacuucggauaaaaaaugucuuuuccuucauaggaccuaccacacccuguugaucuggucugccuaccucccuucuucauuuauucuccuucaucccuagucuucuacacucaacuuuuuucacugccuugaaugugucacugccuucacacaugcucuuccucugcccagaacacaccuuccucuauucuuuacagacuaacuccuacccauucuucaggucucugugugucauuuccaugaaaugaagccugaaagggguuucccuggccuugauguaaauuagccccuaauagauauuuuagagauuauuguuaaauacuacagagauauuagggucucuccugccauucucuucuaaucuuucauaacacagaagacaauuuguaauuacauauuuauuugcacuauugcugaauaucauuuacuacaugaaaauaaucucauuuacaauauggucaacuccaugagggcagggaccaugucacaccuaccauagugccugguaugcagcaagcuguuuaauaacaacuauugaagggugaauguuuggugcuucccuacaguguuuguaaucuuuaguauucauguucuuaagaauauuuaaugacaugggaaaacacuuaggauauauuauuaggaggaaaaagcugacucagacauuuauauauauaugguuucaauuuuuaugugaguugugagcuugugcaaauguuuccuuuuagugggcauuuagugagcauucccugguaaucucucucacaaucauaucuucaugggcagauuucuggaacuuacucuuacuugcugguauauagaaguauacauuuucugcugacuagauuuaauauuuaaaugaucuuauuuauauuggauuuuacucucuuuauaugccaaggaagggcuuacucagaaggagguaguugcguaaagaccugagaagguagggaagugaggucugcaguucuggggaaagaguguugacagcagagggaacaagaugaacacaggucuuacaggucauuuuaaggaguuuggcuuuuacuucaaaugagaugugaagccuuuggagcauucuggagagaagaguaacuggauuaggcauguauuuuaacaguaucacucuggcauguaugacaguccaccuacaggggacaaggauggcugaagagagaccaauuaggaggccaguaaugcaggaggcagauggugguggcuuggaagguaguagcagugaggguggugagagguacugggauucuuuauguuuugaugacaaaauggaaaggauuuacugagggauuggaugagagguagacaaaauacaagagugaagaugacuccaaaguuuuagacaugaacaacuaaaggugguuguucuuaccauuaccaggaccuuguacuguaccuguacaugguugguacuucauaaauacuuuuuggauguguaguuggcccagaacaacauggguuugaacuguguagguccauuuauguguggauuuuaaaaaauaaauauauugaacaaauguuuggagauuaccuguaguuugaaaaaacucaagagacaaaguguguagucuagaaauaucagaaaaauuaaaaaaagauaugucaugaaugcacaaacuauauauugauauuagucuauuuuuaucauuuauuagaaaauauaugacucuauuauaaaauuuaaaauauaucagaacuuuuacacaaaugcagaccauauauggugccauucacaguagaaagaaauguaaagaaacaugaagaugcaguguuaaaucauaacugcauaaaauuaacuacagugcauacuguacuauugcagcaauuucguagucaccuccuguugcugauaccgugagcucaagcguugcgaguguuugcuuaaacugcugugugauacuaaucaucucccugugagcaguccaucucuccaguaaauuucauacggcagugagaagugaucuuuggcaguucucauguauuuuccaucguguuuagugcaauacuguaagcuuugaauaacuccauggaacccauacaaagcaccguuagucacaguggaagugcucccaagaagcaggggaaagucaugacauuacaaaaaaaaaaaagaugcugaauugcuugauagguacuauacauugaggucugcagcugugguuucuugccauaucaagauaaaugaauucaguguaagggccauuguaaaagaaaaggaaauuuguggagcugucacugaagcugcaucaguaggcaugaaaaccuuguucuuuucacgaaauaccuuuuuaucugguauugaaaaggcagcuuuuauguggguguaggacuacuauaagaaaggcauaccuauagacucuaauaugauuccagauauagggaagucauuauaugguaacuuaaggcaaaaggaaggugaaggauguaaagcuggagaauuuaaugcaaauuaaaaggaugcaaagggugguuugauaauuuuagaaagaaguuuggccuaaaaaaugucaaguuaauaggagaagcagcuucugccaaccaagagacagcagaugaguucccaaacaucauuaagaaacccauugaggaaaaaggaugucggccugaacagguuuuuaaugcagaugaaagugcccuacacugggggaaaaaaugccacaaaggauguuuauuaggaggagaagcaaacaccaggauuuaaggcaggaagagauaggcuaacucuacucuuuugugcaaaugcagugagauuuaugauugggacugcccuuaucuguaagucuggaagggaaaagaugaacagcaguugccagucuuuuguuuguacaguaagaagucuugaauaacaagaaccuuuuucuggggugguuccauugaugcuuugucccugaagucaggaaucaguaagggacugccuuuuaauugugcaauacuccuggccacucagaacuccguaaguucaacacugaaggagaaauauucuacuugcccccaaacagaaugucucuaaucagggaaucauaaagaccuuuaaggcucauugcacaugguacucuaugaaaaggaucgucagcauuauguaagagaauccugacagggagaacaucaugaaagucugaaaggauuacaccauugaagaugcauuguuauagaaaaugccaugaaaaccaccaaacccaaagugaauucuuguuggagaaaacuguguucagauauugugcauggcuuuugaggauuuacaagagagccgaucaaacgagucaugaaagaauuguacauauggcaaaaaaaaaaaaaaaaaaaaaaaaaaagauggugguugugaaggguuucaagauagagaucuuggagaaauucaagggcuagcagacaacauaccagaggaauuaacaaaagacaacuugaugguguugaguccuuucaaaacagugccagaugaugaggaagaagaucuagaagaagcacugccagaaaacaaauugacauuagauaaucuggcagaaggguucagauuauccaagacugcauuugacuucuuuuaugacauggacccuucuaugauaucgucacugaaacuaaagcaaacaguuguaaaaggauugguaccauguagaaacauuguuagagaaaugaaaaagcaucuguaaaguugcacugaguaugccugacucuccggccuccccuucuacuuuccccaccuccuccacuucuucugucucuuccacuccugagacagcaagaccaaccccuccucuucucccuccuccuccuccccccucaucuacucaaaaugaagaaaacgagggugauuuauuuuuauaacgauugacuuuuagugaauaguaaaauugucucuuccuuaugauuuccuuaucuguagcuuuauuauaacaauacaguauaacacacauacaaaauauguguuuauuuuucuguuuauguuaucaguaaggcugcuggucaacaguaggcuauuaacaguuaaguuuuuaggaagugaaaaguuacauaaagauuuuugacuggaaugggagaagcaacccuauccugcuuuguucaaggauuagcuauauuugaauuuaaucugucugcagucuuuuuguuuuaauuucugcguucucuauugguggaguggugcuuggcgauugagauaaaaaguguuuaugcugaaguugugcuccauggaccauuaguuuuuaggcuuaaguugcuuugucuaguauuaucagagccuuuucguugguaaccucuaccugucucuguucucuccucagcuaaaucgacaaguacauuuuaauaaaagcuuuaucuguauuucagacuuuugaaaaacaacauuuaaaaagcagaaucaccaaucuuuaaagaaauacaaagaaaaaguguuuuuccaggaagagauuguagcaguaauuuuaugugauguguuuagaaacuguugauaaguagcuucuuuguucugugauugagucacuguuuuugaucagucaaacguaguauguauugaauaccaauauuaggaguucuguauuauguguuaccauugccagucuguuuaccuaucuuauuaauauuggccuauuuuguagaggaacaguguccuguuuucucuaccaaacaaugguaacuuauguuugucccuggauuuuauuaugcauauauaaguugguuuccaaacucaagaacaaucauuuugucuuguuggaaggcuuuuuuauuccuuugguuuaucuuguaauagcuuugcuuguaauuuugugugugcucuuuuuuauacccuuuuuauacaucauaaugugaacuucaugaggucauggauuauggcuguugcuuauguuuauuucaccaugaacccacugcuagucacaaagaugcugauuauagauuacuaaguauggguuauugaaugaaaugaaauaauuguguuucccuauuaaagcaauucugaaggaaauauauuuuugaaaaccauugauuauagugauuugcuuaaaguucagauacuuguuuugagguaaauaauugagaaaauuuuuagacuaaaauugcacagaccugucaugaauuuugcccauuuuuuuccuuugcauuggguaauuuuugugacaaugauggcaggaucuaagaugcuucuuagaaaacaaagagaguaucaaauaaucauaacuagaucauguaaaacugucagcugcaaaugauaccagcuauuuauuccuaaagcuuuacuaauauagcaaagcaaaacauacaguucauucucauuuagaaucugcuagaauuaucaucgauaucaacgauuauaauuggacuaucuacuugaaaaaggugcuacuaugccauuuuaugcaguaucagaaaaauguaaauaaaaccauuggacagaauauauuguaaaggaaauuuuauaaucuaagaaaucaaaauucauagauuggaggcuucucaugagcacaucugguugccuuauuuuauugacaagaaauagaagucccagauagguugauagcuuacuuaacaccguauacuuuaugucaaaguuagacagagaacuuuguuuuccuaauaucugauuuuguuauuuauaaauugcauuguauuauauaucauuauauuucacuauaucaaguuaaccgauaacauuuaaggcaaaagcuguauucugcucuauauuaauuauuuuuggauuauuuauagugauugccuuaguuaggauuacaagaaaauggacuaaaaccauaaaaacaguaauaguauaucugaguagaauccaaagacacuugcacuggaaaaacugaguggugaggugaaguuauuuguagacuguuccauaaagagaggguugcgugaagacuucucuguccagcauaacuaguauuuucauugaucauuucaugaaaaaacuaaaaaugccagauaaaacauuaaaaaauguguuaaauugcuuuuaugaaagauaggauucacauaagcaaaauaacacaaacgaacugcagagagauauuagacaaaguacugcuaaagccaguuuucacccuaaggguauuuaccaaacccaagugaacuagcauggcacaggagaacaggaacaaagcccaggaccugugcaaccuggggagucugacagaagcauccccaucaucuacauaaagcauauggaucaucuaaaaauaucaucucuuucccauaauaccccaccuccuauaagagacuaaaaggaaguuggucaccuugacacaggcugaggggagaaaaaaaucccuaaagaauucuuaacuagauaucuugucaaaauauacauccucuggguagugugaggaaaguuuaaagugagaauugaguucaaaaugaguuccagguugguagugcccuuaaguggacuagcagaacuguugcuaauguuugggauaggaccuacuuucaaaccgggccuuaaagaauugcuguagauaaagaucuaaggaauaugagaguauaaaacaugcaaacauacacacacaugauacacaggauaaaguuaaucaggauucaguagaggugaaaggagaagaaccagaucagcaaagacuuccaauaauguaauuaucagacacaugauacaggcuuauuuuuuaauaugauuuuaauuaauaaacuuucaccuuaaugacuccugccuuuuauaccuuuuucuugcuuuauugcaguguuuauuuuuaauggcugcauaauauucuaguuauauauauauauuuauguguguguacaucuguauuuauguuuauuuaaucuaguuucuguuuugcauuuugagagcuuuuuuuuuuaaaguucaauauaccauucugugaggaacaucuuuguugccaaaucuuaaucucacccaugcuauuauuuuuuaaugagguugggaguaaauuccuagaacugaaauuuugagaucaaauaguauucaaaauguuaauuaacacuuugugcaugugcuuuauaacaaucaagacugagcaaauggaaaaugaaaauuuuggguuuacauguaagugugcuagacaaauguggagcaaauaagauuggaaaaauucacuacuuuuugcuuugguggguggucgacauugaauuuacugaauucagugaaggacggaggucaguacuucaaacauagaacacuuaaccuuuuuucuauugguuggugucauuauuuugauuguagauauguaggagugcuguauguccuuuuguuaucaauauaguacuccaucagagcaaaaauuuaaaguguauucuaccuuggagaucugggaaauagucugagucuggauagacuauaaaaugaugauuauuuuugucaauuauuuauugaacauaguaaauguacaacaaguaauauuauauaucauaauauguaacauucucugugaaaacaggaaaaaugccucuagcaauuguaauuuugaguauugaucucgucauggcucauauuuugcuggcuuggaagacugauuuugauuuuguuagaauauuacaaaaauugcuuccuagaguguuuggaaaguugacuguugccaguuaagccuaaacagcaacuauagguuugcugguaaaguuauuuaaagccaccugugccucaguaauccagaugcuucuaaugagucaugaaauaaugcuguuucuguuuagaugccagcucugauuaucuuuaucaguaagcuaaauggcaccauguuuugcaaccuguauuuugacucugauuuuguauuuacagagcacucgaucucuccggcuucucuuagucauuuugaguuaugcuuguuaugccaauccguucaaaauaauuucuuuccaaauuugggaguacuuagauuuaagcacaccucugugcgugaagacaaugacagcauuuaaacaacacuauuucuucuauaugaacuaguacuaaucauuuccaguggccuaagcucuuuuguggacccuuucacagacaaaacaagauugauaggcucaacauguuuucaguuugagguuuauucacaucagaaaucuacugcccaacuggcaagccgucaucagaggauucucagcuagccaaccauacgcuuuaggucagcaaugagaugggcucaccugauuagagaacuucauggcauucuguuguccuucauaucacucuugcuguuacaggaauuacagagcaaacaguaaagucuucugcaaucugaaacuugagugagaagagaaaccauauugucuguuuuaauugugagggauaaaacagaauagacacuuaguacaaagaaugcagauagcacagauacuuuccuaguuggcccaguuccccagugcuucugcuguagccaucaucuguuaugucugguaaugccuucucaaugauucuuugacauacacaagaccaccccuacaagagccaggugagagagccuagagaagaaaauauuaauacuuucuuucucugcgugcugccuaccuucucugucucccuguuuucuguguguguguguguguguguguguuuguuuuuuuuuguuguuguuaguuuguuuugagacagagucucccucuguuacccaggcuggagugcagcggccuaaucuugguuuacugcaacuuccacuucccaaguucaagcaauucucgugccucagccucccauguagcugggaccacaagcgugcaucaccacaccuggcuaguuuuuuuuuguauuuuuaauagagaccagguuucaccaucuuggccaggcugguuucgaacuccugaccuuaagugauccacccgccucagccucccaaagugcuggaauuacaggugugagccaccgggcccagccauuuucuguuaaccaacuaguuacuuaaaaacaaaaaaccuagcauuaggguccagccucuuugaaaagcaaucuggcaguuucugaagauguuuaacacagaguuaccauaugacuuagcaauuucaguucuagauauacugaggagaauugaaacauacauccacacaaaacuuguaccuggauguuucuagcagcauuauuuaauccaaacaguagagaugcccaaauguucaucugcugauaaauggauaaauuaaaugugguguauacauccauuggaauauuauucuuccauaaaaggaaaugaaguacugauuccugcuacaccacugaugaaccuugaaaacauuaugcuuagugaaaaaagaaugaaauguaauuagaaguaggguuccccagcucacacacaugagaaucucugagcuagauauacucaaauagccacuaaaacauauuuaauagauucaagauaauuaaaucuggagaaucaguuaaagaguggaaagagaagaauuacugcagucuuccaaaguaaccuuaaaauaaagugaguuguaggauaaugucacaaagguaggaaugcuccucagugguugucaauuaaaacucccuugugccuuguugaucaaccauuuaaaaauaugcguggagucacuguguauccuuugguaauuggcucauaucuuacauuuugcucuuccuagaacaugccauuuucagacuccauuauagaaacauugggcacugcugcuaauggauccuccuuugacuuaugcucauggaagagcuccaggugaacacauuuuacugauggcucaggaugagcuauuauuaaccuucaaauuuguugcuucauuuuuguuucuucccuuguuaucuuguccuuccacuccucuuuuaauuuauuguaaggagauaauugagaaagguacuuuuuuucucuuguuuuguuuucuaaaccaagagacuaccucaaaauaaauaguagauuauuguagaauucauuguuauuuaggagcuagaauguacucaguuguugaacuacaaaaaaaaauaugauuuuuauuuguuuaugagaauuauuuuauggucauuagccaaaaaucuaggagagagucuuacuugaagcaaaacuccgauuaguuauuuccauucuagcagucuacugacauggacguuuccaacacacguaagauacugcacauacacgugacaugcuguucuuuuuacuucaaaacauaugagagauguccuucucacaauaauccaucauuagguacuccuaaauuuagauucucugucuugacauuuugccuauaccugugagugacucuagggaggaccaaaaggaucuuuccuuucuccucuggguugagauccuuggaauuucccuuauuuccuucauuucucuggagccuuauggccaccuuuuuaaggcccuaccucuuaauacuguugcauggcaaucaaugugaguuuugaaggggacauucaaaccauagcuuuuuucuguguugugaggaaacugcaagacguuguuugggucuuggaugauuagaaauguggaaaugaucugugguaacaguaacagaagcaagaaaggucuguugacuauuuucuuuugucugucugucugucugucugucuguccauccauccaauaaagauagggucucacucuguugcccaggcuggggagcaguggugcacucaugguucacugcaaccuugcacuccuggacucaagcuaucuuccugccucagccucccaaguaccuggaacuacaguugcaccucaccaugcugggcuaauuuuuuaauuuuguguagagauagggucuuguuacauugcccaggcuggucuguaacuccuggccucaagugauccucccaucucggccucccauagcgcuggaauuaagggcaugagccgucacaccuggccgauuuuuuuucuucuuuuguaggagaaacagaauagguggauuucugucaguguuucugggaugacaggcaaacucuucacaguucuuuucuugaagguugcaaacuuuguuuuuuguuccucccuucauguuuuugacauccagggagcucucaccagcaauuugaaggugaggaugggauaaguaucaucauagccgcuacuagucaggagagacaggaaaacguagaguucuaguucuugcugcuggaacuguauuagagaggagaguauuucuagcuucaguuggaccacuaaauguguuuuccccccaaacguugcauacaugaucauuauauuuauauauauaggacauaaccuauauauuguuucucuuaagcuucaccuacauuuauagugaggcuuuuuguguuuugucuugaauaaccagcugcuuuauuuagaguugauuccauggaaaauauuuugugugucaaacuccaucacaauaucaggguucaguacuccguuuuagacuuuuccugcacuacugugaucuggauccuuuuauucaaccugcgaauuccuuggaaacauaaaaugauacuaagcacauuguaggauauauaguugaaaaaacuguucuuggagaaacagacugaaguuugaauaaugaaccuacucuaugugugaccuugagcaagacacuucaugccccuuaauccccugccaugagccuccauuuuuucaucucuaugguagauaauaauauuauaggaauauuauuaggaugaagugaguauuuuuauguaaaggauucagcaaagugccaguuucuuaguagauguuugguaaaucagaaucagccccuuucccuucuuuuccuuuuuuucuacauauccaggauaauaacuuggcaccugucuuaaccuaaaguauaacgcgagagcuacacaagaauaaaauauaauugagcacaauauugacaagacguuuacuugucuuaugaugagaauaaugaauuuauuucuauuugggagauuaucuuuuauaaauaauacuguaaucaauauacuuuuucagcccuuucuugaaacauggauuucucacugagcaaacuuuauguaaaaacauaauuacuauuugcuccuaguugguuuguagguagaauucacuuggucuaaaaagacauucuuucucguuuuuuguuugugcauauguucauucaacaaauauguacugugugcuuauuccccgggagaaacuaucuuaggcacaaagaauacaauuaugaacaaaauaguauuguuguuauuaauaauaaugacacacuaccuaagaguugagugcaauagguaauucuuuccuugaaggggcuuguugccuggauuuucuuccuguguccagcagcagcucacccuuggguaauacaguaccaucacuaauucugauuuacuugacuuugcugucauaguaaaucauuugagggcaaggauaaguauuuuaccuuuguuuucuucuugauauagcaacaaacccaaggucacauacuuguaacaagguuaccuuugugacaaguuuagugguggugguaggagcagcaacagcauuaagccauaaugaucgcaugugcuuuaagaauaagcacuuacuaaggaauguaaucuaaaagaaccccucuggcagggugacagcugugaauucagggaacucuugaaccauucagcuggcucuuagagccaauuaaagaccccauuuauugaugcagucaggaguuccauauuuauuauacuguauacuauuucauaauccuuagaaaguaguuaugaagcaaaauauuugcuauaaaagaauucaccuucacugugguucuuuucuacguggaaaggccaauuuaaaaaucaggacacauuaaaaaugucagauggggcaugccacuuccuauggcucaaaaagucaugaucauuuuaugcuauuuucauuggagcacuuaguacaagaugguuauaauuucaacaucuauacauuuaauauugauuauuuuuaauugaaaaauaaagaguagggcuggguacucccuacuacuuugggaggccaaggugggaggauugcuugauuuaggaguucaagaccauccugggcaacauauugagacccuguuucuacaaaaaauaaaagaugaaccagguaugguggugugcaccucuagucuuagcugcucaggagcuugaggugggaggaucccuugagccuggaagguugaggcugcagugagcugugaucacaccacugcacuccagccuaggcaacagagcaagacugcaucucucucucucuuuuuuuuucuuuucuuuuugaggcagagucucgcucugucggccagguuggaaugcaguggcaugaucucggcucacugcaaccucugccucccgggcucaagcaauucuccugccucagccucccgaguagcugggauuacaggcauguaccaacaagccuggcuaauuuuuguauuuuuaguacagacaggguuucaccauguuguucaggcuggucuugaacuccugaccucagguaaucugcccaccucagccucccaaagugcugggauuacaggugugagccaccgcgcccagccugaccucaucucuuauaaaaaaaaaaagaguagggggaaugauggcuaacacuaucuaauguuuuuauaaauuaaaaaaaaguaaaaauuaagacuagagaaaguucuuucuguccugcuaaguguucccagcaaauuucuaaaucuuucacuuacaguaauauuuccacaaaaauaaggcaagcauguuuuacacauuuguuguaaaguuggucucauuaaugauauugacuaguauuguguugccuaaaguaacaagaacaacauuuuuugaauuuggacuuucuuucucccuaguuugugaaaucaguuagaucguucuguguuuggcaauucuaauggaaaaggagaagagcauacuaggcacagaacacuguacugaaugcccuuaucuacguuacuucccuuaaacaucaccacaagucuuugaaaaaguuuauugcaauccuuauuuuauaaaugggaaugcugacgcucagagaauuuaaauaauuuuaucacacuuaugcuaauaaugaauaguggucugauguuugacacaagaucauuuugauucuucccucuguuccauagucauuucagugagaauccuguuucuauuucuuucugaggcuuugguuucuguuuguguuuuauuaauaugacaauauuuauuacaaaccacauuaaacucuaguuggguagaaucaaggaauaaauaaauguggaaucuuauuacuuaaaaguaaaugaauucuaaaagaagggaccagccuaugaacacuaagauguugucauuccagcaguuaucagguggccuuggugccuguugccagcugccugggacagcgugucaaaucaucguccuuguaauacuauugucaguuucccuugcauuccagccauccaucaucauucgacauuuucucuggugccuaucaccuggccucucacagcugcaauuagacuauaaauauaaugaagggaaggagugcucugaccuguccagugcucuaaccaggauugaacaacauguuccuuaagaaggcuccuggccagcgacgguggcucacagcuguaaucccagcacuuuguggggcugaggcagguggaucacuugaggucaggaguuugagacuagccuggccaacguggugaaacccugucucuacuaaaaauacaaaaauuagcuaagcauguuggugcgugccuguaaucccagcuacucaggaggcugagacaggagaaucgcuugaaccugggaggcggagguugcagugaacugagaucucaccaguguacaccagccuagggaacagagcaagacuccaucuccaaaaaaaaaagguuccugacaguaggucccagguuauuugaucaugagaaggcucaugaggaaaagugaguuuuguuucucacccagaauacugaaaugcugaaguagauuuccgggggucaggacucagaccuuaugauuuuuggccgugaccuuuacuuuuguuucugacagcuugauuuucaagaauauuuucauuggguuggcucuauuuauugguaauguaguaagaaacauuugacuucucaucuucaagaggaaaucgugacaaaugcaguauagauggcacuugguaaugaaacuggaagaguauaugagguuccuguagguggaauucuguuuagguguugggguagggaggagagucucuuuuuucauauuucugcccgaacuuuacuuuuuauuuagcuuaacugcacuaugugaaucaguagucauccuucuguagcuagcagggguuuagaacuaaugaaaguauuauuuaguaucuaaucucauacccugucaaugugcauauauuuucacagccaaaucuuccucucacugacauuucuagugacucugacguuuuauuuuugguauuguagcuuaucuuuuguuguuuuuguucucuguaauauggucaucaacaaacguuuauuaagcacaccuacucccuauacagcuuugaggauacagggagauuugcuuaccuguauuaguuuuugacaguugcuuacauugauucggguuuugacaguuuacauuuauuaggcuuucacacauacugucucaucuaauugcuauaacauuuuagcaaguuaggucuuuuuuccuuucauucagcaaauguauucuuguauaaucacuuuccaggaaguuacauuccuggugggaaaaagugacauaaggaagaaaacacauaguaacagaagugacuuguguuaagguucauaauggguuauuuuauacauagucacuguuaaugaaauuguggacuuugagacaggggcauuugacaguuuggggauagaugugggaccuaaagaaaugguacgaggggagagggaccuccagaugguagcgcaguguggcugaggcauagaggugcgcaugcauagagcgcaacuauacaugaagguuuucauuugacuggagccagguuagucaggucugaauuuaauuaaugaguaccuaauaucguagcacuuaagaauauuuagaaaccauuggaaaucaucuagucuaucucguaaagguuaucaaaagacauguucauauugagucgauuauuacauuauuuuuauguagacuuauuuaucuguuccugaaguguggaauauauccuaguuucuucuauacacaucucuuucaugaaucaauucugacuagauuuuauaaucuuaaaaggaaauauguuguuaaagaaguuauauuuauuuaucauuuuuguaaccguaccauaugaccuuucaaggaggauuuuauuaaaaguguaguguuugugucagucuucaugcuuuccuuaacucagcaaaacuuagcagcaccuucauaucucugaugcaaauauuguacaagauggauuuuuuuuaaaugagaaaaaacaguccaugauuuuuaauuaaggguugaguaugccauuguauuuuuuguuauucuuaagaaaacguaugcucugauuaguugguagaaacaacugauccaaaugucuagacucugaugccucugggaaguccugaugauccaggguauggauuucugaagcuucacauguuuuuaucagucgauuuccaagaugcccagagaccauuaagauagauaauaaaucaagggagauuuagcuguguuugguaacauacaaagaacuauacucagaaagaaaauguuuaauuuagaagaaggaaaccaaauguugcgaguguagauugcuaggguuuugaggaagcccacuaaauaguagccaucuuuccugcugggguuuugaaacuauugagaaauaauuaagguagauaguuagugaaaugucacuuuuauauugauuuaugcuagauugaaggauauaacccaguuugagaaucaaacaaagcuugcuaacugaacaucacaauuaaacagauuuacucacccauuuagaaaagauguuggcccacuucaagccuucucugacaaagcggggccuuuauagcuaaacuuacaccagacaccacugaacuaucuucaggcauucuaguuucuaaaguggaauaugggaguugcuaagccaugcaugcccagccuuuucuuuucaauuuuuaucagucaggcguuauaucacuuccccuggaguggguaaaagguggagagaggucagagauuacauuaguugaacuucauuauaguggcaagaaacauaaguggggguagaguguuuuucccaacauccaaagugauacaucuuuucacauucuaaacucucugaaauuaggauguaucugaaaucaguggcugccuacuggaaaccagucauggugaauugucacccacacagugugugugagcuuggguuacuccuugcaccaugacccuucauuguuuccguuaaugaagcaauuaaggaccauuugaggaaagaguaugaguccuggucggaauaggaaagccuucuguuuaaaccuucugauagcaucaagaaagcaucaacuuuaaacuuugcaggauggauaucagcagcguggaauaaaauauaggaugcagcauggagcacugcuuuaugaaacacacgcuguuggugacacuggaugacaauguuuagaaaacaaggacauugaaaacucuuuagucagagugauucggaagagcuagacuucaaauauuauuuaguguuaagaauaccuuaacaaacuuauuuuucuuauauuuccuuauugaaugugccugagagguuuaugguaaccauuuguuuauguaaaaagccaaaggagcuauucaauaaggaaaaggaaacauuccaagaaagcauuauauaguuuaaauagcaggacuuuuuuuuuucuuagugauacauaaaauaauagugugucuuauaaucauuggggucuuagauaugauaaagugugaucaguuaggcuuauaugaaucucugcuccaaucuuuacacaugcagcaacuuugaauggcaggcacuucauccuuucucugaaagcuuuaugugccauacuauccaagauggacacuggucauuagagaccaaaauuuucaccuuaacugaauuguagccuugcacuguuccuuuaaaugucgcauuuauucuuacugugaguccauguucuuacucagaguaaaagugcuguuuuuuguuuuguuuuguuuguuuguuuguuuguuuguuuugagacggagucucgcucugucacccaggcuuuagugcaguggcgcaaucuugguucacugcagccugcaccucccagguucaagcaauucuccugccucaaccucccaaguagcugggacuacaggcacaugcgaccaugccuggcuaauuuuuuuuuuuuuuuaauagagaugggguuucaccauauugaccaggcuggucucgaacugcuggccucaagugauccacccuccucagccucccaaaguggugggaccacagcugugagccaccgugcccggcuagagugaaaauucuaaucuguuguuuauucaagugaggaagaccagaugaagucauucaaaauaauuucguacauaccgaagguuacuguuugcaaagaugguccuaauuaugacaguauaggacucaucuagauaugcuugguuuguuuauuuauaaaaguuucaaugagcuaagucuguuuuuuuucuuucuucugaaaggggguccugaugacaacuuaauugaagguggaggaacaaaauuugucugcaaaccuggagccagaaacauuaccgucauauuccacccauuacuaagguaagucaagugcuaugauauacuuacugaagaucaauauuuucauuauuuaugcuggucuacugaaugccaguuguugagucagcacugaaacaagucauaaaagaaauuuauuccauuuuuagggccucacuauuaaaguuagucaguuuagcagauaaucucaaucccacugaguagcuacuuauuuucaggaguaaauacuuuuauuugauuuucuuuuuuucacacucgcuaccucugucccucuccugcccucuucccuucccucccucccucucucuguuuuaucuaucucaggaguuggaaacugcuuacuggagaaaucuacucugcacacguauuuuuaaauacauuuuuauugacacacagacaugcuuauuuguuuauguauugcccauagcugcuuuugugcuacaagugcagacuuuuaauugcaacaggacucauauggcccacaaagccugaaauacuuauuuucuggcccuuuacaggaaaaaauugcaaacccauaaucugucccucucauuuacaccaaugucugagauauccuuugagaauuggcaggucucugaaauaugauuuauaaaaaaugaaagacauauacaucaaacauauguuuuuauauauugaaugauaacaugauaugacuagagugaaaucuauucuaaugcucaguucauugugauaacaugauuauaggaaaguaagaauccauggugccuccauuaaagaaaaaauauaaauccuaaauacuuuuaaaaagguacuuuaugagaguggaaaaaaggggcaauuguugaguagauaaaacguuucaguuuaugauaaaaaaguucuagagaucuguuacauaaccaugugcgcauaguuaacacuacuguaugguacauuuaaaaaagguugaugguaaauguaauguuauguauuuuuuuaccacaauuuuuaaaaugcaccuuuugggauccagauaucuaauauaucaauuguguguuuucucuguaaagaaccagaguauauauuuguggcauuuucgcauaauagagcagaaacuccuggauuuacuaaauguuagguacuucagaauaucaccuuaccuuucucacaucacuucuauaauauuugaggcauuuagaauaacaguuaaacaaaugcuguugaauugaccagauauaauauuauguauauuuucuccaagcauaaacaguuuauuacuacaauuauccuaccuucucauuaaccgagacuuacuaaauugauaccauuagaacuaauuacauucuaaucucuuauauagcuaaccaguguucuaaaucguaguggauuaguuuccucaauugauuuuaaauacaaaaacauaaauauguaaauuaaauaacaaaaacuugacuuucacacaauaaaaaguuuuuaaagaaauuuuauugccuuuaagaagucuguuguagcagagauuuguagcagguaaauucauuuaggaaccaugggauuaagaaaauuaagacuauuaagagguuaagagaauuaaaacuauuucucuguagguuuaguugauaaguacuauauguauauaauaaguaaauuauaacauacagaauuauagauuaaauaacauugauuauuuuuauuugacuuugguaauuaguuuaguuuucacugucuucuucaauuacaauugauuucuacuuagguaauguugcuaauuguuagaaauuggaaaauaccuuaaucaugauaggcaucuucuaaccuagauuuaaugccauaauuugcugcuaaguuggaacucuugugcuuacauuuauucccaaguagaaaagaaacccuuuagaaacuauuaaccguguugucaguaaccacuuuucaagagauuuuuccucuaaguuuuuucuuuuuaaaugugaaguuagaaugaaauauauauacacacacauauauguaaauauauauguuaguacuuauuuuacacuuaauaaaaugcauuuuuuuguagaagacucugguggaacuuaauguauuacaguucuugacagcuacuuguuaagucuuuauaaaugcugcuuugcuagauaguuguuucaaggcuugguaauacucccagugguuuuacucacuuacuugguuucuaccuucauucagaauuuuaacuuacuagugauuaaaaccggaaaaaguuuguucccugauguaguuuaucauucauucuuucucuguguaucucuuaauggaaauccccaaaauauuauguggucugaaagguaaguucauucuuugauaaacggaugacuaugauggaguuuaaauuagcccuuggcccaaauugcaaccuugucaaaaacuccugauuggcuuguggaacuugaaaugacuaagaucuuuuaguggauuuuuacuuuuuuuauuugaguuuucacacuucagcauuuccugaguguuggauuuauuauuucuucuaaaguucagaaguuuaguuuuuguaaugaaacgaaccaguguucauuaucacgcuuguguauuuuauuaguacuauuauaauucaaaauuuuucuuuuauauucaacaaauauuuauugaauacuuaugaugcauauuuuccuaucuccaaguuagauguggucucuuguucagauguaguuacucuuauuuuuaugagacuauguaaauaaaauuguguagauauguuuucuauucuuuagaauggucauugcuuuuauucuaugcuaguuuaagugaguaugaguuagcauucuguuauuugaaagauaguguagccuaaugggagaggcagugcagaagaaugaaagcuggaaaaauguacaggauugcaaauuucaaaugaaaaacaugacaaauaaucuugguucaggacuaggcuccuucacuuuaguuuuacucaaugcuuguuacuagacucugauuaugccauguccuggggaaagaaaaaaauaagaccauauccuuaccugcaagcuccucucuugguagcugcauggguugcaaaaaugaagaagccugaaaacaccacauauuggcgaggacauggaucagugggauguccuauaccuugugggaggauauaaauugguucagccucucucaaaacugguuugacaugauugagaaaucacauuuccuguuacucagcaguucccucuccuaaugcucuugaauguguuucuacuuguuaucaacugacucauauuauuuuucugucccaauuugccaaacucuuuuucuaauugauuacaauaauuauucuauauuuauaacuuagcucauauuaaaaaauaaguuuggcugggcacgguggcucacaucuguaaucccaacaccuugggaagccgagguggguggaucaccugaggucaggaguuugagaccagccuggccgacauggugaaacccugucucuacuaaaaauacaaaaauuaaccaggcaugguggcaugugccuguaaucccagcuauuugggaggcugaggcaggagaaucacuugaacccggaggcggagguugcagugagcugagaucgcgccacugcacucaagccugggcaacaagagcgaaacuccaucucaaaaauaaaauaaguucuagaggaacuuaucacaaguugacuuuuaucaaaagucaggaccuauuuaaacauuguaucauuuuuuuuucuuacguggucucuuggcaaacucagauuuguuuucaguggagggagaaucccuuucaagugcguagguccuucacuuuccuuugcuacuuuuucccuaugucuggugucacugguacucugucuuccugaaacuuugcaugacuguucuaugcacuucauuuauuaaaaucauucaguucauaauuuucauucagcuagcagugcguucuuugcagccuagcggguuucuauauugacaauuccaaccacccuucuaagaauaccacagagcaguuucccguuaugcugguuuauauauucucagcagucguuuuuacucuccuuucauaaaauuauuauaccggguccucaauucugguaaucuugcuaacuuauuuuuauacuguucucauagcuacugcaguuccaucacuaggaaaucucacaggauguuagcgucaaauauacugacuucuaauuuguucauuccccauuaacuccgcuuaucccuuuacuuguuuauuuaaugcuuuccuuauuguuuuuucuuuacagucaggcaugucucuuagagaguaaauuucuggaaagaaaugggcuuuaguauuaucuuccuugcuuuacucuuagccuaccaagacauugucuguaauuaaaccuuuaaugaauguuuuuaaugauaguuuuuuuuuuguuuguuuuuguuuuuuguuuuuuaaauagacggagucucacucugucgcccaggcuggagugcaauggugcaaucucggcucacugcaaacucugccuccuggguuuaagcaauucucgugccucagccucccagauagcugggguuacaggcaugcgccaccaugcccggcuaauauguuuuaguagagacagggauucgccauguuggccaggcuggucuagaacuccuaacaggugauccgcccgccucggccucccaaaaugcugagauuacaggugugagccacuaugcucagccaauaaugggucaucuaaucaguguuucugccugugggucuaaaugaacaaaaccguauuaaaacaaagguuucuagccaugcccggauagauucugaaauacuuucccuaaaauacagacucugaaaaugauauaacugaugccuuuuuuucuuccauugacauguuuccugucuuucagcucucucuagaagacuuuuaagacgaaugaauucauucuuauaaauggaauuuauguuaugggccuugauuuuggggaacagaaggaagauauguuaauguuggaauuugagugacauuauuucucuucuuuuguguaguucugacauggauuuagguuucuuuccaaaaauaauuauuuuugaauaauuacaucaugguaguuauuaaccaugaucugcauauaaaggaaccuuuggcaaugaaguacauuuuauugcaguaucaaccacaauuuaaaucagagugacacuuuuuguuacaauuaauauauaauguagucuuuucaggaaauuugaaaguacuuuguagcuguuauuugugggauuuguggggagaaggagugagaauuuauuuuucucuuuguguuuucauucauuucuuauucuuuauucucuccaagucuaaaaacagauaauuuauugugccuuagauuuguuaguacaguucuuucauguagcaaacacaggugagaacacaaguuauuucuuagaaaaucuaaaugcuugcaccuaaccagaaguaucauucagaaaauacucuaaugccuuuuuuucuuccuggaccaauaagguauauugguaggagcauugcuaaauugaaacaaagucaugccuuugacaggugcacuuagcaccucauaaccacagagucccaguuaaacagguggaauugucaaagaaggauggcagcacuuaaugcagcccaucacugcuuuagaaacaggguuuagcuaggacaugacucaggaacaaguacacccuggcccaaggaaaccuuccgaguccucacauggccucuucccugugcacugggacagagcucccuggagucccuuccucuuacaagaauaucagcucuaugggaucagggcccugccauugugaccucauuugaccuuaauuaccuccuuuagagaauauauauuaaaauucacugucagaacagacuauuaauuaaagugguauuuaaucguccuuuuagcauuggagcccuauuucaacuggaaaggaguuuugugcauuguaugagagagagagaaacuagaccacuaaaagugaaguguuggggcuggguagaaaugaacacauucuaaguuuugaugucugccaaaucacugugagccuuuguuucccuuaucuguaaaggaaggaaaaacauucauuaaguguuugaugacagugucuugguagguaaagaguaaagcaagcaagauaauacuauaccucauuucuuucagaaauuuacucuuuaagagacaacgcuuaaccagaaagagaaaacagcaaggaaaagcauuaaauaaaugaguugguugguuuggauguugcuuucuaccuguuaaguuuugugauucugugacugggcagugcuuuuauaauauuuagggaaucugaaggccuggcauuuugaaauuuaaaaguuuaugcaaaaagugaguuuuauaguauguuggagaauugcugcuuauuugcuucaacuggcuuuuaaaaggcauuuggcucuuuaggguaaugaacacuuggcaugcaugaaguaauauguuucuuacaggagaaccaaagaacaguuguuugcagucuuguagugacauggcagaggcaggaggcuggggacauggggaugaugaugccauucaaauugcaaaguguuacugaugcugguucuguugaacacugcuggaauauugaauaucugggcuaugagcauuuuucacuaguaauuauucacaccucauuaagaucagacaucaguuaaugucuuucuagguagagcaaaaagugaaauauuuauuggucagugaguaaaguccuggcaucuaggucaguuaagaagaugaaccucucuuggcaacuugggcuuuuggugauagacaguaugguuggcuguguaacauucuuaagacuaguaacagucagaacaaguaguuguagucauaucaucuaauguauagagaauaauuucuaaaaauuacucuuagauguauauguuacauguagaaaucgccauauugcagcaguacaggguacuguuucauggccuguuugugaaauagcuuugaaaugccuaugauuaagagaugcuuaaaguuaggaggacaggaaguaacuaaauccaaaccuggaggagugaaaggcuccaaaggugauuaugcuauuaacuaguaauuucuguuuccaaaagugacauuucaaaguaaaagacaauugugauuaacauuuuuauuuuauacuuuuuguuuuaauaauuauaguacuuauaauaucacauauugccaauauuuccagaucaaaggcauauauaauuugcuguuauaauuaagcacauuuucccuaauauuuuuaucuuugaaaaaugcagugacauuguucuacccaugucaguuugauguguacauugauacuuauuuagcagaauauuauucucaguguucacagguaugugauauuuuuauacagaugcauguuuguucuuaaugagcuaaagccuauguagacauuuugaaagauguuagugauuagacagccuagcaaauaauguuguagaucacauauuauucaugcaugggaggaaauauagacaccuuguugcauuuuuaugaaacacagccauuuuucccccuaugcucagaauuaugaaaaaauauugcuaguuuucagucugccugaccuguaaggucugugaagugcugagugguugguauacauagauuucaaacccuguauuugaguaacuucuuuugaauuaauauuauaaauguuaaaugcuauaaaccuucaaaccaccuaacuuuuggagauuaaaaaauuucauucuaaacuuuuuuuacuuuuauauuuucaaaauguaugacauauggcuaaacaccgauugcaacuaacugggcgguuuuauacuacugaauaaaauggagagccagucaagauaucaacccauguaucuaugcacauuucagcaguuucuaaagaggugaggcaucccaaucuaguuagcacaaaagaauaggcgguuucucaugagaaacaguagggaaaacgggaaauguuagugaaaaacagaggagaaacagaagauuuuuuaucuauuuacauauauaaagagaucacuuuauauagaaaucacuuaaagagauaguuauuuuguuauuuguugcuucauaaguauggauuauaacuaguugguuguauguuuagagagauucuacucuacacaaugagaauuuucaaaugaauaaggcagcagaaauaggaaagcuuuucuugggagauaauauuuuucauggaaaugcuuaaccagaaguugaaguuaugaugcaguuaacugguuguugaauuuccaggucuacauucuuuaaaucucugauuguaagccuuccuaauauacugugcagcuucagagcucgggguagauauguuucuuccaaucuugcucauuugaguuacuuuuuuauacuucagcuuaaugcugaugauuaucauuggcagagucaaggaguauaguugacuucugugucgcuucagcauugacuuucuucuuuggaacacaaagagacucauggagggguuguuagacgaaugccaccccucccuaccauauaguugcuucuguccucuuucuuuuuuucuucucugcuuuuguuuuuguauuuuucuuuuuccuuuucauguccaguaacugguacguacgaguauaacuuaacucuuccagugacuguuaaaggaaaaagaaaacuagcuuucuucuguuguaaaagcuaaugugggaccaacgcuguauuuccaaauaaaccuaaaaucagcaugacuuugcugcugugauuuugaccuagauuuaagcugauauuuuagaugcagguuuucgucucuuuaucaauuauuuuuuuuuauuaucgauuaaccuuauuagcagcuuauauauaaaagacaguagaaaagacuauucagaacaaaaugcuugcauaauuuguaugcugcuuuuuauguauucugaacauguguucgucuuuuggacugcaguacccaaaaugugcuuauucagcauuugacgaaauauguuuauguccagccacagggccauuuacaucugauuuugaaaucugaauugauaauguaauuugguguuaaaaauaacauaggcauaccuagggggaaaauacagucucucccuuuaauaacguauauuccuuugaguguuggcuaugcauuguuuccuuguaugauuuggaaaauuauuuuaucauuccccuugcuccucagaaaacagaaagacacacacacccccucuuuccgauuuguucuguuucuguuuugcauucuuuguuacugggucugcuauauaauaccaaagacucuucuuuggucauaagugucauuugaacauuugaucauuaauauugccuacuguguuuuuaaaaaaugugucauacugccugugaaguauuuuucauuucauggucaugaaaucuuuuuuauuuuccuuuuguaguuaaacaaaaauaggccccaaaauaagcaaugcuauuuucucaggacuuuauuauuuauuaaccgagaaaggaaacuucuuugauucagcaagauaagugagaagagccagcuagaaaggagaagaagguggaagcaucauaaaggaaguuuuaguuuuuaauuaccuuaauuucauuuuuugguaagaguagugguuaugaaccugggaagugcugggucugacuuucuuguugcacuugaaauaauugcuggaauguuugauguuuuuauguuguuuuuauuaguugugaaagaauaguaauuuugacaauugcuauuuuuaaacucgaugagcauucuucaaaguccauuucuguaaaauaccacauuguaaauacaugagaaaguauucaauaaugucaagaagaaaaaaaaacuaacacuaacaaguuucuaggguaucacucuuuagugaaggaauauggaaguauguuacuuaauuggacucuguaaauucagaaucucuaaauuuuaaaaaucuuuuaaaauuuuuauugagcuauacauacauacauucaaauguauaaaucuguacacauauuuuuaaauauuuguauauuuauaugaauuuuuacauguguauacauaaguguaaccaugacccaaaucaagauauuagacaucgacauagaucauuuucaguacccuagaagacuugcuuauauugacagucaaucccuuucccugagagauaaccauuauugugaauucuaucccuacagauagauugguuuugccuaugguuuaacuucauauaaauggaaucauauaguauguccucuuuggugccugacauuugugugacaugaugucuauguuggucauccauagacuaacaaugauuucuuuauguuagucauugugucaguauacuacugaaaugagcaauuauaaaauauaauauuuaaucauuaauuuggaauaaaagaacuuucagaauccugugauccuaaaaacuguucacaauuuaaacuucuucuaaacagcuuuccaagaaaucuuuugauuucuuaucuuguggggccaaggagguucucagggcaguaagagaucuugcgguggagcaguguccagcagagcagugagccagcauagcuggaagccacauucucuucaugaugaauguagacuguuuccuacagcuuugguaguaaaagcuagcggagcaaaaauuaguugacauguuuccuagacuuuggguuuucugaucagucagugaaaagauaauuggcaauuaacaugaguugcuacuuuuauuaaagaaaagggauuuuucuuagaauuaagauccauccuuuuuaaggaaagauaauuggcaacuuaaaaucgacauucucucucucucucuuuuuuuuuuuaagagagaggaucuugcuguguugcccaggcuggagugcaguggcuguucagaggugcaguaauagcacacugcagaaugccugggcucaagcgauccucccaccuuagccuccauaccuggcguaagucaauguucuuaagccaacauuaauauguaggcuaguuuuuggagacaguaaauucagucaaggagggaggagagaagcuugacaugagggauuagccaagaaccagaugcagaauuaucacaggaagccaugagcagguauggacccaauugagagacccuaacauaguuguagugaguugggaauuuacuuuuauugauuguaaaucacauccuucuggucccuaacaggcagucacuaaaaauguuuugaguaaaugagcaaaugaauugaagguaaaagugaugggggcaguuuuaaauguauaaggcaaauuggauggauauugaauauucuuucaguaugucuacaguaccuuucauuguaauucuugaauauuaaaagauacuuuuuaaaucucuacacuguccugagcacacauauauauauagauacacacacauacauauacguacauacaaacacacacacucauugccuucacuuuagcuaguugauuauuagaauauauucuguacagucacauuuguuccagccacuuuguuuuugaaguuuuaguacaucugcagccucuccugguggcugccaguaucgcugucaccugcaaugcuuugccaaccaccugaagcucucuuacucuguccagugugcugaaggugcuggcauccaucaauaucuuuuuugcauauucuauuuaguuuugcuuuuugcaucugugaaaaauaguagaacaucuucucaauguaagaguggaaauaagaauaguaaagaaaauuguacaaaaauaggccacuaaauucauucuuuagcaugaaauuagaaaugcugaacagguucgauagaggugcaucaaugcucagaaaugcaucuaagugaaucuacagcucuuucuuacuuugaagcuuuuaagaaaauugauacgaggauuucacugaagauuaaaaagaaaccaacauccuucucugaacguuggaggucugucugcuuuauaagccucaacucauuauauuuucuuuuuuacauguuuuugauugacauguugauuuuaaaaaugcaacuucaacauucagugggaguugacaguauuuaaacugaauuuuggggcaaaauucuucaauauagucauauuuuucuguuauuuuuaauucauucuuuuuuuuccagcaaauacucgcugagugcuuacuauauaccagacacuguccuuggcuuuguggaagcuguguuccuaaugaggguauugugguaauuugagaauaagagaaaaucuaugauaaaggagucccucauuccacuaaugcuaaauuucuuccaguuuccuuuuuuacacguagaagauuaucuguuguagaggcacagcucuuuucaugccauuucuuuuucagaggcaguuucaccucugaucuucauccuauuucccuccauccccuuugggauccagaucaaaaaaucuugaaguucuacuuagaagauccuugucccucuuaccccacacgucuaguguugcuaguuucuaccaguccugcuuuauaaauaugucucaaauuuauccauucccugcuuuugauacuuguugccauugcuuuagucgcucaguuuccuaacugguuucugcuacuccaaaccuaaacuucuuuaauccaucuucuacacuacuuccggagugaucaugucacuccccuccuucuuugugauuucuuauccucagcccuugaaguggaauuccuuguuguagaauagaaggccugacuuucugacuuuaugcacacugaucucaggcccccuuguacacuucaaagccacgaauccuuccuuuuuccaggucugucaugcuauuuucaaaauuuuuuucuuucuaccaaaaaugcaucuaccaacacugaccuuugaccuccuucauuaucugaaagacauuuuauccuucaagaaucagcgcauguauccccuuuucuuccaacuuuuuccugugccugcucuuacucacccuuacauaauguaaguggauugcugucugcuuuuaaaaaauuauugugauuuugccauauuuuuauuauagcaccuggcacauugucuggagaugacucaaaagagaacacagguguuauuugauguauuagucaggguucucuagaaccucacacaaucacaaggucccacaauaggcugagggacccacaauagccugcaggcuggggagcaagaagagccaguccaaguuccaaaacugaagagcuuagaguccaacguuugagggcaggaaguaucuagcaugggagaagauguaggcuggaaggcuaggucagucucucuuuucacauuuuucugccugcuuuauucuagccgcacuagcagcugauuagaaugugcccacccaaauuaagggugggucugccuuucccagcccacugacucaaauguuaaucuuugguaacacccucacagacacacgcacaauccguacuuuguaucuuucaauccagucaaguugacacucaguauuaaccaucccaaguccaccccuugucaacuugaacccauacacaucuccugagaucauacauaaucuuaaaauaaagacaauaauaaggucaaaauuacgccuaacauaauacaacuauccuuuguacaaccagaaacacaccaauccucagcccaaaugcugcuacauaaaguuaacaauacuuaaaugcugauaugaagucaauaaaucuuaugucacaugaugaaggaaaaaggaaauaaaaugaagaaacuuucuuaaugcaaguguauacauacacaaacauguuuuuaacaaaagaaggaggaaauacucaugauaauuacaguccucauuucuguaacuggucacguggucauggcugguauugaugacuacuuccucuacugaucauuuuccuuuccccaauguacaguuaccgugguaaaaggccagaggucuccuuggggaaggaugggagaaagauucacugcauaaauugucaguaaugcgguaggcuucuuccucaaggggacccggccucccguucauucaaggaguucugggucuguaaacuggcucaagucugaaaauugauugaggggcuuugauucucuguuuuuauaauucaaauuagucuuuuguccauuugaccuagaaguuuucugcuuauauaaauuaaguagguaugcaguaggcuuccuaucaauuucacuuuuaggaaugcugugauuaauuagccaaugccagagcucuacagaagucagacuauucugauugcugcucugcccuugcuguccauuacgguagcuaugccuacuuugcguuugaugguugagugccaucacuugaccccugccaucuugggaugcaguuauucccauuguauuuaaauuuuguaguugaaugacugugguucccaugguuagaucuguuauaacuuuauuacuaugauuaugauguuuacuugaauauguaaaguauauaauagcauuaauagcuaacauuuaaguacaguuugcaaaauaugugaaaauacauugucuuuuuugguccucauaccaacccuaagaaauaguuugaaggagucauauuauuucuguuuuauaguugaggcuuggacaguuucuuguuuaaagugacaugguauuagagacaaaacuuaaaacccgugaaucugauucuaaaucuuguguuuucugcacuuuguuggaucuggugccugggcaugaagagagccauucccagguacuccaugggauguaccacaaggugauucagggauucaggccaccuccauuugguggccccccucacgccuaggcccucagaaucuuuucauuuaguaagugcaugagaaagaugggauuguagaacucucuuuuaagcaucauuuccuucauuuuucuguauucuuccuguggugcaaacuauuuaaaguuuugugagccacagugcucagccauagcuguauccccuuugcaucuuuguauguguuuucuuucucucuacucgaugcccuuuuccuccuccuucaccuggugaauuucugcucaucccucagcaacaucuuuucuggggagccuucugccaccuuuuuuuuuuuuuuuuuuucuuugagauggaaucuugcucuguugcccaggcuggagugcaguggcaugaucucggcucacugcaaccuccgccucccggguucaagugauucuccugccucagccucccaaguagcugggacuacaggcgugugccaccaugccuggcuaauuuuuuguauuuuuaguagaguugggguuuucacuguguuagccaggauggucucuaucuccugaccucgugaucaaccugccucgaccucccagagugcuaggauuacaggcaugagccaccacaccuggcccucuaucaccucucuuauuccuccucuucucucaguggucccuuuccuuuuccucugugcccuugugggaccuagcagguuauuuccugaguauuuguucucccucauaaagaagaugcuagggaccauuuuuugauuggcuuugcauaacuagaacuugaaugauuuuuagcacacacuagauucucaguaaauauuuggugauuuuuauuugguaaugugauuuuuuuauggaaauuaaggucauauaguucucugucagaaccaggauaucaagaacaggguuguuaggaauucacacaguucaucguucagguuuugugcuccuguguaccuuuggaccauugcccccuaaaauagauuuucauccaauguuucuucuuggaguugcuuuugauauccaaauagacaaauuacaaauaugcacuuccaaauguauuuugugguaaaguuauguaaagaggacuaguuuuuauuuagguaauuguaaagaugaggcugaagcagauaaagaaggucuuuuguuuugcaaucuuuauugcuuuauguuagcuggcaggcugccuguguuugauuaaaaaugauagucuguaaacuccuuaaguuagaccauuaauuucccaugacagcacacgaagcuucuccucuccuccucuccccaaacagcauacauaucagaggagccuccuaugugagacauuuguuuaacguugccugucagaaaaggugcuacaacaagucagucagguuuggaguuugcaaacauacuuccaccuuacugaacaucacaaaggcugucaaaaauuucauguccuuauauuuuuucuucuuuccagaagaaaaaccauuacagauguaaauguuagagaaauuuugucauacacuuuggagcuucuccaagaaguauuuuucauagcuuggaaaagaggaaggaggccucugcugacacauuugcaaucuuuccaguaguuugugugaacuuuauaguuuacuacccuacaagaggcuagauauuuuuucuucuaaauacuacuuauaucucauuuucuuuuuuuuucuugcuuucucugaaaaugaaaguguaagcuuuuucaaauggccuugauauuucuaaaauuucuguuuauuuuuccuuuuacuuucuucucagucuucuagaugcuuuccaccaaacccacuucugggaauuauccacauguguacuuacuugggaguuugaugaaauauauguaugugugguaugcauauuucugauauuauuuuauuugauggauguugaauaacuacuaagagagaaaccaguugcucuucaaaauauaauuagcaacaccaggccuggagaaguuuacauuugguugugacaaaguuaguaguaugcccucugcaaagaagagaaggggaagauggaugcauuucuaaugcaaucaggaaaccccucuauaauuuaaauauauuagcauauccuaagaaacccagguauuugaauguuccuaagacagcucgaagccuuuccuaaacaagcaugauuaaauuacuuggagcacauugaaacagcacacauggcccuuaauggaucagcauuaucaauaugcauuuucacggccaacuccaggaaagccaucacuaaagccauaaggagucaaauuaccgaugcaguccuaaugauuuugcuugcauugcucacauccaguuugccacuaaauguuugacggcacgcaaacacugaauuucgcaaacauuagugucauuuccuacuugucccuagaaauaguaaugagcauacaucuugaauccucuuauuuuggaucauauacaagaaaguaaaaguuuucaaauauucugaagucugggcauguuaggauaauaugacauggaacuaauuauguaaggguacauucugggucauuugaaauuugcguauguauugcaaaggucacaaucaacucaaauaaauaauaauaagagcuaaaaugauugagcccuagugaugagcucagcuauguuaucaacacuuugcauguaguaucuaauuuaguauuccuagcaacucugugugguaggaaauaguaucacccccguuuuauagcuaaggaaccugaggcauggagagaugaaguagcuugacaaagaccaggcuauuguaaauggguggcuaggaucaaaccuagacagaaggacccuagagccccaacucuuaccuccaacucuaugccucaggugugugccuccauuuaaaacccuuaccagaggaggcucaaaggcucgaggacucuuccauaguggcucucauuaggcuguuugacucugauaauccagucaaacaguuuaucuacagucaaacagagaguagauaauccacucugauaauccacagucaaacagauaauccaguuugacucuggauuaucaaacagccuaauuagagccaucauggaagauuucugguucauaaacaguucuccuguuagguuaaaauacgugauuuuucuguuaaaaaaaucagcccugcauuccagauaguucccaggccaggucaagaugagcuccucagaacacuuuguuauguugguccagcccagucacuaugcccuucuauuaguuuugcuucuaaaagauaagaaucuagaaauaguugggccaauuuagaagaaaacauuauguauuuaaugggcuaauauaggucuaauuacucgcauaacuuaaggacuuuuauuaaauacauuuacccaagguaaauuuucaagcccauuuaaaauauaauuuaauuuauuuaaaagaaaauugaucugcacagauuaggguugccucuauugccaaagaggagcacuuaaauauuuuuagaagugaacauugugauuccccuguuagcauaggucuuggucugaagugaaaagaaaacuuuuagcaaccucacaugcugccuacaggacugucuccuuuauaaacauucucuguuggcacugucuucuggagagcauacacuucccuacauuucguggcauuacauuauuucucaaaugacuucugccuuuguagaaucaucaucuuuuuuccaugagauaugugcaauauaauauuguucucaaauauuuuagucuucaugacacuauugugaauuggcuuuaaacacauauaucccccaauguacgauauauuccuuaguccuuauuuuauaguaggaugauauagugcgugccauaaaaggggaggaagacaauucugacuuaaaagacuguuuguuagugccgccuuugaaccuuagucuuacaugaggaggaguagauacauuuauauauuuauuuggaaaaggucgaauaaaggauuugcaauuugauucagaaacgucauuaauuuuuaaaauuuauuuacuugcuuauccuuuucugaaaagacugugaaacaguugccugaauauuucguuugaggggcaguuaaaaacagaaguuguggaaaaacaaugucggcaacaauuuaugaaaggaaagcauuggacauauuuaauuuuucuuacccauuucucuugaaauaccugugcuuucccauuuagugccuuuaauaucacaaagagagaugaaagggauuaauuuugucgaugguggauugcacugaagcuugaguagacuuuuuugguaguuuuacaagccucaguauaccacucauacagggaaaagucaccuuggcuuuuaaauuuaguugagcauuuucuugagcuauuauuuuaaaauaauagugcccccuccucuuuuaaaaauuacuggcauugcaaacccuuuuuuauaauuucuucccaauguuugcaaaaucccccuuaggauacuuaugguucuauggaauuccucuucuccagauauugacagaaucauuaaacaugccugaagcuucauuauuacuuuuccagcaccacuuucuuugcucuuuaucauugcauuuaguuauguuucaucuaguuuucaauacacaugauaggguucauagcccagccaaauggaaugaauuugauagcuaagcauuucacaggcuggcucuguaacauauucugccagacccuacugugugugaagcauuacuacuuuuucuuuuuuuuuuuuuuuuuuaaccaguaaagauuauuuauaacuuugauuucuuucaugcucauuuguguuccugaagaagggauggaaugguguaccccaucagaguguuucucuuggcuuuccuguauguaaaccucacuaauacuuucagucaccaccuucugugucauuccuuuuaagcaaaaggagaagaaguggaauuggguucaaggccaugcuuugcuuuucacaagagagugcucucagaagcgcugguguaguuccaacaccuuauuucuacugcugccugauaguggcuugaagugguuauuuagagggagaggguggcuugguaggaauguacuucauucaguauuuuuguugaugcugucauuggaaugaaccucagugaaugauuuuaagagcauaguucuuagaaguuaugaugauaaaugacugaaugagaaccuauuuaauauuaugucacuacuuuggggaaaaauaauuuuagcugaguauuucaggaguaagagaaaguuuauauuccuaagauuuaguuauuuucuagguuuuuauccuuuuauaaauauacaaaacuacucaaaacagacuugguuaauacucugaaccagcuuggaauacauucuuuuguuugaucauuuuuccucuauuuuucaguuugguaauuuaauuuuacggucauauguauguacccuggucuggagaguucucucacauggcaugauuagcaauugugugugaaaugauuauguggcaacauuacuagugaauuacagcuagucuaaauacuuuguguuuucacuugagaacauuggcucuggaauguauaucuggcaccgagaaggaaaaaggaaaaaaggcuugacgauaaaaugcagccagaguguaaauugugaaauggagcucuaggcucaauugauccuccacugcuagcaacuugagauugugcauuuccuuucuagaaugaaaauuaugcccuuuuaagaauacuuagucaauuuuuaaucuucaaauugguggguuuuuuuaaauaaaaaaagccagaaguuuacaugguguguguuuaugucuguauauuauuauacaaaggaucuaaauuauaagcccuaauucaugccacuucaaacuaauggaguagcuguuucaaggucccuaacuauaguaguuacuccuuggaaugaggaagugaaucuuauauuaagacuuuacacuaauaauccuggccgacuucguauugaagcccaaaucuggaggaguggucucaucauaagauguaaucagcaaccuacccugcuggauauucacuguuuggauacuaacuguacaauaacugcaauggaagaaauacaaagcagaaguaaagccaggagacauauuccuauuuucuagguuauuuaucccauaauagagagaagcuguucauuuaggauuauaaauaaagcuuucuuaguacauacugagauuggucaguuuuuuuuuuuuuuuuuuuuuuuuuggaaugggcauuuauuguguguccucaaagaaagaaagcaggagggaguuuccuuggugauuuaauuauuaugauugugcaaguuucuuugaauauguucaaaguacuccccauaugagaaggaagaaaagucauacaccacauaucccccaguuucugucgaaauaagaccucaguguucuguaauaaaacgucccuuucuacucacucccagcauuugauguaaaugauugacagcauguguagcgccuucuguucuuuagggucuaggucaaggaagacaucauagcuaagaaaauaaaaacucagaacugaagcaggaacuuuucauucaaacuugaauaaaucuaaaggaaaaggauguuauaucuucaaaaaauuaaaaaccaaaacaaaauaagaaaaaaaacacaacaccuauaguauccuuagcacuacagauucuguauuuguuuugaauugaacauuuucugaaaaacaucaugauucauuaguaugaaaaauuaucacauuaucauaagaaaaggauuguugacuauaauggaaauaggcuuuggaucacuuaugauacggauaagugcuuagccucauagcauuaaaccaggauuccaagauacagauugcuuguuuauugcauaggaagauuuaaaaaauuacuuugaggacuuuuaucugauauuagaguugcccagaaggaccacaccuuguaacucaaacuguauuuuuuaaauauauuuuuugagauggagucuugcucugucgcccaagcuagagugcaguggcaugaucucgacucacugcaaccucugccucccagguucaagggauucucacgccucagccucccaaauaacugggauuacaggcaugcacgaccacaccuggcuaauuuuuguauuuuuaguagagaugggguuuuaccauguuggccaggcuggucuugcugaccucaggugaucugccugccucagccucccaaagugcugggauuacaggugugagccaccacgcccugccguaacucaaacucuagaaggcaggugcgacuugauagauugauuuucauuauuggcuuagaaauaaacgggaaaccugguugauuuucuuuuccaaguaauucggcugugaugucgaugguuuauaacugccuuucuccccgugacacugacaguaaauauuuuccauguagaugaaaaccuaccaguguaaguauuaauacuuauaauagaagaaugcacauuuaaaaagauuuacaugugaaaaaauaugaauuguuauuacuuucacaugcagccuagacauauaguaucuuugaaugaauguaagugggaguuggaggagagauuuuaauuugaaagugaaauacugguaaaauacaguuuguuguuguuauuguucuuaaagaaauauaagcuauuuaauugucuuuagcauaauguagagauuauagugcuuuauuuacuaaacacagcaauauuuuuuuuuuuaaaaaaaacaaccaaaccucaguuccauaaaagccacuuagcagagggaaggaguaaagaguggaguuucccccuugcccaguggcaaagggaagccauauaaagaagaaagacaaagacagaccaggguacaaagaggaguaguggggaaggggcaagagggaguccugguucaagaaggagacuuagagaaaaauggagauugcaggguggcugggaagagagaagcagccacaggucaaaggccuuagguggcccccuuggccuuuccgccuccgagcaagcagcuguuuuugcuguuuuaaugaauuucaacuguuucuacauuccaaacucucaucaucaucaucaguuuuacuuacaaauagagaaaugaaaauagcuuuaaugcuuuuguggcaauauccuaaaaguuuacagaccacgugcuauauuaaaguagaccccuuuuggacuuaaaauaucagccugcuuuuucuuguuugaaagaguaaaaaucuuuaggacauaggaauuguaggaauuuaaaacuaucagugaccuauuuuggcaaugcuuacaauuuuuuaaauuagguuaacuccuaggcagagaacaacauugguaaauaguaacugagauuggggccuugaagaauuuugaaaccugagguuauauguuugcaucuguaauagaacaguuguauguaauguuuuucuacauauuacauggugggccugggggugucuucagagaggaagaagaucauuauuaauauuaauauguuauauuaguaaguagaugcuauauuuucagauucucuauuacuuugaauugguuuguaauccaaaaccauaacuuagcuuucacuggcuuuuucgcccuaaagaccaauugccaugauaaaaugcucucaacauaucuaccuauaacaguugagaauacucacuguacuaagaugccccuuuacuuguaaaacuguguaucaagaguaauuuguuaaaguguacaggaccucucuuuacuauuuuugcacuauuuuguguuugcacacaaaugcagcaguacauuuaucucucagaaauuucaauucucucuggcagguugauaggguaaauacccucucuaaucuuuuuuucucugggucuucagcucugcaaauauccccucauuccuuguaaacuguccaaagcucagcaaauaccuuucccuauauagcugaguauucuuucccauguugcuccauuuuccucccuuuugacagauaagaaaagguaagccugacuuuaugaaccuuuuucugaguugucacucucuaaacaacuuuccuauuucugaacugcccagcagaauuuggagugagcaaauuagagauauugagaaugguguacucucuguccacagcuaccuuuuaugaguacgagaacaggaaaagggcaagagagugcccagggcagcagagaauucagggcuagagaaauucuguuucuguuggccaaggugaauaggacacaagaaagucuaacuacaauuaagaaaccuagucgggaaagguagggauagucauggaagaagugaguuuccucuagaaauuuuucccccuuugggacucauaaaauaggguuucuaauagauggaguuuugccugaauaagaaaucgagcagugcacuggguggucucugucauuacagcaccgguucuaugcaugugugaauaagggcuuauccaaaucaauccugcaugaaagaauauaccuuaguaggaauuuaaaggaggaccuuaaauucauuaguauuccgagaacugugagugaaacuguuuagcccugaaagcagcaauacagcugagguucagguuuuagagucaaacuaaucuaaguuccauucuuguuuuagucacugaacuucccuaagccucaguuccuucaucuguaaaaugggaaugauauuauuaaguuuuaugggauuauuaggagaagaugagccguuauaccuaaauuaauuagaauuguacuugaaacacaaguguuguuaaaugauauugguacagguggugguuguagaaaccgaaaaauggaugguuaaauggauuaacacuuuuagaggaucugaggggccuuagcauuugggaguguugguuauggauagagcaaacugaaggguaugguuguauuaucugcuccuucccucuuaucucaguacugggcgcagcaguucucuuucuuucuuuucccuauugcucaggcgucauucauaauaaaauauagucacacaucacuuaaccauggggauguguucugagaaaugcgccauuaggugauuucaucauuaugcaaacacuagauguuauaaccuacuacacgccuaggcuguaugguauagcccauugcuccuaggcuacaaaccucaacagcagguuacuguucugaacauuauaggcaguugcaacacaaugguaaguacuuguguguuuaaacaucuaaauauagaaaaggcagagcaaaaauaccauacaaaauguaaaaaauaaugcagcuguauagguccuuuacccuaugaauguugcuugcaggacuaaaguugcucugggugagucagugagugguacgugaaugugaaggucuaggauauuacugaacaguauuguaacuuuguaaacacuguacacuugaguuacacuaaauuuauuuaaaaauauuuuucuuucuucaauaauacauuaaccuuagcuuacuguaauuuuuucaacuuuauuuaaaauaaacuuuauuuuaaaaauuuuguuuauaguugacauauuguacacauugggguacagugugauguuucaauacauguauauauuuuauaaugauuaaauuaggguaguuagcauaucuaucaccccaaaccuuugucauuucuauguggugguuacuguugucuuuucuaagcuauauugaaauauaccauacacuguuauuagcuauaguugcccugcuguauaauagaacaccugaacauauuccucuuaacuuucugauucuuucauaaugacauuuagcuuaaaacacaaacacauuguacggugguacaaaaauauuuucuuuuuuauauccuuauagauguuuuucuguuuuggaaauuuuuuauuuuuuuacuuuuuaaaauuuuuguuaaaaacuaagauacaaacccacacauuagcguaggcuuacacagggucagugucaucaauaucacuaucuuccaccuccacaucuugucccaccagaaggucuucaggggcaguaacacacauggagcugccaucuccuaggauaacaauacuuucuucuggaauaccuguugaaggaccugccugaggcagcuuuacuguuaacuuuuuuguuuauuuuaauaaggaggaauacacucucaaauaaugauaaaagccgaguaugguaaauacguaaaccagugacauuguuguuuguuauucguaucugguauuaucaacuuuacauaauuguauauacuguacuucuguaagacuggcaguacaguagguuuguugacagcagcaucagcacaauacaugaguaaugcauugugcugugaccuuagcauggcuaugauaucacuaggagauaggaguuucucaguuccauuggaaucguauuggaccaccaugguauauauaagcaauccauccuugaccgaaacgucauccuguggugcgugacuguaauaggauauauugccucaccacaguauuuguaguauagaaggacuuggagaaagaucacuuacacuuaaauuauuaagguuuaaauuugaagcuuuaguggcaaagauaucaguuggcaagggggaauucauaaaacacauagaauauacugcuuucuuuucagccugugaaaauaaauuaaugaguuugaauauuggaagaaauagaaaaugaauuugaucuuauaaagcauccacaguauguauguauguauguauaucuguguguguguguauauauauaacuggaacagugagaaucacuauuuuugaauucugaaaauauuaagaagguaauaacccccucaaauacagaaaaagcgcuaguaaaauggugagugauccuauuaagguaauaaugcaaaugagacaacagccaacuacuaaugaaaugacccaucacagacacauauguguuaaauuaauugugaagacuucagugaauccuuacagaacaaaaacacaagugccuaccuauuuuaaauuguuuccaucuuaagcagaaaauauuuccagaaauaguagaauugcaguuauuuguacuaaaugaaucaggucugacuuacuacguaugauuugugccaguacacuaacauaaauuugaauguugugaaaugauauaguauagcuuuguagugauuugugugaaguuguauauacuugucugaacuuuacuuuugaugguuuaggaauuaaguuaugauuuugggacuugaaaugagaguaauucagaagagcauuucaaauaacaaauggcacuuaggggaacaaaagcucauuuaucuaauuuaacauaugcugugaagauguggagacagccaaggagaauaucagaaguggcacauauuaucucuugucuuuuuguucuuagucuggaaagguaaaauggcauuuccucuaggaauugaggcaugacuaagaaaaacaaguuuugcuaaaugcauggugacaguugcuggucccuucggguuucauauuaaauuaaugaugugaaugaaguucagcaaaugagaagcauggacaucaguuucuuuccauuccuaguuaauauucaacccaggaagggauggucauucacagcuacuauuaagaaagcuuuagaguuuuguuacugagcauagagaaauaaaauuuuaaauaucaaaauuuuacuuccgagcauuuuuuuuagcauggauguuaaacaccaucaacaguucuguauuaguucuaucccaacucccuugauagauacaauuaaauuuuacugauguugguauuuuacuaaagagggucauuauacuuuuaguauaaacuguaauucuaagcagaaaugaucuucaguuucccaaggacagcauuuuguaaguggugugcgugcuuuuugaguuucuucucaucuaaccagaguuguacuguuauguuagaaaucaguguggauccuaccuugguugaguuugggcucagcauugggagauaauugaguugguuacgaaggcuguguggagaaacuuggaacugggagauacagguucucugugcaucuuguaaugguaugcaugguuuuugcucuuugacacuuuauacucaacgcuugaaauaaaucuuauagaauuggcucugccaugaaccuacuguggguccuuggacuuugucaaggcuuaguuugcuugcuuauuuguucauugguuuauucauugauucauucagcaaucaauuacugaacacccauugugugguuggcucuguacuagccaauaggaauaaaauagacaugagucauuccaacccucauggugcucacagguuagugcgggauauaggcaaucuuacagaaagcaguuagguaccaaaaggaugggagaguauaguagaguaaucuaacucuaccuuuagggcagggaaauccuccuaaaauaggagaugucuaaacugagacccuagaggaugacuaauauucaguuagggauauggagaagaccuuuucugucagaaaguacagcaugugccaaggcgguaagaaaagagagagagcgagagagaucccaauacauccgugaggacuguuugagucuaagaucuaccagauuaugccaguaugaacuuguuucuccauuagcucuugcacuuucucaccuaugguuugaaaaugcaaccaggugauuauaggccacacgacccuucugccaguauguuuuagggccuuuaaggaucccagcagguuaaaaucuacuuaucuacuuacaucugcccugugcccaaauaaggagguccacaucuguuacugugucugucccugccgaauauccucuguauggccaggcugcuauggggcucauguugcccaugccccaaaaguacaugauugcaccuagccugugggcugcugucucuucacagccugugcuaacugaaaucaugagauuggcuaugucuuugggguaacgcugcaguuuacagucaccucuucuacagauuuauuaugauagugaaguaaguuguaagcacaacggaaaauuccgacaggaaaggaugugugggguggaugugugaucaacugaagagguuuccuaggaagguagaaaucaaaugagaucuugaguaaagguaacagaaaggaauacuguugcaauaaggaguaaagaugugguguuuaauaauccuguuuaaucucaaugcauaguuuauggagagacuaguguaccuggaacaguggcugcauguugauauuguugcaaaugauauugcauaggaaagaaaugaucuuuugguuuaguuucagguaaaacaaaaacaaaagaaguaaccuuagccaaucauugauuuggugaagacuucagagaagcuuuuuuuuuuuuuuuuuuuuuuuuuuuuugugguucauauaaaugggaaaaggggcugguuucuccaagacagaaguagcugugguaucuccucucagguaaaaugcccucaaagcauuagucauugaccauccauagguaauagagacauagacugugaugugagggcaguuuaguuccaugauuucuuggcuguaugauauaggguugguuguuuaaucuaucuucaucuuucuaauguggauaguaguaguggcagcaccaccagcagcuauuucauagaguugcugaagauuauuuaaguauccgauaagugguaacuauggugacaguugucugccuguguuugcuaaugaugaacguauucauucccucacucauugauucacugagcaaauauauacuaaggaugcucuaagggccuugucccaugccugcguucuggggaaaaauuacugguuuuauauuguuauuugcauuucuucccuuuuuuuggcaaaagcaaauguuuucuuauuuugguuucauuuauacuuuugcaguguuugucaaaguguguucuaaaaacugccugcaucaaaaucagcagggguucuuauuguaaguguggauuccugguccuuacguuggaccuacugaaucagaaccucugggaagggcauggagaaucagcauuuugagcaggcucuuaggugauuucuauacauauugaaguuuacaaccuguuagggucacauugucuccccgauuucccauuuggugcuacacuaaggaaaggcuaacagucacuuuccucuucuuuccauuacauacacagauuuucuacaacugugaauccugacaaacccucuuugcuuuacuuuggguggagaaacugagcaauuugcuucuuaagcaggcuucauuuacguggauaauucccagagaucaguaagauaugacugaacucacuuccuuucuaguuaagucuucucuuacuagcauccauuucucugaaaccagaagcagaggcugacaccaucagccaccaaccugcagugucauggaguuaccaauacccuuucccuuuccccauccugggguuuguuauugcccuggagcaguacauuuagaauucacaaccugaauauuaauaacaagcuaaaaacggacuagaacuucuauguguuuucauuaauuuuuuuuuuuuugcagccuugaauugauugcuucccuuuccccaagcauaccuucugagacugauuuaguguggcuugaucaauagacugcagaaugauuaauuuguuuccacucauuucuuuacugaguauuuuccaagcaaaggugaguuaggaaaccgugaacuagaguaaggggaauuguugaggcauaaauagcugucugcuuguguuugcugcaggaguuuuaaaacagaauaagcaggagaaaagaaugguggcgaaggugccuaccccucuaagguauuacuucggccacauuguguggaagacuucuugauaacaggaguauagcacaacgugucuuguuuuuguuuugggcugaucucuauaagccauggaaaagaauuuauuccauacugaauugucuuaguggaacucugcaaaguuuaaaagcauccagucagaagaauauuaaaccuuugagugaaauuuacagcuuuccuuaucuuuuuaaaaaaauuauucuucacuuuuuugccuccuauuacuuguuagggagacccaaugguaguuuuauuccuuggggauacauaguaaauacuucauuaaaguugaguacagaauuugaugaaaaguguggaugugugggauguacugccgccuucagaaguccacacacugccuggagggagagaacugcuguuuauucacugauuaagcacuugcuguguaccaacuacuuuucaugucuuaucuuaauucucauaacagucauuugauauuuuaaaaaaccccagaaaucugagaaagagauaaagugguuugcucaagguuauagaacagacuaccauguguuguauuucagauuuuaauucauguuugucugauuuuaaguuuuguucgcuugccaggguaccccacaaaaaugccaggcagggcauuuucaugaugcacuugagauaccugaaaugacaggguagcaucacaccugagagggguaaaggaugggaaccuaccuuccauggccgcugcuuggcagucucuugcugcaugcuagcagagccacuguauaugugccgaggcucugagaauuaacugcuuaaagaacugccuucuggagggagaagagcacaagaucacaauuaaccauauacacaucuuacugugcgaggucauugagcaauacaggagggauuuuauacauuuuagcaacuaucuucaaaaccugagcuauaguuguauucugcccccuuccucugggcaaaaguguaaaaguuugcugcuacaaagaauacagaaaacucagaaagaaaugcuaacauacacauuuagcuggcccuauggauauaucauauuaacugcuuaucguuaggggcuguauauuuguaaaauaaaagaauuuugggaguuccaucucucggcuuuggagccccccuccuuuugucucuguauggaggagcuucguccuucugccuuuuucuuuaccuguuaaauucuccacuccuuaaaacuaaaaaaaaaaaaaaaacaaaaaaaaaaaaaacaagaauuuugaucacagucagacucuguauuuuaaaauacauuguaacuagugagcuggguguccagcaggaguuugauauggcaccaugcuuuauaggacuauauugguaguccuguaaagcauauauaguccuauaaaguaugguaucacaucaaacuccuuaguacuuagagaguaguaagaaauuaaacgugaaauuaagaaaggcuggagcuaggaauuuguauuugggagccauaauaauagccagcauuuuuaauaugcuuaauaugugccaaucucuguguugagccuuuuauguggaugagcucauuaaaucuucacaaaaacuccacgaagguaguauuaaaacccacauuuuacagaugaggaggcuggcgcagaaaagguuuuuguaauuuuucucgguucacacaacugcaauuguuagggcgagauucaaaggcaaacauuugugauguuuaaaucugaacuuuucauuccugugguagucugcauagaggugauuuuggaaccuuaaauauaguugaaaacagggcuccauuuaaucuuagaacauacccguauuaagggugagagaaguguugagguagcacaugaugagauagcaaaggacacagaaagaaagccaguuucgggaaaccaugcaaggguauuauuuagagaagaagagaguuauuaaaaacuacaaagaacucaaggagaaugggagggaaauuaucagauauagagauuaugugucuuuagggacuuugacaagaacaguuuugaguagagcauuuagucauaucucaauaugccauucauuuugaagcuuuggauuaguuuauuccaugauuauccucaccuaucacguauggcuaguuuaagagcguuauuuaaucuagaguaacaguucugaauguuuuuuaacaacaacaacaacaacaaaauagcgcaugugacacuuccuuuacuucuuugucccauuccuccucuuuucuaaaauaaacaaauauguguauaaaacaagaaaaaaaaagugugggauaguaucugcuuuacugagaacagcagaaguagcuauuuuucucuauuuugccuaggaaguauuuugcuaagaagcaguagauagaagauggcaguagguaacgguaaauguguuaguggacucucuugaaaguggaauuuccuauacuuuuuacuaagguacucaaaacaucucacagaccugcuucguuuuuauaaguauguauugugcaagugauauggcuguuaauuuucuuuguuuucccuuuugcaguggagaaagugaaacagaaaggaguggugugggacaaaugcaacccccaguuuuccuuuucugugcagugucuccuagucugcauuuuuccugcugaucagaacaaagugucaccaccauugugaccagcuauucugacuuguugcuaaauccaucuauaguauuugauguggcucacugguauauccucuuugaaagacucccuucacuuagcugccaggauacgcgcucuucuaauuuuucuccugccucauugucuccucccaacucuguccccuccaucucccugaccucuuacuagccuguaguacccagggguuagucauuggccaccuuuucuucuuucauguacacucacuucccugguaaucugauccauuccuaaggcuuuuaauaccgucucaagcugaucacuuccaaauuuauaucuccagccuggaccacuucacugaaccccagccuuaaaugccuuuugcuuaacauguccacuuccuuguuauauuggaaccucaaauuuaaaauauccaaaacugagauaccaauauuccacacucuauguucaacaccuucuuucccuuagucuuugcauuucaauuugugggaugccauccuuccaguugcccagaccagaaucccaggaguaucccuuuucucacacaccuuagaagcaacccaucagcauguccuguuggcuuuucagaaaauauccagaaucuaaccauugcucaccaccuucauaacuacugcccuggucuaagcugucaacaucucuugccuggauuaggcuuccuaauggucuuauacuuuaucucuugcuccucucccuuuuaaccauaaugaugcuuuuaaaauguaagucacauuacaagaacauuuuggcacagaacuuuuuaacagcaauucaugcagaguaaaagccagaauuauuuucaguguuuuacagggcccuaaauaaucugccccuacugguugaugcugaaugcauuuucuacaaucuucucuguggaucacaccccuccagccacacuggccucucagcuauuccuugaaccuuaaacauuugcacuacuuuucuuccaccaaacguccaagaaacuugcucccuuaauaccuuuacggcuuuucucaaacguuaccuuccuagugaagccuaccuaggccauccuguugaaaacugugauaucuucuuccagcaugcccuacuuuuuaauuuuuuucuguugcccuuauuaccaugcacauauuuuaucuguuaucuggaaauagaauauaaguuccaaaugggcagggauuuuugucuguuuuguucacuguaguuuucguaccacuuagaaugguuccugacauacaguaggcccucaauuaauguuuguugaaugaaugaaugaaguuucagagccuaaaauagagugguugagucaggguaugucaguguauguuggucugcgaguacgauuuuucuacugaucuccaaacuacagucucaagacaacaguuuuccaccucugaacagaggugccucugaauacccagaucuuuaugucugugaacaagcacugccuauuagagccaaacaagagaaacacauauuaccaucuccaauucuuuagaauccuuuuggcccagaaugacuucaaaaugcuaacccauaaaggcaaacaaauccagagaccuuuguaguuucccuuagccucugcugcauuagcugaagauaaaucuaugcagaauucacuuaagggaacagacaacuacauuaagcuguguaaugaugaacauuaauggccugugacaaaaugggucucuguaggcugagcaaccaugcaagguggggauuuuucccuguuuuugguaagguaaugaagaaggaaaaaaaaagucucauccaaagaugcaaagaaacaaucugcuggcccaggucauuuucaugguaucuuuuuguuucuccuuucuuuguuuuguaaguacaugcauuuuggcugaaaaagauacaggcaccauuuuacaguggugggggaaucucuacuuuguuaaagaaaaaugcaaugcucuuuauuuccaaccugguauaguucauucauuccuuuuccugugguauucacaugucuugcaaauuguuauguugaauuuuuuaguuccuuguuauuuuuacuuguagacacuuacaccauggucacaggaaucuauacugauuucuuccacuuuccaugcauuuguuuccauuauuaauuuaagugagaagcaugugugucauuccccuucccauuugacuuuuacaugguuaacuggugaucucaaguugaucaguuaacuuuuccuauugugcaugauuguuguggggaucaaauguguacaaauacgcuucauaaauugcuguaaacauuuaaguuaauggugcuuauguggauauuagaccaguugauuuguagacuugaaucauucuaagacuucugaaaguaauccuucuggcaaauucuauaaauuaagguaauugggauauauauacauauauacauaaaauuugggguuucuacaaguugaccaugaacuauugaaugaucugaaguggccuaggauuuuuuuauaaucuauucagaaugucacugugacacacauacuauauuuucaguauuugcuucucagauauucagaacacuuuuuacccuacagcagaauuauuugacaacacauuuccuuccugcccucugaaucucccuggaugaucuacaaaaauauagcaucuccauuugugacaauauaaaacccugguaugacucuuuucuauaaauucaguuuuauugccuucuuccaaaguaauuucuguuaauccagccagaaccuucauuuuuguuuugucauuuucaagcuagauucugaaguaacagaacugacuacaauuuuagccuaagaacaaaagaguuucaaggccuauuucaagacccugguuuugcuaccucaucuacuaaauuuauacauucuaggaauccauuuacuuuuuaaaacauuucuuuucuuauuuucaguaccaauuuguuuccuucagcuuucccacaugcaugacuuuuauagcauggcauaaaguagagugcucugccauauugauuuaaugguauguuucaauaaauuuccccuguuacaguucuugcuccauaccaggcauccaagagggaaauagacggaugugcugguuaacuaauuuuaaaagcgaaaaaauuccauuuucuccauccuuuaaugucauagcuguccugccaaugaccugauacugagauauauuagguuccucugacauauguuacaggaaguagugaccugaccuuuuaaaaauuuuauuaacauuuauaaauuuguuuuaguguauuauguuggaagcagugauuuuucuccagaauggauuggggugacugguguacagauugauagccaugucauauauuaaggugguggacauuuuguagaguccaccaucucuauacucacaauauauuguagaguauagagaugcugucuuuuuuuccccucccucuucucuccugccuuuaaggguuaugcuaauggggauggaaacauucaaaaucuuacuuuaaugcaguuuauaagcaacuagaaccauuacugucagcuuuuugguagcugguuggcuuugacuauugcuugauaaaacauugagacauggacauucauccauuuauucacucaaccuuugcucagugcuuaauguauuccagacacuaugccagucacuaggcauguaagagugauugccacaauaccugcuuccaaguaauuuauagacugauggauuaggacccaguaguauacaaucaagauccuaaucaaagauuuuuuccuucuucaacucuguucaaagcccagauaaguaucaucucucugucucuuuuuuuaaauuuuuguuuauuuagagggugcaaguacagauucuuacaugcauauauugcauaguggugaagucuggacuuuuccagaugggugucuucuuuuucccuccuuucccuguuucucuuuccuuuucuuccauucucucuuagcacuuccuaggaaauaauuuauauauauauuuuguaggcacaaauacuugucauacauuaagggaaaucuuuauugauguaaagcauuggaacuuagcuauauccaguuuuauugccuuagcaauucucuucuuuccuccauacccuaaguaaucgaggagaguguggcuuuagacaaaggacaccucuccugugacagaaaacacaggagccaggagaguuggcaugcuggcuuucuaaccugcuugcugcaagagcaguugugagcaaugaugaugacugacacucacauccaucauuugccuucuuccaaaugcuucugaaacugaaaugaagcuucccaacaccucagugaguauagauggcuguuuuauuuuauaguaaguauuuguuuauuuucuagacagggaaauugagggacugagaauguaaguggauagauaaauaaguuauggacacugcugggaagcauuagcuaauguuuauugagcccguguggaguguaauacuuuccuaagcccugugcaguguauuuuguuucuaguuuuccacuuuguacuugagggaaguauuccauggaucuucuuguuuugaauuuacucuuuugucuucauagaagguuauuguuuuguuguugcacauuucacaauuacauuugcauuuucuucaaacauuuuguuuuuuaucuuugcuaugcaagacuuaauaacaggaauuuucgcuguauuuccaggcucacucacucaguuuuggaacuuuaaauuguuccaacagucacucaguuguuggaacuccaacaacuagugcauuugguaagaacucuuacauaaauagccuuuacaaucaaauagacaaaaaauagacugugcaaccaaaaacuuuuugcuguuuucccacaaaauuaucugaauuuguuugacuugagauuuuucuuuguaauuuucucaucugcugccuauccuaagauuuaggauguuuuuaccuuaauagccauaucauguuuuaggccuuagugggccucucuccuucaugcucuacagacaaauauaaagugacucaguguuaaaaucugauacacuacagaagcacuguaugguuuauauucggaaugguuuuuuaugucaaaggaagugcaaugaauauaggcaaggaauuaaagccauuaaauguaugaauggaaaauaauuuuauagaaggucuuauuuuucucauaaauguguuccagaaauguaaguccaauaaaaauguauacauacagaauauucaguggucaucuuucggucguguucacagucauuugccuaaucgccuguuuucugaagcuuuucuauaagcagggcaccccauuauaaugguaacaauauaguuuuuuucuuguaaauagauuauaguucauacaucugauucacuuguuagucaauuguuuggaauucagaaugcauuuucucauagacaucaucuuauauuaucuugauuggugcaacccuuugcaacacagguuuauccauaauguauuucuaguaucauacuguggcuuucugaaauuuaacugaaguguuaagcauguguccugggaauggauuuagaguuugacuugagauucuaggagcacauuucuuccuacugaaugcuguuugugggaucagaagcucaugugauguuaggacauggucaacagaggggauguuaaagcuuauuuaguccaccuuccuuuguuuugagaaugagaacaucaccuccaacauucccgaguuaugguuccaaggaccugggccagaggugccuuucuggagagagccagguggugaggggcagccuccaggggucacugguauaagaggcaggauguggccugggucagaugacagcuuuggggugaggcaugggaaggggaggaggugaugggggucugaggauaggagugaauaugugggucccuuuuguuaugcacaauagaauuguucucccaauuuuuuuuuuuuuuuuuugccugucacuucauacucuauucuauuuacuucccuuucuaguuaguaaggcauguugggugaacuccccuuuuuuggcaaaaaggcauuuaccuuucucuuccccauuaccacuaccagcacaccaauacagauuuucccccucgcucagggaggccaugacuggagggagggguaaggagccaaaucgagcugucucugguggaugcagccuuuacaguggugagaggaggagccgcgggauguaaggaaaaggagcuccuauggccuggcuggagugugcaguggaugaggcugccucaaugcagggcgagauccacacaucacauggugggggaagccauugcugagguggggaggguaaacaaugcuagcuuuuuggccaggccagggcaccuguguggguguggggaggacgguugaagagugcucagugcuuuucuuuggaaucagaauuucugauuuagugacaaaucauggaaaguuuagaauggaaacuuuuuaauuuuagaaaccaauuaaauaauauucaaacacagcagugaauaaagaacuauguucgcuaaaugccuguguuuaacaugugagaagauaugucccuugacccugaaucuucuaaauauguacaguuuuaaaagauagaaauuuauagugaaaugcauuugcguauauuugggguaagagaugguguucagaaagagagggaagcuagaugggcugaaacaugaaauaaauuccuucagagucccuuccacucauguaaagcuccuugaagggcgucaggagacaacauuccuguuucugaggaacacuuacaaggacucuaaggaauguuguuucccuuauuauauuuuuauaucaaaacauuuuauuuccacaguuauuuucuuuaccuaaucuggcauuguagcugugauuuggcgggggaugggguguuaggaaguucauuuucuuuucaaaauugaaguuuuuaaugaacuugguagauuuccugaagguuaguuccuucaacuuuugguauuacaaagucaugauuaguuuuaauggugaacauuaagauugcaaauaacugcuguggcgaggguguuucuuugugaauuugaagugucucguuuaaagauuggugccuacauugcuaaggugcauaccacccucaguagcuauauuaacuuaucucagguugcagagucuuugggguugugcuuggguuaaaauucuagccaugcagcuuugugacagggaaaguucuuuaaucauuugaacuuguuuccucacuuguacgauggagcaaauaccuagcucaccguguuguucaagugucaacucaaaugauauuaugugaaagauucuggcauuuccuagcugccuagccaguguaugguuuguuucaauuugauuccaugugugacugcaugcucuuggccuauugcuaacgagcaggcagagaaacagcagcaguacagucuggcuagagggcgucuguugagccuccaaacauugaaggcuacuuugccucuuugucaggggcaugagccuccagaaacucuuuccuagaugcgcuaauuguguuucuucuuccucacuguguaacauguuauacugggaaucucuccugaauguuuguuugugucucuaucucuauauuuucuaugacaguauuugccugacugagguaaucccaacuggagggcugaggugacagauuuggagaacauucuuacaacaugcuguucaagcauuuaccaccaugauguaauaaguguuuguauuuaacaguauuuauuuaguuccuguuauguaucaaguaaugaaaaaaaccugcuuucauggaguggacauucuaaugggaggggcagacaauaagcaaaugucaaaugccucagguguguuaaguacugugaagaaaaauaaagcgggcuaaggaggagucagauaggaugcugcuugccauagggugcucagggugcguggucaagcaaagacuugaaugaauucagggaacaaaccaugagauaccugggagagacgcauuccugguagaggacaacagcccugagacccguauaccugaagacaagugagcaaggaagggagugugucgaagaugacaucagagagaugccagggcaagauuaugaaaggucauguagaugguaauaaggacuuugaauuuuauccacagugagauggggagcuauuggagaguuuugacuagagggcugucauaaucugcuuucaccuuuuuaaaggacagauuugggccaggcacgguggcucaugucuguaaucacagcacuuugagaggccgaggcagguggaucacuugaggucaggaguucaagaccagccuggccaacauggcgaaaccccaucucuacuaaaaaauacaaaaauuagcugggcguguguuggugggugccuguaaucccaguuacucaggagacugaggcaggagaaucacuugaacgggggagucagagguugcagugagccaaguucacgccacugcacuccagccugggcgauagagcaagacuccaucuuaaauaaauaaauaaguaaauaaauaggauggauuuggcugccguaugaagaaugugcuguaggggaguaauaguaguggcagagagcagaaagccauuguaauaauuaaugguaagagaugguaacaguggaggggagaaguggucacauucuggaugaagugugaagauuugccaguggguuuaaugugcagguaagaaaaagaggagucaagcauaucgcaaagguuuuucacuuaaguaacagcacaauggaaauguaauuucagaagaccauaggaagacuacaggaagaagcuagcuggagaguaagaucgugaguuugguuugggacaugcuaaauuugacaucucuauuagauagucaaguguauguguugagcagcuaguugaaguacaugacacuaaaauucguaaaugggaauuagacuagcacuguccaaaagaacuuucuaccaugauggaaauguuuuauaucuucacuguucaauauaauagccacuagucauguguggauauugagcacuuaaaauguaccuaguacaggccaggcgugguggcucacgccuguaaucccagcacuuugggaggccaagacaggcggaucaugaggucaggagauugagaccauccuggcuaacauggugaaaccccgucucuacuaaaaauacaaaaaauuagccgggcgugguggcgggcaccuguagucccagcuacucgggaggcugaggcaggagaauggcgugaacccgggaggugaagcuugcagugagccgagaucgcaccacugcacuccagccugggcgacagagugagacuccguuuaaaaaaaaaaaaaaaaaaaguaccuagaacaacugagauauggauuguuuaucuuauuuaaucuuaauuaacguuuaaauagucauauguguguagugguuacuuauugcuuggcauggaagacuauggauauaaacuugaaagccaucaacauuccaguguuuuguaagguugugagacuggauaaguccaccugggggaagcacagguaaugaagaaaagacaucugaggacugagaccuccaguguagagguuaggaaaauggaaagcuaccagcaaaggguauuccaaaagcaacagauggugaggaaggggaagaccaaaagaaaucaguuuccaggacaccaagugaagaaaguguuuuaaugagaaugaugaaauguauaaaugcuguugaucuguucaucaccuucauuauagagcaagucacguaaggauuuaucucuuugaaacccagucuuaucccaggcccuagcaaauaguuauugcuuuauaaucacuuuuaaaaugaacaaugcugaacaaauuaauggguuacucgauuagccuuuaaaauuuuuuuucaggaaauaugcucucuucuuugagguccaagcacugccaucuuauagcugcuaccuguuggaaaucccagauucuguuaaugacugaccucuuacucaucagccacccaccaucaccccuccccaguucuuccagggcuuauuuuagaggagcuggauuggagauagccucaguauuucuuauuucagcaguugagguuaaagagccaaacaucugcuuagcucuggacuuucucuuucucccuuacuuugcucuucuuugguuccuuaaaggaguacuuaaagggaguuaguuucuagauggggaagcuagcaucuguauguauacuuggacugugguaacugguaggaaguuauuguguaugguuaaaaaguagauuuuaccccaaaucucugguagcuagaucugauuauuuuuccauuauuuuucucaucuuuuaauucuucuggacuucaaguguugagaguuaaccuugcaucuccugucuuucucuuuuccccuugaaugaaguuccauucauuguuccgguguaugcccugauucagagucuuucuuggucucaccacacacacccuugcuuugucuugaaguacucuaacaugucugcauuuggaauuucuccugcaugucccaaccucugguuguauucuuugcaccuggcucugccuuaccuuccauucuguauuugauauacuguuuccugugcucucugagcuauuacguuagcauagagguaaaucugaaaaacaagaagacaacacacaugcuucuuuuccuugccauuuuuaagauguugauuauaggucuugugggaauucuguuaaguauguuuuucaauaauuacuauggcauucuguuacuacucauuuuucuuguuccuuauaucuguguuguaccagcucauaauacuaaacaaauauuguaauugacaaagaacaugcauccucauuccuauuguuaaagccacucacaguccuguaggaaguguugguacagcacuguaugaggaagagcagaugcuaggguuguauggugcccuauucuuaagaccuacugugacuuucuauaguggaguucaaggaaggcaaggaauuugugucacucucaaacucuccagauuuuaaaccugccaaggaaaaaaugcagagcuggagcuugccuugaaugauuaaaagucacaugaggaauggggaaagaaaaucccaaaggauugauggcuagaaaguaguuuauagucaaaagcuauaccaaaagcaauugcucgaaacccuagaaaccacaaauggaaaugagaguggauuauauauaguacaaaagacaaauacacacacauuccccacccagugggcuuuacuauaaaacaagccaauuaagacaaaaugcacaguaauuaggaacaucuuagguggggucaggguugcuggauuuuuuuauacauucauacacuuaauuuauuuuaaauuuuaucacgauaauuacauuguuuuaagguuugaauuuuugcaauucagguauauaaaaaugauagauuaccaaaugaguuugguguguuuaaccucaugauucacuuauaugccaauaaugugccuugccuagaauguuugcuuucuaauguuucuguguuacuccagcugccucccuuuauugcugucauauuacaaugaauguuuucugcauauuuaugaagagccuauuagcagcauagacuugauuuaaagaacuucuccaguuuaugaauacaguucaucucuugugaaugaauuuagcacuuuaaugcuauuuauuuacuccacaccauaaaauguacuauaauaaauaauaggucccuugggccuaugguaaaacucacugaucauccucucagcaggaagaugaacacaacuugaguggagaaguaaccaucaaaguucaccaugcucacugggaugucauuuauauaccugaaucuaauaaagacagaauuacagugcuuaacauugugcucacuacuagcaucugaauucagugagacucagggagggaaaagacucagucacauuagcaacaucuuagaaggugauacaaagucuaaauuggcaauucaaauaagaaaguguucuuuaaaagcauauaaugcuuaauuucuuaugcuaaauacacaguaaguuaguguuuuccauuuucuucacccauggaaaacccuuaguuuuggaggguuguguuuuuggugggggaugguagggggcaggggauugcuucaaaaucucuucucugucaauuccauuuggaguuuucaaggcgaccccagcugucagcuauccauaaaugcaauaucuacaagccaggacgucuguguggcauuuggucaguagggccauucuguuuuaugguugaaguccagaaagagucaauauaugaguguucaaaacucuuucuagaugaauguaugccugauuauauucuaagauuauuuggguuauuuuuguguuaucuuuguuuuuauuugauaugauuugcuuuuguagauauuuguuccuuuaaauaaauggucacaaauuugaaugcuuaaaauuugaaaccaggcaguguauuauagaaacaguauaggccauaguucuguaucagggaagaguugacuuuauucuggaagauuuuuaggucugauuuacuaguugucuacuucuauguggacaaaucauucugcuuuguagauuauuugauuuagagcagacuacauaucugauggcucugccaagaugaauuagccccucacuacaucuccagauaacggcguaggagugaggaacuguauaccguaucccucuaaagagaggcuucaaaaagcacaaucuugauuugggugguugggaauuguuccuuuguuggacagcuuuaauuauuaaauugagaugaaauaugccagcuuaugauuuuuaauacuaauuuauucaaccucaaaauucccagugcaccauuugguucucuucucaggcaaauuguuaguuucugccuuguguauuauuuaugcuuguacuaugaauaaaggaugucucaucucuauguggcaaugucgucugcuucaugagcugacaguuuugaagaggaacaugagacagucagaucuguuagugcaacucagucaagcagguggucgcaaaauucguggcgugagaauugcagucauucauucauucauucaaaaaauauuuauugagugcccguuauguaccaggcacuguucuagauacuagaugguacucauccucuauaucuuccuuguacucuaugagaauaagguuguugucugaucgccuuuuaucuucuacuucacccgacaaaguacauuacauuuagaaugggcgcaaaauuuuauuuuaaacaaguagcauaccaaguaugccucuuuuguuuuagcugcaacugcuggaaugggaccgaguaugccuauuuugaagagcaacauagaguaguucuaaucacuuuaugacacccguuaaauauuucaaucacauuagccucaagucuagacugaauagcaccaguucuucuucuaaauaguuuggcugcccuucugugagucuuuucuaguugacucuugucucuuuucauguguaggaaccaggacugaagacaguaauugugagaggaucuagcauguacaaaguggaagggaggguguuauguuucugugauuuauuacuuucccaaaagauguuuuaucagcuaccacccuauccuuuuuuccccaaggcauucuuuucucucucuaauuaaguaaauaaauuaauuaauaggauaucuaugugguaucuaacuguguauacccuugagcuauuuauuuuccuauuuuucuggucauuuucauuaguuaaaagucuguucuuaagaucucuuauuuacaguaggaguuucuuauguauauuauagaaagcuauucaaaaaguuauauucauuuaaucaaaaaauaaauuauugggggguauguaguaaacucuguguguguguguguguguguguguguguauguguguguguguguguguguugagaacaaagugaugaaucaccaaggcuucagaguucuugccuccuuuauucugacagucauucuuauuuaugcugauaacaucugucuuauccuuacaagguauuauucuguuuuauuagagcucccuguuucauauacaugagaaaaaacuuagugguuuaguaauucuuagugucucccuugucucuaauguuuugaguuuuaggaaaaaagaacagaagauucuuguuaacaucuuuguuaccguuaagauguauuguuguuucuaggaacaaaugacaaaucccaugucuuugucauuccauaagccuucuaccaaauccaugggucaaagugccguaugcaggugauuuacugugcuugauuuguuccaugauuucaucuuuagacacuuccaucuuugucaaggccaugcuaaucucaccacagagaauguauacuagaauuucucaaaugucaaauauauuguguacacuuaaaaaaaagauugucaucuaaguuuaucaaucauaaaaauaaaauuccauaguuucaguuugcaauuacaagcuugugucuuaaaguuuguuuugcuccgauuuuuaauuuggcuuuuucuuucuuuauacauuucagcuuccuucuuucucuagguuaauuucgcaaauauuucuuaaauguuggcuaugugcaaagaauuguuuuaagcaccuuaauagcuacaaagauaaguaagagcuuaucucuacuuucuccuaccccaaggccacccaaaccugcuaaucaaucuuaaauccuucucuuucugcuaaauaucauuagaaggcaucacuuugagggcuuuuuuuguauuaguuguaacugagggauuuuuaaaauauuuuaauugguuauuauugguagauauauuugagagaccuuacaucacauagugaauuaggauguuuauugaauguccuauaauguguucaacaguguacuguuguuaaaaagcaucauuauaauuguacucuaaaacuugcaauuuuuaaugucuucauugccuccugcauuuguugaaaucaauaauaaccuuuuaaaaaguaugaacuuuaugauauguaaauuauaucgcaguaaagcugcuauauaaaaaagaauaaccuaaaguaucuaaauuauauuauuggguguuaaaacacaaauagccuucucuuguuagauuuaaucccacauguaacaaauuugcugggccauuuugcagcaccauagauugacugcuuuauuccacauacuacaguucuaaaacaugaggaaaucuuaguuaacuaauugaaacacucauuuggauaagaacuugagcaugguucaauaauucucaauuucccacuuugcuuguaaaacacaauguaaguauggaauuacccucuucacagcuuauugcacuauguguucagucacagagaaauaauuuaaagcaguucacuuccaacuguuucccucaugcugaccccuuucuuaaaguaacgaauuucucaagguuauguuuauuuugaaauuauaaauuuagucacauaccugguugguuucauucuccuuuuguuguuuuccccuuuggaauuuccacacugugucaccaagcaagcucuugauugcucccacccucuuuuuuuuuuuuucuucuuuguugagacagguucuugcuguguugcccaggcuggaguacagugguaugaacacaacucccuguauccucaaccuccugggcucaagugauccuccugccucaggcucccagguggcugggaccacaggcgcaugccuccacaccuggguaguguuuuuuguuuuguuucuuuuuguagagcuggggucuugccauguugccuaggcuggucucaaacuccugggcucaagcauucuccccgccuugaccucccaaagugcuggaauuacaggcaugagccaccacaccuggccagcuuccacugucuuuauggcuccucguccugccugguuaaucucauacuucuuucaauuaaauacuuuauuuuauuuuuuauuuuuguguuuauucuuuaugcauugaaaccgaugucauaacuucuguuuuguuaaaaucuuuaaggcccaucacauauuuauaauuuagguccuugccuugguguguuuuccucagugcucccaaccauagaaaagcaggacaaguuuacaguugcuauucaucuaagucugaugcuucuuucccauaaguuguuuugggaauuaagcaucuugcugaaagugaaugugccauuuugaaaaucuuagcaaauuacauuuucagaauuuuauagggccuuuuuuucccuuucgcuaccuuuguuccaaaucaugcuuuugaaacaaucuuucucccaaagcauuucuauuaauaauacuuuucaguucucccucuuauaacucauugugauaaauuaccuccucccuccaugauguuaauguucuggaggccucugagaguucuccucaugguggaaguccacuacagagcugcugagagcagagccuuuagccugauguuccaggagcucuugcuacugccccauccauccguccguccguccauccauccauccauccauccauccauccauccauccaugaaugauugcugcucuaucaugccucauagcuggcccuggggagugguuuuagcuacacuugaauuccaccuuuuccucauaaagugguauggacaucauauuaacuauaacacuauuauaaucaguugacauugccagucauuauuugagacagguguuuguucuucuagaauuugcauuuucucacugcagaacacuguagaauguuaaagcuaaaagauugcucauaaauggccauaugugagaacaugcaguacauuaacuugcucauuuguuuaugauuuaauuaugagaguaaguggaaaagaagguuuagaguggcuaacaaaugauacugucucaauauuaaauagugggggcuuuguuguuguuuuuauaaauugggugaaaguccuucaugcuuuuaauuuuuuuuauuuaaguaauuuauauguuuucucccuuccaaggaaugaauuuuauucuucaucauaaucccugcaaauuagaggcuaaaaaucuuuguuuuacaucuggagaacaaauggauguuccugcuucauucucagacaagcaagugauugauagcuuugauaucagauucugaaaugaaauaaauuuugucucaauuugagagaaaauagugauaauacagguccuuucugccaaccaacucaggcauaugggccuuuuauuuuuuugaucuuuuuucauucacuacaauucuaaauugaaaaaucucacauuuucuucuaaaguugauuuaacaauauaguuaacacuuaaaaauaucuaaaauaaagaauauaacacauucuacugaaauaggcagccagcaguuuauacauauuuggucuaauacauuccucaccuuacauaaaucuccagaaaagcuauaggaaggaaacacauuccccugacacgacaggacguaaaauggauauaaaccaauuacuuuuugcaguucccagagucucaggaauacugacccuucugacuucauuuucaagcaagaacucuccacccccaucuuguaaggaaaaauaauugagcugaauuucuagcaagaagcgaaucaagauuuucaaagaauaauuucgcuaggaccuauggagcaaaucaccuuucaaacaugccaaagguaguuauuugaauacauuuaagccccuaaucacagaagucuuuugaugaacuuuucccacuuuaaauacaucaaacgaagcaaagagaguagagaaagccauuagaaaaucauuauaauaaauaccaacauugaucuacuucuucccucuccuuuggaaccuccccuuuccuuguuuuuaaaccuuuuaguugagcuuuauauagcaaaguaaucaaacucucacaggccauuauaaaagaaauuuaaaugauuuuuacgaaaaccauuuuccuuguuuaagauuucagggaaccuggucaguacugugagggcucaguuuuugguugugacuuucaaguugaaccuuuuugaugguaaauagccuccugcuuaugccuguguguuuugacuuaaaaaaaucaaucucugagaaaaugggcuuccaucuuccuuucagccccgucuccuuugaugauugauguuaauucaguaagcugcugacccaagaaaaaaagaauuguuugugcuguuguuuugaauaaauaaacuuacaaagaaucaauggcuguaacuuagagaaauuagguaguagagagcauaaagucucugucguguuucucauguaaauaaagcaaaguaaagggcauuucagcaccagauaucuuuuugaaugaugaaaacuugcuucaagggcaauuuuuuuuuuaaauaaauguucucucuguaucuauagugagaaaggucuguaguugugacaaaaauaggacaccuucuacuuauucacauaauaauucgaauaaguagcgaagcaaagcaaauuccuuagucacugggcccagcuuacauucaauguuguuaguauguggacuucagucuuccuaccauaguuuagagaaaacuuuuugaaggacuuuguaacaccaugauucaauuaccuccuccuggguccccccuacaacaugugggaauucugggagauacaauucaaguucagauuugggugggcacacagccaaaccauaucauggagcaaaaugauuagcuugcauauuguaugaauuuggccuuuacuucucgguguuucaguuaucucacuaugagauaaggaagugccuccuucaucgguuguacguuuuaguuguaaggauuaaauaaauuaauacauaugaaaugcuuaaaacagcacuagauuuauaauauuccauaauugguagccauuauuauuauuauuauuagagacaguaucacacucuguagcccaggauggagugcaguggcaugaucauaguucacugcagccucaaacucccaggguccaucaauccuccggccuuagccucccaagcugggaccacaggcacguauaaccaugcccagcuauuuuuucuuuuuuaagagaugggaucuugcccuguugcccaggcuugucucaaacucuuggacucaacugauccaggcaccuuguccucccaaagugcugcgauuacaggaguaauccaccaugcccaggcagcuauuaucuuuauuaccuaaauagauuuacuugauuuuaugacuuuuauauuaucauuuaccaaaguuguaaauuuuuguauuuuuaaaaaguuuccauucucaaccauuuugguaugaaauucuucacccauaguaauuugaaaaguauauguuaugugcuauucucgugauagugaauaagucucacgagaucugauggguuuaucagggguuucugcuuuugcuucuuucucccuuuuaucuugcugccgccauuaucaccucccaccaugauucugaggccuccccagccauguggaacugcaaauccaauuaaaccucuuuuuguucccaguuuuggguauaucuuuaucagcagcaucaaaacaaacuaauacaccccaugucuggaauucucauaccagguuuauaccauuaaguuuguuggaguaacacucagauaagcguggauggcauuguggaggaagggcaaacccugagcacuuucuuaagccaccuuucucaugcacacauuauuauuccccugccugcuagucaucuaccacauguaaaguaguggcaaacaucagacgcuuuuaccaccacauagaguuugaggcucucagucaaaaugacucaaaugccgcaccugcucggucccagagcacauuguuauuuucucaaguaccgauacgugcuuuugaaggaaaggagguagugcagacauggcaaagggauguauggauuuacccucuugugcugaacaccaugaaaugcuuuucuuuaaacaaguugguuuucugaucuuacagagauguugucauucugugaaagggggaaaacugugaaggcucauuuaaaaguccucccuucucaccuugauuuucugagcacuaugacucuuuugaaugucaucucuccuccuggucuuuuaccccucucuuucuuugugggaccugacuucuccuuccccuuguguuuauauugcauagcucauucuagcugacacauuuuguuaguguuaucagagagauuagaaggaguaaagucacugagaguguuguuucuccuucuuccaggucaacaggcuuacuuucaaagauagcacuccuuguuugcucugcuugggccauaauugagcaguaucaaguuugcaguuuauucuacgucugacuuguuaauuuaacucacaguguacugauuuuauaugcagcguugguucauaucuuggggcucagaaucuaacauauauauuaaacugucaagacacuggcaguaggagaaugaaugcuucauaauuugaucaucugagccauuuuaacuaauaucuguaucuuuugaaucaaaugaaaauauacugugauaauuauucuuucacugaauguuaauuaaguguuguuuuaagguuagaauuaugaaaauaauuucuaguaaagcccccguuuaaaagcucuaccccuaaaaauaaaacaagaaaagcaaggaaaaagaaaaaauuccuaccccacauagcacauugucucuuuuuuccaauuucggggcacucaugugagauuguaggcauucuucaaccacgaagcaacuuuaccaacucuguuaaaauugccacuuuuaacauggggaaaaacaagauaauauuuauuaacaucaaaauauaacaagcugguaaauaucuuuacuauagaucuaaaugcacaaaauauagggcugcaaaauaaaagaccuagaaaauauaauuuuuucuuuuuucaaaauuaagcauagcauauugagcaaaugaucacaaaguacauccaaguuaguuuauacauguuuagcaaucuguccuauaugauuuagaaagcuacgggaucacauuugcuguuuuaaauauuuauuguucugccauagcauacacugcuuauccaaauuauuuagacaccucuacuuuaacgaacuauaacucguagauccuacuuagcauagauauaaggaacuugagugagaacuggucauauugcucagaaaagaugucucaggauguaguaucauucuugcuuuacaaaucaaaguguucauccuucaugauaaaaagguuauuuaaaauaucagaauacuuuauucuuugaguugugcaaugcgcucauaacuuuguaaaagauucaaaauugaugguuuaaauauuauguguaaacuugauaugcuucuaaagacaauuauaguacaaauuaccauauuuuggauugguaauuugaaaaauacuaaauuacuuugacuuuuuaauaauuugguuugauaagguagaaggcuuuuccaugauaucugauagauuuguggguucuaugucuaagaaaaugcaagaaagaaaaaauggugaagaaaauauguuagaaaggaccccauaaaaagaaaaugaaaggacuuugauuccuggcaagguugagugcuaaaauaugugguaaauuuccaguacaaaggaguuagaaauguuggguaaaaugcaauaaacuucuuuuuaaaaaaguauuguugaccuucuuuagagaguaagcggucuccugggcaugcaaauaaagaggaaacuaaaaaccagaacaguaaauggacacugauauugcagcugccuuggggcauuugucagccucaggaaccuagagguccaaguuuuaacagcuggaucacuacugaagacagggccuugggccuguacaagaggggauggagaauugaaaccuccuuuuuauaaagcauguaauuuuugaaggguuaccucgucaauuaaaggguagaauagaaaaaaauccaaucagcaaagggagauggcaaggaaauuugucuuggcaaaagcaagcaguucuucucuugaggaauuugccuucaauuuaggccuuuguucuucccauggauaaagucuucuaaaacaugaguucacaacccccaaucauagaaauauacagggaauauguaaccauaagcuggagucagcagaaacaauaagcaguugguauggucaggcuuugcguccccacccaaaucucauuuugaauuguaaucuccauaauccccacguguuaagggagagaccagguggaggucauuuaaucauggagugguuucccccacucuguucuugugauagugaguucucaugagaucugaugguuuucuaaagggcucuucccccuuugcucggcacuuauccuuccugaugccuugugaagaaggugccuugcuuccccgucaccuucugccaugauuguaaguuuccugagaccuccccagccauguugaacugugaaucaauuaaaccucuuuccuuuauaaauuacccaaucuugggcaguuuuuuauaguaguaugaaaauggacuaauacagcaguucaguuaguucccaauaacuuuagaaaugagauuucugauuacagaauaucaaaugucuauguuuuaaacauuuaagaaauagaaauugaauaaaaacauaguaaaaguaguaaaagauuaagaugcugccagagaagacuaggccgacuugagaaagaacaaguauaccucuaaaaaugaaaauguuaaauauuuaaaaauuucuauaaauuuaagguguacaagugcauuuuuguugcauagacauauugcguaguggugcagucuggucuuuuaguauagugaucacccaaauaauguacaucauaccuauuaauuucucaucccucaccugccucucaccuuuccaagucuccaguuucuauuauugcucacuccauguccaugcguacacacuauuuagcuuccacuuguaagugaaaacaugaguauuuggcuuucuuguuucauuuaagauaaccgccucuaauucuaucuauguugcugcaauagacaugauuuuauucuuuuucguggauuaauggguuaucaugagauugggacugguggcuguguaaccagaggaagagagaccugagcuaguacagucagcccccugcccaugugaugcucagcaccaccucaugacucugcagaaaguccucaccagauguagccccuugaccuuggacuuuccagccuucauaacuguaagaauaaauuuauuuucuuuguaaauuacccaguuuuagguauuauaagcaacagaaaauggaucgaaacauauuuugaguucagaauuucuguauuggcauuuccuuccucucauugccucuuagcauuuuuuucccacaccauaggacucuacuguuaaugaaaacccgauaguccuauagacaguuguuuuuggauaaacacagcaauugaugcuucuggcccuaaaguuugaaacuuaacauuuguuuugucugacguccuuccucaggaauggacuuucaggccucccaaaaaaguaucuaagaaucaaaaaguaggcuaaggacauggacaguucucaaaagaacauauacaaauugccaauaaacauaugaaaaaaugcucaacaucacuaaugaucagggaaaugcaaaucaaaaccacaaugcgauaccaccuuacaucugcaagaauggccauaauagaaaaauaauagauguggguguggauguggugaaaagggaacuuuuacacugcuggugggaauguaaacuaguacaaccaccauggaaaacaguguagagauuccuuaaagaacuaaaaguagaaguaccuuuugauccagcaaucccacuacuggguaucugcccagaggaaaaaaagucauuauacgaaaaagauacuugcacaugcauguuuguagcagcacaauucgcaauugcaaaaauacagaaaccagcccaaaugccuaucaaucaaugaggggauaaagaauuuugugugugugugugugugugugugugugugugugugugugugugucugugugugugugugauggaauacuacucagccauaaaaaggaacgaauuaauggcauuugcagcaaccuucaugaaacuugagacuauuauuguaagugaaguaacucaggaauggaaaaccaaacauugugugaaguucuuacucaaaaaugggagcuaagcuaugaggaugcagaggcauaagaaugauacaguggacuuuaggcacucgggaaagggugggaggggagugaggguuaaaagacuacaaauuggguuuaguguauacuacucaggugaugggugcaccaaaaucucccaaaucaccaucagagaacuuacucauguaaccaaauaccaccuguucccuaaaaaccuauggaaauaacaaauuaaaauauuauauuuaaaauuaaagaaaaaaaaacugaaacucaccagaucacuaaauccagacaauaagaugcuggaccccucauucaccauaauugcuuccuugcccaucccuaguucccguuuucuuuacagauucuuucauuucuucgcugcuauauaaacccuuaguuuuggucagucagggagauugauuugagacugaguuccugccucuuuggcuguagcaccugacugaagccuucuuccuuugcaguaaucaccaucucagugacuggcuuucugcacagugagcagcaggaccuagacugaacuucugguguuucuguaacauuaauacaagugcuaauuuuucuccuaacuaguuauauucuucaaucuguccuuaaaaaauaauucaaacaauuggucauuauuuuagcuuaacuagcuuuuaaaucaguuaccaugaaaugugacuuggaaaaaaaaacccguuagauaaagauauuuauuuaacauaaauauuuucauugcaucuuaaaauacuaguguauaacucuaacaaacuguguguauacaggcaugugugaaauuuacuuuuuuuaggauuagagaacaucuauauuugccuucaagcucccuuaaaauaguuuagggaaccauuuagcaucacuuuccaugccauugaacucagaguuaaaaucgugauugagauacuuauaaugcaaauagaaaugucccgaggucauuguguaauuuuauaggggucuucaccaaagcaaggaagaaggcaguaaguuuuauagcgugauagguggccuuuaugugaaguggguugaaauguugcucucuguguaggcacacagugcauggaauaggcauuucauuauguucauaucuaccuguauuuuuccuuugaucaaugcauauguuugauuaaacagaaugaaaaucuacaaaagugaaaauacguauugaaaaaaguaauagcgguaaagcaguaucuugcagcuuuuuacuuugagucccaguggauuagcgauuuuacuuuacucuagaaaugacaguauagugaugauuauuuuucuuuugggacugauaagaaaagaaauggugcccaauuauauuagucauuaguauucuuuguuauaaguauuaugggaagcuuguggagcuagaagaacguggccugaauauauuuuuaaacaaguaaauuaucuuucaguauuggcaaaaaauguaguuugucugccuuagaaaaauaaaacguucauacauaauuuagcuugucugucauuuuaaacaauucagaaggcauagcccugucgucuaggccuauuuuuuuuuugucaagagaugcuucauugguuccugugugaaaguguugacauuuauauuacacucugaauacuuaagaaaccagaggauuccaguucuuuuggaauuaaccaaugguaucucaucuacuagucaggcauucacaacauugugugcacaugcugaauuugugcuaauggcuucuugccauagguacauuuugugaaugugacuauuuauauagcuucuuucauauauggcccaguccucauucccuuguagccacccuccuuccccaaauguguugcuuuauguugaauaguuuggaaaagaaacacaaucuggaaacuaugcuguggucucuuagguagaauaaccaacacacccagcaauuucucagugaauggcugucauaguagaggugauuauucaugaucaugaugaaauacuuucccugaccaauuuaagcuuccuccuuuaguguuuucauaguuccucuuacaucuguuuacucuaacacauauaaaauacagaaagcugagcagucucauggccuaauugaacaaaccagcccaacagugagggcuaugaaggaauuguuaaagaaaaaaaaaucaguuaauucaugauaccuguuaaagauagaauuuauucaaggggggcuacuacaaugggguuuuguagugggguagaaagaucaguuucaacugcgaauaugucaaggagaaguagagauuuauagccaaggauauggauguggcucaccguauggaaaauuacuaagaagaaacaucaaggguaacaguguucuggcuaaaccaacuugauaggauuauugcugaaggcaggccaaggugguaaaacacggaaggcagggauuaaagaauuugacuagauaucaaagguagucagauaucaaggguggggaggaggaauuugaucagauauucagggugagggacuuuuccucaacuaacccaguaggauuguugcuaaaacuggacugaaggagccaaggacagaacccaaggucagggaccuucucagaaagagggcucagaggagccagacucagguuuggucaggggaaagaauugucagaagacaaaauuacaacaaauuuagcuuaaagaucuuaauugaccuuuauuugcaauuuuagaaucaagcaaugccucauuccauaaaguagaaugaguguuuugaugagcugagcagaugagguuggcuuuacagacuaaaaauggcuguggaaaacaaaaacagacugcaaaaauuggauuggucauuucaaagcucuuuuuuuaaugaaaguuaaagcacagggaacuucuuuaucaugccagcuaaaacuggccuguuuggagauuuggcuaucaucucucuccugguuccccagaaggucagauaaauaacuugcuuucagcuugguggcuugguacuucagcaugaguuauuccauuuugguuuggucucuuggguguagugcgggagcucaguccaaaccaauagccuccuguaaauuuuauuuaacagucuuugucagaauaaagauauuuacuuuuaauuuucuugaagaggagaaagucacuuuuuaagauucacuucacagcaaaacuuuguaaaagcccucgugagauaccuccuccucagcgcaaaguuugcagucauggcagcagcuaaaaaugugccuacaggccgcaugccaccaugccaucucccuguuaccauuaccuucuucuuucucuccuuccugcugaugcagcagugccuccuuggauacaggaucauuccugcucuaggcuuuuuccugagaggggcagcucuccugggauucuggcgaaucaaaugcuucaucucaacagauuuguuuauauucgccccuuuuccauguggugggaggaaaaacuuuuucacuacuuucuuuaauucaaugcuuggggacugcugaauuagaauaacagaagacagauuaacaggauaaaaguuacacaguuuuuauuaauauuuacauacaugggaguucacagaagagaaaaucaaaaaaguagucucagggucuuguaucauucaaacauaggacagggcggauugggcuucaaggggucauaaauuguggggaagugacuaggaauaugggggaaacuaauggaagauaggauuauuuuaguaaggguugcuaauucagucucauccaggugccgacuccucaucuugugauaacuugugauaagaguugcucuccuuucugugguccggaaguacggagcacccucacaagggaaauuucugcccugcuuuuaagcagauaagggagggcagagaacucuucugcaucuguucauucucacuugccuucagcucaaaauaauccuuguguuugagcagcauauuuuaggguaguauauccucaucuccuucauccacaaaagauuuaaggugguuuuuacagaugcaauuaaguaagcuaaacuuaaugauauaugagaaauaugaaacuaaugaaaugauggcucaaaaagucagaagcagccauugauguuagugguuggagauggacugugaauaugucuugagcuuuccagcagucagcacagagaugcacauagauauaccucauuugauuccuugggucuaucauauaaaauaaaccauuugcucagaagaauuaucuguuccugggaaugggauagcuucuagagauucucuugaagauaauacuuuguaauguaaugcguauauuuuuaacaaugaaguaaaugcaguacaacagaguaaauaaaauauuaauaauacauauuuacugaguauauucuguaugccagaaacacauuagguaugcuggauauguaauagugaaccagacagacaugaccugugucuucaaggagcuuauaaauauaauggggagagacagauaauaaacaagaaguaagcgagcaaaaauaucagauacuuaugaaauccaguaaguggcagguaggaaaucaccagggaguaauacaauaaagaauaaaauuagguggccacuuugagaagguucagccaaaguugcuuccuggggagauguauucaaguugagaaugaaagguucugaggugaggaagagcuuagcacauuucagaaauugaaaagcagccagugugcuuaaaauaaggcuaugcuuaaaaucacaggaagccuucacauggaaaaguugcuacccuuugaccaucuccacuguguacgucauaaucucauggcugauguuucagucugcuguuggagagaccaucucaucucugaugggaggaaaaauaauauagagggaauaaugauaaggcugggucaagagugucuuuggaagacguucacuucucaccuaugcauaaauagugaggcuauggaguaugucugugguaguuuuaaccugaaaaauuuaugaagcaguaguaacaaaaaaacuaccuuagcgccaauaaaccuaaguagaaaagacaaucaagccaaaaguaauccucaagagaguauuucuagaguccagcuaugagcaguagaauuuccuggcauacucuccaaaugugauugcaaaauauacacauuauuaguuguaaaaaaaaauaguuuuuacuaaagucuuuucucuaccaaucuaggaauuacucauugugugcuuuucuuuuuacagcaucgcaggcuuuauuauuugugucuccccuaacugagcucagaucaaugguguacaacucuuuaacaccaccuccugcccugggacacucacagggucuuuggaccuuuuaugggaaaucucaggaaauuauuguugugugaaugggaagauggaacaaaucccagauacuuguuaaacacuuccaucuuauccauauuugagugauuccacuuccauaaucuccccuuccaaugaaucagaaucccucuggauugccaguugugagaaaagaaaauauuuuaaaagucaauagaguucuuaguccuuuucaaacuuaguacucagucuguguccaguagcaauacguaucagucucuguguaaaaaucaguguauguucauguacguuuuuauucgagaguuuuccaacagcaccuuaaccuuucuccuccuccuuagaauuaguauuucucaauaauauugucaaugaaguagaaauuaauuauuugccacauguucgguacugugcuaagcgcuucacauguuauuuuauuccauuuguaccuugguccuaugaaguauguccuguuguauccuccuccuuguuuuggauagggaaacugagguccagagaauuuaaguaccaugccccuuguauuaggguucucuagagggacagaacugauaggauagauguauauaugaaggggaauuuaguaagaaguacugagucacacgaucauaaagugaaguuccacaauaagcugucugcaagcugaggagcaaggaagccaguccgacucccaaaaccucaaaaguagggaagccaacagugcacccuucagucuguggccaaagguccgauagccccuggcaaaccacuggugugaguccaagaguccaaaagcugaagaacuuggaaucugauguuagagggcaggaagcauccagcaugggagagggauguaggccggaagacucagcaagucaaaauucuuccaccuuccucugccugcuuuauucuagcccugcuggcagcugauuagauggugcccacccugcuugagggugggucugccucucccaguucacugacucaaauguuaaucuccuuuggcgacaccuucacagacacacccaggaacaauacuuugcauccuucaauccaauccgguugacacccaauauuaacccaucacacuccuaauuacacaguuagaaagucguguagccacgauucaaacaaacccaggcaaucugauuccagggcccacucucuugauaaucacauggauuuaaaucaauaaaaaaaauauaaaaugcugucuauauucucggcaugggugauagaaaaauagccguguagauaaaccuagccuccguagucccuggcagagaaaggcuguaaggaaagugucuuuucuguaagaggaaggggaagcaggauaggaagacacaacuaaggucucagaugaggcuucagaaaagagauuauuuaugacauaagcuucaguggguauggccagguuguguagggguguucaaggcugaagagauaaugcuuaccagggagucucacagaguaaccccuggaugaacaucucuuaagauuguuagaaaugcuggcugggugugguggcucaugccuguaaucccagcacuuugggaggccaaggugggcggaucaugaggucaagagauugagaccauccuggccaacauggugaaacccugucucuacuacaaauacaaaaauuagcugggcguugugugugcccguagucccagcuacuugggaggcugaggcaggagaauugcuugaacccgggaggcagagauuacagugagccgagaucacgcugauguacuccagccuggcaacagagugagauuccuucucaaaaaaaaaaaaaaaaaaaaauuguuauaaaugcuaagucucagaccuauggaagcagaaacacugaauguugggcccugaaaucugcauuuuuaaagccuuuacaggucauccuuagguaugcucaaacuugagaaccgcuauaaaugcucagaagaugagagaaugugacuuauuucaagaauuacaauauuauuuccauuccucucccuugcaaccuaaaagaaacagaguuguuuaucauacugaaauugucuaccuuuggucuaacaguauguguaaagaaaagcaauugaagauauauucucauuucauuuauuuuuauuuuuuaaauuguuacauaaugugcauauuuugggcguucuucugaaauuuugauacgugcuuacaauguguaaugaucaagucaagguaauugggauaucugucacuguaaacauuuuucuuuauguugggaacauucagauucuucuagcuauuuugaaauaugcaguaaauuacuaacuguagucacccuauugcaccaucauacucuagaucuuauuccuuuuaacugcauuuuuguaccuauuaaucaaccuuucaucaucuucccuucccacuaccuuuucuuugugcaauggcgcaaucucagcucaccgcaaccucugccuccuggguucaagcgauucuccugccucagccucccgaguagcugggauuacaggcaugcaccaccaugcccggcuaauuuuguauuuuuaguagagauggaguuucucuauguuggucaggcuggucuggaacuccugaccucagguaaucggcccaccucggccucccaaagugcuggaguuacaggugugagccacugcgcccggcccccacuacccuuucuaacuaugguaaucaacaaucuacucccuaucuccaugagauucauuuuuuuuuuuuuaccuuaccacauaugugugagaacacacaacaugucuuucugugccuggguuuuuuuauuuaacauaacgacuugcaguucuaucuauguuguugcaaaugacagcuucccauucuuuuuaauggcugagugauauuucaaugugugcauguauuguaguuucuuuauccauuuaucuguugacagacucuuagguugauuccauaucgugguuauuacgaauaguguugcgauaaauaugaacauauagguaucuuugauauauugauuuuuuuuauuauaugucuagcauuuuuuuuaauaagaaaguagacuuuguggauagcagguuuccacauuucacuuucacuuuucaccucuuucucaauaguugaaucccuucccaacuagccucuuacucuuaagagacuucauauuauuuaauaauguuauaauuaacuaaugacauauuauuuaaguauugggguaaaaccaaaccaucaucaccuuaaauaagucuguauugauaauuguugcagugauauagagauagcaccuuuucuaguccauuaucauugauguucauugaguugucucagcaauuuacaaauuugaaauggaauuccagaggcaucugaauuaugcuuauccuaacaauuauguuguaugaaucaaaugcuauuacaguaaaagccaaggggaccauccaaauucauuuguuauacugaaacacaacuguauguggggauugcuugaaauaauguuuuauuauaugaagauuaacauauaaauaugguucaaauguuuuucauguuuuagagguuauuuguacugcuucuuaggucauuaaaaaauaaaacauuuuacugaucaaggggcauuuaaagcaugacaguguuaaaguaugccccggcuggcaaagcggacuuccuguggcuaacugaggugcucauuaaacagaucagguggccguggcugggugagggagcagucauguacucuguguuuugcagagaugcuguuaaagugucacaggaccucccuuucuacgaucaugccaaaccaguuucuguugucaaugcagagauaggcuguagcuggaagucccccagcugaccaccaacagaccaccugacaccaaccaacugaccacugaaccagccaauuaagaaagacuggugauuuagggcuuaaaggucauccagucaauacuauuccucacuccccugacucuccuccucuguccuacaguuuuugccuucauaaucucugacucuucaacccauccucagagccagcacauuuucaguuugcacuguagguuucugguccccaaucugcauauugcuuauagaaaauauagcuccucuuuuuuuuccccauguaccuuauggucuuauauuaacaguauuuuaaaugcaaaacaaacguauguuuccacucaaauucuggucucuuuuucuguauaaucuuuguuguuguuguuguugauauugacaagagaauaacauaauuauugauuucuuauagcugcuuuagagcagugcauuaaucccacuuuccucuuuacuauguuucuguuguugcauuuaccacaauuuuauuuaauuucuuuguuuacacaucagccucucccuuacuaugucaugagggcaaaaugucuuauuugucacuauaucucuugucccuggaacauuauuaguguaguuuuucuuucugaugauuuuacaaauggcucaauuagucaaucaugugcaauaauucauuuaauaaacauuuuuugagcacagacuuuguguuaguacuguuaccuguuguaggaaauuuguucuaaguccuggcugcaucauguuacuuagggaacuuugaaagaggcucuuuacuccuacacuccaucccuggugauucucauacuauaggguaaggcuugggaccugggaaguguuuguuuguuuguuuguuuuaaaaaagcucucauaguaauacuaguguucugucaugcuucaagauaaagagauuguccuuucacuagacuggauauaucauauucuuccuuuucuuugauuaauaucuuugucucuguuuuuuuaaauuuuuuguuucuauucacaagaaaaaaauagaaauugggagacuugaguagcuuauuuucaaguuuaaggaaugggaaggcacuucaauauagauuaucuuauuucacuuaauaauuuuguaaaguaaauguuauuauuucccuuuuuuccauugagcauugaagguuuuuaaaacuuacagaaagccacaaaacgaguuaauguuagaauauggcuuggaauccagagguguguaacuccagagcucauauucuuuucccuuaauuaaaagcaauguuaaagaaaaaaauuauucuuggcacuuguuaaagauggugagggaggcuuuauucaaggggccuuggccauagguauggggaccacugcgauggggccucgcagugugggagagagauugggcucuacccugauuccaacaaggacaaguggggauuuauaaccaaagagcauguggugcaggauuggguggaaagucccuaaguggaagcaucaccugcaggggguuucuggcuaacccgacuugauaggaccacuguugaaggcaugccagaugauaaguuauccacgguggucagauaccaaaggugggugauuuucccuaaacugacuuaggauucuugcucuaauuggauucuacaaaagcagagagggaaacccaaugucugcuuacucagaaaggacucagaggaggcuggcucaaguuuaggucaaugaagagagucuaucaccagcucugcuguaaaaccaaaguuagcuguuuuauaaauguguuguacugacugcauauguguucuguuuuaaaaacagaagaaaaugaaugaguuauuucauuaaaaaauguaaauaauuuaugaaaaaaaauuauguugauuuaugugugugaccuugguuguguuguguuuuguuuaccccugcucucuguaucagugccuuuccgcggcgggggugguggugggggaauccuggucuauuguuuuuuuaaaaaacauuguguauaguuuaaguagugccuucacuucuguguugagacuguuauucuuaaagaacaugcaggccaguuguggugacucaugccuauaaucccagcacuuugggaggcugaggcaggaugaucgcuugagcccaggaguugaagaccagccugugucucuacaaaagacacaaaaauuagcuggguguaguggcgcccgccuuuagucccagcuacuugggaggcugaggugggagaugcaccuguguguaugagguugagguugcagugagccaaaaucacgccacggcacuccagcacagacaccagaguggugucaaaaaaaaaaaaaauauagaagaugcgaugcauauagauauacaacuauuuuuucacacuacagacuagacuauauaacuauuucuuaaacuuacaaaaacagcaaccuauauucagugugcacauuaacacacucugugccuuguuuuuuucuuauggcaaguauguuggcuauuguuuuucugucuugguggcuuugaggccauguacugugauuuugcauagcauguuaagguuuagcaguugaugguuaauuuauuuguguaugaugugugucugcaauauggaaauuaaaagcugacuguaacaauaaauuaugaaaaugaaaaaguaggcaauaaaauaggcaugugcuuugcaaguucuauagcauuauauuguauuucuuguaaaacugcacuaccuugagguugcuuucuagaaguaauguuauuguuuaguaucagcauucacuuuuuuuagaaucacauugauagauaugauguaaauauuugcacaggugaaauuaaaauacacaguaaagaggauaguucgaaaucuuaagagagggauauauuuaauuuagaguguuuaaaaugcauguucuuacacucuucucucuguuuggaauucucuuucccuuuuuugcuccuggagcaaauugguuugcagccccucagguccauuccucaaaagagccuucuccgccugacacuuuccuagacugagucaguguuuuuucccccagucuguaccugcaaugguuuuuuuaaguguaugucuuaucaaccuaaaauaagcaacagaaagaccaacucgccaaagaguuuauucaggaauagcaggggagcaauccagaauaugccugcuaugauggaucauaggcgcuuccagagaggcaagggaagguaagagucuguaaaggcaaaaugagggagguuacaguaguuguuuagcaucaguucguuaguggaacaggcaguugcugggcuggucuccuuguagaacuaaucuguauguaggguugcgguggccuuuauguaauguugugguuuuggcagucucuuaugauaauuccuguugucaagcaaacaugcaugagggccugucuuucaucgcauccuggcuccauuuuguugggguuugaauaagugacucucuuuugacauggacaacuuucacagucuucucaaguacaugugagcuccuucauguaaggaccaucugugggaggucccauagagucugaaacauugaacauucacuaaauguuugauuuugauuuaaugaauaaaauuuauuguuugcaauagaaaauguaacagaacaacuaauuucacauuauauaauugugacauauguuaugauucuuauuuucagaaaaaccgaggucugagguagcuaaauagcuuucugaagucauacagauugucccuuagauuuagucugacauuauguucauguguuauucaauccuauaugcuuuucaaaaaaaccugcauuugcccagcuacaauccacaugacacuauugcuuccaagaaauguaacuggaaucauggccaguggaggggaaauggauuuuggaaaaaacuauuaaguaaaaguuaauaguauuuuuuacuuuugacuccaggacuuuucucaacuauaaugugcuaaagugcauaguaccaaagagauugauuuaacacgcaauauuuuacaguuauauguuaacagaagcccucuucaaaauuacuuauuuucucuugagggacuauuuuuuuuuaaggauguaauuuggaggagcuacacuaaucuauucuguaagauguugauucaaguucuuuauaucaaagucaucucaacuuuguauguuaacaaaagaaauugaaaauauauugguugugggcucuuuuccuauauucgacucugauaugcucuauaaguuuugacaaauuccaaaauugcaggaaauuguuuccauuuauucauuagcaagggggcuaucugaggagacacauggucaaauacucagcuuuuggauuugugaauuucagcuuguagucauuguuuugcuaagaggucuuaguuaagauguauaugucagaucauacuauaauaaauaauagacaauccaaauucauuuacuuuacuggauuuauguuuuuauuagcugaaggagguuggcuugguaauuguuuuuuauauggagacuuaaguaucaaauauagucuaaggaacauuacagggaccccucucuguggccauuauuuuuaguuaguaaaggggaaaaagaggccuucucugauagucaguauuaacuuaguuuaguagugucuguuguaagauaauuuaacuugaucaaauucaaauauuaggcuuagaaugagcucaggaguucaaggucagccagaguaacauagcaagacccugucuguaucaagaaaaaaaaaauauaauguauucuuaccugguguaauaaauagaaaagaccagguaagcaguaugagaauaaaaauauagauacguauguuaaugaaaauaaacauuacuuugaacuugcaagugguauuccaccaaaguuaaaaacaucuaugaagucuuacuuuuccaacuugaauuuauccauagauaauuaaaaguaaaauguccuagacuugagaaauuuuuuauuauccaaauagcucuuacaugcccccaaaagaucuccacagagugcaagagacuucauaauucagcauuaaucugaauuggaacugaguugaagcauaauauugccuuaaauauuuuaaugaaggagaauauuaaccugauuaaacaagaucaacaggcucaaaauggaaacauuugccuguuuaaucaacaguguuuuagacacuguuaaggauuuugcauacaguggggccuuguuaugcugguuguugguuagagugauucccccauuauccaugggaaagacauuccagggccuccaauggauaccugaauccauagauagugccaagcccuauauacacuguguuuuuuccuauauguacauaccuaugauaagauuuaauuuauaaauuaggcacagucagagauuaacaacaauaacuaauaauaaaaugcagguugaauaucccuuaucugaaaugcuugggaccagaaauguuuugcauuucugauuuuuuucagauuuuggaauauuugcauguauauaaaaugagauaucuuaagguuggaccccagucuaaauacaaaauucauuuauuuucauauacaccauauacacauacccugaagguaacuuuguauaauauuugugauaauuuugcgcauauaacaaaguuugugugcauuaaagcaucagaaaacaaaggugucacuaucucagccacccauggggacaaucugugguuguuuggaaucacugucauuuuucuuuuucuuuuucuuuuuccuuuucuuucuuucuuucuuuuuuuuuuuuuuuuuuuuugagacaguaucucccucugucacccaggcuggaguacaguguggugaucuuggcucacugcagccucgaccucccacacucaagugaucaucauuucugacucugaauguauaagcuacugauuagcaaucauuuucuuacgcuuauucacacauaaauacuuaauagcaaaauauauaacauaccauuaaaauagugaaaaaauaauguguucgggguaucuaagcagcacagcagcaucaccagaacacccgcaucagcugcugaaccacagccagcuuugucgccaccaacgaugcugguuuguucauucucuucucuucucuucccuucccaucuugacaaggucucacgcuguugcccaagcugcagugcagugaugugaucacauuucacuacaaccuugaaaucaugggcucaagcaauucucucaccucagccucuugagaagccuggauugcaaguggggcaucaugacuuccagccaauuuuuuuuuuugaauugcuauguugccgaggccagucuaaaacuccuggguucagaugauccuccugccuuggccucccaccucacugggauuacagaugugagccacugcacccagccuguauuuuauuuauuuaggugagaagaaacaucagaagcaguugagggaccaagaaguggaucaccuagggaugaggaagcauugugcuagguggcuuuuaaaaaugcuuccagcagagucauccguggcuccauaacaauuuuugucuuagaagucuuucuuuaauuuuauaaacugccauguucuguuaugaaugugcacugcucuaguccuucaguaagcucaucacauauuugcaccauguugucuguagauaguaauuuugcaguguuaacaaugccaucuuuaucgucacuauuaucacaaucaccuugauucagaaccauuuugguuauuuugccaucagucaaugaaugaaauaacugaagccucauuaucaauguuaaauuucuuuaacauccacuucuuccagcauacugaugaauucugaagauacaucuuuugcauauguaaggagaucagacuuuuuuuucucacuugacaugugaaauccuucaaagucagcauuuuguucaucauuaucacugaacauagucacagguuagaagcugugccaggcacgcaccacugugucuuuagucacaguguucuagguguuggcaacagcauauguagcauuauuuaugcuaaacuccuuuugaauaucuuccacaaccacaccaauguucauugcuacguugcugcuagcauguuguucaagaauacauuuuuauauucacucuacauugauguaaggauaccuucgucacauggaugaauuaauaaauucacauuuagggggaguauauguggcaugaacaugauuuuugaugagaauuucugcuggaggaugagcagaacaguggucaaggaauaauaaaguugugcauuugucaucccggccagcuuccuuucagugagcacaagucacugguacaaaauguuugugaaaccgaucagaagagauaucccuggugauaaaugccuuuuuguucauauaauaauagacuaguaagaaaaucacuccuugaaaacugugagaucauagccuuuuccuaucauaacaaauuacgcuuaugcaugccuacugcauuagaacaucccaacacagcuguucugucuuuggcauccuuaauuccuguaggagcugucucaucagcuguggccagugucguucugggaccauacaccaaaacagugauguuuuaacagcauuauagacuuguucuggcaucagauuuccaucagcgaugaccuuggcaaauucaucagugaauugcucugcuccuucauggucagcagaugcuuucucacuguauaaaucuuuaaaacaaauugaauuccauguuuaaguuucuauaaguagccuguugaauauuuacaguucccuucaauuuucaguucaucuugauagagcuuugcuuguuucaucaucagcaauaccauuaagaggcauguguucacugugacacugaucaauccacucuuucaacaccuaagauuuuaaaaggaauaaauuaauuuuuaaauagugacgagaacuugccauguugcccaggcuggucuugaccuccugcaauuaggugauccucccgucuucucccaaagugcuggaauuacaggugugagccaccauggccaucccuaagaucuuuauuuuuagcuuuaugcaguguuuuuguauuuuucguuaacuuuguuuaucacuuucagcauggaacuucaacaguuuauccuuguucuucaggucauauaugguggucauuguaacaccguagucuucugugacauguuccauacuuacacugcuauucaguuucuccaacagccugacuuucagugcuauagagaaacauaaaugcuuucccuuuuuccuaucacuguuauucauagccuucuugacauuuucaacaauaucuuucaccacagagcagagaauaagcacaaaaauacagugaguaaugcacguaggucuuagccccauccuggggaaccuguccuugcugcaucuggccuguacauguggcauuguauuacacuuugugagugugcuuuuaugggagggauccggguguguguggaaaagauacauugcagcugaagggaagaaaaaaaucuguccugggaggguaauuuguuccuugggagugcugaauaaacuguguuguacaccugaaguugaacugugacuugucaugugaggucauguguggaauuuuccacuuguggcaucaggugaugcucagaauguuucagauuuuggagcauuucagauuucagacuuuuggauuaggguugcucaacauguugaacaauuauaacaauaugcuguuaauaauuucacagauuuguucuuaccuuagaucuuaguaaccucagcauaugauuuuauuuucuuuccguaaguuaagaacuuuuaccuuuucacuuagcagaaaagccggguagauacuauacuuuuuaaaaauuaagagagaggcaggcacgguggcucaugccuguaguccaagcacuuugggaggcugaggccaguggaucacuugaggucaggaguucucaagaccagccuggccaacauggugaaacuccaucucuuacuaaaaauacaaaaauuagccaggugugguggugugugccuguaaucccagcaauucaggagucuaaggcaggagaaucacuugaaccugggagacagagguugcagcgagcugagaucaugcugcugcacuccagccucagugucagaggaagacuccaucucaaaaaauaagaagaagaauaauuaagagagauuauuucuaaaauuauaaauguacuggaacugcuaguuaaauucugucugcuucuaguagaaacuauaguuacuaaacaaauaaaaauauaguaguuccuccuuauccacaauuuugcuaucugugacuucaguuacccauagucaauugugguccaaaaauauuaaauauuaagaaagcauuuuauggcuuauuuuugguauauccaaauugccagcaucacuacuuuuggacucuggggccauuauuaaguaaaauaaggguuacuugaacagaagcacugcaauacccgucugagaguugacuucauaaucgagauggcuacgaagugacuaauggacagguagcguaaaacgcacggauacacuagacaaaggaaugauucauauccuggaugagacagagugggacagcaugagaugucaucacacuacucagaauggugugcaauuuaaaaugcaugaguuguuuauuucugaaauuuuucguuuuauauuuuuggaacacaauugacugcagauaacugaagccacagaaagcaaaacuguagauaaggaggaauuacuguauuuuaauuuguuuauuaaacuucguuucuacuagaagcagacagcauuuaacuagcaguuccagugcaguuauaacuuuagaaauaaucucucuuaauuuuuaaaaaaaguauaguauccaccugccuuuucugucagguuguguauaaacuucccucccagcgaguuugaauuaaugucauuuugaugaccaccauguguauguguaagugcaauucuguaucugugugugugaaaaauuguguaugaauccuuuuauuaguuccauuagccucaauauaauuaaauuauuguacuaaaaauauccagauaaguaauuuccagcauacuacuaugauuuuacuuuauaagaauuuacaaaauaggcuuaucaauuacaaaaggauacagcaaaggagaugugcacaaacauauuaguauuuguacuuauauuuacauuuauacacacauacauggaaacucacaagucaucauuagacauggcuuuugguugacuaagagcccucucugauaggagaaauauagugcaagccacaaauguaauuuuauuuccaacagaaauaauaugagccacauuuaaaaaguguaaagaaauagaugaaauacauuuuaauaauacauuuuauugcacccaguacauccaaaauacuaucucuucaaucuguaaucaauauaaacauuuuuaacgagauauuuuacauucuuuuuuucauaucaggucuuagaaacccaguguguguuuuauacuuagagcacaccuccauuuggacuagccacauuugaagugcuuaauaucccugcauggcuuaugaguggagcaaggggaaaagguggagagggaagaguaccugucucucuucuucuuugcuuaagggcacuaaucccaucaugagaucccacccuuaugaccccaucugaaucuaagcaccucccaaaggccccacauccuaauacugucacacuggggauuagggcuucagccugugaauuuggggaaacacagacauucagaccauagcauuuauaaccucaagcuuucacugucucuaucccaguaaaccagagcucuuguaagacauguguguguacacauuaaguggccuuuuuuuuuuuugccuguucuucuuuaagaaaaccaauauaaaauugaagcuaagacacuaauuuaggacauaauuaauuguugaggugcuuugaaggaucuguauugaagcauuuacugguaaaaguauagaauuuaacauagauccaugauuagccaagaaaaugacagaaaaugugguggugcaugucuauaaucccagcuacucuggaggcugaggcacaagaucacuggaacccaggagguggagguugcagugagccgagaucaugccacugcacuccagccugggugacagagugaggcuuuuuauugacauaucaaaagaaaauaaaagaugauagaaaagccauuguugguuuuuuuuuuucccuccacaagagucuacucaaaaaagucauuguuaaagagaaacaaagaaaaaguuaaaaaugaaauaccaauuaauuaaguuuucuauuuuaguguagauuuuaggaaucugcccaauuuuugcucaccucccaggugcuuauuucugaacaauauuugcccuuuauuuuuuauuuauuuauuuauuuuuuuugagauggagccucacuccaucgcccagguuggagugcagugauacaaucucagcucacugcaacuuccaccuccuggguucaagcaauucucuugccucagccuccugaguagcugggacuacaggcgcacgccaccacgccuggcuaauuuuuguauuuuuaguagagacggaguuuugccauguugggcaggcuggucuugaacuccugaccucccaaaaugcugggauuaugggcaugagucacugugccuggccucauuuuuguuuuugauggaauggaauuccuggauuuugaaauucugaaacucugguuaucaugagugacagugaacaauuacuuagauaauggaaugauaaaaauaccagaaauuuuuaaggugcucugugguucauauuauuuauaaugugcuuuuuugaaaucuucaagauagaaucuaauaaaaacuuucagacucagaaguuggaaguaggaguacugacuucuuaguauaaggugaagcagaaguauaugacuccuuguuacaaggagaaaaagacacaaaaaggaagaauauguggucaauacagaaaaauaggaauucuucauacgugacuugauaaacuaaaauaaaugaagaauuugaggcauuuauuaucauaaucucuuguugaguuugugaugcugaguuugggaaagaacaaacauuuuaguuggcuagauggggaacauugauaugaaacaauucaguggguuaccuaguccuaauaaaagaauuccauuccacagcauggagaaagagagaucaacauuaauugacauugaauggauuggaagaagacaaucaacacauuuauucauuuauuuauucaauaaauauuuauuggacauuuauuauuugcugcagaacagacaagauucccugccguuguagagguuaaauucugaugagagagaaguguccauuuuguugugagcacugugauggguucuucccguucauucucucauuuaaguccugcagcaacuuauggcauuaucauuauuucccauuuaaagaugaccaaacugagucucaguaaguugcugaagauuacacagcuuguaaguaacuggaaagguaauugauguauacuuauuaacagauucaucaaguuacaugcauuaaauauguacagcaucuuguuugucugucagucauauccuaauaaagugguuucaaaaaacaaaaaucucaguuggucugaccccauggauccauagcuccacuacuguacugucuccuuccauggucacacuuuuuauaggaaucccuuaccaaauguccacauuuaauaauuuuagaacaugugaguuugcucaucauucaguugcauuuuuucagagcaguuauuuuggaguauuaggcuugguuaugucuucaaagaaaugacaucugauguggcuguucugaucugguugcacaaauggcuacuucucgucaguaacagcaggaagauuuguaaugggcacuguguucagaaagguucugaucagcagcuuccucuuuacuaguguagucuguguaauugcaaaggacaacaaguuaucacuaggcugugucugccaagguggacauugauggaggugcuguagaaacauauagauuuuguggaggaauaggacguaggagaugacaucaaggaggaagaaaagauaaaaaggaagcaagacaguuccaugcacagaccagucagcuacagugaagcauccugcaaacuggcaaacugauuaucagcaguggcugucaccaggcucugccccagcaggugagaguugcuaccugccaauuuguuuagacaccuuguuuguuauuagauuaagguuuugaauacaucugauccaagagaauggggcauaaucauauuuaauguggauuuggccagaccucagacuacauagcuggaagauuaugucuauucauugccuaagugaguuuagcauuguuuuaaaacauucucugauggacucaucacuaucauaaucuguuuucuuuuuuuuuuuuuuuuuuuuucaaagugguaugugguuucagugucgucgugaagacucuguggcuuuuuagccaaaucaucuuaaugccaaucucuuacuacuugugaaaccuuggauaaaugacuuaaucucuugucucaguuuccuccucuauaaaauggggauagcaauagaaccuacuugauagcauuuuugugaguaaagcacuuugaagagugcuuggcacaugguaaaugcuguaggcauuagcuagacugcuauuacugugauuauuguuauugcuguaguuauuauuacacauauguuauuacaccaaacuuaaauuggucaccauuauccucuuagcaucaaaugacagaugaacaagagcauuuacuuuuagauuccuggcacuuugccuaugaguguugucauuuuuaucagccauaaaauaacuuaugaguuuaauaaaauaucguaugccauaguagccaggcauuuagagaauacuugggaggaagugcagcagaagcagcaauggugauagucugggcuucuaucacagggugggacagaccuuggagauaugcugucuccucuguacuugaucuuucaugugccauccggagucuucccucuugcucaaaggccugggucagugcauccuuaguggcucaguuugaauggggauuucacucagugaugagaugauguggacacagaaacuaguugugauaaaaguugguaguugcggccgggcgcgguggcucacgccuguaaucccaacacuuugggaggccgaggcgggcggaucacgaggucaggagaucgagaccauccuggcuaaaacagugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagugagacucugucucagaaaaaaaaaaaaaaaaaguugguaguugcagauacaaaaugcuacugcaugagaucuguccaguagccucaacuauuuuuaauaugcagucagagagacagaaauguauuucagggcagcugcuaccaauuucuuuuuuuuuguuuuguuuuguuuugacaugauacuuuuugccagauacuguucuuuucuauagaguaauccuaaaucagaaaaccaugucaugauaucaggcuuaauuuuaacagccagaaaaaaaaaaucgccaccaagauauaaaacauuuuacaaaaugaaugagggaagagauuuugagcacaguauugguaaaguagaguucaaggggugagagaugugauacaccacaccguccccacggaaaaacagcaauacaaaaugaacuguaucauuuuuuacugacuuguucuguuggugauugaggcauuucagugcacaaccaggaaaauaauagguuacuuucacaaugguagaaguuuaacaaaugcucaauuauucacccuacaucaucgcugucauuggugagaguuuuacuguaugauauugaugccuggcuucuuucuuauugcuguauucuuuucagauucaaucugucugcaaugggccacuaaacauuucaauuugcuaccuguggagcuggauugcaaugcucagacugaaaugagaaaaauggauuuagugaaacucaaaauagagagaguuucauggauuuuuguggaaggaugcacaaacugaaacccacugauaaaaauacacacgaucacuuuugagugucucauaaaaguacaugguauuaagcaauucauggauguuuuuagggaaaauagacucagugagauggagacugacaagacucccaacacuuaggggaacucagacucugucaaucugggguguaguuguguauacucagugccauuaucauaguccuugaauacaguauuuguaaagccguacuuguuuaggugcacuuaagagagcugagcuagcaaagaacaggauaaaguccaaauuauuuucuggccaacccuagcauuuaguuuuuuccuagcaggaaucauuuaggagauuuccugguugggagagaggguucauuucauaugggugccucuuauuauugucauuuccugacuguugcccauaguucuugacugacuguaguacucacugucuuaccaugccuuccuguuuauuuauuuauuuaugcccauuuuggauuuauuuuucucuuugacuaucaagaugcucuaaaaguuuccccacauugccuaaauuugagcuccaugaaauaaaguggauuugacaaacaucaagaacauucagaaguacuugauagaaaaugcaaguauuaagaauuagaggcuuaaaaaagacugaaguaccacaguaagguguuacuucaagcccacuaggauggcuguaacauaagaaugcaaaauaacaagucuugccaggacauuaaaaaauuggagcccucuggccggacgcaguggcucacgccuguaaucccagcacucugggaggccgaggugggcaaaucaccugauguugggaguucaagaguagccugaccaacauggagaaacuccaucucuacuaaaaauacgaaauuagcugggcauggugguacaugccuguaaucccagcuacucaggaggcugaggcaggagaaucacuugaacccaggaggcagagguugcggugagcugagauugcaccauugcacuccagccugggcaacaagaaugaaacucugucucaaaaaaaaaaaaaaaaaaaaaaaaaaaaaaaaaauggagcgcuccuacacugcugguaggaauacaaaaggguuccaccaugaugcaugauggcagguuuggccgugccucaaaaaauuaaacauagaauuagcauauaauuucacuauucacuccuagauauauauaccaaaaauaaaaauuuaaaaagggacucaaacaaguacauauacacacacauuaauaaagcucuauucacaauagcugaaagauagaaauagcccaaauagccgucagcaaauauauggauaaacaaauuaaugguauauccauauaguggaguauuauucagugauaaaaaggaaugaacuaccaauacaugcuacaacacggauacaccuccaaaccauuauacuaagugaaaaaggccaggccccaaaggccauauauuauaugguucaaucuauaugaauauccagaauggauaauuuuauagaaacagaaugcagauugaugguugccaggggcuagggaaaggggacaauugggaggaagugcuuacuggauaagggcucuuacuuuggagugacggaaauguuuuggaaauagagagagguggugauagcaaaauauuuauuguacuaggugccccugaacuguucauuuuaauauggcuaauuuuguauuauaugaaauucaccuuaauaaguuauuccugaggaaaaaaaauagcuaagaauucuuaucugggaagacaaaguaaaggguuaauaaagacaaguccucauaugcaguagguuuuauaagaauaaccaacucaucuccucuucuacagaguugccuaaguaagaaaagauaauuuauaguggaaggaauauggaccauguucauuccuaccaacuagauugugaccucccucagaauggggauuauucuuugacuuaccaauuauuuuuuuuucacaaaguuacauaacagucauuaauuucaucauucugaaauauucauaagagcuugcugugcuauaggcauuauguuagucuuggggauauaaaugugaguaagauagauaucaucuagaauuaagguucuguuugaauagaaagaccaaaaaauaaguaaacaaacacaagaaagguauuugauaugguuaggcuuugugucccuacccacaucuccucuuggauuguaauccucauaaucaccaugugucaagggagagaccagguggagguaauugaaucauggggggugguuuccccuaugcuguucucgugauagugaaugaguucucaugagaucugaugguuuuauaaggggcucuuuccccaucgcuuggcacuucuccuucuugccuccuugugaagaaggugccuugcuuccccuucaccuucugccgugacuguaaguuuucugagccucccccgccccaaacaugcugaacugugagccaauuaaaccucuuuccuuuauaaauuacccaauuucaggcaguucuuuauagcaguaugaaaauagacuaguacaguaucauagaacauaagagcuauaauggaaaccaauaggaagcugagacauagaaauauggcggggaauuuggucuauacugcuugauaggauacacagagccuuggaugugggcacaaccacugucaggcccacccucacaccagcaucaguacuagguagaagcuuucuagaguugggagagaguuuuuucugcaaaaaacucuuuugcaguuuaaagggaagauaaccugaggacaggcugaccauggacuaggcaagagccaagggagugacagacagcuggagccacaguucaccguccuggaacccuccccaccuucugacuaacuguugcauccucuugcugcugaaagccuacugacggagaggucaccuuggauguuucuuccauagucuguauuguauguucaggaauuuuaggaaucaauuguguuagcaagucauccccauuuuaccagagugagaacaaagccucuagugguguagugacuugccuaagacucagccaggauucaauuccugaucuuuagaacucaaaucuagcugucuuuuccauucauauuauaaugauugucauaauauaauaaaaguaacaauuggccccccauauuccuggguuuugcauccaguucaacugaguauaaaucaaaacaucauugcaucuguauugagcauguacagacuuuuuuugcacaacuguuuacauaguguuuacauuguauuagguauuguaaguaaccuagcgaugauuuaaaguaugugggaggaugugcguagguuacaugccaauacuacaucauuuuauaucagguacuugagcauccaugggcagugggcuggguugguccuggaaccaguccccauacagauaccaggaaugacugcacuagacuacaaaagagcaaacagauuuggacuuuagccucuacucugcuacugugugaccuugagaaagacaucacaucucugggcuucguuuuucucugugguaugaugggguagguuauaucuguugaucuccagcucuucuuaugguucuaauaccugauuccauuaauauuucuucuucuguuuuuucuuuacuccucaaaaucaucaugaucaucacaaaagagcagcaguuuuuuccuggguuguauaaauaaaggaggcuagacagcagagaauggaaacugugggcagccuuguacuggguauuccaguaucucuaauuccaaacuaguauauguuuuuaaauaauuucuuuuagagacagggucuugcuauguugcccaggcuggccucaaacuccugggcuaaaguaguuccccugcuuuagccuccugaguagcugggacuacaguugugcccaaaucaguuauuuuccagacuucaguguucucauuauccuuucauuucuuguggcuaccacugaacacuuuagcuagaaaaggugaaaccugacugcagaccacaaaaacggauccggucucuuagcuccuuucucugccacccucaaaguagccauuaaaucuuucacauuuucuaaugacuuuuuuuuuuuuuggaagggggagaaauugggaaugcaagcaaugggagagauacaaguuauaguaauauaaaaaguuauaguaauucagucauacaguauaaaaacccuuauauuuugugugaauauaggaaauuuucuuuucuuuuuucuuugagggccuuaucucugcucuugucugcugaauucaaagcugaccacuuucuaccucuucugcauuuuguguguuguuucagcagacauuguucguuguuuucuuuucacuguuagaggcuuucagagagagaaaggaagggaagagaagggaggaugcuaggguaccagugcccuuucacuccuaaauucucaugagucuguacuauagacccaugaggcugagcaguuuacuucccauguuaacucuaauucuuagucuagaaagcauauuuuuuucauuggaauguuacugucaaauugcuauauuauuccuguucaaauggggagaaccauuuauaggugaugcagaaucauuaaagcaguuaacucugcuggagaagguggaaggcacaugguaucucaauugagaaauucuuuuccugcuucuuuaaauuauuaaagucaaauacuuaaagaguacaugcuacaacacuacauucaaaaagguuuauucuagcaugauacuuaaguauucuuuuucuagaugcauuucauucauuuaggcauccauucaucaaauguuuauugaauacuuacaaugugcagggcacuacagagugcugggcauguagcaaugaaaaguugacaugggacucugucuuuaaguggcuuucacuguguuggagaaaacaaauugaaaaauguaagggcuuguuauagagcugaaauacuuguauaugggagcgagucuugggugaaugcaaccuauguauacagauaaggauuuagaaaaauguaagagcaaaaauacugcuuuagaaggaucuguaagagacauucugccuauucacagaauaguguauacuuauuacaucuaaucuugccugauagacuugaaaacauaaaaugguuuuuaauauagauuaugauauggucuccugucaugacauauagaaauggaaaugcccccaaaaaagagcuuacuucuagaauauguuuguaauuauaggauuuauuuguuuuacacuacuuagaaaauauucuuuggccgggcacuguggcucaugccuguaaucccagcacuuugggaggacaaggcaggcagaucaaaaggucaggagauugagaccauccuggccaauauggugaaaccucgucuuuacuaaaauacaaaaauuagcaaggugugguggugcgcaccuguauuccaagcuacucgggagucugaggcagggaaaucacuagaaccugggaggcagagauuguggugagcccagaucacaccccugcacuccagccuggcuacagagcaagacuccaucuuaacaaaaagaaaaaaaauaaaauauucuuuaaaaguacauuucuucaauuggccauaauucauaccaguccuguguucuuugagcucaacuauaaauuaagaagcaagaaauuuaguuuuucuuucauaguuacauuuuuuaaaaaaauugguaucccgaauagauuccaauaaaaaaaauuccaaagaugaacuguaaaaacuucugaaagguucacuauuuuucuuauccuuuaagguggcuacugccaaagaauaaaaucagugaaauugccuuuuguguguaauucaagguuaauaacuugugggagaacuuucgaucauaaagugagcuuuauaauuuuaucaaugauaggaacaaucuucuauuagguuaguauuauucauuuaauagcuaaagaguugguguauuucucauucaguuguaaguguuuucucccuuuuaaucugauccauuagagcacuacuagaauguagcuguuuuggcugugcacaugcuugccgccccccaacccgugagguccuccaugaugugcucuccacacuaccccaugguucugcauaaauuuuuugaauauauuguuuauauauucaucuuacugcuagauugggagcuucuugugccaagacaguaucuuugugaauccagugcccagcacgguacuugguguauuagaugugcauauguaaauaaugaguagaugaaguguggucaugugaaggauagaauauacuuacacacauacacacacaacaagcaaauauacauuaaaugccuauuuuuuacauguuuauaucugggccuguugaaguuacuaaauauaaggcucuugucuuauccuuggggagcuuacaguuucauuggaaccaaaauuaacauuugugaaaaaguugccuuaacuaaagaugguguauaucucaaagccuugcuuuauucacaggcuaaaggaucaccucucuuauaaacagaggcuaaagaacuccuuuuaauaaggagaaucagggacuucuucacagagggaaugggacuuuagcucagccuuaaaaaagugagugagacacaugacaaaaggcacugucauauagguggugauggugguuucauucacuagauuccaucuaagucuccauucaucaugcaccagaguucaacacugauugcccgccucacccagcguggguuaaggaauagguuuuacuggugaaagggaaaacuuacaaggcuaagucagcaagagaaaagagggaguacuagguauacuagguuuggauucugcugaaccuacucuguggguuugaguuucccugguauuccgccuuaccacagggcaagaaugaggaagcauucuuauugguggggaauacagaggcuacuuaggaccaagcaguucaauuuagggccccagcugccuagagaaguugucugagaaugucagcugcuuuccuaguacuuagaugccuuuagacugaugugaauuggcaguuuucucuuuuuagagaagccaccagugcugaggagaacugauuugggaggaaaguguucaccuacccaagccagcccauuguccaggcaacacugggucagcucuggggucacuaucagauaauccugcuucuugcacuaccgagguuaagaauuugcacccuagaagacuucaauucaaaucccugcuuccccacucacuggcuauguaaccugaggcccuuaaugucucuaggccuuaguauuguaaaauaugaaguugggauaguaauaguucauuuuuccugggauuguagugaggauuaaauaaaauagccauguaacacauggugaauguuuaguaaacauuagcugaaaaggaaggauccucugagaaagcgaguggugagaacauuuuuaugggcauagccaugcucagggauaguggguggacccacuuucccagucuuguuagggaaagggcucauucuagggagaauagacuggauuuguggagggcccuuaauguaagaccaaagaguccucuuccaguccauuuggagccauucgugauuuucacgucgaaccaugugagaugguuuggcuguguccccacccaaaucucaucuugaauuguaacucccacaauuccuauguuuugugggagggaccuaguaggagguaauugaaucaugggggcaggucuuucucaugcuguucucucaguagugaauaagugucacaagauccaaugguuuuaaaaagagcaguuucccugcacaaacuuucucucuuugccuucugccauccacguaagaugugacuugcuccuccuugccuuccaccaugguugugagaccuccccagccaugagaaacuguaaguccauuaagccucuuuuguaaauugcccagucuugguuaugucuuuauuagcagcaugaaaacgaacuaauacacuaugacacauagaagaauuuuuaggaaaaauaguguggugguaggcauuccacauagauuggaaaguaaacaaauuaaaagcaggaagaccuuuuaggcuagaaguaauuuauuuuccaggaagccauggauuugaguuuuuugaacuucgacuuccaucuagucugccaucagccuucauuccuuucauuaagcccuuaguugcagugugccucagaccuuugucugucugcugcucuucaucauugugugcaugguuugaggcuuagcauugcaaaaaagaguuaagaaguaaucaagauuauuuuaauaaggcauagugacaaaaacaacauaaauggcauuucucugaagugaguuuuggugauuucucauuaaauugaauuggcagaaacucagaaacaauacuuucucauuucaagaaauaguaauuguuuuuaauguagcgagccagaguucuauaaaagauugcagugucuuguucaacauucuguuuucuaaccccgucuagcauaaugcuuguaagaaacuaacuucucaggaaaggauggauggauggauggauggauggaugaauugaagguaugcaaaggaguucagauucauuggaccuuaucccacugauugugauugauuauauaugauugucuaauauguucucaccaucgccacguuuggcuguggaccucuuggggcaaggucugugucuguuuuucucacuguauuaccaguuccuaucucguuaacuagaauagucuuucauuaaguggguaagugaaucuaccccugaaauaaugcuaagcgugggguucugggagaguauaucaccaauaaaggauuauguucuggccuugggccuuaagccacucacuuaagaucucugagccuugauuuccuuaucugaaaaaauguguauaguaccuauuuugccaauacauaauagguuaaaauauaauaauaccuuagaguaauacuaauuaaaucugcuauaugugcaaauaaucaagagacuuauuuaaugaauguugcguauaaaccuucauaauuaugagauugcaaggcauaaccaccgguaaggaaauaaccucuuuacccaaggaaaccauaaugcacaaaacagucgaccauaggaucuuauuuuggggguauuuuauuuucuauucauguuaaagcaaauaaaauagucccuuuuggaauauaucaaguuauacaacuagaaauuucugauaguuugguggauuuugcaugccugccucaguuguuuucuguuaaaauaccaaagaaaaauaaauuucaagagagucaggacaauaucuugcuuaacuuguugaugaugcuuaacggcaaccugcuauuguauuuagcaaacaauaauauuuccaugguagauaaagagaagauagacuauuuggagauguagaaaaugaauauuccagcaagaggauagauaacuucaaacugaccugacugcuguccuaagcaugccaccacaaaaacagcuaauaguuauuuaggacuuaaauuuaucugauaauuuugagaacaaaaucuuuugagcuagguuauaauauaggagccuucgauuuuccuacauuaaauguguagcuuagugguauuugauguugaaaugguaauuuugcucuauuccuuuugcuucugguagacuugcucuugaauuuacuaccuguauccaauuaacggaaaauagagaacuugaaauucagagaacucauucuucccaucaaaauauguacuauacacuggccuugguuuugggugaagaugagaaaauauggagcuuaauuuucauuuuuuucauuaagauuaugaaaaaaucuguguuuugcacauuuaucagcaauggcauuaccuugcaauuuacuauuucccauacucauaggaacuuauuauaaagaaaaauaccucaaaacauuaucagacauaccuuuugaguguuaccuguuugagauucuuauaguauccuuagggaaagagcuacgaaucaaaacugguaauuggaaccauuaauaagauagagauucucauaauuugaaaccaggguggugugucagaaaaacgauacguuuggaagucaaggagucucauuccuguuccuaauguugucagaggccagauuuuaucacauuagacauaggccaguuuaagauuuagaaaaagaaaaauccagauaaaauaugaugcuugguguaugacacaguaaguuuuugaaucuuuguggucaaccagaagcaccaguucuuuuucaugacuuccuaauaaaucaggcgucucuuuucauguagucauggguuagguuuacaugguaagaaggaauuuguugggagacaaugcuccauggaucgcuuguguccaugugucaugaacagaggcacagugacacccuuuugguugugaccugaaggaugguugguuagugaacagccuuggaagaaagagauaaugccucccacuaaaugaugauauucuggcuacuauuuuuguggggaguaauaaaauauccuugucccugacccaggaguuuuuguuuguuuguuuguuuuuaauuucuaccagcaucugugaaaugauggcaggcuaacuuguuagcuugcaaguaggguaaaaccugagauucuucacaguuucuggcagaauugaguuugaacauacugaauuuaaaguaagggacagagaugaaguuauauaccugaugcaauuugcagcugcauauaaauucuggcacgcaaacaggaggucagaacuaaagacauaaaaauguggcuuuaugauuucuugcuaaauaggcuuugcccuguaucccauuugggacuuggacgccugaaaacuguucuuucauugcaaugaaauguuggaaaucuauugauaaugcacuuugauuuugagaguguuaagacauaaaaccagagaaaacugguaucucuggccacacauacucagcuacuuuaccugaguucauuacauucuuguuaccuuugcauuuaucuagaguacagucucuuuaaauggagaaaauaguuaaugucuuucuccuuuagaaaucaagauucuacagaaugagaaaugcuaaggaagcaauauuuuuuuuuccacagggaaagggaaacuggcuauuguuaaacccugccuuuggcaauugcaugucucuaucaguagccaauuuggaaauauugaaacccugucuuugguguaauacaacugguguaguaagcagaggugauaacuguuacguacuucaccuugaauuuuaggcauuuuaaaggucauuggggaagggaaaauaauccauuaauuuuuacuagaguguucauguaagugucuucugcugugaaaaucaauguaaaauuucacugccauucaaaaugcaaagugguguauaauaucacuacuccaaacugcccuaaauuguugcauuuuuaaacaagcagguuuugaguuaugcccuuaccucguaaauucagcuucacagauuggauuauugccauguggauguaguagcaggaaaaauaaauuugugucagucugaauucuacuugugcauuuauuaaacuacucuuaaccuuuucuuaggucagugaucaucauacagauuugcuuuuauaugccuuagagaaaaauuccucuaugaguauuauuuaugaguuaaguguuacuuauccauuuacauuaguaaucuuaaauuauuuaccugcuuuggaauucauauguuacaaauuugccagaugaaagcugccagaugagugaauauauuugugcuacaugucuguugcucauuaaaguagcugguuugggauucacagcaaaaauaaaaaguguuacaagggguagaaaagaggggagaagaggucaggcaguuuauagcaaagucugcugugcugcagcuggcacuagcuggcgccuuugggcaguuucugcuaaaccuugagcaauugcuuucacucuuccaccucccauguuguuucauucauucaaucuuagauggaauugguuagagaggagaaauagaacacuauuuaaaacaagagaaaugguauaucccccucuggcagagaacacagguaagacauuaccucuuguacuugaugggagaacaucuuuuuuuuucuuucuuucuuuuuuguuuguuuguuugggacaaagucucacucuguugcccaggcuggagugcaauggcgugaucuuggcucacugcaaccucugccuucuggguucagcgauucuugugccucagccucccaaguagcugggauuacaggcauaugucaucaugcucagcuaauuuuuuguauuuuuaguagaaacgggguuucacuauguugguugggcuguacuuagacuccuggccucggguaagguacaugccucggccucccaaagugcugggacuacaggcgugagucaccaugcccaacuuauuuauuuuuuucuuuuuaaugagacagggccucacuauguugccuagucuggucuugaacuccugggcuccaacaguccucccaccugccuccugaguaguugagauuauagaugugccaccaugcccaacugagaauauuaucuugaucuacuaaauaaauagauuuuauuuccauaaugacuuauuuagaauuaaaagcgaagcccugaguuauauauauauuaaaaaaacuuacaugcauuugcuagucaggccaguuuaacuuaugugagagccaaaaaucuuacauaauuauuaacaguuuaaugaugauagauuauugauuauaauuaaaccuaggcugucagacuaaucaaugguaaguuuagucuuaggccuugaguugcuaggucagaucugguuuucccaggcugauauuucaaaagucuuacagucuucuuuuguugagaauccuucacuuuuccaguuacuccaaaggagaccucagucagaccaaaguuugauggaggucaaguuaaaauuuaaaccauaucuggaagcaaggucagugcagcaaaggcacauucuaaagcauuacuucauauaccuuaauucuuccggaaacucguuugcuggguguuuucauucauaaguucauuuacucagcacucauucaacaaauauuuuuuauuuuuuucaacagauauuuauugagcaucuacuguguacauuauauuguucuaggcucuggaguuauauuagugacaaaacagaaaaaaauuuuguucuuuuggaacuugcagggaaauacagauauuaauaauaucauaucuauuauuuuauuaaugaaucauaagauacagauaauagaucauuuggugacaagcaccaugaagguaaaguggacugaagggcucauuaagaaagggaucucugaaggugauauuugagcagaggccaaaagaaauaugggaacgguucaugcaguuauuuggagacagauguucuagcaagagggaacagcaaguacaaaguaccugaaagaagcaugugcuuggcauuuggaggaacugugaggggacugguaggauuagaacacaaugagugagaagugaagggagaugaggucagagaagugguguggaauuggggaugaagggugaucacaucauaagccauagcaaagauguuuacauugaauuaaaaagcuauuggaagguuuagcgaaguacaggaaaaugaugugacuuugguuuuaaagcgguccugaacaauagcacuuucugugaugauggaaguagucuaaaaucugcagugcccucuaacccuuugugguuauugaacacuugaaauguugccaaugcaccugaggaacugaauuuuuaaauuuaauagaauuuuaauuuaagcaguaacauauggcuagcguauuggucagaaaaauuuuauacauuuucacagguugcuuuauggagaauaguauguggaagcaaagaggcaaaagcagggagaagccuuaggaaugcagaucaaggcuuagcaaaaauuuuuuuucuuauaaagggcuagcuaguaacuauauuaggguuuacauuuccuuuuucuuguuuguuuguuuugagaucgaguuucacucuuaucacccaggcuggaguacaauggcgcgaucucagcucacugaaaccuccgccuccuggguucaagugauucuccugccucagccucccgaguagcugggacuacaagcccccaccaccacauccagcuaauuuuuguauuuuuaguagagacagaguuucaucauguuggccagacugguaucaaacugcagaccucagguuauccagccaccucagccguccaaagugcugggauuacaggcgugaaccacugugucuggccaggguugacauuucauagggacucuaugacaacuacugaaguauacuauugacaguauguaaaugaacuagcaugguuguguuucaaugaaaguuuauucauucauuggucagauuuggcccauagguuguuguuuaccaacuccuggugugaaugagaggugcgaugaccaggcuuauuucaaagguagacuugacaggauuuauugguggauugcaugugugguguaaaagacagaggaaauucaaacaaauaacuuaaagguguuuggacuccacauuugacaaaaaggaguugcuauucacugugaugggaaagacuuggauagaagcagauuugggagaaacuguuaaauuuggcuugaaguuuaagaugucugucaguuauccaagggaaguuuggaggugaggacugagaucuggacugcagcuauauacacuugauaguuauaaaaaaugguauuaaaaccauggguaggaauaagaucuccuagagagagaauuugacaaagaagagaaaaaggucugaggacuaauccuuggcauacuucaguaugugguaaaacacauacggaaaacugagaaaagaagacugcagaagggugaaagaaaccagaaagugauguuuuagcagccaaguacaagugugucaaguaagacuucaucaguacuuaucaaaugcugccugguacguaauaggcacacguaugugugcugagucaaugaauaacuggguacgugcuauucuauacugacuucuguugaguucuaauguacaacacccccuuaccccauucagaggccuuuaauggcuccccauugccaacuccuugaccaggaauuuguauuuuaauauaugacugaguugaacugcaacaccucuucauaggccuccaauaggcucugcaauuuugcauuucuuuauuuacucauucuaugcaaauuccuucaugugugaaaugccauucuguccuucuuugccucuugaaaucuuaucccucuacuaggagcccuuucaaaugcccucuccuaaaugaguacuuccccuucccuccacuucucuucuaaccuguccuuaaacccuugucauggcucuacugacaugcaucccacuuuccauuugguuccaguuguucauuuuguuuugcacaugauauucuaggaucccugugagcaggugcaugacaccauaguggaaugauugugaacauggagaaugguauaaacagaccuguuuucaaauacuaguuuuuuauuuacgaaccugugacuuuccuaaguaaccuaaacuccugaaggcuccauuucuucacuuguaaaugaagacaaauaaggcgucauggaauuaguugagauaguuccauuaaauuuauucaaauauugcacuuauugccugucagauucaagcuaaauuuuuucaauuuaaauaauuuauuuuuaauagauugucaaucuguuuuuguuauugaucuaagcacuauacagugauuauauacuuuaaguaagugaaugucaagcuaguguuaacagauagcuauugccagcauaagaauauucccugccuacccaaaaauaucggaaagaaauaagaccagccacuuauaagagaaggugccaaugcaauggcuaaucuuuaugagaaagaagaaacuuuacagcacauuuugaguaacuuagugcaugggcucagugggccaccugcugggacaccaccuucuaauggauuccacaauuaaggcauugcugggucuugccuuugcacagccaaaaccagaugaugacgcuguuguccucuucacagacacagcccccuauuugcuuguuggugauggauaggaccaaauuaggcuccuucuugguuccugaggcugccuuugggguuaguauguuguaggguccagucccuucagugcagccaucauaaccucccucuccaacccagucaccugcucacuaucacuaggagcacaaccuccagaugccguggagcgcacugcggucgcccacugggacugcgggccugcguagucaaugcugcagcuccggaaaguaaccucgaagucgucacacccacaacaagcagcaguaccuccggguaaauaauuuaauaaacaagugugugcaaggaaaaguuauaacaagauuacucccauuuuuauucguuuuuauauuuuuauaguguuuaccacuuucccuugugaacacaugcuuauucuuaaauuauuuacauugaaaggauuaagcauuaacuuuuauguuuuaaguuaauuacaguugaauuucuuucuuuuuuauuuuucauuuuacacuccuuguuaaaauucuuuuaaaucauugccgacuuggcaguuuauugccuugauaacagcaaaugaguaucugauucuuccuuuaccccaaauugccacuuuucuuguugaucagcagcaucacugagugaaaaccagcaacagccgaagucaauauuuauaacuuuaucauuagaccuuaaaaucuuauguuagaaauuuaugguagugcaucagguggagagagaaaguuccaugggaagcuaaaccucugcuuaaaggcuuugugaaacuugacuaguaagaagcauaguugcuguuucaugaaaguaacuauuugcuagggagccaucuugaaaggauuauuucugugacacuauguacuggggaaauuuuuauugagacuuuguauugauguugucacauaauguuuacuguagacaguuuuuuauuucagaacuguagauaacauugagaguuauagacugucucaagcuuuucugaccauaucgaaugaaucaaagagugucuuuccuuguuagauuuaaguuggauuuucuguccuucccuuggaaaaugguuguauuugcugguaauuugucuucauauuuaguguaaacuucccuuacuucauugccaucuagcuauuuguaauuuacaguaugugccacuauaacaugauguaaaauucaucuauucuguaaacuucuuuugggcucuuaccccauuucauuauuaguuggccaauagcauuaacaagaaggacuucuauguacaagucauuauacugagaccuugaagguuuucuagcccagacacuccaacacaugaucuuuucucuagcaucccuucaucuugaauuuuguccacccuaacauacuguuaguaauacagaacucuccaccuuuugaggaaacccauuccaucucucaaugaaauuagcuauuagaaagccuuccuuuaaugcaaaacgcagucuccucccaggaggauuauuucugugacaguauauacugggggaaauuuccauugcacuucuagccuuuggguuucuauggaaauagucuaaucucucuuccacaaaacaguucuucaaauauuugaaugacagauccauaguucuauucuguagacucuguugguucucagauaauguugguuauugaugaauuuucuuccauuauauuuccuuagaauuaguuucaagaagaccuaaaaagaacaaauacaaaaauuuaguugcgaacuaaaaacuugaggcaaguugugagaagaaaugugggaaugauugacagcuggcuugguuaccuucuauugaguaaauauauaauuaugccauuuuuuaaaaauguuauuuuuuugagaagacaguaauugcacuagucuauuguauaauuguuaaagcaaugcuauuugcuuauuugucuuuaaucaauggguuuggacucacauugaccuaauauacaaaucuugcaaacugcuuuuugagggcacuggggaagggagaaacacauaaaagauacugccagguaaauauauauuuaaccagaaagagucagcacugucagcucaguucacugcauauuagggagcaaugaaaaggccucauugugccuccugugauugaaaugauauuaucuggcaugacuggaagggagugcuuacuuacagaauaacuucuuuggucuuuucaaagaugguaagacuucucaagcuuucuuguuauuuuauuuuuaguuaguuauagauuuuucuuuuagaguauuuuucaaacuuccuuauuuugaugguaacuuuuuaaaaaguauugaaauagucauaaucagcuuuuauauuucuccuuuucuaaaugcuuccauguauucaaaagauagauucucuccucacuacagaaggcuaagaaaacuuccuuuucuaggucuacaguaguccagucucuuggucaaagguauacgauacauuaaaucuuuaucuggaaaccucucagaggaagauaaaguaaucgaccuuuagaaauuaaauguuauagcauucggauaaauaaucauuggcuauuguuauuacuuuucuuggauuuaggugaaggaaauaaaagaugcaggcuuuugaccaaauuagagcauggcuuuaauuuccuguuauuccagcauugcuacucuuucuaauaaccacaaaucaaggaugacaaacaaacaaaaccgcacacuagaucccaaaggcagcuaaaacagcuucuuagugaccuucuuucugaccuacauuguacaaaugagaugauuggaaacaggauaauaauugauugcaacaauaugacaaucuuguuaaaugggcuuaaaauuacauucucuaccuggacagggaccuuauaggggagaucuuagagguaacaggauccucauguauggagcguuaggauuaauuguuuaugauggcacuuuacugaaauguucuaaauuuucauuauuucuuucuaacagauuaguaagaugguauuaaugguccugcccuaucugcugagcacaguucuuaaaaaaacagcuuucugauauaacgaaagucaacuuggugagcuaccagcuguuuuagauuuggcagauuucacauucgcuuugggaugccuguuuggauauguuuauaaagucauuaaucuucugucucuccucucuuccugccuuccuuccucuauuacuugcugaauucuggacauacagcaaaguguaagaugaaucucuguccucauggagcuuacaauccaaagcauauugaaagaagaguucaaaaauaccaacauugaauaucaaacuauuugaaauuaugugcuauauugguuuuauuuuucaauuuuguauggauuaacuugcaauaacagauaaacacaaguauggugcacuuugguaauuuuuuggugaaugcuguggaagacaggccuuuaguaagguuaaauauucuacuuuccucuauuagaucucauuugacuucacaagauucacuugauaauaguuacaaaguaaauccaguucuucaaauggaagauaggauuuagguauuuuuuacuuuagauuuuacuuaaaacuauagauuacauuuaaauaagcagcauauuucacagagauuuucaaaaauauuagauuucacccuaauuuauguuuugcacaauauuucaaugaaaauuugaugugguuguuaauguuuuauuccuuuugaucauugcaauaaaauaauaaaauguaacaucagauuuacuguuuuaaccauuuaaguguaugauucagugacauuaaauacauucacauuguuaaacaaccaugaacaccaucuaucucuaggaucucuucaucuccccaaacugaaaugcuacccguuaaccaauaacuucuuauuucccuuuuauugcuugcuuucuuuuaugugagacaugcauaaaugaauaucccauaucuuuggcuuuuuuuuaaguaauagguacuaacugaagacucuccauuuguuacugggauaugaaaaaaaaauaguaacuuguagaacuacuagacuucuagaacuacuacugugaucuugcaaaacagcagagaaaaaaauaaagagauaaauaaaauaguaacaugucuagccaaauaaaauacucacuaauacaguggaguagcauggaauuuggcaugagaccucaguuugaauccugacucuaccauuuagcuuaaaugguugcuucuaggcaaguugcuaaccucucuuaguugccucagcuauagaauggguauaauaaaagcuuguuuuuucagccucauguucauguugugaggaccagaaauuuaauuauaucaaaguauucugaaaauuagaacucacauuucaaaaaaaaauuuaaacaaaucagacuaugggaauauaaauuaguucaaccauuauggaagacagugugacgacuccucaaagaccuagaacaagaaauaccauuugacccagcaauuccauuaugaguuauauacccaaaggaacguaaaucauucuguuauaaagaugcaugcauacguauguucacugaagcacuauucacaauagcaaagacauggaaucaacccuaaugcccaucagugauagacuggacaaagacaaugugguacauauacaccauggaauacugugcagucauaaaaaggaacaagauccuguccuuugcagggacauggauagagcuggaagccauuauccucagcaaacuaacacaggaacagaaaaccaaacaccacauuuucacuuacaagugggaguuaaugagaacacaugaacccagagaaaggaacaacacacacuggggccugucagggguauggagggagggagagcaucaggauaaauagcuaagcaugcggggcuuaauaccuaggugauggguuauaggugcagcaaacugauggguugauaggugcagcaaaccaccauggcacacauuuaccuauguaaccaaccugcacauucuccacaugaaucccagaacuuaaaauuaaacagcaacagaaaaaaggcugaauuuuaaacagauuccugaacuagugguucacacccaucagcucauucaacuucagcaccugucuugucucuaguagcuuuuccagaaccacuaccuucaccaugaagccccaugcccuuucccaauucaaacuugggcuuagcauuuuuacuuuucuaaccaagacaucauggaaaggauaaauagauuagcaagcuguuuuaauauauuuugcaaugcuguccgaagucaauuuacuggccacuucuuucaagucaucugucuugcaguuuuugggucaugguuuuuaucauuaucuccuggauuuggcagaccuguuggugcugagcauaagaagucuuuuguaucugauuguuguacuuuuuaguaaaaccaacacagaacagaugaagcaaauaaccaucaguagucuugacaucaacaugaacuucaguaauggucugccauuuuuuugaccauggaacauauuuugucacugguaggauccaugccaugaaaguuaggcaguuuuuaccuuguucgucuucaguaaucagccugaauuuucuaaaugcaacuugacugcagaucagcaaggcucacuucaaacacgcaaacccuugaggccaucugaugcaauuuugguuccuugaguccuggugacuagugucuuuccaauacuucuuauauugaauguagcugcuuucacaucacacuagucggucuuagaaaauguaucuaccggcugggcaugguggcuuuugucuguaaucccaacacuucgggaagccgaggcaggcagaucacaaggucaggagaucaagaccauccuggccaacauggugaaaccccgucucuacuaaaaauacaaaauuaacugggcaugguggugcaugccuguaaucccagcuacucaggaggcugaggcaggagaaucgcuugaacccaggaggcagaggcugcagugagccaggaucacgcugcuguacuccagccugggcgacagagagagacucugucucaaagaaagaaaaaaauaaagauaaaaaaaggaaaauggaucaacaacuuucuuggcuuccuuuuugccacuuuuuguaaggcacuuguucuuggcaacugccgugcugcuacugaaagagccaaaaggaaagaaagugccucaaauguuaauguauauggcauuuggcauauacagauauauggcauaaauguuuuccucuuauugccuuuccuugccaauucuuaacuacuaguuuugucauuacacuugacacgucuaggugucacucuuuaauuuucauucucccugaacuuuaauuuuuacaagucuaugguaacuuucucuucaguguuuguaacuaccacauuucuauagaaaucuuagggugaucuauugagauucuucacccuucauuucuaauuccucaugauacuaugcaagugacaaaaagguggcuugugacagagaaauaugauauuuaaauaaaauccuuagaaucaaaaaagugccuaaguuaacaacuuuuuaaaagggcuauuuuaccaacuccauaauugacauucugucacugcucagacuuuauuucauuccugcucaacucaauauauggauuuuuauacaaaccauuuaccaaccacuagacaauagcgccucuggcagaucaaauuuguacagguaaguuguuuguuauccacaggagagcuucauuguauccuugggacagcuuccguuagcagcccagagugagaguuggugacacucaaaaacucaaauuauugaugagaacaucccaaguacuaggaagaauuuaaaauuaaaccuuuuaagccugugcagucauuaucacauuaagcagggagauggugaugggucauaaauugguuuuccauuuuacuuaaacaggaccuggcagaauguaaauggaaccuuugaaguucacuuaucucaugauaauucuucacuuuuuuuuuuuuucgagaugguuaugagguugaaacuuuagaucucuaauuguuucuguuagauuccauuuauuggaaaaauuauauuucgaggauuuuucccccgguuucuguaugccuuccagaaacccagggacuucuugaaauucuaguuuuccuguacagguugaaucucccugauuuugaauuagaaaauucaaaaucugaaaugcuccaaguuugacacuuuuugagcacugacaugacauucaaaggaaaugcucauuuggaguauuuuggaucuuggauuucuggauuagauaugcugaacugguaagaauaugugauacaaauauuuuaaaaccugaaaaaaauccaaaauccaaaacacuucugaucccaagcguuuuggauaagagauacucaaccuguaucgguuucaugcaacuuuuugaaauauuagagauuuaacaagucaugacucacuucauugucuguauaucguaaauguuaaaggccaggcacgguggcucacgccuguaaucccagcacuuugggaggcugaggcggguggaucauagggucaggaguuugagacaagccuguccaacauggugaaaccccgucucugcuaaaaaaaaaaaaaaaaaaaaaauacaaaaauuagccgggcaugauggugugugccuguaaucccagcuacucgggaggcugaggcaggagaauugcuugaaccuuggagguggagguugcagugagccaagccacugcacaccagccugggugacagaggaagacucugucucaaaaaaaaaaaaaaaaaaaaaaaaaaaaaaaaaguuaaaguacgguuugguguuugucuuucuuuagacuuaauguacauguugaaacaucaguuuaagcagugcuuuuucuuuuuuauaaagcagcugggaucugacuuuuaaucuuagcauauuguuuauaaaccucuacuagaugacuuacaaguuuaucugagucaucuccaugcacaccacucaucuuccugaucuuuucuuauaaggaaaucugauuaguugcauuagaagauuauguaccugccucaguuaaaugggaucuuagauucucuauuuuuggagauaugauaguccuccacuuuuugccauuugagacccucugaagagucuucuucuagcaugacucuauucuacucaaaaaucucuuuuuaucuuucucuucucuucuuuuuucacuuuuucugaggaacgaguugucuucugcuauaucaagcgaagcuccccauuuguguuuuugauuauaaauucuccaaauuuucuagaaucuugcuccaugaucccccaccuaacccaauccagcccucuauuaccauaagauacuuauuuacuuccccggcaugguggauuaucccuguaaucucagcaccuugggaggccgaggcaggcagaucacuugagguuaguucgaaaccagccugggcaacagggcgaaauuccaucucuacaaauaauaauaauauaaaaauuagccuggugugguggugcaugccuauagucucagcuacuugagaggcugagguggaggauugcuggagccaggguggcggagauugcagugagccugcaucgcacgacuacacuccagccugggugacagagggagacccugucucaaaaaaaaaaagauauuuauuuucucuauguccacugauuucuuucuuucuacuuacaagcaugcucauucucuccuuauccuaaagaaaccuuccccuuaccugagauccucucaagauacucuucuaccccaaguuuauccaaacaguaggcuguguuccuuuucucuacuuuaaccacccacugacucuacucuuucucuuuugaauauuuuuugccucaucauucuguguagaacaguguuuucagcccugguuggaauauaaucaucuggguugcuuuuagaaacuucuaauccuuuguuuccauccugaaaaauucugauuuaauuggucagugauaagucuucccacugauaacuuaaaaaauuaccccagaagacucuaauaugcuuuggguugaggaccauugcucuaacucaucaguauaauaccuccuaaagguuacaucaacagauuuccuucccaauauuuacccuucuagguuuauucuuucaaaguaggagaaaacauucccuaugcccauaaauauucacgguugaaauagugcaccauauuuauccucccaccuuucugacugcucauugucuuuguccucuuuugacuggucuuccccuuuccuguuccaaaaauacuacuucugccccaauuauuaaccuggguaguuguucuaaucuauguagucuagaguaaugaucuuauuuccuugcuuuuccauuauguuuguguaauaucacccuacucuuuccccaaacccagaauccucaaaacaaacugccuucuggacaccuuuuuacauauaucauuggcauucuuguccaaagaagaaccuauugucuugcugaaauuguuuuuguuuuuucuuucuagcuccuguuucuucagccaccuaugccauaaacaucauauuuaaauuuuaucuuucuuuuugucacuaacaguuauuaucuaaaaccuauagauuccguccuauacacugcuucuuaauuugcuauucuuuuaguauuccucuagucauuaaucauauucuggcugcacauguacaauuauaauaaccuaguagcuggucuuuacuauguaccacacacugcugucauauuuucaggcacagccccaaucuuuucacugucuuuuaauguguucuauggcuccuuauugacuguaauugaauccaaacaauuaggaugaaauucuaggcacuugguaauaguucucugccagcauuuucaauccaucuccaucacucuucugcagagacucuaugcugcagcuaaacugggcugcuugcuguucccuagccuuuaaacuuuuuuuuuuuuggacauuucuuuucuaguauaaauguucuuuuuucuuaugaagcuuauuaauuuuuuuucugacccccuuaggcaggaaaauuuuugccuuguucuaggcuauauagaucuaccucauguuauuagacuuccaaauucaguauagaacugguagcuuaccguuucuaguuguuuguaucucauuuaaccaggauguguuuguacauuagaagauggcuuguggcugauugugauguaugugacauccugcgaccuuuguguagcagauuguuuuuuccuucaaacuauacaugacacagaagagguuuuucagguuuguuuuguuuuuuaauuaccauguuuuuguaggccagaggcuaucuucacagccuccaugauuuauggaauaugccauucagacuuucaguuaaaugacaaaauaaauucccuagaaaguuggacccauauacuuuuagauucuuuuaacuuugcccacuuuuuugugccucuugauuuuucuuucuuuuuuuuuuuuuuuuuuuugagacggggucuugcucuguugcuuagguuggagugcaguggugcaaucucauuucacugcagccucugccuccuggguucaagcaauucugcugccucagccucccgaguagcugggauuguaggugcaccccaucaugccaggcuaguuuuuguguuuuuaguagagacaggauuucaccacgugggucagacuggucucggaccccugaccucaagugauccuccugcuucggccucccaaagugcugggauuacaggcgugagccaccagugccgagcccugcuugauuauuaaauccaaauuguccuccugcuaucuuaaaagaaaugaaauuucucaguaguagcaaacaaugucaaucuauuugagaccauuaaugacucauuuauaaugucaacagucacaugaaggcuagaaaaauuaaauguguagccucauuaccuuugugguuagcauuucuuggaaauagcauggugcuuacuuagugcaacauuguaaaagacaagaagaauuccuuuggagaagagcuuuauaguugagaauguggauaauggaauaacaaaaugauaacuucuuacucuuugagcugcauucuacgagacauucuuugugauuagcuaucagacucugcauguaugaagaagcucaguuguuccagucauugugaccuguuuuucauagauaauuuugacauguauuuuuggaguuuugaaaacaucauuuuuagggaauaugauuuaaaauauuuuuaaaguaguaauuauuagaaauuaucuaaacuauuagcuucuucuaauuugaagauaauguuacaucuccaaggauacugcagaaaggagcuuggguaccaugugaaccagcaugccuguaaguuuccuaucaacuccaaguuguguugguacuuccguucuguucaaaugguuaucagcaccugaaaugaauaugcucuagauuagucuuccuuuuuauauauagaauacacuuauaaaauagauggauuacuuuaacaguuuguagcugugaagagagcgaaaccaaccugcacaauggagacugaaacauaacuugagacccaaaguguacucuuagcuauaaaauguaauauaaauguaaauuauuuguugugguucaagaccuuauacucuuacuucuggugccuuuuaugaauucccaccaugguauaggacuauacuuuuucuaauagaacaacaaaagacauuuuaugaaaggauggcauugaaguuuaucgugacaucuaccuaccuuacagaagcacauguagagggguuuguguguguguguguguguguguguguguguguguguguguauaaaaagagauuuguuucaggaacuugaccucguuuaauugugggaucuggcuaaacagucucuguaagauuuuugucuucucaacucaugcuggagcuugaaguucacaaggcaggccaucagaagacagagggaucauaaagucagggagagcagugacaagcuggaacugcuagaaugggcuggaauucaugucaguucucccugucuccaguccuaaugauguggauguccuguaggagaagcaucauggagcuagagaaacacuuggcuuacacaucagugaagcagaagggggauccaggaaaguuggagcagcugccucaugaaaaguugcuaagcagcaacauuaaggcugcagcugcugagugucuaaaacagacuggcuacugcuuuacuuccacccuucacugcucuagcaaaaaugucucuuuuagcccacccuagcccuaaacacacagggaagagaauucugggaaaugcaguucagccuggccaaguugcacauuagaaagccaccaaagcaaauaagccuucugcauaacuucucuaauauuucaaaaggguaguauucugcaaccagggcuuuuuccaaccuucucauaauaccuggaugaugaaauuugaggcauaaccaguguauuuccuugcaucauuauuguuacuguggggcugagaguccuauagcauggcucauuguuuuuaaggguaaaggauucuaauguagcaaaauuaagaguaaagaaaugaagauauuagaggaaauuucuuugaaaauuucaucaucaauuuauggcauccaguuuuguaauauuucauauuauaauguaguuugauucgaugaguuaacuuuagcaagcagaaagauacuacaagcaugauaauaguaauacuugcuacccucauagaacuauaugaaauaaaauucuacugaguguaaaaaaauaauguuagaacuugacaggaagacuugauaugcauuagcuugugcacuggaagcaacaaguaagcauaugacccuuugaaaacuguaggaccauaaaauucccaauuuuucacacauuuuauauaugagucugcaugaauguuagcauguacauuaauacuaagaccugucccuuaaacuucagguucuugaucuuuuauuaccugcugggauggcagaauugcuucauaaauguaguccaucuucauuuacauagugacacugcucaggagagucucuguuaaaaaaauuaucuggaaacacuccaacacuguugggcaguuucauaguuugcugguugucuuucauuagauguaaucuaaccuucuuucccacgaugacaauauaaaaugcuucagaaacacacaucucagcaaauugcuuuuccucaugacaauuauuuguccuucuaauuaacacuauucagaaugagauauuuucugagaaacaaaguccccuuucucacucccccuuauaauaauaauugcaucuacuuguauacagagaguuuacauaugucauuuaaugugauccucuaggaaugauggccccauuagauaguaggcauagguucucaugggaaugaugacccuguucgaugaguaggcagauauuaacauccucacauuagaauucaggaaaggaagacacugagauuuggagguauaauagcuagagugguuucugucuguuacagugagacccuauuugccacuuuuagucaguuuccuguuacuugcagcucaauuaacacugguggaaacagucacauacaggguaaauacuggagcuagaacuuaaauccagcccaucuaacaauaaauucaaagcucuuucaauuaucgcauguguagaaaguugguaagaacuagaguucaguuucuggaagaugacugucuacuuuuuuauuucaucuuucuuuacucuucacuuugucuccuaaaguagcuccccagcagguaucuucaucucucuucccguucuugccucuaaacacaggucuguucuuauucauaccagcuugucucuccccaccaggccugagcugaccugagcaugccagggccucuuucuacccacuguuccagcccugcugcucuccugcugauuauuugaauuauguuucaagauauagcuuaaauguaaccuaaaaaauaugaaaccucccauuuucuuucuuuaguuaacauaacaccucgcuccugucauaauuauuguuccuaucacaugguaucauaauuauuagaguguuucucuccacuaggcaaagaccuuucuagagagaaagccuaggucguaucuggcccuguauucuaccaucugggacauaguuggcacucagaaaauguuuccugaacuucugaaacauugagugcucuaauugaacuaugugcacaguacgguauuacuuuucagaauuaggucauucaaaauccuaaagauauuuuucagcuuucauuucugagccuuaaauuuaagguaccugaacuaacauuucacuaaggcauguuugaaacccauauuauggaugaguaucuaugacuuuaucugaugcuuuuuauacuguuguauagauuguaguaugacuuuguuucucaguaccuuccagugauuuguuugccauuugcugaucuggauuggugauguaguuauuccagagacuagcugauuacagugcccucagggacugauaaaguuauuuuaauagaaauccauuugcccuuuuaugaaaugaaugcccccaaagucuauagaauugucacguuguagugaaugugcuguuguuguuauuauaauacacuuuguagguacuaaacuacuucugcggcugcuucuacugcucaucgcaccaucuguguugaauaccagucauuagcccucuuuuucagucugaugauuuuuuaaauucauuuuuccuuugaauccauuggauuccuucuccugucacuuuccccaugcuucuuggauuagacaacacuaacaccauuuuuagggcuguugcuagcuagcccuugagaaagucccguuuuuagagauuucugguuaccuuuagcauugagaacugcuccugcuucauuuauuucuucuuagaguuuugcuuuaaaagauacaguaaaacaaugcaacaugauacccugguuuaccaaggucuucuuggcuccuagagaaaggauuugcgacaacuuuacugaauuauguuugcuuaaagugaacuacaccuugauagcaauuuaagauucucaacauguaagauguuauuaguauuccauaaaacuuggauuuaugagaaaccaaaaaguuuaaaguauuuuagaaguauuuuuaaagcuaguuucauauccugcagcaagaaaaccauaaauuucucucugacaaaggaaucagaaucuguuaaaagcauuugucagugauacauuaauauucacgauagcucaugcaauauugcuuaguuuuugguuuguuuuuccccccaaguugagacuuugaauacagcagcauuuaaaagggaacacauguagcucgaaaggaugucaccuucauuccuggguugugcaucccccuggaguuguugaccuggaaguucuaauagaauauguguuaaaaauacgggaaacauauuauuuuaacaucaaaagaggaacaaagaaaaagauuguuuuugcuuuucccaacugcccucugguggcaaaggcacaacagacagcaaagacguuuaacaaagauucuugcuguguaggugcugcuggugguucuuaagaggcucuuaaaccaaagucuguacuguacaugugugcuucugaaaaagaagaacagaauauugggucucauaauuauauuuuacuucccagcggcaucuguucuuaucauaguagcaccaggcucuacuagcucagucaauacuuguauauuaacaagagacaaucgauagaaaaauuaaaaggaaaagucaagguaauuaggcuaaagcugcugcuuauggguuuucaauaauuacuuuagcuuccucuuguuuucccaucuccagaaaaauagggccugauugaaggcccugauugaagggccugggucguguuugacugaggacaugucaaaauuauacaaagccaagcaggaaauaaaauuaagcuguauuuguuuuagagcaguaaaaggggcuuugcaugauggcaugggaagaauagauguugauuuaaauguaccccuuagcagcugugccauuguugguaccuguuucaugucaucaguuucuguacuacuggcaguagcccacucaaaagcacuaugacaugucauguauuaaauuaaagcuccagaggaagauagcgaauggauuucuccccaaaacaucaggauauguuuggaaacuagaugccauccuuuaugaaaccaugaaauuagucaaaacccccccaugguugccauugugggccauacuugggccauuguucuuuauggacauaauugcuagagaucacuguccauuuagugaggcuuaaucaacaagccacacacauugugugaaggagucuaaucuuugguuuugagcuacuuggguguuuucgugcccugaugcugugaaaucuucuaaauacaucagagccacccugcuucucacugcugcuuaguagguuggugugucugccuccuaggggaaggagaaaaccagaggauuuccuaguuuuggagagagaacucugaggaggaaggauaggcuacugagagagagauuucauuuuuuauguucauuuacagucuucauuugcacuauuucugucagcucaaaguacuuuauaaacuuuacaaccaaauuauguaccaacaucauuucauucauugcugauauauagcuguuaaacaucugccagguacacauuuccuggaggcaaaaaaaaaaaauguggaagagaauuagaucuuguuaaauguucagagaaaauguagauauggggcauauuauaugaagauauuuauugagcaccuauguacaaggcauuauagaagacaucuuagguacaggaaauauagcaaacucuuaacucugccccucaucaccgcugcccccuugaaccuccccuccuucccuccuaaguuuguuaaucaaaagugaguaauagagccaggauuugaauccaggagagucugauuuaaaagcacaaaccuuucauuacgauuuuuacuugauguuuaaaagaaagccucucuaggggaagaagaaauguacgaagcugguauuaacucagugaacccaaaaucuaacugaugauagaguuguugguuugggagagugagauagaagaguauugaauuaaauguacaugcccaaaggcauugaaaaguuaagaugaggaagcacagauaguacuagagcuuugaugagaacuguuguuaauuauuuuuaaugccacaaauggcuuuauauuauuccaccacugguuaagcuugcaugugugaaucccugcugucuguaaaaccuccagcaaguaaaaccuuugcugauuggugacuuggcucugucauuuuuauaagacuguaccgaggcucgcagaaaaugcuugauucuauacacccuuuagcuaaggccaaugaauugcacaugcagccaaaccuggacaaagcugaucgcuacauuuuugcugcuuuuugcucaugaucccaagcguauagaagguucuagcugaugauuucauggugaaacuaguacauaauaagcauuuguguuuuuuacuuaaaaaaaaguuauuccaaaugcauaaucacuucuggaucagcaaugucuagaaauuugccaaggagauaauuuuugaaaguucacuuuuucuccccuuucuugauccuuuuuauuuaaucauucccaggaaagguucuuucuacugcucugccuuuuuucuuuuauuuuuguugcuuccauugucacuccauauuuuuugucuuuaccguuuugauuuucacccuauagaaaguuugugugccaaauaccaaauaagaaugaugggauauuaugcaagcacuaaggcaguagaguguaguuauguaauaagagcuuacacucgaguacagcugccugguuugaaucucaacuguucuuuuaauuaauuauauaaucuuuaguaaguucuuuaaacuuacugucuaauuuuaucuauaaaaugagaauuauagaaguaucuaucuucuagcauuguuaucaauauuaaaugacuaacauauaggaaguauuuuguacacaguguucuauaaauaaauguuaaccuauuuaauaacaaaaacuuauuaaauuaugucuguaagguauguguaaugauacagaaaauguucaugagagaacuuuaagaaacaggauauaaagugacgugaucacagcuauuaaaacaagcauuuaaacauuuuugaaaagacuggaauaaaauaggacaaaauauuaauuaugguuuauuuuagaacuauugccuccuguuacucuuuuuuuuuuuuuuuuuuuccuguuuggguuacuuaucacaauccacaguuauaguauuggucuauuuaguugguuuugauggucucuccuucuagcauguauguuuuaaaugagaaaggacucaagucaaucuuuuucuaccauuauauauugugucuaaugccaagugucuggcacaagacuucucuucaauaaguacguguuaagugaauauguuuaccucuuacuuuucuguguuuuucagucauauuaacagaaaaucccuguuacaacauuuuuuaaaaaggcuauuuuuaaaacauuagcucagcuuuguuaaaggcuuaaaauagguaaccuuaaaaguauuacccuauaguucaugguaaaguaucaaagaagaagaaaaaauuucucauauuacauguucacuuguuuuguuuuguuuuuagaaguggccauuccaacucacagccuuuauuuauuuuaacuuuuugauguuuuucuuguuagcuuuuaaucagucugagaaaauccuagguauauuuaauuuuccccuauucuguuuuacacaaacuaaagcucuuccuuuuugauuaggauaguuaguuucaagugacauaaagaacuuucguuacuuugcuaguuaaauguuaccuuaaagccuuauuguaggugaggaaauaucccuuuuuuuaauuccaaaaauuguagcaugauuaaugaacucacagauuccuuuagugguuuacucuguguuaauuaucccagugccagaguuucuaccuaguaugcuuugacucacugggccacagugcauuucugccuaaggcuggguuacauguaacuuaccugcagauaugccagugagaggaauacguguuucuuugccagagacuuugcuuuccaguaaaacuuggccuuggcauucguuguugagguucauaagguuuucuguuagcucuguaauucagugcucauuuuuaaagaugaaacuucagugaaauaggauuguaacgauacacacagguucauacagagaaaauucaaacagaaugcagaaaccuucucaucuguuacuaaaaaauuucaaagccagagaugcagcccaucuuucucgugauuccucauucaacugccagacugacagcaggaaauucuaccaugauccuuaugagucagggcagcguuuucucuuuucuaaagagggucucacugaaggacuuuagagaaagcaaaaacaggagaugagagaaagagagaaggaaauaacuugaggaaagucagagguucagacugguguuuauugacuggguaauacuaguaguacaacuacaccuggggaauguuaggaauuagguccagacaaaagguauguuguuugaagcagcacuuagaaaaacauccacuucucugaaucuuugguugaagugacguaauuagaugugcauaaugaaucuuccaguagcauuuuguuacucugaaggucugagacuuuucugagcccuuaacuccaaguugguaguaucuucaguuuucugaaauaccaugcuauuauugcucuauauuaagaucuguuguuuaauauaauauuggaaaguauugcagcgaacacaccuaaaaguaauuacuauugaaaguaauguaguccagaauaaagacaacuguacgcugaguagaaggaauaaaugguacagguugaauuuuucuuauggcagugguaguacuguuggggaugguggucacuaucacuguuauuuuauuuuucuuacagggaauaaacuuggcauguuuaacuugugguuagaacgccaagaagacuaauauuauaguauauaguaacauuuauuuaaaaucacacuagaaauagucauagaaauugauaugcuguaucaaaugaaauaauuugugaauugauuuugaaaugcguguacauugaaguguauguugguaaaaugaugauggugauguaccuuucugaccuugguguauucauuuacccuugucaaaaaauaaaggugauuugagcuguuuugcuccucagaggauccaacugaccauauaaccugacuuccuagccacucuguugcuccccgcuccuucauccccacgccaacauaacugcuccuauucugagacaguguuuuaaaucuguauuauucagcaagaaaaacacaacagucagggagaauaucaauuauuuucuugccuauccguaccaucacauaauugcaacaucuacauccugaucgaagauuuggucuuucagauucagaaugucucauuagcuuuuugcucccugucucauacugaaaaaggagaaucuaaacagucacaaagacuagcagaccaguagauuuucucuucccgggggcauauaccuaaaucuuugugcuagaccagcccuauuugcagaucuaagagcugcugguguauuaugaccagagacacugcaaagccuguauugcccccagauuuuuguuuucacugaucaauuauugaccugucaucuuucuaccuggccuaagauuucuaccaugauaguuaauacuuuggcuuagacaaugaaccugaggauuuuuuuucaagaaugauacaguuuugaagaaagaccuuagaucuuagaacucuacagugacccuucuucacuaacacacuguaucaguaaucuaggagaguaugagcuaggcagguuucaacauggggaaagugaagccuaucaaucaaugagccccagggaugagaggaaccacaugaaggcccagauugccuaggcauugcagaguugcacugggguccccaaaauuacucccagguuuggagauucacuagaaggacuuauggaaccuuagcauguaauuuuauuuauggcuaugauuuauuacagugagguaguaagguuacucaacuggauaacaaggggaaaaagcacagguguugaggucuagagaaauccauguacaggcuuccugugcucucucccuucccugagagggucauauagagcacagucuuccccaacagacaaaaaugcagcauuugcgagagauucagugccuaagauaagggacuugucaccuggucacgucagcaacucucucacuagcauaaaccaaaauuucagacuuccagaaggaaaucagguauuuggcauaaaccauguuauuugcacagucuagcauaggaaacuacccuuaucagucagggaaagguaagcucacuuccaaaacccuaguucccaaaugcuacuccaaggccaaccuugcagacaggcccuucuuaagauagcagccucagacugcacaaagauaaguacuuggcuucaaggauuucaguggauaggcaacauguaaaaauaggcucaggagccuggacaguugcugccuguuuucauacaugagagauaaauacuuuugugcuugcauucguacauauaacucacuauuaguaaucuaagggaacuucauuacuuggaaauuaaauucaggagauuuaggugcccugcucuuuuguuugagaaucacugcccucugugauaggcuuuucacuggagccugaagggaugauggaaaggagagauauucccccagauggccuacuuuacaauuuuauccauaucucuggguccugauggaugguggcccauauuuaaaagcuuuccgcauaaucagaaugaagaacucuaaaaaugugacuuaauuguuuugagucuuuuuuuuugagccagagucucacucugucucucauuguggagugcagcagcaugaucucggcucauugcaaccucuaccucccagguucaagugauucucauaucucagccuccggaguagcugagacuacaggggcgcaccaccacacucagauaauuuuuuguauuuuuaauagagaugggguuucgccauguuggccaggcuggucuucaacuccugaccucaggugauccacccacuuuggccuccuaaagugcugggauuacaggcaugagccaccaggccuggccuguuuugagcuuguucaaucuaugucauaaguaaaccuaaucuuguuaaacuucaaaggaauaauauugugucuaaaauuucaauucaagcacugagcaugauaugaacuaguaucuuaacaucaaaccaauggucaauuauuuuucuaagcuaaauugcuucuccuuuuacaguaccuugagguucaguagaagacgaacccuaacacuuguuuaagauauucugcucucccuuauugggcuuccuaaaggugguuggcaguuuuuuuuuuuuuuuuuuuuuuuuuuuuuuaaccaguggauuuuggugccaugaacucuaagcagauaagccacugagaccaaaaugggauugcuuuaaauuuagcagaagugaaggaaugguacaaggccuaauguguuuuucuugggucauaagcagagaagggagguuguauauuagaauuaucugaggacucagauuacaugggcuucuguuucuccacuacauccacuucccauugucuccuuucccugaagacucuggauucuguguguccuuaacagugagccauugucaugaucauggauggaaaugugcuugauauuucaagcauauuuagaucucgauguguuuaaggaucauugaccugaaacacuuuucaggguauccauugaacuccauuuccuuaauaggucuuacacucuuuugguuuuauaugguguucccuaaucggagauucagagcaccauugguagcucacuuucuucuguaaugaauauauauguaaagcagaaugccuguggugcuucaugcugugaggaauccagcuuuaaaacuaugguguagguagugugcugcuagagaacgugaguaacuguugugugaggggauuauggacuuguuuuuaaccuuuuuuuuuuuugaaauagggccucauucugucucccaggcuggagcacaguggcacagucauggcucacugcaacccaaaucuccugguucaagugacccucccaccucagccucccaaguagcugggaccauaggcucacaccaccaugcccaaauaauacaguuuauuuucuguagauaggggaucucccuauguugcccaagcuggucucaaacucuugggcucaagcugucuucuuaccuuguccucccaaaguguuggggcuuacagguaugagccacugugcccagccuugaacuuuuuugaugggaaaacuuacaaagacccauuuuuggagaagauaaaguuuccugaaauacaagaaucacaccacuuggacagacguuguuuguauuucacgcccacacaaguguguuaguguggagaaggaccauuuuggaagaaaguacuuuuuccucugaacugguuuccugaauccuuuugaguuucauguuuuauggaagaccaucaaaauauuuggaaggccagcuuauuucauggucacaaaggcagcuuuaauugcuugcauaaaguuggagcuugucuuucuccuuuuccaacaaagugacauuuauuagcaauucucugguaguuauuuguaauugcacuaguauucaccauucccaaauguuacaauuaaaucauuugagagucuagucacauuucuaagcagauguaccaaauuacagcucaagacuucugcuugaaaucuacaaauccaauuaguaaaauuuuggggcugggaaggguuagccagggaaagaccugagaaaacacauagcccaaaauaguuugaaauuuccuugcugcuuugccuccacccaaaguugauuugucagcauguaaggggguguuacaucuuuucagaaacugcuugguuuucuuuucauucaaguuuaauugguuuucauggacugaauugaagcaggaaggcauaaguuagguagaugauguaagugagcaaaucuccauguauagcagcaucuugauuuggguguuuguucuuuguuguucuuuuauuucugucaaaaccacagcuucauauauagcucuuuuugucacaugaguuuuuacguugucuuaaaacugugaaacaguuacaucuaguuuuccuuuuuaucuugauucaagagcccuugaaacuauccuuuuacauacuauuuuuuuucacuuggaacggcuacucuauuauauucucugaauuuucuaauuuauuuucuucaagaccagcauuagccagguguugugacccauacuuauaauuucagaacuuugggaggccaaggugggagaaucgcuagaggccaggaguuugagaccagccugcacaacauagugagacuaucucucuaccaaauaaauaaauaaauaaauaaauaaauaaauuaucugggcacugugguaugccuauaguccuagcuacuugggagaaaaaggcaggaggaucucaggagcccaggaguuugcagguacagugagcuaugaucgugccacugcacuccagccuggacaacagagugagacccuuucucuuaaacaaacaaacaaaaagaccauuaucuaaaauuucuuccucuaguaaguauuccuuuucuggaggacucauuuauguuucucagcacuuaagaauuuaauuuuacuuguuuuaaaaggcggacucugugaugaagaggaaaaagcgaaaaaagcaugggugcagaguccuaaguuuuuggacuugcaacugccuuugcugcuuucugucucugugaauuuggucagaucaguuaauuucccaguccacaauauucucaucauaaaaugggacuaaugguacccaccuuucugggaugauguuuucucguuugcuuauuuguucuuucauugauucaggauaugcauugagcauuuacccugugugaagcccugugccaacaccagaaugucaggaaggacauagucuaugcucucauaaaacccaccaucuauuagggaaaaugaacauuaaaaaagugguuauaagugugaucacuguuuaaaaacaaaaaacaaaaaagagugaguacaggaugccaugggagcauuaaacagaagcagcaaguagaaaccaucagucuuucuuuuuugaugggguauggagagaaggcacaaguaacuugacucaacguguaaauguuaacuuaaugaaugucuucacgaaggaugaggaaaaauaggccuuguuuugcugcccuuagcaaagcuugcagguguuucaccagucucaguuucccaguucuucucaaccuuugaccgcuccacuggcucugucagacaucaucccacacagaugcccaccucugaugccauguuuugcuaaugccauccugcuuaggcaaagcugguucauuugucuuccuuucucuguuauuugaucacuuccacuucugcaacaccauucuuuuuauccuuauccugaggaauauucuugauauuuuucuucgucauauugaccaacucuuuuaaagaucaaagaacucaaucuuuuaaaaaugugcuuuauguguaaauuauguucugugccuuuucagcuuaaauguauaaauauagaaaacuugauccauuaggaauaggaaugggaagaagcugagguaacuguucuuuccaaagaccaacuuuguaguccucauuguaacuguuuauuuucugaaucugcuaccuuacuguggucucagugaggcaggaugagaauuuauucaccuuuguguuacuagcauugacauccaaggaugacagacacuugauaaaauguugucuaaguaagggacuauauuaacaaacauuuagggcugagcuuagaugauaucuaaacaacaacccaaaacucuagaaaucagcuauguaaauaucuaauaggcacugcaagauauaauuacuacuacagagauauacugaagacauuaaaucgcccuaccaggggaggugcagaagagcucgaugaauguuauacuauuuauguuaaaggcugacaagaauuucuccaggugaacaaggaaggaagcacauuccugccugaggagucaaccugcagaaagcauagaauuggaaagaaucucacauuuuugcacagcuacaaguuucucacuguaccuagcaugcugaguguauuuaguggcgugaacuugaggcuggaaggguggggcgaggcuggagccuaacggccuguuuuacagaggacucagaacuuuagacuuuauggguuguggaauguugaaggaguguaagucaaaaugauuugaucagauuugaacuuuuagcagguggaaaaaagggaagagaaggugauuauaauucuucuaaugugccaaaaauucacauucuuuauauauacuaacucauuuaaucuucacaucuuugaugcccacaauaaugugucagucacguagaggauguuuugaaugggggcaaaaccaaaggcaacgaaaguaguuuauuauaauacccugguugagaaaugauggguccuugaaaucagauuguuucaguaaggcugagaugagggguuuugucacaagaauugacaggucuuagccuguuggagguaaaggggagggagaaggccacggugaucccccaauucugcccugggcagcuggcgauggcagugccuuucucugagcuagagacugagagcagaagcagcuuucuggagaaagauguuaaguuuagguucgaauuuguggcauuugaggucccaaacaaaaacugagaaggaauacgcuuguuaguuaggaaugccucucaagagcucaaagggcuaucaguaaaagguuuauggaagggaguuguugguacuugggugcuagcuggaaccaugucaguaguggaacuauggagguuguuaaauaagaagagaacugggugacacuuuagggaacauaaccauuuaaggaauggucagaggauggggacuaaagggaagauucuacuacuauauacuguuaacauuuuuacugugauaaaaucauuagccaucauaaauguacaguauugauugauuauaugagaugcucugauguacuaugagcuaugcauauguacuguuuuaaaguccaacuugauuuuacuuuaaugcuaacaaauaagacaaacaucacauauuuaguuaauaauaauuuucuuucugucuuagaauuuagaagggcuaagaaguauuacuucuaagauguggucuaaagcucuucaaagggacuaaauugaugcuuucuuuuucucuacauauuugcccuugcucuuuaugaggagggauuguuugcauuuucccacagaucuguaaacauaguuuuauaguugcuggucagugaaugcguauugaugauguucuuuucccuacuuaaaacaaaaaucuugccagaaauguugacccuacauuuuuuccaacauaccuuucucuaucaacuuagucuauuuaaaauauaaugaaaagcugagaaacaggcuaaagaccaacagaaaauaagugcuaacaaauccuucauuuaccaguuuuauuucugcaagacuuacuugaaguuauauaaauucuucacacuaugaaacaguuaguaaaccauuuguuuauauauguguguguguguauauauauauaauauauauaauauauauauuauauauauauuauauauauuauauauauuauauacauauuauauauauuauauauauauuauauauauauaauauauauauacacaucucuuuuuuuuuuuuggcggggggacagagucucacccugucaccaggcuggagugcaguggcgccaucucagcccacugcaaccuccgccuccuggguucaagcgauucuccugccucagccucccaaguaguugggacuacaggugcacgccagcacgcucaguuaauuuuuguauuuuuaguacagaugggguuucaccauguuggccaggauguucucgauauccugaccucgugauccacccgccucagcaucccaaagugcugggauuacaggcaugagccacuucgccuggcaucguuuauaauuuuuaaaaggucuguagaauaauaacaguaacaccuaauuccaucugcugaaugccuagcacacuagguucugugcgcauagguauaguacaugucuccucucauccacagaacuaugugcucaaccacccugagccucuuaaaccauuuccaagauauuccuguuuuuaauuucuucgugucuagugucaagguguaaucuuugaucuaaauagcuugcuuuuccuucucucuguuaaccucuucauccuccaugacuuagcuuauauuaccagagucugcaugguggcuguauucucaguaagaucauugggaaaauagucugauacuaaugaaauauuugaaugaagaaaaaacaucauguucuaucccaacauaacuucuuuuaguuccauacccuccagcucuuuuccucaugcauguguauucuuauaaaaccacuuguacuauuuuguauucugcuuuucucuuacacagcauauuuuuucauauuuccauauaauuuucauaauuaucauuuucaucauaaaagcaauguuaacccauuacagaaaauaaaucaaccauaauuacuaucuugaugacacuuaacugcuuuuuuuccccuaaguacucauguuacaauuuaagguaaaggguggggguauuuagcugaggaagccuagacugucacuuuuaauuuugauaauguuacuuuuucacaagaguuccuucagauucacuuacccucucugaucuuucauuaucucaccuguagaaaaguguugagcuugaucaucuguaagauuaucucaaaaguccuguuaagcuguaacuagucugugacucuaugauacucugaauguuauaauccucucuaauguugguaauucuucaccuuuuugugucauauaccccacugagaaugcggugaaaguuuugaauccuccuccauuuaaaauugccacucugcacaaacacauauaauguuucaugcaauaccaucuggggaucaagaaucuuuugcccuaagcacaggaaagaaaaauuuauggaaaugacauagaauucagaaaguauuccccaccuaacaggugggagacuuuauguggcuuauuuuacucuaauauuaugcaaccaagaaaguagaaaauuggaagauauucugaaaagcauguauaaaacacauugcaagguuacauaaaauagugacaaaaaugaguucaauauaucuggaucugaucugauuauuuaguuuaggagaaucgcuguugucaaagauggugacucuggaaaugcuaaacucaggcuucuagaaugagaaggggaaaaugggcaaggucacgauggucuagcugcuuuuuaaaaauauguauuaagggauugaauauguuuccuagcuucacuguauauuauuagaaaaucuaucugugaaauugguuguucgagauuucguuuucugugcguaaguggcuguucagaugcuuacaugcugucuuaauaccgaagaugccauccuuuuuuccagggcccucuucuuacaugggaagauaguggauccuacuuuaaaaugcgauuauaguggggaaauaauauaauguugaaugugagccauugaacacaaauugcauuuuauggcuauaguuaaauggcucaggauuguucugcugaguuaagggaggugggaggaaguaguuuuaggaaaaaaauaugaagcaucuuacuuuuaaaaaaaugcagauuguguuugcuuugugauuuugauguuuaaaggagugucaugaguaugcuucagcuuuggaaguguccagguugagaugagagagaggaauguuagacagcccuuuuccugagggauucugaagucaaaacuacuugguggauucuucugagagaggccuaugccguggaaucccaaguuggauuaaauuauggugaaaaaaggacaauaaucccacagugggauaucuuccauuguccgugcaaaacccuucuauauuaacauucuugcaauacugcaggacuggauaaagacaagguauucguauaucuggauucaccuaaauauguguuuguucagugaccccauuggcuccucgucagcccugagugcuauucauaugacaaauacugugugggugcuucuguguuuauaaacucauuuaauccccuuaacacgccuaugagauaguuaccuuacuauuauuaucccucauuuuuaaacagauaaggagacuaucuuaaaauuuuuaacacaauuugcuuaaguugacacaaguaaaugggaaaacagagcuuugaacucaggaugucgagcugcagaaccugcuuucuuauccagagggguugaagaaggaucacauuaaugguugcuuuuauuuuuuguucaguugggggaauuuugaauugcuagacuauuuaggaaaacaucuuuauugggauuauuaguaagugugauccaggcagaaagucaugaagcuaauaugaaauaaugaaaucagugcauaguuuauuuauuuuauuuuuguuuuugagauggagucucgcucuguugcccaggcuggagugcaguggcgugucucggcucacugcaacaucugccucccgaguucaagcgauucuccugccucagcuuccugaguaguuagaggcacgugccaccaugcccggcuaauuuuuguauuuuuaauagagaugggguuucaccauguuggccagaguggugucgaauuccagaccgcaagugauucucccaccucugcuucccaaagugcugggauuacaggcaugagccaccgugcccggcccauaguuuauuccuugaauugaaugguuacuuauugaaugcuuaugauaucccaggcccuagggacagaaagaugauuaaaggcuaggucucaaucccugaggagcucucugucugggagaagcagauauacaaaucaacagguacacagagucacauauacagaugccaugagggcacuggggaugaacacguguucuuuguuucacuuauauuucgagaaugcauauauauuuuugauaaguaaaauagacacaugcuauauaguuauacacugaaaguguguauguguacaucauaguuucauuaauuuuucuugccagacaaccagaugauucuuuauuaaucuuugaaguuuaauaaccuuacuaagauauagcucuucccccugccccccagagauacagcaugccuuuuuagucuguagacuacagaggacaaagaucauguuauucauaaggggaaaucaagaauucaagugcuuuggcaguuucaagugcuuaaggaaaaaaaugcugaaauuuugaggugucucuagaggguaaagaggaauaaggagagggaccacuaucauguggacagaguagacaguuuuaaaugugaugaauuuuuuuggauuuagggauugcuccccaugccaaaaaaccccuacgggcacaccuccuagcccagcuaauuuaaaacaaacaaacaaaccaacaaaagaauuuuuuuuuuuuuuuuuuguuagagaugguaucucacuuuguugcccagacuggucuugaacuacuggcuucaagcaguccuccugcuuuuaucucccgaaguuuugggauuacaaggaugagccacugcaccuguccagaauccuuuuucucauggaauauuaaacuaagauauuauuucucugagcagucaucuuuuaaaacucaaguggaucugggagaggcuacuaaaugaugaugagaugaugaugguaacauuaugauguuuuaaaauaguacauagcugcacugugucucaggcacagaucuacaguggcuuuccaaguacaaguauuaucucacuuaaaaacagcuguccuaugaguguccucauuuugcagaugaagagauuuuggcuuaauagauuuacauaacuuuuucaugguuacaugacuaguaaauggcagagccaggauucaaacccugauaguaugacucuuacccccacugcauauaaaguugucauuagauacuugccaccuggaaucaugaauugacuccuuuccuguauccucuaugacagcaaacugagagaaggucccugcuuaguuggaauucugauggagguugagggaaaagaagaaggagaaagguuaucaguccuuggauguugggggcguggggguggucagaguuuaggaaggaguacaguagaagaaaaguaagaugggaaggcauuggccuacucaccugcuuuccaguuugggcuagaagcagucucagguaugagaaaagaacaugaaagggcuacagaaaagaacugagaaggaacagugugcaggugagaauucaguuuugacucuccacgucagcacgaguuuggccaaugaugaaauggcguaaugagugaaaaucccuuacuggcaaaaucaccagaaaguaaauucuguuuuuaggggugcuguugugcugcuuaguuccguguaaucaggcuacucucuugggacagccauuguaaacacugccuuccugauaaggauauagcaaguuguauagagucaaagccaauuuguuuaacagagccauucagaagacccuguccauuuuuuguucuuuuaaugaagaaaguaacguuuugaauguaguguuuauguauagugacuauauuggaauauaauguguaaugcuuucaauaaacccagaaacuuuuccaaaauauugucuugguucauaggaugugauauggaaggauagacaccgucuuaauauuuucccccaacagaaugucaauucuuagaguagggguggggcaggaaagugggcuauaaaaucacuggcuauaaaaucaacuuuuccccuuugaaucucagaauucagugucuucuagggcagaucucuacucaucaucucuaccugauaugaccgcacacgugagugccuggcaccugcucuuucucuugcucugaugaccacuuccuuucugcccaucuguuuugaccucgcaccauucuggagcuuuuaggaaaggcauuuguaacaaaggcaggacccaggucuccugguuuucaucuccguauuguuuucacuauauuauaaaaccuucuuuacuuaaaaaaaaaaaaaaguuuaaauguagccuagcaugcuuaauguccuaucagguugauuuaaaaggggccuuuuaucuggacaacagaaaguucuguguaacaaaaguauuuccaaggcuuaggaaaugcucuuauuucaagcaauauuugauacaacaacauucuaagcaaauaaacagauacauaucaccuuuuguauuucuguuuaucauuauuugacccauaacacccaguuuuacagcuugauggcaaaaaaacaagauggcaaauucacaacccugcagcaaaauuaucauguguucagccuauugaugauaagugagagggcaaacaaaccgauaaauuaagaauuuaguauuaacaauaaaucuacuggggcuucagccuucccuaauuaagaagucuuagagggagauuagcauucucuguugauguuuaccuuugaaauuuugaacaaagcauuguaagcagaagaugcccuaaggagcauuuuuggaaaaaucccaacaagugcauagagcgacacagaugagaugauucaauuagcuuggauaacacuauuucuucuaaaguaucugaaacagacucaugaaacucauaaaaagccuuguauuuucuaccauaugugagaguuuaagggugcuuaagagccugcuuugaaagguuugcugaaucucucgguaaaaauuauugccggauuauauggaaaagagucaaucuauaguauucuccaauugucagugucaucauggaauuuagaacuggaaagagacuuuagaacucuucauaucugacucuuuacaaaacagugaacugaugcguuggcuguugacucagugaaguucccacggcuggcuuuggcaacagaccuagggcuagacuauguugccuggaagauaaagaagcauucacugcucuucccaucccacuguauugccuggcuaguguuugaucagcuuuucaaugugcggucaaguuguugauugagcuaguaacuuauaagugaauuaucuuuaugauuguguucauuucuaaccaugucccugugcaguuuacgaacaauacuaaucauaagcaaauacuuucaccugggcccaaugauuuuuaccuguacugaccaagugaacaacuuaggcuggcuuaugccagugaaguggugcuucucccuccugacaugagacuucacugaagugacuugccaagaagaaaugagaagauggcacguggagagucauguggaugcucuucucugccucaagcucagcucucacgugcuugaucuguucugucuguguccuuuaauauaaauguuuaaauguuuaaaugucauuggguacuugguuauaggaggaggcagagcucugaguggaauccaugaugguccugagaccagagauauguauuuuuuucuuuucauguauguaugucuuauauccccaauugagaauucuaucacugugagugauacagcuucagaauccugaaggcuaagcuauuagguuugaacaauaugaaauugcugguuugcaacuauauuauaucuacaaaagggcaaguucauauagcuuaaccuaaaaaguaaaaaucaaaugacaucagguaugugcaaaaaugucauaaauggcuggugaauauauaagaaguucaacauuacuaagagccaaaaauugaaaauuaaaauaagaaaccuuuuuuuuacuucaucaaauaguaaaccaacaauuaguccuauacuuuccugguuugagcauugauuaauacaaccaguaaguaugcaaauauuuaaacucaguguuuuucacugauagauauuuauaucaaggugcuagauugauaugcauauaaauauuuuugcacaaauauguucacaauuuguuuauaacagcagaaaauggaaaacaaacuaaauagcaauagggaacguaaguuaaucaugcuguauccauauuacguaguguuauauaauuaaaauuacauaauuuauuaaaaugauauuuaccaaguguuuuuaaugacacuggaaaacauguagaauauaagaagugaauaauuuccgaauaguauguacaauaugauaauuguguaaaaagcuguaaacauagaaaagaacaagaaaauacaccaagacauugauaauguuuugacuuuuaagaaauauuuuuucuuugcuguuuuaauuuuguuaugcaauuaacaucuauuuuuauaucauguauauauuaauaauuacauauuuacaaguguuguauaccgauuuauaaagucaauaugcucccuggccaaaagguuagcauguucacaugaaaacaugcacauaaugcguuucuaacaaguucccaaauaguguugaugcuauaagucuggggaccacacuuugagaauuacuaauguagagaaucaccauauggggauauauaucccagugaguaaaacaaguuccuggugucaacauguauccauugcuacuccccccugccacagccucugcuuccagggucagaaacucuuaccaauggucguuggauuucuuuaaaacagggcugaguaccaaguauaaaugcugucucgaagucaccaggcuguaacaaauuaaaauuccugucuguaucccuuucaccuagcacaguccaugacuuaggaaaaaaauguucaguuguguugguugguuuauggaauggauuaagugguaaagaguacaguuuugaaaucauaaaaaaugaauuggaaucuuggcuccauaaacuuacccugaugugauguuggccagauuauguaaccucuugcuccccgaguuugcucaucuguaaaauaacuucaugagguuguuggaagaaguaaaugaguuaauacacaaguuuuugaauagcacuuaguaaauguuagcagcuguuguuacugucauauaggauugcuugcauuuuuaaucuuuuucaaaaaagaagaguuauuugaacaccuagccaaaaaggaaaaaaaaaaaagauugcaacagcaaacacuuucaagagggggaaauuauaguuuuuguuuuguuuuguuuuuguuuuuuuaauuuacuagggaaacuugcggaaaggacuacaaagaaaauagaauucucugaaaguaauauggcagguuuuacuggacauuucugcuuuuaguggcucuaacagucccaggauuuaccaacuaggagaccucucaaaagcauaugaaagugucuuagucuuguuuugauuuuuguagccauaaaaaauaaaccacaaagaagcaugaaaguuuucucuuuggccucaguagaauucuuuaaccuugugacuuuguccuugucucuuugugaauggugacaauacucacucccuuauagguuaguugugaagaugaggugaggaauuagcaaggugccaggcacacagcugauucaguuucaauguuaauucauuuuauuuuuccuccccacuuugccuucugcucauccugcagcccacauucccgucauuuucaaacguacagaagugaaaacuguguugucacuaggauuggcaaacuuuuucaagaagugcuguaaaaguucacagucuaauaauuuuucugauacucccaccauuaaaaaaaccuaugcucuaagaguuaauccaaaucgucaaaauaugaaguccuccuuucucuuccaggacgagaaggcuucaugaauauuuuaugauggcgucucuguugagggaugaauccauuccccuccuaggagaguuccagcaugcugugggcugccaggacuuagcccaggagugugguguuuuacugaggcaaaggugacacuggaaauuguuugguuugaggcguucaguucaaaaacuuucuaaucccagaagagugaauuaauuuccugugaggauuaggaaacaaacuuuauaucucauauaugcacaguugccauuuaauuuucuuuuuagguaauauuugaaauacugagaaaguuuguaguuuuaaguauauuggguaacauuucuagauaaguuguuuugccaucagcuaacccagcugggaggugcuuaagauugaucaagcuuuugcucaucuggagaaugaugaugucuguuauacauauguacagaucuuuguucucuuugacaucuggaagguggugggaaggagcaaauucaaaauacaaagacugguuuuaagccccaguugugccacuuauuaguuaggugaucccaaacaaguuacuuaaccucugcaaucucaauuaccacaucauuaaauacagauaugaaucgcuagguaacuacaguugugaccaucagcuaaguuaaaaugugagaaaauuucuacaaccaaugaaguccuacauagagguagauaggaccucuaguccucuauagagguaggcuguugcugcuaucuuuauguuauacuguuuaugaaaauaaguuuucuuuucuguaaaguaagcauaccuuuauuccuuagggaggguuuacacuuucauugaacuggauauugcaucuaaugaggauugcuguuuuuuucuccuugauuucaggauuuaacauuuaaaugaaagugaucccugccugccuuuggauugaauuuaucacugguuuagaauaacauguaugacacaaaauuuaaaaagcugaauagcugauucuuuuugaaugcagaguagaucauauuuucaaauggcuuguucucauuuaaaaaacccaaggcgaauagaauaccuauaaggaugguaggcuugggaauugaaagcucuaugugugucuccagaugugcccuguuaacauggacaaaucguuuauuucuugaucacuaaaaccaucauaguuuuuguauguuuaggauaaaaauaaaaagggagugugguauuuuaagaucuuuguguagcauagcauugugauguuaaaguuuauacuugggcucauuuuagaaaugaccuaauuaagucuuccuuuuuucugcauuaaucgccuuccuuuguauuaugaucuuuccuauaaggaagcuagcagacugacccaucauuuuucuuuccucaguguuaaauaagaauacauauuuuaaacuuuaccugugaaucauauuccugucucuuugguaauuuauuucccuacucucucuuuuuguacucaaaguaguauaugacuucuagaugacuugcuuuccuuucgaaggacagauuacuuacuacuaggagcucauguaaaaucagucuuuuaaaaauaugacuuugucccuccuagcuuagagauagagcuccauaaaacgaaagugaggaugauaucugguaaaguucagauggagcuaaagaaucaaaaucaacugaacuuuuaccaggaguccuuagugaaguaauugauugcauucuccaacgccccuccuucaauaagauuucuguuauuuguuuucuuuuacuugaauauggcuuuuaggaggcuuguauuuagaguuucugugcuuaugaaaaaagagauagcuuuauaauuacuauguaagaacuaugaagugggaaagaauacauuggcaagacauauuacaauuacuuugucaugcaucugguuauguuggcauauuuguuuaauuaaauucccugcuaauuauaacuguaugugcuuguguuaauuauuauuuaccuaacacugguaacaguguaauucuuuaaaggaaagcaacucgcuuucuauuuaaauuaaacuucaauuuaauaugcuuccuaaaauaauaauagugacauuucauuagaaugguaguugaaaaaucuuuaucuaccucaguggaauuuggacuggcuaaaauuuaacagaguuguuuuaauaucagauuguaauuagggaucuuaaaguuagaguaaaaugguuaacauggccaaaccaccagcugaugcugcacaugguucaucugcugaaggaaacauuuucauccuuuaaggaaaaccuugccugcccuuccaaacuuccugaucaccuacuauagaagagagagggaggaaauuauacuugacaaugauucucaaagaccuaauuagaagugggucuaauauauucucugaagcauuuguuuaaaagucaaauugcccaggucacuugguuaugaucacucacccagauacuuaguauauguguaagcuuuuucaggguugcaaaccuauucgaguuaaaauugaacucccaguggaguugagucuuucccauuucauucacuucauccucucuguuucaaaauucuucuaccucuacagauaucuucuuccucucacccuuugucagacgcuagauauuuuuaaauuucccuuacuuauccuagugauaagcggggaacucugauuuccauagcugcuccuucuuuuugcaugcauacuugcaucuuuucagagaguuugacucuuaccugguuuuuuuuuccuucaauuuaaaacuacuuccucucucugaaaugccaaucuaagaaaauuugcaauuucuucuaccuagucacucucccuaauuuacaucaaaaacuuucuuuucuaucacaagagcuggaucuuuggcuccagacagaaacgaguuuaaaacaugccucuucagguaaguugcuaauuuucugagccucagaguccuuauuuauaaaauggggugcucaaugaugacagccaucuagggcuagacagaaggugaaaugacguaacauauguaaagcaucuaauucauaguaggcuccaauuaaacaguggccuuuuauauacacacacacacauacacacacaccccuuauauaugugauguuuuauauguaccauguacacaccacugaguuccuuuugucauauucucacacucuuauuucaagagacaaaauauaccaacaaaugagacagaagcuacuaaaagugcuuuucaagcuuucuuagcagugaaaagucuuuucaacugcaaucuuacaugaaaacauaugaaacuuaugugaaacagagaaagggguaacugcuguccaugaaauacaagguccuuuuguguucuaagucagacccugcaaaaucagauaguucugagguauauaauuuaaaagcuacugaaccauuauuuugaauucacucacauuaaugagugcccacuacaugguaggaacugugcuaggacuagacacaaagacaaggcauaguccuucccgugaaggaguucauagucugguagacaaccucuuugaacucuuagauucagcaauucuagauucgguuaaaguaguuuuagggcaauaugcauggcauaaauggaauguguaaguaccuaggggauagaaaguugugcuuauccaugaacucaucugagaaggcuuucuuuggugaugauuugaacaguuugagccuugauugucaggagcggaaaugaauccucguguaaacaaaaaccucugcaagacuaucaaggacuaagacagaagacuaagaaacccugguaggaaacaacaaacauauugcuuaucacauuuauccucuuaaaugggaaagacggaacuaggaagcuggaaaugagguagaaggaaagagaaaggaccaguuguuugaugauuugaaauaaacauuuuuuauuaugaggaauauagauuuuuuuaauuaagaaaaagugcaauucagaaagaaugcuauuguccaucuugaagucuuuauugucucccccacaacucuuccccagugucaacugcgaaugggcaaucaggcugcuguccaggagagagaggcccuaggguauguaaaauacugcagagaaaucuacugugucuacaacagcaacugguucucuaggaaccuaaaaauagucaaaacuucuuuucaaguucaaacugucaccaagauuaguuaaugaaccuuaauuggcaaaaugaaaaugcugcguuauuuuuugagaaggauucuuaguuaucauaugaaauuuguaucugguucauaguaaaguguuauuuauuagccacacuuuaaugaauucccuaaaauuuguugcugaauuuaggagagauguucaguucaauucaacacucuuugagauugacuaucauguaucaggcacuguauuaagugcaagaguaaaaaggcauggcccuucuucucagagagcccauggucuagugaaggagucagaugaguaaguagauaauuaugaaauauugugguaagugcuauggaagaaaucuaaagaacagguuauagaaaagaggaugucacaucagaggccacgacacuuaaacugagucuuucagaaugaaugagaaauuaggcagaugaagacagagggaaggauguccuaugugccguuaacgugcaaaucacauacgcuuggaugucugauacuugggccgguuaacuucucugaacaugacuuuccauaucuucauugaguguuuaucacaaaacauugugagaauugcacgugcaaaugcagguaaagaggcuacucaauccuggugcauagucauuuacaaauaaguugguuuccaccauggcacacguaugccuguguaacaaacccacacauucuguacuuguauccggaacuuaaaguaaaauaaaaaauaaaaauacauagauuguuuuuuuuuuaaguguugaaagcugggcuuucauugccaaagaaggcaaauguugguguuucauagcagcugaauuugccaaccaccuacccagugguuaggcuacuaaaguggaaaguuucauucccaauuaaugcaccauuuuucucagagacuuugaacagacauguuuuugauccaucaaaucuuucuguccugggguuguguuugguuuuuauuccaauucuaaggucugucugaacacgcugugccuugagccauguagcacacagaaggacaaaugauuucuucuuauuauucuuuuuauuaacaauugaagggaauaguuaacauuuaagaaaaaaaaagacugacuugagagaaacuuuugguuauuuucuagugagggaaaaaaagcucuaaaugcaguaugucaaucuuguuuccuagauaacaaagcaaaucuaaaacaguuuugaacuuuuuuccuuauucccuuuaucaugaauguuuaauauccaaaggagccaauuuuuguugagaauuagcuuccagguuuggaggcuauuagcaaucaccacagggagccucacacuccaguucuauuucccauccuuuuuccugaaucagaaucauuuucuguguaguuauagcaagugccucgguuuugcuagccucaucugcuguuuuuaaaugucagccucugccaagcugaaacaucaugaaaguaaucaaauuauguauuaggaaagaguagaucauugcuucaauaaacuugccaaaaucaacauguguagccaucuauacauguggaaugucacuuugaucccccauagcuauuucaguaaugucauaaauguucucauaaucauuuuauaaucauaauauuaguuaacuauuacauuuuaucacuuaacucgugcuaagcauuuagcuuguauuacccacuuuaccuguacaauaguucucucagguagaugcuagaguguuauccagguuauugugaggaagcuaaggcacaagaaauuaagcaacuugcccauuagccuacagcuaacaguccuggauucauacccaggccugugugauuccagagcccaugcucuuaaaugcuaggcuacaccuccuucuuuuuauccuucugugaucguuaaaaaagacaugacaguuguugcuguaaaccauaauuugaugucuuaugauaacacuuaacuagcuuauuggugguuuuguuuguaaacauugaaaguaagcuuuagccaaugcacacuuaaucagauuuguauucagcaagugugcuuuugcuaauaguaagccagacauuguaucaggcaucaggguaaacauacauauacauauguauaugucccgaccuugaggaggucauaucuagcuggggaaacuuacaaauuguacauaauccauuauccacaauuccaaauuccaaaaugcucugagaaaugaaauuuuuaaaauauguagacucauuuagccuaauuccugaauucauaugaggccacauuauauauagccuuuguuuguaccucuuaauauaauuuuucauacauguguuugauuaugaggugcuacccuaagcucuccuggcauuguugcauaauacauaguaaaugcccugaaaaccuuucuaaaaucugaacuuuuugaauucugaaauauaucugguccuaagaguuuagcagaagggauuguggccauacaugaauggacauguuguagcccagcaaaaggaaugauuuacuucccaugauugaguuaaagauucacagaagaggcugcaggcagugaaacuggaauuuaccaaaguuguuuuggcagccuaggcagaacugaaguuacagccaaagauauagacuuauagagaaucuggggaggguauacauggaagacaggacuggaaaggcaaguuggcaccagauuauggaaggccucccaugucacaggagaaugcauucuuuuucuaucaacugacaggcucuuuucugauuuccuucagccucauuugcuguuguaccuugcuuuguugcagugugucauggauccauuuggagaagcugaugagucaucuugugaaagaaaaaaugaauugaaggacauugcuuacuuucuguguugauucaggccucauuucaucuuaacccccuaguuagaggacaucaguaaugauucagucucugcaacucauuccuaaauaaaauuaauuggaaaguagauagcucucuaauaaccaugcuuguuuuugcauaauagaaggagaaaaggauuaaauucuuuguucuaauuaauaggaaugaaaauagaauugcaauccgugguauggcaaaaugagagaaaauaaggcuuguaaguaauuuucaugguuguuuaggaauaauuguuucauuauugaguuaauaguuuuuacaaacagcuuccauuuccauaucauauugcuacagucgcucuuuauugagauugccucggcagaagaugacaagaaguuguuuuaaauccaucacuugucuaaaauaugaguuccaaaguaguuaggggaggguaugcagcaggaaagaaugagguaugggagggaaacagggggucagauugaaaucaguugauuaauaagacaacaaaauucauucaccagcuuguuucaaaggagacucuuauuauucuggaaagaaauuagacaucagaucccucauaggccccaggcucugacauguguuuuauaaugacaguuaauuagauacugucugcagcaaucauaggcugucauuucuaauacauuucugggaaguugaaggacaggagaagucacccccuccucauauucccccuucccguaacugaaaucgguugccaaaauuaacugugaauauaugaggcacgaguucaacaauuauacagccguucugcacauuuauguuuccuacuuaguauguacucugcauuccaggcuggucugggcaugcauuuugcagacagagauguuacugcagcccugguaauauuuaggaacaucucacacagcagucuaacaccuggucuuaaguggaagaugccacuugucauugcaacuuaugcauuagaacacaaagaaucuuucacaccauuaaauucaaacuagcaggcuucccucuuuucuaaaauagaacuugcaaugcauuaacuaaagucaucuauucucacaugugcaccagcacggcacauguauacauauguaacuaaccugcacaaugugcacauguacccuaaaacuuaaaguauaaaaaaaaaaaaaaccuuaaauuugaauaauuccugcaguaguacuuaaccuaaauuuuucaugcuuccuuuuaucaaacaucauuauaacaugaccauaaaguauaauauuucuuaaaaacuaagccaugagguagaaaccauguugaaaucauagauguuaacauuuuaagcauucucagaaauucucuaguccaaucauuuuggucugcaaacaaggacauuugagucucagaaugcuaaaguaauuugccaagauugugcaguuucugggcaagccugacuugcaauuccauucuccugaguucuacgcuguuacucuuuccccuuaagagcacuaccuagugacauuaccugaguaacuuugggcuaagcccuggauguuucugagcuugagaguccuagucuguaaaauggacauaggaauaauauguaccucauagaauuacagugagcgucaguggggaagccacuccaaagccuucaguaagacuccaagcaaccuuacguugccuucugauugcuuuuauccuuaggugucccuaggucauugcuuucaucccagagcaugccuggagcuuguaagugccuccuaagggacauaagaaggcucucagugccuuugugauugaaaaccauacuauuuuaugggccacccaguacauuuguuucuuauuuuagagacaugcccacucaagccaugugcugaaauucaagcuuuuucaacccaaguuaucauaacuggugucucuaggacagugcuucccaaacaugcuucccaaacaugccagaggaagaauuaccuggagaauguuuuaaaaguacagauucucgcucccugacccacuuaaugcccuucugucaauuccccuugaaagaaaaccuuuaguacaagaaguguggagaagagucuguuaaucuguguauuuacuagguuuuuauuauuauuauuauuauuauuauuauuuuucuuuuugagcucccuggacaauugugaaaaacagccagguuuuagagugccuggcucuaucagagcagaucauaccauacccaaaauaugcuagcuuuaacagcugcuaaaauaucuggguacuuuuuguggguucuaauuaacuuucacauguuggggguugaaauaucaucagugaacugauaauauaaauuuuuggaugcacuggcacuucuuuccuugcacuuauguacucauucaugcacaaagcuauccagcacccacugucaccacccgggcuacaacccuucuaaucuaaauggauuauauaguagauagcugcuauugucugugaagauaagccugcugucugcuaccaguagaagacauguuugagauuuguuucguuuuauuuuauggugguagugguuuuaauccccucauacccaccauccaaauaauauggcugguuuuguauuaggccguucuuucuuacaucugguuuccucauaaucaaagauacagauuuucaaaacacguagcugggauuaaggauauggugugugguacugguuauucucugugcaaaauaaacugggaucagaaagcauauuaagccauaaaacaaggccugaccuuguaugauucucuacccaaugagcuaaccagccagggcagaguugggaaggcuacaggauuguaggccauuaacauccccgaagagccaggcugaucucuuguauuauucucaggcaugagcagagaguguaugcaauagccaguuccauauguuacuauaaugguucacuugcuuucuaaaugaaugcagccuccuuaccagcuguggacucuuaguguuuguaaagguuuaaagaugccccaguaggaaguagaaugacauugaauaaagauguugaaaaaaagaaugcaaccaaagaugacgagauaguauauauuaaaguuaguuuagccagagcccagcacauaauaagcuuucaauaaauguuaacuccaguugagguuauuacuauuauucuugugccaucgucguuuaacucaaauuauuacugaucaucaguggcauauugacuauggaugugaagcauagaaaguucaagacauuuaacuugauuuucuagaaaacagcaguuuaaacaaucuacuuuuuucaagccuaacuucuuacccuauuugugcauauuauaguauaugguccuuaacuuauggacauuaguucugaauucauauuuccauuggguuuagugcauuggauguuuuaggugaacuaaaugggcuguaugaagcucaucucuggaguaauuucaagaaucacugaggcuuauggauaauucacauugucaauucaaaguuuaugauuauuuuucccuaaagacucuuaauccuccacccagcuugcucccccgccccucccccaccacuuuauuaguugaauaaauaaggaugaaaacauggcuaaccugacgaaagucuauucucucuagcaguggcccagauguagggcaguggaauagagcacugucuuuaccccugggacuccaggucugcagauuuuaaaaagaguuaacucuauggagcuauaauuauggcaguuuuucaaaaagguagacagcauuuuacaugauuuuuuuguucuuaguuugucuugucagaagugaggaauugcauuucccuccuaaacucuuuacuagguugugccaugugccaggauuucuuaaugucuuuaaucuguaaugugccuaaucuuugggggaaaaggaguagaaaucaacaugcaugaaaugcacagccuucauguguuaggcuuugucucaguuagacgaguguacauggaucauuuguagcuuguagcauggagaaaugacgucaagccaccugugaagccauucauuuaagcagucaguuugacaaucucacagggugaucugcgaacacgugaccuucuuaaucuggguacacaauguagcucuguuuauauauucuugucuuuuaguuuauugucuuuaauaaaguuagcaagaggauaaauuaguuuuaucugccaaauauauaacaggugcaucagcaggcaugucuauaacuauacuaaggcuaucugggauguauucucccuauaguuuuucuuuguauuaaguacagagggagaacuguugcacaguuaaagcaucaaaaugucuaagaaaauguacaggauuuuuucccuauccaugucuccuguggggcauccguaagccuuucauucacuuuucuauugcacauccuaagagacaguuggacugauuucgcacuuucagugaagaaagucauggcuuauagaccaugugggauguucuucugucuacauuagaagaauugaacuuugauguucucuacuuuucuucacuucaggaaaggauuucuaggagauauaagauuaggcucgaugcuagaaggaaaccacaucaucaguuaucuagaaggaauugcaucuaucuucuuuuuacuuauagucuuaauagacuuaagauuuauugggcauuauugggcauucuguagauaaaaagcacucuuaaagaaauaaagcaaaauaaguuggauaucuauuucuagcugggcuagaaagcuaaagcaaguagggacuucaaguugcaagcaugauuuuaaagaauagguuagcaacuuaaagauacugaguuuuucaguuucuuuuuccaccaucucuuuauugucacgagucuauuuucuaauuccacccgucgguucuaugaauacaaaugguguugucuuuauguuguugcaaaauaaagcaacaaugcagcauccuccuuaaagucuacucucucuccuuuucugauccugccaacugagaugacaugguuuguauguuaguuucgguuccauauuaauuuauucagucauuuuucaggaguuaauugaacaucuugucucuuguuccagacauuuggcacguguugccccaagcccaauuccuuuauguggaaaaagggucugccaaagaaggcuaauuuaccuucuugugaaugaaggacuccagaaugugaaugauggguugggauccauugucaguguggacacgagucauuuacucuucugucuaauuuuuuagaucauggguaauuuaugaaaaauucaauucauguuugauuuguacccucuuaaaucaucaacauauuauuuuuuaagaguuaucaaguguucaagagcuaacauuuggcuuagaguaagccuauucauaugccaaauaauuuggaagaaguacagaaaccuauugcuuugggucuucaaauggaugaucuuaacaaaguaugauucucuguguuucuuuauugcauguuaugggccaugaauuuguucccugcuuuacugauguccuccuaauugcuugauaucuaagaauacuuaucuguaauucacugccauauuaaaaauacgaaacaaagcuguccuguaacaagaagguccauuuagccuucugaaaaguaacaaaaaugaaaacaaaaaggagcaggagcuuuaaauuuguucuaaauacaggaccauuugagagccaagagaauuaauuuauauuuuuaaacauuauuuuauaaauauauuuuguuguugauuuuuuauauuuagucugcuaagauuauagauuuaaaauggugaguuuuaccaggaucuuuaaugauucuuguugccuaucaagcagaauucuuugagcacaguauuuaucagaacuucuccugagauugaagaucauguauacuuucuucuaggccugugcuuagucuaagagagagagaaagagagagagagagagagagagagagagagagagagagagagaauauauauauauaucaauuaaaugugauuguacuagacauuuucagaagaaauuaucaggaaacguuguuacugaauucuauauccaggucugauucagacaaucugaggaucaccuuuuggaccacaauguauagaaaaauacuuccugcagaggguuaugugagaaguugcuacucuagagcugaaaagggcuuucacauucuuagggcauuuauucuaagaaacaggacaguguuaugauuauugguggaaugaggaugcacugauuuggaauuguaguagaaaguggaugaguaacauagaugcgagauggcagcacauaguugggaaugcagacuaucuggguucaaauucugacccagucacuaauuagcuuugugaccuugagcaagucgcuaaaccucucuguacuuugguuuccucaugugauauauggggaugauaaugaucaguaccaccuuuuauaagguuguuguaaggauuaagcuuguuaauacauguaaaguuauuagaaaauccucuggcguauagcuaguauauaugaaugacuauuaucaugagucguuaugaaguuugucuuggugcauacuuuacccagguaauagucugugcuuucuggaauuacaucaucucugcaucucugugcuaauuaaagccuacaugucuaguaacauucauucuccgucuuccauuuuuuaaaaaaaugucucugaaagguuuauaaaaauauacuugauugagaauuacaggcauucucccaagaauauuuacauuuuaaccaggacugugccaugauuaagacaaaggaaagguccaaaguauuacgaguuuugacccaaguugccauccauccuacuccaucucuugaugcuuaucuuaggggggguaauuagugagaaaagaaaaauguaaagcaaguuccucaugaaucccuuauuaacuuugaacaggacucagucugagauauuaucucauuuaagacuucucgggucaggcauggugggucacaccuauaaucgaagaccagaagagagacaggaggaucacuugagcccaggaguucgagaccagccuaggcaacauacggagacucucucuacagauaauaaaaaauuagcugggcuuggcgugugccugcagucucagcuacugggaagguugaggcgggaggauggcuugggcccaggagguggagguugcagugagccgugaucacaccacugcacuccagccugggcaagagagugagacucugucucaaaaaacaaagacuucucuacuauucuaagaugcagauaggucagaagguugugaccacugacuguaucccacgauuacucauucagaaaguuagcaucgucuaaccaaaguuucagaggugcauccucuucauucuaucauacagaagaaacaaugcucaagcaauaauugcuuuaucgaaucccuuauuagucuauaauguggucucuguuaugucauuuuuuuucuuuuaauuuaguucuacuaaaaugcuaacauuguuuuccuucugauuuagccucacaugggcugcaucagagauuuuuaaauaaauuguuacaguguuaauuaggauuucauggucaggcuccauuccuuuaauagauacgauaugauuuggccuucucuguaucuucaaauaagcaguccucaaacauccuuaugaucucuccugcugccuuagaagauuugagauaauggagggaugaugaagcaaucauacaaaaucuauugauucaccuuggugaguaucauuuauacaucagugaguaccuugguugcaaaauuaccuuuggaguuuaaaugucauugcaaaguuguauuggaaagguaauuuuguuuugguaggccacaggguuuugcuuucugauacuguaaaauuuauaucuacuugccauuuucaucauauaagugagagguuuaaaugcuauguauuuaaugccccugucuauaaaaaugaggauuuuuuuuuaauggcuuucucaauacuacuaacucuuauuuuugccgcaguguugagaaguacggauuuaugauacuauaaaaugcaaagaauaggguggaaagaaggaacacuucaaauaucacagaagcucuguuccuugaaacuuuucuuacuucaaguaggccuuuggaucauuuuggacauuucaauuauugaguucuugauauuuaggucagaggacuuauccuugagaggugggacuugcugggucagugaggacuuggagaaauuuucuguagcuagcuagagguuuguaaaaugcaccaaucagugcucuguaaaaaugcuccaaucggugcucuguggcuaucuagggguuuguaaaaugcaccaaucagugcucuguaaaaacgcaccaaucagcgcucuguagcuagcuagagauuuguaaaauagaccaaucagcagccuguaaaauggaccaaucagcacacuguaaaauggaccaaucagcucucuguaaaauggaccaaucagcaggacaugggcggggacaaauaagggaauaaaccuggccaccccagccagcagcagcaacauuuauugugaagagggaaugcugcuucucacucuuugggucccugcugucuuuaagagcuguaacacucaccacgaagguuggcagcuccauucuuuaagucagcgagacuguguacccaccggaaggaacaaacucgggacacacccugauggugugcuggcgauaaaagcaguguguucuggggaguuggaagagcagggguuagaugcuggagggauuuugcuugacaagucauauuaucaaaaaacuaguggucacuaauaguuuuuuacaacuagcuauguuuuuauuucuagucaugaagcagugcccuaaaugcuuuaguaagcauaguuaauaugcuucccaaaaaaaaaaccuuccuuuucuuuguauuugaaauaauuuucuuccuguaauugcuuuugaagaaucuaaaaaaaaaaaaagccauacuuuuagcguuuuuugaaaguauuaccaaguuaauaugaggcuuuuuguuuuguuuuuguaaauccagaaaauuaaugauauuagcagcuucagagauguguuagauuugggagcucaaaaacuguguuaagagcuugucauuaaacagccugauucuugcacuauuuuuuuuaacugccuuuuuauauugauagagacgggaucuuguuuggacuuaauaacuuucccaaauucacuaggagucuacaggaauuauuguuuguacaaaugauuccugggagagauguguuuuuuucauucuagagcauuacagugucauaaagaaucccacauugggcaggagugggccaguucagguuggccugucaugcuuaaucacuggcuaggagcaaccugggggaagggcaggaacuccaugagaauccaaacagguggcgccuguagaccaaccaacagcugugcuccccaaagcggauucucuugaagggagaucuaaagggggcacuuccauggcugccacaccccuguuagcauguugguauuuuucaaaugaagaacugugaauuuuuaucuccugaaaugcuaagugaguauuugaccaucuaaggaucccuuuugugauauguugcgcuucauggugacuccacuaugacaucacaaaacuggguagauaaccuuuuauuagccuuuggaagcaagaggcacuggccacugagucagcaaccccaacaggaguagaauaugcugucuguguuccugccaacacuuugguucugaaagaaaaugcugacucuuggauauuaugucuuucuauauaauggagauaaaaaguaucaagaagcaaaauucccuucuaaguguugaauucaaaaccauuugugaagaaggcuuuuggaagcagaaaacuuuugaaggccauucuggguuuucucguccauuucuucacacccuaggguggccaugaaacucaagaucagaccagaucucuugggguuccuggagucaccauaaaaaauaaauuggcuuucuguaggcuauaaaaucuaaagcugguuuguccacacugaggugccauuaaaagaacagugggccuggauuuuguagaccugaguuuggaaucuggcuccgccacuuacuaguuguguuuccuugaagauaucaguuagucucuggguuuguuucuuuguuugcagagugcaagaauuggaauggcagugaaugcacagacccuguacaauccuaaaacuuaguaauucugucagugucagggcuaaguaauucuagaugauugcaguccucgaagcccagcugcccacguacuuaaagcucgugggagagauugauauguccccagagagucugccuugcacugggccuucuucaccucuucgagucucccaugcgaggcucagcagugacucaucaugaucacuggagugguagggggcucagacccucaacucccaauuguguucuggacuuacaacucuuaaugccuuuggccaaguugucuaacuuaucuuuaguuucaccagcugugaaacacaaauaauguguacuuccagaccugccgcauaaucagugauaacacaaaaaaguuuuuauugugucagaaccaaucucuucuaauuuuaauuauuacuuuguggcuucuaauuuuaauaaucauuucuuuguaauccuagccuaugugaaucguuuugugagaugaauacaaccaaguggggucagugucaaaaggcugccaagugucacugcugcuuggguugcaguauugucugcaacuaguaucuuugaagcuuuuguuaagaccauauuggcuuccuuagcucagaggaaguaaaaaauccagacauugguaguuauuuaucaaagugcuacauuaggaaauguuguauuuauccauauccauagguuuacuaaaauaaauguaaccucugagggcaugcagucauucagggauccaaaguagcuagauacuugggucucuaggcuuacaaauaagcaaguaucccuccuugguuuuauaaaguucuuggauuauuucacaucacacaaauguacccauccuuggggacuugagggcauuaacauuaaucaaagugaggcaaaauucaauuagaaauuaucgaugcucccugcauguugauuuuacuaggcaaggagucucuuuugcaauaaucugcuugaacagaugaaacucagaucaggcaggcugaaagcugucaaaggauaaguuucaaauaagggcagaaaaaugaacccgacaugggagccuucuucacauucauucauaguaggaguggagccuggagcaaaucacacucuuaacagguccccugaaacacauccuuuuguagauaaaaucugguuaaaugaaugccaggaaugacugucaccuuagauuaaauguuccucggacccggguacuuaacuacaauuaugcugugcacguggagagaggggcacaauagcaaaggcgaaugguauugugaggcauguauggaaagacaaaauuagucuccauagaccuucccucuggcuucaacaccacccacugguggauucuguauggucacucgcccaggccauuggaaagcagggugucagagugggaagacccaaaugucaagacagacuagggucugaaucucagcuaugccauauauuugcguagugauuuuggacaaguuacuuaacaucgccgugccucaucuuuaaaauggggaaaaugggaguauuuugaagauugguaauauaauguauauagcaauucauauaaugccugauauaugguagcauuaauacguuauuuuuuaaggaaccauuuacaacuuauaucugcuacugugaauauaagccuuugcaucccuugaaaacuuuacuuuuuuagucccuucccugucacaggagaccuaaguauaugaagaugucuucauagcauccuuaaguuucauuguugcccguguugccaaggccagcuguaguuggacauguccugggaucagggguugguuguugaaagaguagaucaucaucucauaacccauauggacuuugaugcuuacauaugaagcacugcuaugugugacaucaugauaucaagucauggcccagccaucauccuauuugugguucccuuaggacauaacugcuuuuauggacaaugaauuuaauaugauuccuaguggcagagggccagaauguucauaucccuugccaugcagaauuacucauccaucuauauuuucuugaacucuguuacauuuagguaguguaagaaaguguguauucggugaacuguguggagaguuaguguaugggaucauugcuuguugguaguuuuaaaaacuguagaugauuuggaaaggaagaagguuuagacuuugacagacucacaaagauagaucaguucuuucuuacuuuauguacaauauuccagagauacauguucucaguaacaggagguaguacagauuuggggcugugaugcuuucaaacuuugccagacucuuucauacaauuuaauugcacaggcccuuaguugauggcaugaagaaaaaguuuuauacaguagaugaaaugcauguuuauuuuugaugugguuugguuuccuuucuugggacaacuuaugcauguaauauauuauauuccucauacccccauccuucugcucuuaaagaauaggaaucauuaguuuaaaaacgucuguuuuaacuaucuuuccauuuucaaugauaauauuacuaauuauguuaauaauucuaaucaauuaaaaaugccgcuuaauuuuuuaaaagagcuuuaucauuugauuaacauauaggcuucucuuugcucauauuuuuuuuucuuuaucaucaucucuuacuaggcaauggcgaaguagaaaugcuuguaauagugcauaacaguuauugaacucuugugauuaagacuucaagaguucauuaagaggacagaaaaaugcaccuuugauaucuuaaucugaucacucuaauugagaaaauacaccuuaauaauuauucaguagguauauugaccugaucauucauuugccuucuaauuuggacccuuggucuuggcccuucuaucuccauuuagcuaggugauauauggagcacccuggacaucaguauucaggggauagagcacaggccuuucuuccucucugggguccguucuucuuguguguggcguugcuggugagcuccaucagggagcugacaguccaggcuagucauaaugaugcuuucagauuucuaaagagucuguaauuaaaugacaucacugagucuuaaaugcaucugcugugaaagucagaaggcuaaauuaucccauuaaagagagaaaaguguuacuugguauuacagaaucccaaguuuauuaugcugaggaguugcuucgggaaggcuauugaaagccaguugagcauggaacauagugggaagauugggaggcuggaaggccaugugguucagaacaggcuguucaagaaucacagcugcacucaggcuaaaguuuaaaaaaagaagccauuaaaaaauuucuuuugcuuucccaaaugcaauuaacugcuuggcugcugguuuuuauuccuaacagcugugcuguuucgggcccuccagaagauaucugcagcuacaugaccacagaauaguguauuguaguuaauuagagcaugguuugcaugagaccaaggccaugaguuuaguuuccauagggcuaacuucucuaaguuaaaucaccaguuaauauauccccagccuuacuuacccgucuuccagauuacugccucauagcaaaaggcgucuggagaaaggaacuucuauuuaucagcccaagugccccugccauuggaauaauaccugacaauuauguucuucgggucuguuugccuacauggguaauuucuagaauuaaagcacuauuaauuuuucaguugccaguugugaugcccccuuuuaaauauuaaaaaaaaaaucgguauuugaucaaaucugaguauuuucaauacucauuuucuuugacacuuccauagaauucagaaauguuuuuaauugauuuuuucuucccaugugugucucauuuacuguacuguaucauaacuuaggaguuuuaucuuuugaugacuuuguaauauagggauagagugaaaagacaaggaggaagugaggugacuuggacaaaaacuaccacauauucccuccuuuuucacuaagcacauacuuacuuucucuaaauugccuggcuucuuucaucaucagcccccaagaaugccauuauuuccagucaccaaacugaggccagaggaagagauggaagacagaaaugggcacauguuuuguuuuuguuuuuguuuuuuuugagacggagucucguucuuuugcccaggcuggagugcaguggugcuaucucagcucacugcaagcucugucucccggguucaugccauucuccugccucagccucccaaguagcugggacuacaggugcccgccaccaugcccggcuaauuuuuuguauuuuuaauagagaugggguuucaccauaaccaggauggucuugaucuccugaccucaugauccaccugccuuggccucccaaagugcugggaucacaggcgugagccacugugucuggccagaaauggacacauguuuuauuuccuugguuucacuuuagaaacuuugaaaaauauucuuacuucauacuucaacuucuuuccaguauaccaacuauaucaauaaaggguucuauuugguaaauaaaauaaaccaauacaaaaaagcagaacuuuuaagcaaaagagguacauuuuuggaggacacuagaaugucucguagaaucuaacccuuuggaaggacaaaaaccagggcagcacugggggccucagcaggagucgucugcaaaucuucucucugggucauuacggagacccagucauuacaagacccaguuaucgcuaacucccaagccccaggucucucacuuuggccaggggucugcugauacugugcacaucaccuagagcaaaggcaaggccaugagacagaaaacaugguuucagaguccacccugcuggaugcuguggauccuucucugagaaaggagacuggauaugccacccaaaaacuauccauguugguggauccaggguuaaagcacggcccagaacguaacuuagaauauuacgaaacaggugucaaagaguuuuccagaccagcaucuguuccagaaaugugaggaaagcucucaaagcauguucaguaccugagaaguuuggaacuccagaucaagagaagcauuuuuccucaggcuuaaggccacauagaaggucugcacuuugugucacuuuacauuuuacugaccuuuauucaacuguuugccucuucuccuccaucuaacugaaggccauguaagauccaacagugaugauuucaccauccuggcuauuagaagacuuaugguuuaaguaucucauauuaaauguuuccuccuaaucauccaggcaaacaaagucagaauguauuaguccacuaauguauguucagcaucugcuaugcucagaguauugugcuagaauuguagaaaacauaaggaaguugaaccaguuucugaauucaaaucacuuauacuucaguuaucaauauaagauauaaacagagaaguaguugcaacuauucuuaaagguuuuaaguaaauuccacaugaucagucuguagaugcaaagugcuuuaggcguaaaagauucaugaauaacaacaauaaugauaagcaauauuuauugagcauuuucuguaagguacuuuuuuuuucuuguuuuuucuuuucuuuuuuuuuucuuuucuuuuuuuuuuugagucagugucuugcccuguugccaaggauggagugcaguggcaggaucauagcucacugcagccucuaacuccugggcugaagugauccucccaccucagccucccaaguagcuggcaccacaagcgugcaccaccacaauaggcuaauuugugugugugugugugugugugugugugugugugugugugugugugugugugugagaugaggucucccuauauugcccaggcugugucaagugucaaagcacuuuuuauggguuaaaucauuuaaucccucaacauauaggugguagugcuuuauaguuaaagagacaggcuuacugucuuagucacuuugaccuucuauaauaaaauacuguagauuggguggcuuaaacaacagacaguucuggaggcuggacauucaagaucaggaugucaguguggucaaguucuggcagaggcucuugguggcuuacagacggccuccuccuugcugugucuucacauagggugcagggagagagcaagagcaaguucccugcuguuuguucucauaagggcacucauccuguuaugagggcuccauccucauaaucuuauauaaaccuaauuaacucccagauaccccaccuccguauacucucacacuggggguuugaguuucaacauacgaauuugugaggauggggagacccaguucaauccauagcacuuguaaagguuaaauaacuuauucaaggucacacagguagcaaccuagauacuucuucccugugcauauauuuauauauuuauauauauauauauauauauauauauauauauauauauauauauauauggaauuuucuagaggaaagggagcuugaauaagguucauauagcuucuaaacacugcacuugcuggguucuugguugguucuucugcuuuacaugcuguugcuuuuccuuugcuggccccuacucaucuucucuaccucuuaauuggaguaucucagggcucaguuuuagaccucuccuuuccucuauuccaucagauccacucccuagucuuacagcuuuaaauaacagcuguacaagaauagcaucuaaacuuuuauugcagugccaaucucuccucucaacucucaguucauauaucuacugcccauuucaugucuccacuuagaugucuaaucaguaucuuaaacuccacuuuccaaaacaaaacucaugaauuuuuuuuuucccaaaacuacuccuccuauugucuuggucaucucaguaaaugcuucacccuccuguuugcucugacaaaagcucuuuaugucaugcucaaaacuucucucuuuuuuuuugagacagaguauuggucugucacccaggcuggagaguacaguggugugaucuuggcucauugcaaccuccaccucccggguucaagcaauucuccugccucagccucccuaguagcugggauuacaggugcccgccaccacgccuggcuaauuuuuauguuuuuaguagaaacggguuuucaccaaguuggccaggcuggucucgaacuccugaccucaggugauccaccugccucggccucccaaagugcugggauuaugggcgugagccaccacacccagaaacacuucucuuucuuuuauacccuacaugcaauaggcccucaacaaaccuugugugcucuaccuucaggcuguauggagaaucugacuuuuucuagauggcaagaucuucagcucguucaccauauaauacaugaaauacauguauucucauaaaacaagcuugauacccuacacugucucuacugcugccccucugaaucaggccaccauaaugucucaucuccauuauuuugcaaugucuccuaucggacacuuuuuacuaauuuucuugccauauagucugguuuucacauggcagccagagugauccuguuaaaacacaggguagauuauggcacuucgucaggguaaaguuccaauucuucaccaugcccuauaaagcaagaaaggaaggaggaaaggaaaacuaggggccagagcauuuucuggaccagcaucuauuccggaaaugugaugaaagccuuaguuuauucuuuaucuaaaaaguucucuccagaaaauacuugaggaaaagauuacagccacacagaagcucuccauuuagugcgacuuugcauuuugcugauguuucuugaguucuaugccacuacucucucuccucccccaggaccaaagggcauauauuuugcuuucgaugacuugugcaguuguugauuuccagcaagcuucugacuguaguuucacacugaugauauaggauuaccauuugaugguagaauaaaagcaguaugauguauuggaaagaagacugggugaggauuugaaagcuguggauucuaggcccguugcugauccuagguauauuuuuggucuacuucgaugacuguaugucuaccucagugacuguauuugguuauaagguuguguuacuguuauaauaauugcagguuuacuaaucaaccugucuauccauuucaaagggaaauuguuauuuuggugucaauugcaggguaugauggggaaagacuuucucuguucaauuucaguuucuaagaauacacuguugcuaaaaguagugauaaacuuuauauacaaggugugcauuuuaaccaucacagccauauuauacugacuuacuuucuaacucuccaucuuagauguagucaacauauugaucauagguuuuaaaguauccaaggacuugccccucuuucuggauagggagaucuucaaccuguugaccacauaauuagaugaaauauauauucucauguaacaaaccugacgccaguaguguuaggcagcuccuaagggagucagaagcugcuuccagccucguaaauaaugagcacauaacuaacagaaccugaucuucccagcagaaauaagucagccuccuucacaguaugcaauauggucaaugaaucagugguugcugagugaacugcacuucccccagcuggaggagaaacaagcuuuuuuaggagcgauagagcaugcaauaggauguagaugggaaaggaaucugaugaauugauuuucacuggaaaagucucagagauucuucaccugagauugcuuaauaguccuaaagcuuuaagcugcuaaugagucucuguccaacccacugggggcacuuacauguugcuaagcacugaguaggcugaaacaaaucauggaaaaucaugcuuccauuuccuggagcugugggggugaugaccauaacaccucaaguugcaucaaagugauagaacuuagacaacuggcuggaaauauguggaaguaauuugcugcuaucacaaguucacauguuaacauuauuucacccaauuuguauuuugugggugaccacaugcauuucauuugaaauaauuaggcaaauucgucauauaauucauuuccuguuacuagagcuagguuguccuucuauuuaagauuuacaacuagccaguaccugaaggcaacaugugacugaaauauucuuaaguuccaugaaacaaaccuuuccagauugagauuugcagguagaguuucaugcugcacgcagcugggggcucucuggaaccugcuugucaaauaaacagagaacauucauucucaggcauguggucccaauagcuuucacaagcauuaaacucacuuagaaaauaacuaguaaucaaaaaaaggcauuuaaacucaacucucugaagcauggaaggagauguacauuacaucgauugaauugucauuacaaauaucuacuuuaguuguagacguaauuagguuuuagugaaagaagacauuuauguagauuggggggauguggaagguuuuaaucacuggaauaccauuuuuauuacagcuggauauuagggacugauauugaacaauggauccacucuuuuccacugagaaugguggaaucuucacauuuuagaacuaacaggaagcgggcaacugaucucauucagcagcugccuguuuaggcuacccaaccccuagaagucugagaaauuggugauaggguuuacgaguuauuuuuaguguauuuaugaauaugaaugcaugcaugauauggccacaaaacuaugaaucaauuuauuuauacuuagguuggaguuauaucaacucaaaguguagcauguauuguaugcuccauagaaauaggggcuggaucugccuaauuuaguucuguguccauagcgcucaugaauaggacuucacacaugauaggaacuuuaauauuuguugguuggaugguugaacaaaugaguggaagaagaacuauucagaaguucuuuuggcaguuauagaaacuuggauuaauuuucuuaaagaagaaauccauuacuguuuaauaagcauaguuugguuaguaaaaauauuucaaaacaaaauguccaugagagcaaauuaguaauauaaguucuuggugugaaaacgacuuugcacacuuguaaacuagguucccgaaaacuuaagugucuugcuccaaguugagcagggggcggugauggcaaaaccaggauuagaauccagagcuauuggcccauggucuucccaccacaaacuauguuauugaaaauagaucagguuccuuuagauguuuaauaaccuuuaugagugaaaaugcugccuaauauuuggaaaucaaacauuuauagcucuaaauaaaacuuaccucuacaguuacuucucacuuuuauucuuacgucuaaaggguguggaaacaucauugaacauuguuuuucacacgcagaugagacucuguugaagggaguuuugugguuuagggguuuaggggguuacagguaccuuugagaaucugaugacagcuguggaccauggacaaacacguguaugcccagacccagcaguuuuacucguggcaucgggcaguucacagaccccaucaugaggauccugauuuggaggcucugccaccauucuguuuggcccucuuuugguuuggauguuccuuucagaauugaugagcuuucacauuugcuucuacuccgauuaaacagcucauauuguuucaucauuuaaaaaugccuuaaaaugagauggcucacaccuguaaucucagcacuucgggaggccaaggugagaggaucacuugaguccaggaguucgagaucagccugagcaauguagugagaccucgucucuaccaaaaauugaaaaauuagucgagugguguggcacgcaccuguagacccagcuacucagaaagcugaagugggaggauugcuugagcccggaagguugaggcugcagugagcugagaucacaccacugcacuccagccuggguaacagagugagacccugucuccaaaaaaaaaaaaaaaaaaaaccuaaaagguacuuuuuacauuguccguagaaggugacuacaacuaaggcauuuucauuuuugaaaaauauggaauaaaaaaccuguuguagaagaaaauuguucacaaugaacaaaaaucuaaaucacuaugcuauguugaagccuuaaguggagcuauuguaaaauaugcauuuuuaucccaaaauggaaauggcacuguaaaaauggagacaauuuuaauguucugaaaaaguguauaaaaauagcaugcauuuaucguucuucaagaaaagguaccaaauaauagaauagucaauggcagguugucuauucuagguggauuuggaggcucauuaguauagagagaaccaaauggugagucauccucccaggcugcucuccuuaccuucagaacaucagcaagacccuagugaggaaaggaagaugcacguggacaaucaccuuggcuuuuuuuugccauucuccugguaaccccgcccauuuucguuaccugugaaaauaagccaauuacuagaaaagcaagcucaauguauccaauuagcaaauuaagacauuuaguaaaaaugaagccucagaaucuugaaagggcagagugaacagggagcacuuucaacuccuuuuaucuucaucaauacuuuuaauucuggugauuugaagagauauuaauagaggcaauaguacucuguuaaucuugacuauauuaauacgagauuagggaaguuuggggggcuacagcuacauuugagaaucugaugacagcuguggacuguggacuaacacuugugugcccagacccaggcaguuuacucauggcgucgggcaguucacagaccccacggugaggaucuugauuugggggaucugccaccauucuguuuggcucuuuugguuuguauguuccuuucagacuugaugagcuuucacauuuguuucaacucagauuaaacagcucacacuguuucaucauuuuaaaugcuguaaaacaaggccaggugcgguggcucacaccuguaacccuaacacuuugggaggccaagguggacggaucaccugaggucaggaauucuagaccagccuggccaacauggugaaaccccaucucuacuaaaaauacaaaaauuaguggggugugguggcacacgccuguaaucccagcuacccaggaggcugaggcaggagagucucugguaccaggaagcagaggcugcagugagccaaaaucgcgccucugcacuacaaccuggggacagagggagacucugucacacacacaaaaaauaaauaaaaauaaauaaaaugcccuaaaacagcuggauaaaguuuaucuugacuguauuuaucagguaccucacauaacuuuugaacugugggucucaaauauacaacuccaagaggacuuucagccuuacauuacccuucuaagaacaauaaaaaugucccccuuacauuugcuaggucuuucccuccauaugcaguccugauacagugagaacugauugaagagguagguucaaggaccuugagcuucuccucauaugucuaguucauuuuuuugcuacuaagugguuugggcuuuuuugguacccuuuccaguuacuauaaucagcuuugaauccucugugaugcuucucguguucuuuaucccuaguuggagaaauaacucuuugaagauacuuuuucauguacauucgggagacaucaguaauuuaggugauauuuucaucuuuacggucuagaugagucauagaguaagugucucucuccugguuuaaguggugaauuccuucagaaagccacuggccgacuagccccuuggugacugucccaguaacauggaggcuaccuggccuccuuagugagcccaggagaagaaccuuauucuucuauuuggaguucuuacuuuauuuucagcauuugcgaaaucucaaaauuaaguuaccuguuuuccugauuuugaacuuuaguuacuaggcuauuccaucuuuucucuuagcaccuaagaggcacuacccucaguucaauuuauucagguuucaauuucuucagcccagauguuccuucugucauuacguuaguucccuuggaagcuauccaggcugcugaaaauagcuugagugugucacaacccacuggcacuuaccacuuucucuucaguagcagaacucuugcccuauugagugagcaucucccaaucaaaucacaauggauaguugucuuuuuuuuuuuuaauuauacuuuaaguuuuaggguacaugugcacaaagugcagguuuguuacauauguaugcaugugccauauuggugugcugcacccauuaacucuucauuaaacauuagguauaucuccuaaugcuaucccucccccuuccccccaccccacaacaggccccggugugugauguuccccuuccuguguccacacaauggauaguuuucaaagcaacuacccauuaugcauguguucuuaaaugguacguugaagagacuauacaaagaacuuuuuuuaaaaaaucaaguauuacgcagccagcucauauauaaccauuguugaauagaacuauuacccucaauaaauaagaaaugaugacacuuggaaaagagagaacaauaguuaaugggucugcuuuucccucuaaccacaaccaugaaaauauaauccucauuaaagggcuauaaaguugucugcuuucaagguucagcacacuaaugucuccuugcuuuuagugcuguuuuaguauguugacccucuguucccugcagcugggaguuuauuagucuuuguggccuuugggaaugaauauucauaaugagauagcagugauguuucagauccuuuuuaaggccccaagaguauuacucugagcaacuaggaaaacugagaaaaaggcaaaucaugccagcaucccauacugaaucauggaacacggggcuguaugcaaaggaccuggugaggaaacugaagccuagggcuacccaguuaugaauagcacagccaggccagaauccaggucuuucaauucacaguccagauucuuucugugacaucauauuaucucuauaugaauuugccuuuuccauuccugagguucuaacccaugaaaaagauaaaacaccaaguaucuaaaauuagaauuugaccaugaugguggaacuuaugugacaaaguuauucagggagggcagaggaguagaaaagcaucucuaucaaccguguaguuucuuagaaguaaacucuaguuauauuuggggguauuaauuucaccaacuauaucacauuuuucuuuuuaaaaauuaccauuauuauucacguuuuaaaaacauccuuaagcuuauucagagagucuaugaaacaccugcuaaaucauauuuacucuucuuagaacaauaaaaauugaucacuaugguagauacaguugagaauaaggaagauguaugaugaugcuuccuuuuauuucuuuuuuccuaauuguauuauaaacaucuuaugaaaucaagguaauuucauuaaaauucuuaugauugggucuuaauuuccuauagacauucaagccuuaaaaguuuucaguuaaauucuacauaacuuucuccauaggcaacuucuuuuagucagugugguacuucuuuaaauucuuaauaagcucagaucagaugaaagaacuguuuuucuaucccaaggugacaucauuuggaucccagacugagguugccuuuuuccuugagugaauaccaaucugauauacagguugugggggaaaggcucugguggaaauagggccagagaaccacuccuccugaucaaggcugcccagaaagauuccucaguucagaaggaugaacuggauagcuuugccuauuacaggcauggcauugauguaauauugaguuaacaauauuauuuuggccgggcgcggugguggcucaccccuguaaucccagcacuuugggaggccgaggugggcggaucacaaggucaagagaucgagaccauccuggccaacauggugaaaccccaucucuacaaaaaauauaaaaauuagcugggcgugguggcaugcaccuguagucccagauacucuggaggcugaggcaggagaaucgcuugaaccugagaggcggagguugcagugagccgagaucgcgccacugcauuccagccuagugacagagcaagacuccauuucaaaauaaaaaagauuauucauaguaaucuaugucuuuggguuuauuuagaagacaccugacuucaucgaaggcuccuuccccaguuacgugccugggaagcuaauuauucagucggaggguaaugaaagacgcugccaucugucugccgacuuaauggagugucagcauaucccaaauaggaaguaauuggauugacagacacaaagccaguuauuagacuguuauuaucugauuggaaaaaagcagccagagaagcauacagcuauagcaaaaacuaaucugaugaugucuguuguucugggaaugcagaaaccaccacacagaaugcaugggcuuugaaaucccugaccggcuuaggaacguuuggaguuccuucucagaauucaucucuguauucuuauuacaaaucauuauaaugcaauagaauaaaacacaguuugcauaaagauggggcccauuuauaaaacugucaccacagccacucuauuaauagagccauuuuaaagauuuauugugagcauauguuacuuuuuacagggggccagauugagagcugcaggauuugaacguggaagagugugcuacugaugauaauucaaaaaaaaauuaaagcgauucugcccaaguaguaucauuagacugguacucuucccuuuucaggugugauuaucaaagaucaaucuuaaugaggcauuaaggacaggugacaaggucuagagcagugcuacauaacuacuuuuuuaaauucacagauucuaguuuuauuuccugggaccgcuagaggucagggaacacaaugcaugggcuaaauauaaggguuuggaagcagaacuggguuaugagcuuuauuguccuuuggaaaacgguggcugcaugugucugguggggaagaaguaguaaagacaucaucucuauucauucacuguugauucagugagagucacagcccuccuccauaggauuccugaagucucuagucccuggaguuuaugcaaagagcuagacaguuccacaagcuuacauuuauucagcaaguuccuaaauagcacuugcaaugugcuaggcacuuuccuagguucuagguauacagcuaugaagccgucuaagacccugcccucguggggccugcuuuccaguaaggcaaaugaaaaguaaacaaagucaaugcuugugguaucagauuauaagugcuguaaagaaaaaaagaggcagugaagggagauggagaaugaucuuaagaaggugauguaugugcuggcacccuacugaagucagcaagugaguuguguaacugucuggaggaagagcagcccaggcagagggaccaggacuuucagaggcccaagcaaauuaugaguauuuuugccaguccuaccaccaagaaaccagcugcuuucagauuccuuugccugauaauauuagaguuaguccucaacauuucuuauuuguaaguuagggaauacugaaaauaugcaugcaaagguacuguaaucuauaaagaauacauaaacauaggauauugugaguaagcuccaaauaagcuuuagagaucuccaucauuauaaucugagucauuuaaaagcuuugagggaauucccacuuaaagagaccaagucuguggugauaucacuuuuaucacacaaaccuuuaucaguaauuuucuuggcauauuuacaaagaaauaaacaaaggaauuacuuguuaguaauauuaccugccacauaaugagugcuaccauauuucagacacuguuuauagacacgaggugaauuuaagauacuacugcaauacauacaucacugccaaccuuauaauaacccugcaaggcagauauuauuuccucauuuuacagauuaggagccugaguggucagaaaagugccacaguuaaauaucugggaaagcugaaauuccaacccaggccugucugaccucagacccuguggccucuccuguauauuauguugcucaaaagaucauaccauugaguucuuaauaugaguggcacacuguguuaggaaccaugagaaagacaaaaaaaaauaaaauaaaauaaaagcacaaucccucuacucagagacaugaaaauauaguuggggagagauaauuuuaugagaaauaacagaggacaguaaaagaugagguauaaacacaucauuguguuccuuggacuaugaaagcuaaggaacagagagagauuaauguagacuacagacaauaaggcugaagcugcgauuuugagagacagguaaaauucaggugaucucugucauagaguuccagucauauauugauguuagaaucuacuccuguaccuagggugaaaaucagauaucaucaugauuaccuaugaaaauugcuuagcaaguuagagaugaacuacugucucucaacaugguaaauauaacccagcuacauuuuccuccaauuuuauaccccuuugguuaaacuccaaaagagguauccccccugugaauaauuaugucacauaaaaaguacacauuuuaaguacuagaucacacagucacacucagaaugacuagagucugauaccaugaaagacauccaggagcugagucugacugaggggccuggauuggugccucccuguccugcauacugugggacacauucucaucgaguggaauggcaggccaaauaccuugauguguuugcauugccccugucccucucagcccauacaccgcugauuucauguauauuaaauauggguauucuaaaaccucacugaaguggaguauguucuaaauaagcagaaaaacauaagcaaaaggacaaggacagaaauaauuuuggauucucaugaaaucaucaaauggccauuaugcagagauaugggaauguaacgcagccugauccuaagaggaccaugcaaaccagagggaaaauuaaagauucaugagauggaaguaaaagccauugaaaguuuuugagaaaugaaauauacugugaaaguuugaugcagauuagucuaguggugaaauauaggguggguagugaaguaggaauggaaaagaccagaccagagacaguuauaauccagaagaagguauggacuagaguuagaucauuucuagagaugggacuuguuuggagauuacuuuucaccuuacuuaaucucauuaaugugauuuaaaggaaauaaugcacacucaaaggagcagguuaaauaccaagaacuuagugagucagguagcuguagcuuuauagaaggcacuuuuucauccauccuuucauccauccauccauccauccauccauccacccacccacccacccaucauauuuucuuuccucccucucuacauuuauacuuacagucaaacauaucacuuccccagaugagagucucagcuuagcacucuaaaaugcugguggcauuaaguuagguaaugaaugugaaagugacuaaaaaauucugaaaacaaauuugaaauguuauuauccaguugucauuccuuuggauucucuuaaagucacauuuaaaguagguagauuuauauauuacuuguacuuuugaaaauaaauauauccuucaaucauucuaauaguuuuuaacuauucugauuccuucuguguuuuuaugauaucgucuucuucuagagaauuaguugaccaaaaauaaagggagucguucuauuucuuaagaccuaaaauaaucauuuugguucauuuaugaugcucugaaugaaaaauucacaacuuuaggaauaaaaguuuuccaguuuuguuuuaauaacauuccuuuuuuuguccucauaaaguaguauuaaguaauaucacauuauuaaguaauauuucugcacugaauuuucaguccucugaugauaggauuuucuuucuuuuguuucaaaaguugaagcaaucuuaggaacaauagucaaaaagaauucauuuagggaaacauuucacaaagauccccuggucauugcuuucaaaguuuagaugacccaaguaacagacaguguugacgucuagucauaacuucaguguggguaggcaggcaucuucuguucuccaauaacgauacuauaaagugucaagcauacauaaauucucaaaucugagcaugagauacaaaauuuuuaagauaaucucaugcuuuuguuccauuccaauguuuuaacuuacauaaauuaucuuagggaauacaguggcucaagcuugugguugaaguugaucaagcccuucuuuugaugaguaaaugaauaaagggauacccaugucugcucagaaccaucuuugguccgaccuuaugaauagcacagauacguccucuauaaucguggccuaaagaaauaagaaaaaaauuguuaguaucucauucugucaccuccacugaggugccuauuacaggauaaugaauuauauauuaucgggaaacgagccauguagucuaaggguaggcaaaacaucuacaacccucaacuuuuaauucauuuucucucacuaauggucucuuuuuauucagcaugcuauugaggauuuuccugauaccaugacagaaggaaugaaaucuaccuucaauuauuuaugguuuaaaugaaugcaaauaagacuuucuggcuugcugugcugauacucauuaauaaauauuucacuggguauuaggaagauucagauugacuaaaugaggcucuucuucaauauaaacgaaagcccuuguguuuuucgcuacugugcaggccuaauucucgugucuggccuucauuaaggcaaaugaauguuagaugggugcaucaacacagggauggauccugugggaaccugaguuggcggggggcucugcagugaaauaauccucuaguuaaaccaaauuuaaucucauuagcaggguaauugugcuguuaggggaaauggccaaccagguuacagagaaacccacauagucuaauuauucuucgacuucugucacugaagaacucagaggcaaaagaugcucagccuacuaucgugguuaagucuuagaaaaaucucagaccuuucacaguugccagaaccuguguauggcauugaucauguccuacccauucugggauccuuuccuguauaaauuaacacaccaauaauacaagcuccugucauguugcuccuuuuuauaugugcauuuugcccacccacuuuuccaacaagguuggacuuugcuaguguuuuaaaacuguucaggauauaguauugcaucagaaaguucuaaaacuaccaaaauauauaaaacuuaguuauaaaaaauaagccuuuccauauuucugcuccuugggaaauuuucuagaaucuuugaaccuguggaccauguauuuuacauuccucuggauuuacaggcauugugggcuuugccauuuuuaggaugugguauagaagaaagcaugguggacuaauuaggaaccagaucuggcuucaagauacagucugaaagcuugagaauagugugaccuucagcaaauuacuuaccuuuucugaacuguaauuuccucacauguaaaauggaaauaauuaucacugucaaaacagcccccaaagcagaaugagguucaaguaugugaaagucuuuuguaagugcuaacaugcacuauagauaugaacaauaaucaugcauccacuugacuuauaagacuuggcauuccuagcuucuagggcacagcuuacauauggucaguaaauguuaauugaauuaauugcuuagauauuugguaggcuuacugucauguuucagguuguugcuggaaucuuacaugaauaacuauugcugagaauuugucaaaaccaaacagugaaauggaugcugcuccauauuuuuuaauaggccgggcgcaguggcucacaccuguaauuucagcacuuugggaggcugaggcaggcggaucacccaaguucaggaguucaagagcagccugcccaacauggcuacuaaaaauacaaaaaauuagccagauguggugguggaagccuguaaucccagcuacuugggaggcugaggcaggaguauugcuuggacccgggaggcggagaguugcagugagccaagaucaugccacugcacuccagccugggcgacgagcgaaacucugucuccacaaaaaaaaaaaaaaaaaaaggagagagagagaaaauacagugaauaccuccuguccaagaagaacuuauuauauugcuuccaaaacaagauaugcaugugggaaaugacagaaaaaaaaacacuucuaaagacauuaauaagugugaaugcauugaaguaaugaacugaauacauaaaugguaaaugcaaaacuaacuuuugugcuugugguuaucaugccuguugccauaauuuuuuauugucagccuuaugacaaugagcaauuuuaugaauacuaucauauuuaaaauaaacuguguuagaacuggcugccaacaugauggcuggaaauuuuuucgcaaguuuuaucugagccagaguaguuuucugaaauaauuuuuuccauuaagauguauuuuguauuuguguuaugauaaagcauguauuucuugaauuuuuccauuacuuugaaaacaggaaacauuucucagaugaaaccagggcuuauacuggaguuuuguuguuuuauuuuuuuaaauguacaaaccauuucuacaggcuuuuucugucucuugcuugcauauucagcugaguauaacauacugggcagagucaccugauugcagacauugacucuugcuuggacagcuguuuuaucuucugugaguuuuaggaauuugucaucaacauaauccaaaagaauaucaguucugcaggaacugauaauauuguaaucgaaauucuucuacagagucuaguuuuucuuagaaaaugaugcauauuguaucauuuuaaugucuauacaacugauagauauucacuugcaaguaaucaguuagacaggaagacaccuuuucuuuauuauccuguguacaaauguaauaaucuauacuuuucuauaucucagauuugugagcagaauuuuuaacucugauuuagccuuacaggggauaugaaaacauaaauaaaauagaaagguggaaauacuaaaagucuuuaauuccuauguaauaaguggaccuauuuaugaaauuaacuauaaagaauuuaacacagaugccucuugaaggaacaaagaacuguaggaauggaaugguagcucagauggcuuaaaauauuuaguuugguuuacuguuaguucacuuuugaugugaauuugauguuacuccaacccauuuuguuaugucgaaauccugauaaugugauauaucaauagaugacccaaagugagacucuaaaaggcaauacugucuuccaaguaggaaagggcuccagaggagguaacuuugagaacuuugaaccacuguagaaaaauaacuuugugaauaccguugcaagauaauuguagauacuguucaggcaaaguguagaugugugaacagagaaagauaccaacagugauaugagauuauccuggcuuaccugaauuaaugaucaagugugugaauacaggaaaacaaaaauagaaaaguuuaagggacaagacuaauaucauaacugucuuugccugucugugacucauaucauuaguggcuacuuuuuucuuagggcacugugcauucagaacacuuugccaguuaaucaagugauaguaaacuuaagagugugauaagaaauaaucauaaacuaaguucagcaauaagggugguugccagauaggcccauuagagaucauucaaacugaguuuuccaaaguauucauauauuaaauguaaugaaauccauccuguugaaaaagaguggaauaaccauggagccaguuuguuucuuccagacaauauauacuauaauuuuauuucagcagguacauaagccagucacauuuuugacauaugaaauacuuccagucuuugacuucuguuauucauaccugaguaauguucagcuuaggccagcuucacuaaauuucacguuugagaaaaggacuagguuuugauuugcugauaguuugccuuaaaaauuccucauugauauguuuaacauaguacaugcauccuuaacuucacaacuuucuuuuuuuccuuucaccaucuuucuuccuuaucuugcuuagccagccguauuucuuuccuaaaacauagccuuaaaauaaucuguauauuguauccgcuuuaagaaggacuagccuuuaaagaccagccuaaacaagcuguaaaaauaacuuaauauuauuuauuaaaacauuuauuaacuguguccacuguacuugauguaguguuagguguuucagguauaaaucaaagauguacaaaacgcaguugcugcucagaaggaacuuaauucuaaaagagaaaaacagguagaaaaaaagacuaaugcuaugaaguuaaauaguucaaauacauaaagcgguuuuaaaggcaucugggaaaacuuugugagugacuuaguuuugaagugguccuugaagaaaggcuauugugaaaaugauaaauuuucaaaacuccucuuuagcugauuugccacaauuuagaaaaugcaagggaacaguagaaauagaccacaugaucauuauaagaaaaggcaugaacuuaaaaaaauacagagaguacauggaacucaaaguuugcuaaugaguagaaguagaaauaauguuagacuuauuucuugaguuucuuaccuacuggauaccaaacaaugucuacaugaaaaagacauguucccucuuuucaagauauuuuaaaacuaguagggaagacagauaccuccauagcagaauucuguggacucagggugguguggugacauaguaaaagggcauucaccauacacguaagggagaagggccucuggaggaagugacaucuaagcuaguggccacaggacaagugacagucaggaaggagauagggggacaguguucuaaauaaacgaaccagcuuguacagagacuaugcuggaggcaagagagagcaaggcauguuuuaugaaacugcaaggaguucuagauucuuugcuuuaaugagauuaaccaaauagucauauauuuuauaaguugaaggaagaagggauggaagaaggaaaaaucaguuaggagauuauuuuagggaggccugggaaaaaguuuugcccuauuuuaauucugucuauucaccugcgucaucucauuuuguaagaaccugaauuaguaugugaguguuacaaauggaggcacaggaaugucugucugaguucaagcauuaaacuacuugaacacuauucauagcaugugcuaagugggugauagcuccuggggcauaauucuuucacugggggugccuuagaccuggaacacuaacauagugccuaccuuucagcauaaggaguaauaaauagugaagggguaaacaaguagauaaauguaugaacuuaagauuuaauauaaagagaaugucuauacaucuagaagcuucuugcaugaguagcaaggcugaagaaaaagugaaagaugauuuuuaagcuugagcuuagguaacuggaaugaugaugacacaaaaauagagaacacaggaggagagaauugaaaugauaaugggagugcagcagcgaagagcuccauguuggacauaguuugaguuaucaggaggacaucauuugaaaguaucuaucaagugauuggaaaugcaggucaggagcaagaagucagggcuggagauaauauuuguuguauuuuuagagaaauaauucagucuuugauauauucaaaugcuuauauuuaguaauauuaugguccucuccauccacacaaugucccaguaccucagcacacacuuuaggguuuucagcauggacuuaagucuauugauugucauccccuugccugcccaccucuggaguucuaaccuuacgggugaaccuuugagaggcuuugauauuaaaguauguuggauagcgugaugaagucuggcauggucucuggagacaaacuguccaaggucaaauuuuggccccaucccuugcuagcuguaugaccuugggaaaguaacuuugccuuucugugccuucgugucugcuuccaaauggcaauuauaaaaguaccuaacuucauaguguuauaaggaauaugugaagcaaagcauggugauuacuuaaaacaaugcuggccuauacaguuggcccucagaaaacacugguuugaacugugcagguccacuucuaugcugauuuucuuaaauaaauacggucggcccucauaucgcagggcucugcauccacaaccaaaugcagaucgaaaauacagcauucacagcaugugaaaucggaagauauggugggccgacuuuucauauacgcagguucugcagggcugacugccggacuggagugugcacagacccagauggucuuggaaccagucccccagggauacugaaagaugacuacaauaagaacaauaagaacugucagcuguuaauguuacugccauuuuuucagcugcccaguuuuaucacauguaaaauggagauaguaaaagcacaguccucauagagugucugugaaagucacauaaaaaagaauccauauaaagcucuuugaucaggacgugguaagcgcuccauggguuuaagcaauuauuaauacagcuccuacuggaauagcaacagguagaaaauuugccagauucuccugugucuugcauuagagucucugaaggucaaacugauauggggcaccuaaaacagaguauauuuaauacgugacacauaaguuuccagguguaugauggauauuuugaauaaauugcaguuuuucuuggaaauuuuucugacagcuuuaucuucugaaaaaaaaauaaagaaagaaagaagaggguauuuaccguaagauaaauugaaaggauaaaaccagaauuccagaccucuuggaaaagcaggauuauuauuuuguucucugaguuuuaugucagcaucccuuauuuauuuaugcaaucuuugguuuaaaaagauuguuugauaugaaggguuagaguuuaagucacuucaauuuccaaauuauaugcuuaaaaaauuuaacagcugucguuuuuagagaggcuuacuucauuuuaccuaaagugcuuuucagucuagagggaacacuuaacuguagucacaaaucacuugcaauauacucaugguaagauuuuuuuaaguuaaauuuguuuauaagccugcagcguccaaauuuuguagauaauauucuuucucccuuuauuuaaugauuuuuaccucuuuucuccucuacuuccagacaugaauugcacacauuacaaauaagagcacccaaaucccuuuuuauuugauuaguucagcaaauugucuccuacggguaugggcugaggacaugauugggcucugcagugaugagcuuauuuuguacuuuuacacagaaaaucuuuauauacaaaaggcacagauaguaguuacacucagcaugaacaauuacagcuuguugggagagaaccucuuccugaugugccaauggcuuacucccaugaauuaagaggcaaacgugcuccaaagugcauuaaccuuuauggauuuuuuuucgguuuucauguuccacugauuuauggucuuaaauaugccuguugcugcuguuucugaaugagucccuuguaaaucauuucuaaaugaucuuuuucgacucagauaauacuagugaguugaauauaucucaaaucaauuccucugaggcuucuuuccuucuuugccuaaguuguuuuccaguuugcucugugucuuaaaagucauaccugagagcaguugagaaaguaagaaauauaucuuaaaggagcccuguuugcugggggcgccuucuuucugcagacugaguuguuuccagccuuuugcauggccucacuuggguuugauucccaaagcccaauugucaucugaguauagcuaacgggucauaguucuuuguacaaggaugggcccaugucuggggguggauuuuauuaugaguuguagguugauuuuuuuuuuuacauauaaaucuaccaugguagggauuuugaauauacuguguucucauaaauaguccaugauuucccuuagaguggugugcagaaagugucaucagaaugcaggacucuguuauuagugcuguuugccaucuuuguacaugggcccauaucucuccugaaaaguucugcauuugacaguuaguguuucauucucauucuggguccaaagauuauuucaguuugcuggauuuaggguguuucauucucauucuggguccaaagauuauuucaguuugcuggauuuagggggaaugugcauuuuauuuucucuuuguaacucauguaucauucaugcuacaggcuuguuuuuacuguuguuugcauucuuuacauaaaaccaaaacucaaaaucaaagguacagaauucugaugcagaucuguggcuuuuguagcacacguaauucauucaugauggugucacaaacaguaugucaccguuuauugccaauuaaaauuuuaaugcaugcuuuuauacacaaucugugucauauaacaauauuaaaugugacaguagaggauuggcacaaugaggaugggaccguguggacuuacuuuugaucaugcaaagcuuccgcagaccuguaaaugucaugcaacuuuucacauagaaaucuuggacuaaaauggagaugaaagaguucagauucauuuuuuuagucuuuauuaauaggagagauucagagcuucucaguaaggaugguacaucucugcagagucaagacuagauuagaaaacauguaagaggaaaugauauguugagagauccugcaaaaugcagaagucauaaaggauaaaucacgcguuucuauugguugugauacauggaaucagcaggaaaauuccaagaccucccaaauaucuauauuaauguguacguuauucauccuaaacuaccaaauuauauguaaugauauacagcaaagucaggagauagcaaagugaaaaguuuauguuguaugauacagagcauauauaaauguacacauuaaaagacauaauuagcaauaaacagugauucacuguuugugaaagagucaugcaugaauuacuugugcucuaaaaccagaauccugaauuugaauauucugaaauuuguaccuuugauuuuguauuuugguuucaugaaaaaugaaugaugugcucucaugauuagacucaaguugcgcauuuuuagcaagaguaacagaaaacaauacuguguucuucuuuauaucauaucagaaggcacaugauguccauuuugucccauuauuagugaugcuggccgucgaauuuuaaaagcuuuuuaggauaugaauguaaggaauacuuauuuaauaagcaauuauuuuuauucaaauaaauaaaacaucacugcugucauugcagcuucuacaauacgauauaggaccucucuguuaaaggauauuuccagcugguagcagccacaauucuuggcugagaugaaauggaagaaauggagcuguacagugaaacagaauuugugauaaggcugggcuaagugagggaugcuugagugaaauuuuaauuaguuuauaauuucccuugauagcaaucaaaucaagauuaaaauuuugaaaauauugggugaaauguucauaguguguccucaugugugcauuccaaaggacacauaacuugcugcaagaaaguaaauucaacaacacagguauugcauauguacauacauuuagagggccuuuaguugagaaucugaaaaggaaagcuucaauuaaauauuuauaaauguuagaauuuagacgauaagauccaugcuuugcuuuauuuuauuuuauuuuauuuuauuuuauuuuauuuuauuuuauuuuauuuuuuagauggagucuugcuguguugcccaggcuggagugcaguggcacaaucuuggcucacugcaaccuccgccucccagguucaagcaauucuccugcuuguuucccgaguagcugggucuacaggcacccgccaccaugcccuggggcuaauuuuuuguguuuuuaguggagacaggguuuuaccauguuagccaggauggucucgaucuccugaccucgugaucugccugccuuggccucucaaagugcugggauuacagguaugagcuaccgcgcccggccagauccaugcuuuaaacauuugaaagcaaugagagucaguugcguacucgcauuuuuuguuuuuuuguuucuccuacuuuacaaccuuaaguuuaggaggcugaucugaauaaggguccucaaaauccugugaugagacgcuccccauacagcauuauguauacccuuuucuuuacucucauagucucuuuuuccauauacacagauauaccuguauguuguguuucccugcucaucauuuacaggggauaggaaaccccugguauaaaaguacuucacgagauuaaauaauacucuuuugacagggcuccaucuguguucuaacuuaacuuugaagugaaguauuuucuuuucuaaugagauucuuuucacuguuaaaaauucaauguuuucauacuuccauagagcuaaugaggagcauuguugggaaaauugggcuuuuugauuauucucuucuauacccuugacucucacuccugucucccauucaacagaucauuuuuaaaugcuuacuaggugaaaggauccauccaguacacugugguaaauuggggaaaauaaaauaaagacucaccaaaaauguugaagagcugcuugcaauauuuuaauuuguggaaauaauucaacagaagcaaaaugaagauguucccuaguagcuguuugguuaauaaaacuguucauuagcuugguagaaugaaucuguaauauucugucaaagaacagaauacaaaguagugugaacagccauauugcacaaaauauaaaacagugugggauguggauaagaaugagaggauccucugucaauaagaauuacugguuuacauucgaaugguggagauaugggaugauuuuuuaaaaauuuuguauugaaaucuguaguccaaacucuuaggagaagggcauuacaugccagauagauuauguccuaguuucaggaacuauggauuaugaucaaaggaccuuuuaauuauuuuauccaauauuuuauucaauaaauauuuccuacaagucuacugugugccagucauagaguagcacuacuaggcaugaaggauucagcaguuagcaauuuacacuuugcgccuggccacgugggguuuuuugcucauuccuacauccauuuauuagugaaauauuccaaguauuaaccuaauguucagaauugucaacuagggaugauuagauaugaaaauaagggagcaaagugaaaagugaaaaaaaaaaucauacaauauuucacacuuuccucuaaucuccagccucaucagaguuuauguaagauaguaauucuaaaaaccgcagcagcaccauuuacuaagcaguuacugugugccggucucuguuuugagugcuuaauuuucauuuccucauuaaaccaucaaaacaaucuugugagguagguaguguuauuguagccauuuuacagaagacacaaguaaagccaagagaggcuaaguaaccugcucgagacugugcauuccagguccaaacucuggaagcccuacuguaaguguuccucucuugaccacucuccuucucuaagucccuccccucugcagagugacacugagugagguucaucuccuggauggcuaggaaggcucauuuucuguguccuuccugcccaugaaggguagguugcccauuuaauguaacuacuuuuuuucauuuuucauuuuuauuuauuuuuaauugaaaaauagaaauuauauucauuuaugauauacauguuuugaaauacauauacguugugggauggcuacauugagcuaaguaacauguauuacuucacauauuuauuuuuugugaugagaacacauaaacucugcucucuuagugauuucuaguauccacacauuguuacuaacuauagucaccaugccguguauuagaucucuugaucucuugaauuuaccccucccggaaauuuuguaaccuuugaccaacaucuccuccccucccccaucccuuagcccccguucuauccauuuuucacugagguaaagaaacacuaagggacuggcgaaacagccuuaauauuucucuuucauucucacccacauguuuugugcuucuguacagggaggucccuugccgcucugaaagcagauuuggaaacauguugaaugaguccccuccaguuagggcugacaacgucaaccuguaugugucaugugagauggauguguaugcuuuaaggaaaaaaugauuugaauuugaaagaaaucacucagccaaaagcgaugggggccccuuugucugugcugcucagcacaguucauauuuuagguacacgaaaggcaaauaugggacuagaaagaaagaaaaugaggcuaauuuagagucuucugcccaucuguuuaugagcagauugacuaguaaaaguuuuguucugauaaauguuaaauauuuugaaaaugucagaaguauacucagaaaacucuuuuccaaagucccuuugaagaaaauagagauucugaugauuaauucucauaauauuaaaaaauaauaaaaagaguuucgguguauuuacucauuagcaaauuaauaacagugguuuucuuuuggaaggcaaccaaguagacuaggaugcaccuggguagaguaucuuuuugggaguuagaugagaacagaaggggucaucgcagcaggaugugguauuuggagaucuucaaauuguggccaugcuuaaccaucuacuuuuauuucauuuuucccugccuucuuucacucacccucucuuuaaagauccauuauauuuugguuuugguccuauuuuauuuuucuuucacauugauaacaucaguuaagaagccucaaugcucuuucuugugccuucucaauuucaucuuucuuugaaggaaagcuacuuuuuucauugugauaauccuauauauacaccaucuucauccccccaccacacauacaccccagggguuaauagagcguuuaacugguaauauguaagguuaacugcaauguauugguuuaguaaguaaagaaaacucuuuacuagguuaaacagcuaaacuuaaggaacuauuauacagcaauuuauuaaauauagucuuugauauguguaggcaauuuuaaaauuuucuaauuuaauguuauuugaguagcuaauacauuaacaguuuuuaacaaucaaaugauuauuaaaaguuauaauucaaaagucuaauuucuacuccucucccagaccugacccccaccccugccuccuauggguacuuagucguuuuuuugagacuucccaggaugucuuuaugcuaaaauaaacaaauggguauauaauuguuauauagagguuaguguaguaaauacugcuaaccguagauugaucugagcuugcuuuuuuuccuuguaacaauauauccuggaggucuuuucacauuaguacaucaaaaguuuccacauuuggggguagagggagcuguacaguauuccaaaauguaaauaucccacaguuuauuuauucccuaauugaugaacuuuuagguuauucccagucuuuugccuaaaaacaaugcuguaaugaucuauauacucuguauguagaugaucacauccauauuuagauauagcucucagaagaauuucccaggagugagauuucugggcgauaaagaaauucaucuggcuuuuugaauaauagugccaaccugccuuccauaaggguuguacuauuuuucacucaugucaguaauauaugagaaugccucuuucuucacacuuauagcaacagaguguguuuucaaacuuuuggaacuuggccaauugcauuguuguaaaaauugguaucuuaguauaguuuacuuugcauuuuucuuaugaaugaaaaauuucuucuaauguuuaauggucauuguauugacuacaaauagucuuuucauguguuuugauaaauuuuuuuacuaagucauuugguuuuuuuucuuguugaguucuagccaucaucugugauauaaauuguaaauauaucuucccaguugguuauucauuuuauguuuucauugauauucuucuccucuuuuuugagaagaaauugaaguacaauacagcucuuccuuuccauagcauuguggaacuguaaaaaugaccaugcaagcugaaaccaugcaaagcaaucuuaaucaaugaggauagucacaauuauuucaugacuuuaaaauuuuuuaucaaaacguuaaaaacuuuugggaggccgaagcgggcagaucacaugaggccagcaguucaagaccagccuggccaacauggcaaaacuccaucccuacuaaaaauagaaaaaaauuagcugggcgugguggugcacaccuguaaucccagauacuagggaggcugaggcaggagaaucacuugaacccaggagguggaggugagccgagaucguaccacuguacuccauccugggugacggaguaagacugcuucaaaaaaaaaaaaaaaaagacaaaaacaaaaaacucuauuccuggcauuuauaaauauauacagaaaugaaaaauaagaaaacugauauguauuuaguacacuguaacauuagaaacauugacaaaguguuuuauuuuuuguuaaaaucuuaucaagaguaguauagcagugcuugccgcugucuuauaugcuuugcaauauacagcaagcaucuuuucugggugaacuaucauacuucugaguuuggcucgguugccagcauuuuauccuuuauuuuuucuguguugugaaauaucuccaagaguuuuuuuaagugugaaauuuguugccaacaucacuuccucuggcuucucaucucucuucauccucugcaucccuuuggucacaaccaccuuccucauuugugcuggccuucagucuggcuaugccucuccaauggcagcagugucaacauucccagggucagcucuuucuccuguaacuccguuuacauucaguucaaauuucacuuccaguguuaucacuuugcgguacuuuuaucuuuguuggccaauucccucuuucauugauccauuuuuauaaaaugccacauggauuuaucagugggggacagggaggcaccacagcugcuugcuuugcucccuguccaugaagugaauaacaaaugcacagugaccaguugcuaauagacauuggaagaagggaugugauuggucacuaaucaugaugaacacacaucaguuauuuacacagggauuucagaggagcuaccaacaaaguuuauacuuuaguuacuuaaguuuaauguacuguggugacuacacugugguauugagguauuuaaacuauguaauugauggacugauguuauuuaacuaaaaaacaguaguaacuucaauuuguucauauuaaaccacacaaaucagggcugccuguauagaaaauuaaaaagaauuuaauaauaaauuuauuuuguuauuaaaauaagaauuuuaauaaaucuauacucaucucugagacuugacaaucauuaacauucuguuauguauucuuuaaggguuuuuaauagaggaaguagaucauugcaaguaagguugaaguucuccuuuguccuccaacucccaucccauucccuuucuuaaccucugaacucacauaucaucaugaauuuuagaguauccuucauucucucucuguuucucucuuuuugacauuuauauauauacauguaaagcagcaauccccaaccuuuuuuggcacaagcacuggcuucauggaagacaauguuuccacggacaaggguugggggaaagaugguuucggaaugaaauuuccaccacaggucagauauuagacucucauaaggaacaugcaaccuagaucccucacaugcacagcucacgguaggguucaugcuucuaugacaaucuaaugugauugcugaucugacaggaggcggagcucaggugguaaugcucgcccagcuggcugcucaccaccugcugugcggucugguuccuaacaggccacagacccguacugguucaucgcccgguguggggguagggggaccccugauguaaagguuucggugggaaauauguacucuucggggaugugcuuuuuaauuucacaauaauuuguguuuuuuguuuuucacauuuucccauuguuucuuguagucuuaucuccuucuggaauuaaaaauaauuuuugucuucuccuuuuccccccauuuuuagaagucauguuuucuguuucauccuauuucuauucaauuaguggaguaauuuagauuuuuacaagauuaaaaauuauauagagaugaguauuauugaugaccugcccucuucacagaaauagccaacacuagauauacucauguccucaugucguauuuauauaacauuuuccucauaaauuuaauaaccuucuuacuguuuguccuccagauuuauucaggagauugagcaugcucugggucuuggcccagccaaacaguguccucuucgagaguuucucaccguguacaucaaaaacaucuuucucaaucaagucuuggcugagaucaacaaggagauugaaggagucacuaaaacaucugacccuuugaagauucuggccaacgcagacaccaugaaggugcugggagugcagcggccucuccuacagguaauaauacacuuugaacuuacuauuuuuaucagcaauuuucauugacuuggcaagugucauaaauuuaaaaaagaagaauuaccaucuguuuccauauucaucagggacaaaacaaaagaaaauaaauaggcacuagggaaauuuagauuuaauguaguuggauaauggaaguuccuuaagaucuuuaaggaaaauuaaaaaaaaaaacgguuagcuuuggauaugagagauggugaaucucauuaacaugcaggcaguuccucauuauuaugccuggaauugguccuugaaaggaacuauuuuuccauuggugaaugcaucccugaguaugaaggauuaacaggaaggaagcuaugaugcccaacuucaauuaccagcaggaaacccucuauaccuuuuaggggcagacuuaccuuucaaugacuuggcuaccucacagggaauuugaaccaguaaacugaccuuuaaaagucaaaucacugaauucacaugaugaucuuguuaguacugaaaauuuuacuuuauauaaaaaaaugguuucuuagcaucagaaaaaauaaaauaaucugucaguagauuuuuugauuaauaggcuugaggcauauauuuuauauacauuuuagcuggugacuuggagguauauauaaaacuaaaacaaaauuaguaggaguuuaaauuauagguauacauuaacuauuauuacguuggaauugaauccuuauuguguuucuucauuuaagaguaggaugggcacagucucacacuuuuaccuaaauuguacaauaugagacuauucaacauguggaaggcuugagcuuuucaaagagaaguuguauauauggaagggaguuuuacuuguuccaguugccugcccuuaccugccuuuacauauguuucccuugauuuuucuuuguauguuagaauuuacagaagugcuggaccuuucuuagagaagcguccuaguuaugagcauucuuuuuuaugagcaagcucuuuuaugauauugauaaaauagaauaggaagauguucauuuggauggucugggucucuguuagccaugugccuggugagggaucuguacugaguguugggugcagagaagggggaaugccaaaggaacgugcuugcucuuccuucugcuggauaucucuuccggcucuuugcauggcuggggucuucuccucucugggugucacuuaaaaugucauguccacuggaaggcuuuuccugacuguccuaccuaauuagguccccuuuccugguuauucuccauucucccauuuuuccuuaccaccagccccauccauugucaauacugaggccaaacccuauggacugugucuguggacugugucauggaggcccccuugccagguagcuucugaucagguucugccgauaggcagcacaaguagaagauuggaaagugggaggagaaagagggugggugauuucuucuccccuuccucuucacuuuggaucauggcccuggcugugagugccucccuccauaacaggagauccugccaggugacacauccuccauagcuccagcucucacuggacucuggcaaugucauuucuucuccuugccucuugauuucagcuuucugcuguuacaaccucuggaugccucaguaucccuuguuccugcuuucaacccugcccauaccucuguaaguuauuucuucauucauauuucuuuauuugaauuaucuaaauggaauacuuuuuuuuuuuuugucaagaucccagauagaucuccccaguuaaucaggauuuuaacacuuugguuuuuucuuccuaacacuuaucacaacccuaauuauuaauuaauuuugcuaacuuguauauuuucuauccuuucccacuagaagguaaguuccaaacacauauuauaaugucaggcagcaggaaggugcucaaugaauaacuuacuggaugaaugcauguugcauggauggauggauggauggauggauggauacagugaauaaguuucgagagucauaaguacccacagagucagaauaaggagaugagaaauagagaguaacaaaaauauguuuacuuuuauguguugucugaccauaucauuagccucauuuccaucagaaagccuuucaguauuuauuucucugaagugucacgcuauaugccauacagagcaacuugaacauguuuagugcacugaauuuaaaaggaaaaaaaaggcaucaguacauuacagagugagucugugaaccaauaauacuggcuuauuaaaugugauaauuugcagcuucaguagcaaagaugcauuaaaaucauaacucauugaucugggccaugucaaggccauaugcuaccaacaaaaugacauaucugggcagucuguccaugugccugucagaucacucccaaccucaucaccgccauuuuguacauguuacugugccucuuguccuuuaagucaccgugaggcuagguaagaacuccagcuuuaccuguucucucuuugaccuugucaacauauaauuauauauaagugaauaagucuugaggcuaagaccauucaagcuauuaaccugcaaauuuuuuuuucuagaguuaacacaccugcuucauuuuuuuuuuuuuuuuuuuuuuuggugauuauguugcucuccuuuuuuucauuaaaaaaauuuauuuuaugaaaaugcaaauuauuuaaaccauaucacuaaguuuguuuaauauucucagagagaguuaugcaguuuaaaaagcaaacaaggagaugguuauuuuuuuuuccuaucuuugguauuuuccugcauuauagugauuguaaauuguuuucuaauaauuccccauacucaagcuucauucuuuuuuugucuuccucuacaagcacagggugaauuuuauucuugaauuuuuucuauguuuccuuaauauuuuauucccagcuaauuguagguggcuaaucugaaaaaagaauaagaaauaauucucaaaaauuuuagcugagaauccaaaacaaauguuaagaaggagcuuggagaaauaugugugugcgugaaagaugcauguggguuaaauauucaauuacaggaaguauaaaaauguccuuuaaaauucuucccuuugcuaaacuguuguuuggucacagaguagaagagaggacaugccuuucccuguggcaacacccagugucacacagcaucagcccagccggauucuccagggagggugggaggacagcugucucagugaugcuuccaguuguuugauaacggacagacacggugccuaggagcccugugaagagaaccccaggacacuuuguccuugucccucugaaguggcaucugggcaguacagacacuuggauuauuagaggcauuuccaugggugccaacauguguucucagugauuucacuuucuaggcacagguuccauaggagggaaggaaggaagucaguaggaaggaagagaugacaaucagcauuuuauaccuaaaacacugugcaaguguuagcccaagcugauacagcagaguaacacuagugguaauaauagaagaaguaaaaacaguaaugauagcaguuauaauaguagauaguaguaaugauagcagcuaacacuuuaguagcauuuacugugagucagacacuauucugggugcuuugucuguauugauugcaaguguuuaaaauguauggcaacucugagugguauucuuuuuaugaggaagaaacugagaaacaaugaaauuaaauaacuugcccacagucacauagcugccaaguaguagaacuguaaugcaaacccaggcgaugcaacccuggagucagugcucccagccaguucuacccaaaguggauucugaggauuaugcuugucugcaagcuguuugucaccagucugcuaugagacguagagaauuuaggagugagcauuuagacaauuuuuuuuagcauuuugacauugucuguugaauccaguaauaaaaaauugggccucauguuuuguauaucuuuguggguuuuaacauuucuuuuuucuagcaauucauuuuuauguuuuauaaaaguaucaaugugcaacugauuggggauaaaaacugggcucuccauaguuagagaagaacugucuaaaucccuuacuuuucgguacugccucacagagagguaaagcacagaaccaucacuuuuaccccagugccuaaagcauuuuucaauagauagauagaaaagugcagauauguguuacaguugggucucuccuaaauccccagcuccuagaauagugucugccauagaggaaacacucaauauuuaauaaauggaugaaugaaugagugaaugaaaaugaaugaaugaaugaugacuuccuuaguaccaggacauggcuguguuuucugcgcaugguauaaaacucauggucuuggguuuaagauaguuaauggugcuaaaauuaaaaugucacaguucuuaugccucuaaugcucccaggaugacagcaggauuggauacaucucauggucuuaccauuugagaucccucuguugccaucacuuuuucugcagaauggccuccaccuguugcaaggaaagcauguugauucaaacuaaggaaauaccugaagagaaauuauucauuucuccugagucagauucugaacacggaguucuggaaacaguccauugaaguggauaccaucucaugcuuuauauaucucccagaguacaaauuauucauuccuuaaacaugaggagacagacggaacugauucaguucauuucccugguuuaccauugauuuggagaugccauuuaauuuauuucuucuuuggugucuccaucugaaaaaaagagcgaggggacuaaugcuuaagguuuuugaccccuuacccaucaaauugcugaauaggcaacuaucuaugugaacaaaugguacaagcaaacuuucuuccucuaucaccaauggaauaugccauacccuugcuacuuagagaguguucuguggccaagagcaucaaccucugaugagucugcauuuguauagaaucuccagaugauuuguauauacauuagaguuugagcagcauugccuuauaccagugcaaaagcaaguguggcccauggaccgggagcaucaguguggccugggagcuuaugagaaaugcagauuccugaaccucacuccacucuggaaaucucuguucacaccagcccucuaagugauuuugguacucgcuaaaguuuaagaagcauacucuuaacauaacgucgucaugauacccagcgugaaguuaggaaacgggaucuaauguugugggguuuuagcuuuguggugaacaacaguagucauuuuuuaaaaaguauucagcuuuguuucaugcaggcccaggaauuguaaaaacaauauuugcugcagcagcagaagcugcuuccuagucuagcacauugauuuugcaaaguuguuuccaaguacaggaugagccuacauuuucuggcucaugcagggcaaugugagacagaggcagcuuuucuaaugcucaggcuuaaacucccacaucacuggaggaacaaacauaagcugugcaaguacaaauucugggcaaucuugaaauguuuagagcauauuuucauuuuccucucugccccaguauuugucagaguaacuuuugagaagugaaauggcuagaauccgccugcaaacaccacacugucaucucuuccucugccagcugcacuuuccacuuauaucugcagacuuagagcagugauucucaccaacgcuacccauuagaaucacccaggaacuuccuaaaaauaccacuucccaggucccauugguugcucagggguggggcgugcuugggcaucaguguuugguaugaugcccagaugaucccaacaugcagccagaauuuguaccucuguccuugaucuuucuacuccaucguaucaguuauugcuggcagagagaguacaucaaaaauuauuguugaaggcugggcaugguggcucacaccuguaaucccaucacuuugggaggccgaggcggauggaucacuugaggucagcaguucaagagcagccuggccaacauggugaaacccugucuauaacuaaaaauacaaaaauuagccagguguggugguaaguaccuguagucucagcuacuugagagacugaggcaggagaauggcuugaacccgggagcuggagguuguagugagccaagauagcgccacugcacucuagccugggcaguaaagcaagacugucucaaaaauacauacauauauauauauauauauuauauauauauauauauauauauauauauuauauauauauauauauauauuuuauauauauauauauaaauauauauauaaauuauauauauauuauauauauaguugaggcuuuauuuaaugcagccagguuuguaaaagacugcuguguuggauacuuugaaccaagccuuguacauaagccuuggaaucagacacaaauggauuuaaaucucagccauuucauuugauagcuuuguggcugucaccaaauugcuuaacuucucuguaccuauuucuuccccuauaaaaugggaaucauagaaucugugucacagcaacacuccagugauuaaauggaguaauggguguaaaacaugcccucuccuuccuaccccgggucaccugugagcaggucucugcguugacugcuuugauguguuaccugccuggcccuuaacgccugccuuccuuccugaacucuacugacugcgccccaaccccugcccucucugcccacauuuucaaccugcgucuucuucucaucaccagcuugcuguuuacgcaccuucuguucuuucuacucuagcacccagcugguaacuucccuuuccugccuucuacuacccuggugugacagcaagagaugauauuguuucaccugcuuucuccuuuuccuggaguuugucagcuggccauuuauuagcagcagaagcagcgugcaguauuuuuguccauuaaagcuaggggauuaguuuccuagggcugccaugauaaauuaccguaaacuuagugccuuaaaacaacacaaauguacucuugcauaguuuuggaggccaggagccacauucccuccaaagcucuggaggacgauccuuccuugacucuuucagcuucugguggcucccguggauuuuuggcucuggcagcguaacugcaaucucugucucuaucguaacguggcguucucccgugugucuccuauguuuucuuuucuggcucuuguaaggauacuuucauuggauuuaggguuugucuuaauccaggacgaucucaucucaauccuuaccuuaauuacaucuaaaaagauuuccaaguuaagucacauucugaaguuccguguagaauuuuggagggagacacuauucaguccacuacaacucauaacuagaaugcaaucgauucaguuugcuauguuuuccuugacgacucucuggcaggaagcaguguggaaguauugccauuggcuagucugggugguacacaccuguaaucucaauacuuugggaggccaagguggggguauugcuugaggccaggaauucgagaccagccuaggcaacauagcaagcaacugucucuaaaaaaaaaaaaagaaagaaagaaaaaaagccagguuucaugauguaugccuguagucccagcuacucgggaggcugaggcaggaggguuggaucacuuaagcucaggaguuucagguugcagugagcaaugaucaugccacugcacugcagccugaaugauagagugagacucugucucuaaaaauaaauaaauaaauaaauagguauucuguuaaggcaguaggcccaggauggucuaaauucuagaugucaacaagguucaaagugaaaguuuuugguaggcugagugauugcuggagcucuuacugaaaguugguggacacagcuacuuacaguauaauaauuugcuagagauaauuauacugcugcccaaaccuauuaucuccccagccaagcuaaggcacugccaguaacuucuucugguuucccgaggaaguguggccagcagcaguagcguauuguuuucaucauaucacauuauguucauaugaagaauguugcauuugaguggcauuugcaucacagccaguuguugcccuuccacucugguagagaauagauucagcuuuuauuaguguaaauagauuagucccauuuaaggucugcuggaagucauuaugaaaaucauuagguugaaaagagaacugaucaauugauuuuuuuucccccuguaagcucugagagauggugcuaauggucucacugugcuaaaauaagucuuagaaccaagaugccuuggggucuaaucugauucuucaguauuuaucgauaccuaaagaaacauuaacuuaucacucauaguuuugauuuucuuugcauuuuacucuuguuauuuuauuuauucacuaacaguauuauuuugccucuucaugucaagaauaaugacuuguggcuaccuaagacuuuauugaggaagauggaguggaagaugccuguguucuugucuuuguuuagauuguccagcacucaccuguucacuuccaagauaccagagcaaauuaaauuuuuuauugcuaauagagacuuuugggaucugauaacauucguccauguuuucagaucauuuuuaucaaguuguguuacuuauguauuguuaauucuauuacuuauuuaguacauuuuaauuuuguaguuuuguugugauucuucauagccaucuuugaaagugcuuacugcuacauuucaucauggugaggugggaaaugcauauaaaacauagauuuggucuccauaaucaucagcucagugaccuuagacaaguccaagcuacuugucuugucugagcuuccccucucucauguauaaaaugagaaugacacuugcccagacuuccuccaaagacuaggaugagaaguacuaugguaucauggauucaguagggcuuuaugaagucuucuacauauugaucuguuucauaauuauuauuagugguccacauacccacaugauugcuccauucagaaaaaaaauccaacaguguuaacaggaguggugcuaagaaaacaccuacaugaauaaaaauauuuucuaccaaguagaaagccucacugauauuuacugguuuguuucauauaugauuagacaaccaguauaagaaccuggcaauauuuuuuccccaguuuaucacaaagauguuuuaaauauacaaaaaaucaagaaaaaaauguccagugaacacccacauacucaccacccggauucuaacauuaacauucuucuauauuuguuuuauagcauaaccaaaccuggucauuuugauuccucuucagccuucacagaaaugaauucugcgucauucccugaguaccuuaccauggugcuguucccaguauuuuaaucuuagaaaaucugaacauacaaagagauacauuagguaagaaaguaguugcuucaaaagaguauuuauuuucuaaaaguacucauccacacauuuccuucacauagugucauggaauaggaaauugaccagcucauucuuaugauuaaucuauaaguagugccuuuauugauauaauauuacaaaggaacuuguccucguaacuguugaugaagaaggcugugaguugagccacugagagaugauuuuuuaauauaccggcagaacaggcccauuauaugaucaaauugaauuuccauaaauaucauuaacuuauugucuuaccuuugaaugaaaaagaaacaggaucucaucugacuagcugguuuucuuagagaaguuccuaguuaacuagacuucuguaaguaacuuucugcaaagcaaugacagaaaaaaauuauuuaacuauauuuaaacuagcuucuauauaauauagccagcuaggguuuuggaauaauaacagagggacuagagauaaacauuauuuucauuugucuucagaaaaucaucugccaccaaccuuacacauuuuauaaggauccuuaaugaucucagcauuuuuuauuuuugaggucaaccauuauucugaauguuuucuucaacaaucuaucaucucucauaauguauuuggaacagauuuuaguuuagaugcaacuuuuaaagaauucaucuacuacaucuggguuacgaggucaguuuaaaaagaaugaacuggaggacuuuaucuccuuggguagaggagucaugagggacuacugaaugagaaaguaauuauagucagugacacuuguuuaccaguuuugcuuggugccaagaaacuugucugagcacgaggcuguuucagaaugacaucaauauagggauaaccccuggguuuuaaaggaagucucugagauuacuuucuaucaugaguaaaggagccccacugauggucgucuuaguugucaccuagacuguucuaugaaacagggcuuauuugggguaagcauuuugagguuuugauuggcuacuguccauuuugaucuugucucagcccacuccuugguggauaagcaggagagaagguaaugccuuaugacagaucugcugacaggaacugaaauacauuaacacucugucacucagaucuuuagagggcugccuuugccugaaauauauuugacuuuacuugcuaacaaaggcaucuucagauuuauuucuuuuccuuaaauguuagagaagaggaagagcgucccauugaaagauacugggaagagaaaagccuggcucgacagcccaagcaaaugauaguuagcauucuugggagcagcagaauugcugaucgugcgagauuacuaguaggagccagaugaguguagacagagaacugcuguacuuaggaaauuuuugagguucuuauccuaagcaguuuuugcccuauguggauguugcagcucuggcuuaggaugcuccagugagaaaaugaagagagagaaacaagacuaucucagcuucaaaguuuaauggccauuuaagauuaacauuucaaguaaagcagcugcuuuucuucaugcuuuucaaggauccugcccuacucaaaaacuuguguguacuuaaucuuagcauagacaaucucagaugggcuggugaaaccugauacaucucuuauaacaagagugacaugacacagugaaagaauuuccaccauugaaauuuuaauaaaaugaaaugauuaauauuuauucgacaccugcuuugugcuauugcuagacaaggugauguggggauacagaauaaacuuaaagcaagacuucuucuucucaggaauuuaguagggaucaauuaauuaggaaaccggaauuccucacaccuacaaauccaagaacaguaaaggacacuuuauaauugaguacugaaugugaugguuuagaagauuuucacuauaagagcugaggagagagacacagaaggcuggaggauucaagagagaccuuaggcaagaagugggcccugagucacuguaggauguguagaaacgaagaaggcagaggagaaaagugaccugaacaacagucacaauguaagcaaagacacaaaagguaaaacugaccaucgcguguucuugagacagugagagucuaaaugagugaaggaaugaaaggagaaugagaaauaagguuaacgggggcacaaaacucuaccagggaggucucaaacugaacacaccaguuuacuuuugaagugaaaaugauacagaauggugaaaguuuuuagagaaggugcauguucaaauggaugcacuuuuaaggagcacugggccuuggcaguucagacaggauuaggaggcagagagccuggggucccagaggcagcuaaggcagggauccacuaguuccgcucugaaggggagacagaaaguuuuauguguuucucuccagaccaaaguuuugggugaugacaucauggcugccugagauucagugagccacaacggugugcugagcuuagcauuugucaucagucuuuugaauuauuguccuaguugaccacacuaccccaacagucugacuuucucggauaaauauugcacuucugaaucucugugaggguguucccugcugagcccucaaaggcaugaccaaaugggguucauccucaccucuguguccacaggagcagccaucuuggcuuuagcacacucacguuuguuuaaagaugaagcuguacauuucucauucauugcuuuuuuagacacacaggagcucugucaguuaaaguccugcuuuggggaaaaggcagcaugcagccaguucauuaacagguuaucuaugucauuauguccuuuuuggauugugcauauuggaaauacagucuuuugaggaggaaaaaaaaagccaucuaggcuucuaguuucccuuucuuuuucuucuucauuuuuaucuccuuuuuuccccuuuauaguuacagcuauuccccugauggauggucauaucuguagaguccagaauacccugaguauucacuugcaaauagcuacaaagucaaauacagauaacuacacuuaaaugagagcuauucucuaccucuccucacugcacacacacuacuucucuuugccccauuucaaccacaggagcuuaauugcuucuuccuuuuuuuuccacaaacauuucggaauuuguuguccccuuggucauuucaaggucaaggcugccuaucaggcacucgcagaagugcuccggugaccuugcuugcuguguuugcccauggcuucugacgcuuuaccagagugagcagccugcccgagcagagaguaggcuggccugccaguuaauuucuugccucgugaagaggaggaguacacuuuucuuccagccuuucaaaauguugcuuuagagccaaaagaaaucuucaacacauaguaggcacuuacuugcuaaaugaauaaaaugaaaauugccaacagcuauguuaaaguguggccucuagcuuacguguuuagggguaggguacguaaaagcaaaccucuguuguuugccaaggaaaggaguaucaaauauuuguguuuguaaaaaauaaacuguuuauuucagagaaguuauagauuuaucaaaauugcaaagacaguacaaagaguucccauauacccccacuuucccuauuauauuaauaucuuacaccuauauuacuguggugcauuuguuacaauuaaugagccaauauugacacauuauuauuaacuaaaaccuauaccuuauucauacugccuuauuuugcguauauguguguguguauuuuuuaaacuuaaugcccucuugcuguucgggauaccacaauacauuuuguuguuauggcuucuuaggcucucuuaaaugugauaguuuucucacuuuccuuucuucugaugaccuugacaguuuuuuuguuuguuuguuuguuuugagacagagucucgcucuaucgcccaggcuggagugugguggcgcgaucucggcucacugcaaccuccgccucccggguucaagcaauucuccugccucagccuccugaguagcugggauuacaggcacccgccaccacgccuagcuaauuuuuguauuuuuaguagagacgggguuucaccauguuggucaggcuggucucgaaccccugacuucgugauccaccugccuuggccucccaaagugcugggauuacaggugugagccaccacaccuggccgaccuugacaguuuugaggagugcugguuagguauguaguagaauguaguuaugcucuacuuccuuaacgauggaguaucaguauaaaugauuuagaaugcuucuacaugagagagcuggcuguucuccuucauuuuuguaauuauuugguuauuuauuugucaguauagacuuauagauuuguauuuuauacuuggaguuauaauccacuuuauuuugcugcugaaaucguucuagcuuuggacaucaguaacuucuuugacuggcuucuguuauuuccuaagucuccaucuuugugauuuuuuuuuuuuuaagcaucuccuuacuuucuggcacuacaaggugcuccuggcucaucuuguauauugccugccccagcccuagaaucagccauuuuucuaggaauccuaguuccuuuuauuagagacuagcauuggaaaacaagaucuggaguuuuagaauguuucuuguaacuugaguaucauuauuucuaggcccacucaguugacacugaaaggaaacauauauguguauauacuaacccuugaauauauucauauccguauauauuucuauauguaaccauuuacgucuguauuaagcuaaaaacgaguucauacugaugucuccaacacuaaucuauaacuacauggagcauucuagccuccucucgguuaggugugaccuaccuuucccucagugagaaaccuggcucccaccaucucccauuaauuuacuuaacuguauacauggagucuaguauacauguguagcaauaacacagucauucaauuacaguauauacguauagcagugucagaauaguuaacccauacccuugugggaaacaacuuuaucagcuaguauacagugcuuuuauaguuuauuuugccuuuagucuuauggacuauacucauuucuaguguuacuuaggucaguaccuuuucucccuacacccuucaaagacauuguuuuacacauuuguaauaguuagacgguuuugucacauucugcacuaaauccuaggauuccaugauaucccaaaugauguuuuuaauuugcauacauuaauguucauucuuugugcuuuaaaguucugugaguuuugacaaugcaaaauguugugugucuaccaugaugauaucacacagaaugguuuuuacuacccuaaaaaauucccaugcuucaccuauucaacauuucucucuuuuuaagacucuggcugucacugauuuuuuaacugucucuauaguuuuaccuuuuccagaauuuguaucauuggaaucauacaagaaguagcuuuuucagacuggcuucuuacacucagcaauaugcuuaagauucauucauggcuuuucacgacuugauaacucauuucuucuuaucauugaauaauauuccauuguauugauaaaccacuguuucuaaaauacauucacauauugaaggacaucuugguugcuuccauuuagaguuauuaugaauaaagcuguuauaaacacuuauguuuaguuuugugaggauauaagcuuucaaaucaguugguuuuuuuauguauugaaauuguaggggucagugggcuugugguggugguaggggcagauuuacaaguaaacaaguauaucacaaugguaagugcuuucauaaaacuauaaauauaacauguaaacuguugaaucuacauaagaaaaaggcaaaaguaaaaauacuuaaaucauucuuaggcucuccuauagaaaauauaauauuuagcaguucuuuccaggaaaaacacucccuuaacacacacauaugcacacacaugcacacacacauacacaccccaaaccaaccuaacuugcuguagacacacuguuaaagcucuagcaaagaccacaaggcaggugguagacucugcaaaacuuaacacaaugauuuuucuucuuccaacucaaauaauaggagagaaauuucacguaaaggugaauaaucagucccugagaaggaaaaaaaaaaaaggccuagggauguuuagguaucuggaaaccuggaauugauuaauaagacaaaagaacaaauauaguuauuuuaccaagucauuuagagauagcaacaagucauuuuuuucugggauuugggguuccucccagauauuucuuauagagggagcuaaacccgaaggaguguaccaaauaguaaaugaaaucuuccuuugucaagagcuaacuaggaguuguuuuuguuaagcuucugggaagagauggcuuugaccagguggccuuuuagaggccucuugcuuccagcuugcacacuuuuguuugguugguugguugguuuuugaaacagggucucacucugucacccaggcuggagagcaguaguacagucauggcucacugcagccuugaucuucuggacucagaugauccucccaacucagccucccagguagcugggaccacaggcaugugcuaccacacccaccuaauuuuuuuguauuuuuuguagagacaggguuuugccauguuggccaugcuggucucaaacuccugggcucaagcgaucagcuugccucggccucccaacauguuggauuuauagaugcaagucaccguaccuggcccuugcacaacuuucaauauuagguggcugauucagcugggccaguuagaaccucacuuauauaccaguuauuggugaagaagguagaauagagaaagagaaguauguuuaccgccuagcagauggaacacacaggaagggguaccaagcacaccccccuugaaugcacagugaccccugcauauuaguaagauauaauauaaucucagaggcuugacuagauuaaaaagcuguccuuauuugaagcagaauugugggauaugaugagguuucucuucaaauaaucugaucaaucuuuuauucuuuaauucauaauacucuccaccccuuuucccuuuuucuccuuuuuuuccuuuuugccuuuguuagauacccaggcaugccacaguaccagacauuaucaguacuggcucacauuccuuaccuuauuuggaaagaggacuaauuuucuagcucauuacagacaccccuuccccuuccucuccacuuccuuuuaagugcccaccuuaucuuaaaaaaaucaaauguuuagccaaccgggauuaguuuagauuguacaaccuuacccuggccaaugaggaaaggguauggggcaggacuugcaucaggaauaaagacucucguaccccuuuguucaggugugcucucauggcaacuggccaaggaggcaccccucugcgcagaaguaaaauuguuuuucuaagaauccuuuguuccaguguucaauuucguuaggauuuugagcguuauuccuaacaagaauuaauaggguggaaggaguaugagcagaggcgccaaaguauaagugcagaaagaacuuucuccaacagccagcaugacaagaaauuuguaaacagcaagugauagaaguguuuugauacauagaacauaaauaauaggaaauuuaagauuucucuuuaagugaaugauauaguuuggccguguccccacccaaaucucaucuugaauuguaacucccacaauucccaccuguuguggaaggaaaccagugggaggugauugaauuauggguugggggggucuuuccugcacuguacucaugauagugaaugagucucacgagaucugaugguuuuagaaaugggaaucucccugcacaagcucucuuuuuuugccugcugccauccauguaagaugugacuugcaccuccuugccuucugccaugauugugaggccuccccagccauguggaacuguaaauccauuaaaccucuuuccuguaugaauuucccagucuuggguaugccuuuaucagcagugugaaaaugaacuaauacagcgaaaaauaaaaaagucagagauaaguuauaauuuauguuauagucaugaagcccaaauaucugagacaggucucaguaaaucuaggaaguuuauuuugccaaauuuaagaaugugugcccaugacgcagccucaggagauucugacaacaugugcccaagguggucggggugcagccuuguuuuauacauuaaggacacaugcaacgucaauacauguaagauguacauugguuugguccagaaaggugggacaguucgaagugggacggggcuuuguguucauagguagauaagagacaaaggguugcauucuuuugaguuucugauuagccuuuccaaaggaggcagucagauaugcaucuaucucagugagcagagggaugacuuugaauagaaugggaggcagguuugcccugagcaguuuccagcuucgcuuucucccuuuagauuagugaauugggggucccaagauuuauuuuccuuucacauaguuuaguuggugaauguuuuuaauuagucccuggguaaguauauuuuuaaaaaucaugcuauaguucauauauuugucuaaagugcauuaguuaaauauuuaugugauuauauauuuauauugucggcuuuuuauggagucauuuuauagaaaucaucauaaaugaauggaauggaagcuaucuuuacucuuucucaaccagcuuuaucuagggaaaaccaagcuaacuggcucaugaaacuauugaccagauuaacuucaugauuacuaacccaauuauagaccuugugccuggguagaaauaauuaauugccuuagugcuagcuuagcaaaugcaaauaccucaauuaguagcaaaaauucuaugcuuauuucaauucuguuuccuuauuucuuucagguucuggacauguaggcacaggcuaguuuacuuacaugauggaaauauaauauagcagacaggcaauguuuuaaccaaacucauacacaugggauaauuauucuaagucauaaaucuuuuuaauaaaagccugauuguguauaguuagccuacauuauuaauuuuccccagcuagcauugguauucucuaucauauaaaggcuagacuucaauagaauguuaaggcuggaagguauaccuuggaaauuaauuucuucgcuggagucaaguucaacacauuaagugcuuugucuaagaugacauaucugguaaauagcagauccaauaguagaaucuaggcccuucuccuucuggccaauucuauuuuuguucuaccuguuaaccuuucaugugcuggaugguuuauuuauauuggauuuuaacagcaccgacacuuguacuguaaaauaaauauuuuguucugcugaaguucccgaaaaguaacaucuuaaaccaccuccuacuuagggugacuuugccuuuccuuuugcuccucucucuaaaggcagaacacguuucacuccaaaaccaaauaacgcacauuucucuccuaauuuaugguuuucaaaauuucagaguguuuuuuuuuccccuugcuguccagaaugcugucugaaaagucacaaugauuuaaauaauugauggcuacuuuaugaaaucgucagccuggauccauccuccugccucccucaaccgcaaguccuugagcagcuaauccuuuuauguuggaugcuuuauuuuucccuuccugguuucauuuagauaauuauauuauucacccuggaauauaauugccguuauacugugggggaugugggagugaaguagggugggagcugccugcugcuggcaucugcagguuguaaaaugucuguuacacucuagccucuaauuuuuuugccaucccaccuuuuaaagauuuaauuauaccuguguaaaagcauaauuugaaaucugacuuauuauucuuuuggaagauaaaaaagauuaauccauuguuaaacaugaauaagcaugguacaauggaaaaaacuuuggccuggaauucaauugaacuaacaauuuuugaaugccuacuaugugccagggacaguacuaaaaauuaggaagugcgaaaauuuaaagaaaaggacuguccucuaggaggguucauccuggugaucuccuacuaacuugugacaugucuuugcacaguacacuuaaucugucugggccucaauuuucucaucucuaagcagaggguauuggaccucuucugcauuuucuccuagcucuaacauuuggcagugcuccaaaaaagaccauaaaauagcagccacauugcuucuuugucagauuuaauuggaagaauagggagugguaaaagguuuaaauuuucuguggcagaagucauuuugucaucugugauuucagcucuuugacaaaugauuccuuuaucuugaaugcauuuucuuccugcuaaguccuccaugcccaaaacagggugucuuuggaggcagaagguaacaaucucugaguaacugaaaguuaucaaagcaacaaaacuuucucuuucagauuauugccugacaucuucuuagcucgugaagcuguuuuuccagugaggauucuaauucuaacgugguuuucacaagccuaaguuucacuguuuauugguuagaagagagagucacaaaaauggguuuuguucuucuuuguauguuaugguuuucucuuuggaggugucuaaguuggauaagguaaaacuuccuaacucaaaaacuuagaaaacuuaaggauauugaauguaaauacaguagagcaggcuuugcaacuuuaagaggaaaugcuguucaucucugucagacccuuacagcgcuggauaaaguaaaccccaaaugacagcauauagccuguuacaaauggaacacaaauaacacaugauaaaauagagauuuagaguggauuuuauaacauguuuauuuucagggagcaaaucauaacccauuugccuuauuggaaaaacaauuuuccuguuacacagggagaauggaguauuuaaaaaggaaaugaauaugacaaccaaauggacuugauugaaaucagcaaauuuguuucuuauuuacucguuguuuuuguacuagagagaaugauauggggcccagaccaucucucagcgguaaugguucuuuuaugaaagaaagaaaacaaaauaccuagccaucugaguuaaaguaguuuucacauguccuguagucucuagggguauaaauugaugcuguuuaauagaaaucucuccccuucaucugcaauauuaauguguucccuaauuuguaauccacuuccuuuucucucaucuuuauaaaaaucuuugcaagcagcccucuucucugcugccuaauaauaaaauauugugagucuaguaauaaucucacccccuuuuuggugaguuuauuucucuuuauaccagugcuucuaaaguuuuaauauucacuuucaucaccaggcacaucuuaaaaugcacauucugauccagucagucugguugcagccucauguuuugcauuuugaacaagcacucagguaauagcuaugcugcaaguccaugguacuacuuuacaguagcaaggcuguagaccaggagucagcaaaguuuuucugaauagagccagaaaguuaauauuuucagccuugugguuuauaucgucucuguuugauugugccaucguaguauaagagcaaucauagauaauauguaaaugaaugagcauggcugcauuucaguacaauuuuauuuacaaaacaauguggcagcuggauuuggcuugcaggcuguaguuugccaaccccugcuuaggcaauguauuugaagugauuuguuguuauuuuuaauguaaagguugucauccauaugucuacaugggauuguuuuauaaugguguuaggcauacauacaaugaguagaguuucauucaugguauaccuagguauuaugcaagaaaaauuuuaagucaauuaacaagauaccuuuuuuccucuagagaacuuagaauaaggugagaggcauaauggcuuagcucuauuguggcauaauagugccagcguuuugaaaaaucacuucuuuggcaaacagucguuuauacuuguauauugcugugugccugccuuuccccgaacucugacuuuuuccugcauaugugcauuucuuuuaucccaucccuugccauaucauuuggcucugauccuauuuggauaaugagauaguuuguugugccugcaaugaagaaaaugauuuuaaauguuuuuuaauaaguuaacaggagcaagucuugaaauuacuguaaugagauaaugacaguguagcauauugcuuugaagauugugcucuggugaaaaauguaugcucuuaauaaauucauuuucacuguauuuuccucaacaaaguuguuuagcauuugccuauuugccuaccaguaauagggaaauggucauaggaguugguagucaauaaagaaugaagaccaaaguugauacucaaguaagaauucuuuugagcuuuaagguaucagccauggaggacuuguaccaagaccggaauccuguagugacaggugcuuuauaggaauauuaaaauccagaaccucagaccacuauguuaguuucaucuuuuuaauuuguucauuacugcagaucacauguauuuccuuucuuugaaguucuaaguauuacacuugaaaguuucuaacaguucaugcacuuauuuagccaacauguaucauguguauauauucaauccauagcacagucucagacacuggggcaacagaggugaaggagaccugaguccugcccucaaguuuauuagagaagggcagauauacuaauaaaucaauguuauaucugccaugaucuacacauguauaugacacauugggaguucaggagacaguggucaguucuaccuugaaggucauuuuaaaaagauuccauaaagaagaugaugcuuaagcugaaucuagaaagguagauagauuccaaauaaaggaaaaaguauuaacaaagauauaguggcauaccuuauugaggggaauagauacauuuucauauauaccuauaaucgaaucugauacagcagugagagugaauggauguacugcauguuauacauagcuugcaugaaucuaacaguguugaaagaagcaagacacaaaagaauauguaaaauuugauucuauucguaacaggcaaaauuaagcuauauaguauagggaugcauaucuaagugguaaaaucauaaaggauagcaacaacaacaaaaaucuauuacaaagguuaccucagauaggaagggagaagauuuugauugggcaggagagcacuugggauaauggaaaguuuuauuuauuauuuuuuauuguauuuuauuuauuuauuuauuuauuuauuuugagauggagucucgcucugucccccaggcuggagugcaguggcgcaaucucagcucacugcacgauucuccugccucagccucuugaguagcugggacuacaggcacgcuccaccacaccuggcuauuuuuuguauuuuuaguagagacggaguuucaccauguuggacaggauggucuccaucuccuggccucgcgauccaccugccucagccucccaaagugcugggauuacaggcgugagccacuacgccuggcuggaaacuuucauuuccuuaccaaguuugugguuccauuggguguuaccuuuaugauuauuaagaugugcauuauuacuauaaacuuugucuuaaauguguuauguuguauuucacaauaaaagagauuuuuuaaaagacagugagggccugaauaaggcaguaggaaauggaagaauggguauugucauaggccauucgggcugccguaacaaaauaccacaaaauggguagcucauaaacaacagaaacuuaauucucacuguucuggagguggggaaguccaagaucaaagugcuggcagauuuggugucugaugagggccuauauucucauucauaguuggcugccuuuucucuggaaccucacagggcggaaggggugagggaucucucugagggcacuaaucccauuucaugagggcacuaaucccauucacaagggcucugcuuuuauaaccuaaucaccucccaaaguccccaccuccucauacugucaccuuggggguuaggauuucaacauaugaauuugggaagugguucauaaacauucaguacacugaagaugugaagggugguaagcauuagaaucaccuggccacugauaggagcugggaagccagagucuaccaugguucccagguuuuuuaauuuguugacuaggaagauggcaugugcugagauggagaauauaguauccacaaugggcaaggcuuuuucugcugcagcuuuuuuuuccuuuuagguccauucuuauucuacaaagagguuauuuuuccugccuccuuccucagauagguacaaaucaguaccauuuccaccacaguccugccaagaaaacuacucaguuccccaucuuuauguauuuauuuccagaaaguucuuuuuaaacuguuauuuuagguucagggguacaugugcagguuuguuauauagguaaauugcauguugcagggguuugauauacagauuauuucaucacccacauaauaagcauaguacccaauagguaguuucucaguccucacccucuucccacccaccacccucaaguaggucccggugucuguuuuucccuucuuuguguucauaugugcuccauguuuagcucucacuuauaagugagaacaugcaguuuugauuuucuguuucugaaugagguugcuuaggaugauggccucuggcuccauccauguugcugcaaagaacgugaguucauucuuuuuuaguauuccacgguguauauguaccacauuuucuuuauccaguuuaccauugauggacauuuagguugauuccaugucuuugcuauugugaacagugcugcaaugcacauauguuugcaugugucuuuauguuagaaugauuuauauuccuuuggguauauacucaguaacgggacugcugggucaaaugguaauucuguuuuaaguucuuugagaaauccucaaacuguuuuccauaauggaagaacuauuuuacauuuucaucagcaguguguaaguuuucccuuuucuccacaaccucaccagcaucuguuauugacuuuuuaguaguagccauucugacugaugugaaauaguaucucacugugauuuugauuugcuuuucuuuaaugaucaguugugcuuagcauuuuuucauaugcuucuuggccacauguauguguacuuucaaaaaguaucuguucauguccuuugcccacuucuuaaugggguugauuauugcuuguaaauuuguuucaguuccuaauagaugcuagauauuagaccuuuguugaaugcauaguuugaaaauauuuuucccauaauguagguugucuguuuacucuguugauaguuucuuuugcuaugcagaagcucuuuaguuuaauuagguuccauuuauugauuuuuguuuucauugcaauugcuucguuaugaaaucuuuuccagguccuauguccagaaugguauuuccuagguuauuuuccaggguuuuuauaguuuuagguuuuauauuuaagucuuuaauccaucuugaguugauuuuuguguaugguauaaauaacgaagggguccaguuucaaucuaaugcacauggcuagccaguuaucccagcaccauuuaucgaauagggaguccauucaauaaaugaacaaauuucuucauugcucauuuuuguggauuuugucagucagaugguuguagaugugcagcauuauuucugcucucuaauagggcucucuauucuguuccauugaucugugugucuguuuugguaccaguaccaugcuguuuugguuaccauagucuuguaguauaguuugaaguuggguauugugaugccuccagcuucguucuuuuugcuuaggauugccuugacuauuugggcucuuuuuugguuucauaugaauuuuuaaauaguuuuuuuuucuaauucuguggaaaacgucauugguaguuugauaggaauagcacugaaucuguaaauugcuuugggcaguauggcccuuucaacaauauuguuuuuuccuauccaugagcauggaauguuuuucuauuuguuaugucaucucugauuucuuugugcaguguuuugugacuuucaucguagagauccuuuaccucccugguuagcuguauuccuaguauuguauucuuuuuguggcuauugugaauggaauugcauucuugauuuggcugucaccuuggauguuguugguguauaggaauacuacugauuuuuguacauugauuuuguauccugaaacuuugccaaaguugcuuaucagaucaaggagcuuuugggcagagacuggaauuuucuaggaauagaaucauaacaucugaaaacaggaauaguuugacuuccucucuuccuauuuggaugccuuuucuuuuuuuuugucugauugcuguguccaggacuuccaguaauauguugaauuggaguggugagagaaggcguucuuuucuugcuccaguuuucaaggggaaggcuuccagcuuugcucauucaguaugauguuggcuguggguuugucauagaugguucauauuauuuugaguuauguuccuucagugccuacuuucuugaggguuuuuaaccugaagagauguugaauuuuauggacagccuuuucugcauccauugagcuaaucaugugguuuuuguuuuuaguucuguuuaugugaugaacucacauuuauuuauuuguguauguugaaccaaucuugcaucccagggauaaagccugcuugaucaugguggaguagcuuuuugaugugcugcuggauucaguuugcuaguauuuuguugaggaccuuggcaucuauauuuuauuaaggauauuggccuuaaguuuuuuuguuguugugucucugccagguuuugguaucagaaugauucuggccucacagaaugaguuagggaggagucccuccuucucaauuuuuuggaauagagugguaccggcucuucuuuauacaucugguagaauucagcucugucaauuucugucaauugccuguguugaaauccaaugacuaccucaaacuauuucuaaucucuuuuacauuuuuacccaaccaauuuaauuucuuggauucccacauauuccuuuuuuuuuuuuuuuuuuuuuuuuuuuuuugagauggagucuugcucugucgccagacuggaguacaguggcgcgaucuuggcucacagaaaccucugcuucccagguucaagggauucuccugccucagccucccaaguagcugggacuacaggcaugcaccaccacacccagcuaauuuuuguauguuuaguagagacgugguuucaccguguuggccaggauggucucgaucucuugaucuugugaucugccugccucggccucacaaagcucugggauuacaagccacacauucuauucuuaccagcuugacaaauggaguaccuacugcucauuguucuucucauuggccauaccucccuaccaugcuucuauagguagaacaacaucaaaguaucauaugccucaaacucaacucagguguuuguaaccaagcuuagaauccccuucacuggcccauuucugacuaaaaaggaggucauuucaggcacucucugaaacaugaccuaaaaaaacccauguccacauuaaaaccacacuagauuuucuacuuuauagcaaauuucauuguaucaaauaugaauuuuauuugaaagggccuuugauuaacucgagccugaaaauccaaaguuguaucuuaacauugaaauuuguauguauaaguagacucuacauccugggaacuuuggguuguauugcuuauguguuuucucuuuguaugaaauagagugaauaaacuauugccuauuuagaaagaugauauggaggccuacucugacuagguagacaugugcuuuauguugcuuuucuagugcaagagcugcaguuucaugaugcaugcacauccuguugccuguuuuguuuuacuacaaauggcccacugggaauauucccuucaguuaagauguacugagcacccagcaugggccaacuagcaugauaggcagguuaguaguguguguguguguguguguguguguguguguguaaaauacaauauuauauauaauauacauauuauacuauauuuuauauauaucuuauauauacuagauauauaagauauauauaaaagaaauacaacguuugcccauuauacuaacugaagauacuugugaguuaggcucaucccaaacuguccaguauuugcuucucuuagaaaguccaaaagcuuuucauguaacuuggugggcuuucucccugacagaagcauuucacauaugccuacucucuagcaugucauuccugccacauaucucagccaugggcaucucacucucagcuagugcagccuaucuugauaccugcucagaacuugguauaaacaaaacucuauauacuucauguugcaugcagugagcuaaaggaagcuuugcuuacuuucacagauuacagguuuauuuuauaaucaugccaugaacacaagucagaguaaucugauucuuugcugcaguggcauuagagcacugauagcacacucuccuuuuucagggagaauguugugugucugguugacuggauaaacucuucagucuuauaggauuugaaagaacauaaaaggcaggcauuuauuuacuauaauaaaacaauagacuuugcaaugaauucuguaauaacugccuuuuaauccucacagucccccacacacacacacgagaacuuuauaccccccaaaaaaaaguuaaacgucacacuuacuuuauuuuauaucucugaaguuggucuucaaucaagcaaaaaaauaagggauaaagugaaaggaaauuugagaaaagauccugcaagaagcaagcugagacuagaauuucauaaaauccauuucuagcccugucagcugccugccucauuaccuuagacuuucauauaaucuuuuaagucuuuaguucaaucuuucuacucaguuauuuuucuucaguuucuuguaaccuucaaaaaugcuaacaauagaaaucacaggccaaccugaaguuaauccaguaccuuguaaccacagccuuuuaccacccuuaacugagcuguguguggguggcuugcaucccacgguugguacucugggcuuagagaguccuugcaugcuauguggguggcguucauccuguaguguuccuacggguuuagggagucccuuuccaguacccaaucagauauacauuguucuuuauaugcugggcugaaagauuccauacuuuuguuucuaggaauucaggaccauucaacuaagauaauacgguauaaugcagggaccaacaaucuuuuucuuuuugggcuaugcugucuguguugcagcuaugcggcucugccuuugugguggggaaguagccauagacaacauauauauaagugaaugcauguggcuguguuccaguaaacuguauuuacaaaaguggguggcaggccacauuuggcccucaggccguacuuugcugacuccugguaucuggacaagauugcuggguuucgagcugagguuucacauggggcuugagacccauauaaucacagaguggucucaaaugggucucauacuuuuguauguauuuguaaaguucacgguaauagcacuugccaugccuuccuuagaaaguuacaugggauaauuuaauuuuuaauuuuuguuaacauucuauagacuuaaaaaaauuuuuauuuaacacauuauacauauugauggagugcaauuugauacuuagguacauguguuugcuacauaaugauuaagguaguuagcauacccaucaccucacauauuuaucacuucucuguggugagaauauucaaaagcuucucuucuggcuauuuugccauauauaauaccuuacuguuaaccauagucacccuacugugcaauagaauaaagagcauaauuuagauaaauaagauguguucacuaugauauacuauguaaacauagccuuuuucccuaauaaguauuauuagcagcagcaagggcaauuuuucuagagggggagaggauuaggauucacuucuuuuauuuuuuuaauuuuuuuuuuuuuuggagacugagucucgcucugcccccaaacuggagugcaguggcgcggucucugcugacugcaacuuccaccuccuggguucaagcgauuguccugccucucaaguagcugagauuacaggccugugccacuacaccagcuauuuuuuuuuuuuuuuuuuuguauuuuuaguaaagauggaguuucaccauguuagccaggcuggucucaaacuccugaccucagguuaucagcccaccucgggcucccaaaguguugggauuacaggugugagucacugugcccggcccgguuaggauucuuucuuuauuugugguggggagagggugggggacggagucucgcucuugucgcccagguugaagugcaauggcaugaucucggcucacugcaaccuucuccucccagguucaagcaauucuccugccucagccuccugaguagcugggauuacaggcaccugccaccaugcccagcuaauuuuuuuuuuuuuuuuuuuuuuuuuuguauuuuuaguagagacacaguuucaccauguuggccaggcuggucucaaacuccugaccucaggugaucuacccgccucggccucucaaagugcugggauuacaggcaugagccaccgcgccuggcccaggagucacuucuaauuccucacagcuaucccagaaugucuuugaacacaggauuuagugacagaaccacaacaagccauaugagagccccacacugggcgguacacugcaccuggaaaugugcgugugaaugugauucuaaucugaaaccccagcaacagaucaccuagcaaagggaacaaaugugaaaggagccuuuuugccugcguguacagcuucaggaagaaugcagaggagaagaggaggaugcccccagggucugugauauuuuuauaucaacuccggcagucaaugaggugauggguauuauagguauuauagcugguuucccucccaucuaaguguucccaugugaaaauguucaacuugccaagauuugauacacucaagggacaucauauuaugacuuucccagccucugaaucuuuaacacuaaugaagcuagcaggcaaacaugucuaaaaggacaacuguggaagguaauuguaucuuagauagaaugguauauucuguauaacacagaccuucucauuggucuaguuauugucccugaaugcacacauggcauuuucuugaccccuuauuauuccacgacuuucccccucuaccugaaauaucuuucauacuuuccuucagcugucagaucuuauccauaaauacaccucaucccuucucugggaucuaaaauguucucauuuucuaaauuuuaauaucaguuugucuggaccaucauuuaaaaguuacaguuuacucauuuuauuauugucuuuucacaucuucucaaugagauucgaaauuugggagcaucaggacauuucuaguucaguucugcagcucucucagaaccucgcaugugguaggucguucaguacauauuuauugaguaaaaauauguuuaaguaaaaguaaauacaguuuuguuauaggagagcccuucuuaaucaaaaauaccggaauacaaaaaucuuguuugauagcuuuuacauguuaauggaggccucaucuguuuuaaccugaagccuugagacucuggaagaaauguacaguagcacaccauuauacagaauuuucaucauacggauauaacagaugcaaauaaccccaagagcauagagaccaggugcagugagucaccucuguaaucccagugcaaugggaggugguaggauugcuugagggcaggaguuugagaccagccugggcagcauagcaagaccuccauuucuacaaagaaauucaauuagcugggcaugguggcacaugccuauagucugagcuacuugggagguugaggugggaggauuguuugagcccaggaguuugagauuacagugagcugugauugugccauugugcuccagccuggugauagaucaagauccugucucuuaaauuaaaaaauaaaaaaagagcuuaaggaguaguaaaauauauaauaagauaacugggaagugaaacauuuugaguauuaccauuguuuuuaauaaauuuuauuuaauuguacguuuacauagguuuuaaugauggcuguguuuaauaacugacucgugaaaguccuaaaaauuuaaguccacgcuuaugagccaaaagagccagcuccagcacaucacuauucuuaucacaauuuauuauaguggcugauuucauuuucucucucuuucccuaaauaaugaacuuccugaaagaagcgauaacgucuguuugcucaccauuguaucucuaaugccuaacacguaguagguacucaaguauuagaugacugaaugaaucaauccaaucuucugcauucuuaccaaauuaauacaacuuaaaacaaaggaaaaaggucucuugucuaaaagucacauuucauuuucuuucuuuuggucagcuuuaacaauaugcuauaaacauucaucacuaagcacuucagcauaugaaauauuacuguuuucaauaucauccaaguaaguguaucugaguuauucauggccauaauguucacagaaacaacucucaauguaaauauguucaggaacuauuuuucaguagaaugucaauuucuuugagcugcguguguucuucuaaaccaacaaaacacugccaauuccugugauauguagauuauuugucuuuauaaaauugcagaaaauugaaaauuuuucucuggguacuguaucuuuuccacauuuuuagccuagagcuuuggcacugaccagaauguagaauuaggaauucuaguauuuuugcauuuuagggcauucuaaggagaaaagaauucucucccucuaguauaggcuaccauuucccaaaauauauuccuugggauccagcucugugggauguuaauaggugcuguaugaaaacugauucauuuccaaguagguuuggaaaaaauugguucaguauuaaauaaguuuguuuuuuguuuuuucuuuuuuuuuagugguagcacaucaccaaacaggauauaguauauaguauuucccaaaugauuuuuuuuccacgagaaugucacagggaccuaauauuccauuucucuuugggaaaugccguauuuauguaugaacagucuuauagaaucauacguucagacaugagagggcuuaaagguuaucuagguuacccccccacacacacacacacccaugucaaaauccauuuuauaucacuccaacagauggucauccggccucugcugaauacagaccuuagcaggaaacuucccauuccaaaagucauuccacuccaugacuggccuccuuuccuuuuuuaacaaagauuuuccuuauaauugaaccaaaaaucuguuucccuguaauuuacucauuccuucuaguuuugccaucuggaauauuggcaaaacaaguuugcuuucuuuucugcaagaugacuaucauguuuccuguucaccuucucuucuuuagauugacucuuccuagcuuauucaauucuuccucauaugaggaaguuucuagaauucucaacauccugguuacuuuccccuggaaaauguccagugucccucucaaaauaagauaacuagaauuaaacacagucagcugugaucugucaagcacacauguuuaacuuuuuauucaacaaauacuucuggagccacuguucuccuuugggcacuauucuggaggcuggggauacagcagacaagaaggcaggcaaagucggauauuucauggagcuucuagucuuguaguggaaaaaucaaguaaaccaggaaacacauaaauaagcaagauggucucuaguagucaaaaauguuacaaagaaaauaagaucagauaauaugauagaaaauauuugcagagaggugguauguuuuuuauuuuguuuauaaauagagacagggccuugcuauguuaccccagcuggucucgaacuccugagcucaacccgucuuccugucuuggccucccaaagugcugggacuacaggugugagccacuggcccugccaggguggcauguuuugaucagugauggggaaagcaucucagaaggugccauuugagcuguuccugaauaauacagaggagccagggagugaaugaagaucugugggcagcacauuacagccagagggaguggugcauggcaggcucuauggugaacaugagucuugucaaaagaaagagaggucauguggaaaguagagcaagagaagaggagagucacuucagcaauaucagagaggaaggcagcagccagcguauuuaaggcaucauagcuguguuaccauggcucagguaaguauaguuuguaagcauaguagguggccauuggaagauuuuaagcaggagagugucacaaacuucaacaguucauuccaguugauuugaucuucccacgagucaucauacuacauuauacugcuguuaguccagcccaggauuuuugguugucgccauuguuuuucuaagaaccuagucaaacuucucauacaaacuuauuuuuggcaaauuaaaauacccagaucuuuuaaaauuuucuuauaaucuugacaaaaccaguaauuuggaaucucagugaaaaacauuuguugcucuuaaauuuuauaauuuuguucucaagccuuauuagaauaauguugaauccugacuuugucguuaguaauacuaaagcagucucagcuuuuggguuuuaaguuuaauaaauaaauuuuuuauucaaaguuggcaauaaagucauuguauagagcauuuuuuuuuuuuuuugagacggagucuugcucugucacccaggcuggaaugcaguggugcaaucucugcucaccucaaccucugccucccggguucaagccauucuccugccucagccucccgaguagcugggauuacauauauaggucauuucuaaggacuauagucuguuacaaguaucccuuuaguugaaagaauccauuaagcgaccuuuucucaggauagcuuuucaaccaccugcuaauauuugacuacaugaauuuucauuuccucauauuuuuacugcaaggauagcccaugagauaauucaacacauauaggucucuuagucugcuaauccuguaggaaaagaaaagaaaauuagcauaauaucuaggugaauguauaauggcucuuaguuaacauuucuuugucuaaauauucauaacccaagggaugauugaaguuuaaucaauaguuucuaaaauccuuucccccgcuuuuaaaaaaauaagcauagcauuuuccugacuccuguccuugggguggagauuggggaacaaguaaaagcuuauagagucuuguuugauaaaaaacauuuuuuucuaagggaaaggaauagcaacauuugcugccacuuaaaauccauccuuaaaauucacacaaagcacauuuauugcuuacuuucacaaugaucuagggaccaaagaguaacaaaaaacaaaacaauaaauaaaugcacaaucgggcaucucugcugucaaguauuccuugaaggccuggcagaaucugacauggaguaaguuacuggaagccggauuuagucaauuaccugucuuuuugcuccuaauguucagaauccaguaaauggcuguagccuaagguagagaaguaccaguuaagugcauuuugacugugguuuaagcaaucgaggucgucuccagcuucuuuggaacaaugccauucuuuagcaugacauggaggguaacuaugugcuuauucacuagauggaauaccugcuucauguaguuggcugggcucuguuaccaucuguuucuuucuuuguuucuuucuguuugucugucccucgcccucucuuucucucucccucucuuucugucucucucucucucucucuuuaacacacacacacacacacacacacacacacacacacacacacacacacacacaacuuuuuagagucauggagagagggucucauuauguugcccaggcuggucuugaacuuguaggcucaagcaauccucccaccucaacuucuugaguagcugagacuacaggcaugcaccacugcaccugguuucaauauucguauugucaguaucucaucaguuuuugacuaucgccaccucuaucuauuuuauagggaaagaaaaucuuucuuugcccuaauaucuaaguagcuuaggcacaccugagaacugggaaaccauucccaaccauugccaguggggagacguccugcuucagugugauacaguuagccaguguuuauugagcccuuccccaugcucauguuuguauucaucucugaggaaugucucuauagugauccuauucuagagacauuuccccccucuucuggacagauuaaacccgagaagaacuugcugguuccuguaagccgagcagccuguuugugcugugcccucauucuaggugcauucuuuggcuggcauauuugugggcacagaguauucacgaacaagguuucagcaguuuauagucccuagggggcggggugagucaaaaacauugacuguuuccauuugcccucuggaggcaguguuuaaccuccaaguggauguggugcccagaggaaacaaccucaaccaggaacuggcaggcaccugccucaucagggcaucagugugcacagggagagagggagugugucaaaagguccagcccauuuggcuguggggagaggccuuauaauaacacaucaguagcaucacuuuacacaugccucugcagacacgagcuguccagcucccuguuccucagggugaggcugggguagagcugggaaugacggacucuggggacugauggagggccauaccuucgagaccaaggaugguguucucuugcacaugcuugccaccucuuauugguccuccgauuccuagggaauuuucuuuagcauucuucucaacugggcucaguuguugaaagagcacacacacacacacacacacacacacacacacacacacacauacauuuuaauccugugcuucacaugcugugaagcuaaagaagagugcaagaggaaggcagcuuacaucagaucugacagucuuacugaucguugcugauaaaaacuggcaaagggaaaaguaaucggagccucgggaauucaauucacuccuuuaauccacucagcagauauuuuauuuuuaaaacacaagcacagccaucagcaaaauugagaggcugugugggaccccaaggcacuuuaaacuuuugagcccuccuaacucccacuccagcccuaccuucaaauagucccucuuagccauuucaucugcuuggguguauccuccucaccaucccuuuuccuuauucccuagaagccaauaaaaaaaaaaacuugccuguuggcauuaauuaaaaaaaggaagacacuuuaugaucuagaucaucagcuagagacuugugcaguauaucaucccuacuuuuuaugauucucauauugucuucaugucuuucucauuugcagcaaguagaugacacagugcugcccucuagcugauuauuggauuauaauggcuucucuauuccuaaggcuauauauauaucuaaauauauauauaucuaaauauaucuaaauauaucuaaauauaucuaaauauauauaaauauauauauaaauauauauaaauauauauauauaaauauauauauauauaaauauauauauaaauauauauauuuuuuuuaucagcaaagagaaguggacaguuguuuuucauguacggcuuaccccagacaaucaguagagcaccucugcugcuuuauacucucucaguccuccugaaccaaccuuccuggaauaaucuacuaaucuaaaccagaaaacgaacuuaguuccacagcagauuucaacuguaccucuauauuacagcagguacccugucagauuucuucuaucgagaaaugaaaagauguacacacgcccaugucuguaugucuuccauuuaucaggcagggagaauugauuaucucaauucuaaagauaucagcacauuuggagauauguggcuuuuauucuaggacccugggauucacauuuuagccuauaaccuucaaaucuccacauucauuuuucuccacccuaagugccuguguagugauguaauagcacuguuaaccauaauagaaugaucaaugauuuugaaaaacauaguguguaccuuucucuuugggaggaggguaaaagcaacuacugauaagaaaguaagccuuagccagcuccccacgauccaucugccagucaaagcaguuaaucuuauauaccccuucccacucaagaaaguuagugaacaguuauuacauggcugcaauaauuaucuguaagcguuauaucuacagauguagacugcaucugucuacagagaaggcgcugauuuuaagccugcuuuggcaccuaguuuuaagccuuuggcuuuaucaaccauguacguagguugucacccauauaaauagguccuaucccucaccauccugagccuugauuuucuuaccugucauuugagauaguuaccucacagaauugccaggaagguuaaaagaucuggaacacguaaaaguacuuuaucaaacccuacaugcuuauuaauuguaagaaacugcccugugucauuaaaagagcaugggcuuuggaaugagacacaggaacagauuccagaccugcuucucacuagcuauguggccuuucacaggaagccuaacuuccucgagccuuagcuauaaaacggaaguaauaccaaucuacagcaccuauaugggaauucaaucaguaauguguuuaaaagaaggucagugcuacauagauuuagguuauuggugccauuguaagugggaaaauaauaugugugaugcuuuagugaguugugagagagcauccaaaugccuaagcaccuggagcacacugccugggccugaucccugacacugccauuuacuaacauuguggugucacauuuuuuguaauugccuguuuacuucucucacucacaagucugaauuccuugaguauggagagauugucuucucacugugugugcagcuccuaguggaguauccaacauguaguagagagagaaaauguguugaaugaauaaaugugugauuuuuaucaucuuccauacauuuuauacuaugguaccucuuagauaucauuuacauuuauaauaauaacuaugaauuggaauggguagggcaguggccaauuaauguagcucauaggagauccagaugcuucauucugcaucucuaggcuucuugaugccucuugggcccuacuugauagguucuuaucuaaagccauaaaugcaauagagaaacagaacacuuuaaaaaauauuaccuccacuaaaggccggguguguuagcucagcacuuugggaggccaaggcaggcggaucacgaggucaggagaucgagaccauccuggcuaacacggugaaaccccgucucuacuaaaaauacaaaaaaauuaggccugguggcacaugccuguagucccagcuacuugggagucugaggcaggagaaucgcucgaacccgggaggcagagguugcagugagccgagaucacgccacugcacuccagccugggcaacagagagagacuccgucuuuauauauauauauauguguauauauauauguauauauauauacacauacacguauauauauauauauauauauauauauauauauauauauauauauauauauauuuuaccucuacuuaaccucccuggaugauugucuuagugucacauauauauauauauauauauauauauauacacguauauauauauauauauauacacguauauauauauauauauauacacguauauauauauauauauauauauauauauauauauauauauuuuaccucuacuuaaccucccuggaugauugucuuagugucacaggauccuucgggugucacuucaccagccagaacccucuguggcuggcggcgccucugcuugaguuucacucaugcccguugggcuuguucuguccccugggcugccaggcugugcugcucggcucaugcuacagacccagacccaugcccacugagggcaagccaggcauggagcagcgaggggugugugcgccacuaagcaugggguccagccagugcacacagccagacaccccagcugcugcggcagggcaggcagcuccaggcuccgugcaagccuacagcuggacuaggcauaccacaagcagcuucucuugugggugccagcaucuggaugaggggaauguggugacaucugaaaacucggagaugccagcaaccacagagccccaagggguggguguggaggcgcucugcagcucucucauuuccaccacccacagcucggcggaucgggcguggggggaggcaugucuuugccucauucagucccaccgccucacucuggcguacagcucccaggcugcccuggccccauugcugcuucccgucacaugggguagccgcccaacaccagcggagggcaggagggcuauagugcuacagcucuggcuuggggaauccugaggucugggcccacagaagcgucaccaguguucacugccacagucugaugaacaggagcaugucaucguccgcagcucaaggagcuggccaggaaaguguuacagcccuuuucgcacccaccauucgguguguucugaauucuuguccagcauccaggaagaaugaguuuccacaaacaacuggaggguaagcaaggcagggaagaguuuuauugagccacagaacagcucucagcagagaggagacccaaaguggguagcuacuaccugcagacgggcagucguaccaugugguugagucuggggguuuuuauggacucaaaaauggaggaagugugugcugauugguucaugguugggaggaagugugugcugauugguccauggguggaccuggaaaaagcaccacuugacugacccaaaggcauuaaggaaguucucacuguggguaguggauucucccggagacugacagccugguuuucaggcuuccugcuguauuuggcuugaaggucagguaucaccagggaccugccucuucuugccuaggaauuugccuccugcugcuaucauuaauaaccuacgacuaaacagacauaauuuuauuggaaacuucuugaggauggagaccugguaugcgcaggugcucaucaaauguugauucggaaaugggaugguguucuguucaguucacaaacaucagagucuuccuguacuuuuaccccauggcgguuaauccaaaaccuauagaauuaaauuauuuucaaauuagucaaaucaauguuacagucuuagguaccucuaugcuucaucuguucugaacagcaaguggcaucuuguugcagcuugcuauccagucccaagaugcauuucaaauuccaggcgccuguucugugacagccuuccacccuggcaggucucuuuguugccaucuuuuguagcauccucuggguauuugacucuucuccccugccucaaaacuuugcagaaccccacccaguggcaccaauuuguucuucaaaaaccuuauucuacuugucucguuguuucucuuuucgguugaguuaaaucuacaaccacugcuugugcaucuucauuuuuccaagcagccauuagaggcaaauggcaccacagcuccugcuacauuucaagcuuaugucccagagguggcaagacagaacaucaaucuucagugccaccuggcucucugauaagcuuuuguuucauguguggcuauguugucaggagcuucacgcccucucuucccacuaccucacccagagagcuuuucugaauaugacaaccaucuaaagacgaauuaucuccuugcaaaguuaauuucuguuucucagcagggagccacugguucccgcugggcuugaaaguacugcuguuuguuaauggaugagugucucuuggauccugguacccacacuggaacugcugcagcgccuggcuuuccauuugcuuuaauuuccuacuugcagcugguguuaggagaccuaaauggguuuauucacggaauagugguuuacagucauuagcacugggaggaaaucauauugaagacaaggacuagagagcugcuuucaugccauccuugaacacuuaggacaguuugguugguugguugauugguuuuggcuuuuuuagagagcaaauucacaaaauccuucuagagauagaacaaaaggccuaacauaaaagguuuauuucugacuuuuaagaguuagaaaaaaacaguauuuuuuuaaugucuucaauguacagaauggugaagauaaaauaagaugcugguugaaaauugcucugagcacuuuuaaguguaauagucgauguugcuauuguuugguaugcccaagcucuuuaaagugcaggaaauuucguuacaaagauuugugcugucuucuauaaagcagagccagcuguagacuagaaaacuccaacccguagaacaucuggaauguuuguuucuauucauuaugaaauugccacuuuuguaggucaaacaaggucaaauguuggcaauuuccuacuauucaaccuaugcaguuuuguuuuuagauagaauucugaaggccaagagagcaccauagguauguuuccugccucugaaaaaaauccaaagccuguaggccaaugccuguuuguccuugagaggagcccaauucuaagcuguuaacugugugaaucugaaaugugccucagaauugcuaugcuaggagaacaucuggucacacagacuggcuaaugucggacagcucgcucucccuuucuccgccucguuuuccacagcauuucuacauauuacacugucaagcuaacagagcaugagagaacaucaaacuaaaaguucugagcaagaaaguacaagugcaagcaauuccucaugccuaaaaagugccacugacaaugaaaaacuuuacuacuggugacuccagagauggcagugugugaaagugaagaaaggacuauggaaaagaaaaagaaaucuuuccccccuuacagcugcuuugugacuuugggcaaauauuuucauaucuacuaguuuuuauuuauuuuagagaaauguuguugaauugaagagaaucaaauagcuaaauaucccguauagagccaacacacacaaaacugcuuaauagauguuacuucuuuuuccucuuuacuuuguuuucaaacaugggauuuaaaugcuuuaauuuaaaccuaugaacuaauaauaauauuacccuuugcaaagcccucuaaaacuuuaaaagcaauuccacauacaugcaugaugucaugaucuaccuaaauccauuaauauguaugaucucaacauguauguguuuauuucucuauguaugacuagaaauaauccaagcacuuaagccaaacacagcugcuuccuuuccccucacauucugagagaauucuugcuuuuacuuuguuacccuucacuuuucuuuauuaagaaugcccuuggacccauccaaagauauccaaauacuacugacucagcugccaccuccuuaacaaaacaaccucaucagcugaaaguaacuaagcaguccucaagucaaaaagggaagagaggcaugugaagagaagauuccuucaaugcugaccugugcuuucacagucagcacuaagucauagaagagaaccccaaaggguuuucaggaaaugagaagcuacaauaggcccagaaacaaugguucuuaaauuugggugcaugagaauugccuguggaccuuguuuaaaaauggaaaaacuaccuauuagguacuaugcuaguuaccuggguggcaaaauaaucuguacaccaaaccccugugacaugcaauuuaucuacaugacaaaccugcacaugugccccugaaccuagaauaaacguuuaagaaauaaauacaauuuaaaaacagaaacaaaaacggaaacuccugggcaccaccccacagauucugauucucugcaucuggagaggggaucaggaauccacuguuuuuuuguuuuguuuuguuuuguuuuuuugugacagagucucccucuuucauccaggcuggagugcaguggcgugaucucggcucacugcaaccucugccuucuggguuaagugauucuccugccucagccucccaaguagcugggguuacaggagcccgccaccaugccuggcuaauuuuuguauuuuuaguagagaugggguuucaccaugcuggccaggcuggucucgaacuccugaacucaagugauucaccugucugggccucccagaaugcugggauuauaggcgugagccaccucgucuggcaaggaauccccaauuuuaacaagcacccagggugauucuguugaagguguuuccuggaccugcuuugagaaacacugguuuagaggacagguaccuuucauaucaagguaaggcaugauacagaagguaaaguugggaaugucaaagggaugcuuucaguuucaugugagaucaagcugauuuuucucugaugauuacacauaaaagucaugagacaaccuacuuggucagcaguugcuguguaccuagcuuugggagcauucccauaaagccguaagauuuauaucagcacuggcucauaugguucaugucuuuaguuuucuuucuuuuuuuuuuuuuuuaauuuuaugugcuucauuaaaaagagcuuuauucuaggucgggcguggugguucacgccuguaauucuagcacuuugggaggcugaggcagguggaucacaccaggaguucaagacuagccuggccaacauggugaaaucccaucucuacuaaaaauacaaaaaaauuagccaaggugguggcgcaugccucccagcuacucagaaggcugaggcaggagaaucgcuugaacccaggaggcagagguugcagugagcugagaucacaccguugcacuccagccucagcuacagagcaagacuucgucucagggggcggggaaaaaaaaagagccucauucccagaggcuucauuaauuaaggcauuuauuuugggguuugauugauugauugacugacuaaaguacuaguuacaacagaaaggauggccuuuaguuaaacaaaaucauugcuuuccugcuaugaaacugauggcuguugcuaagguuuuuaggaugucuacaagaagucaaauuugcucuuuaagcuauagauacauauauacuauauacauauacaugcauacauacauauuucuuuuuaaaaacugagguaguuauuauguagggaaagcauuuuucuaaaauuuuuuuguuauguuuacauuuggcaaugugacagauuuaugucaacagugagaaauuauaccagagcaaauauaugugaguaaaacuauuugaaaauuaacaucuaaaguauaguuaucagugugagaaucucugaguugucacacagauccauuaaucagaauuauuaggguucauauguaaguguacuauuuguuuucauggguaaaagcuauaaugauaacuauaaaauaauaauaaacauugcugaaguuauaauaucuuuggguaauuaaauauauucuuuaucaaugaauauugaacauacaggugccaucauggggagaucugcacaauuuuuuucuuuaaaaagaaaucaguggagcauaauagaaaaucaaaaccagaccaaccucuggcuaucaacacugccauugcagggcuaugggggaaggguaguccuuccauacuggugcuggaucaccuagauauccaaaugaauuuuaaaaauuuggaaagauaaaauaggagaauaucuuuaugacuugcaauuaggcaaagauacaauggaauauuauaacaaugaaaaauaauacacucugacuaaaugccacaauguggaaaaaucuccuagauguaauaauaaaccaaaaaacaucgagacacaguaaccauauacugugguauuucauuauauaaaguucaaaaacaggucaaaggaaucacagggauagaagucagagcagggauuaccuuuggacagggauagugacuggcagaguccagcaagagaggcuucuggagugcuggcaguguucucuaucuugauuuagguggugguuauaugggugauuucacuuuguaaaaguuuauugugcucuguacuuacaauuuaugcacuuugcacuuuucuguuuauauauuuucuuucacuuaaacauauugccaagaaaaucaaggcuguauuagaggaugcuaucuaguuuggaauggcuuucuugcuuagaaaaacuuccugcuuugcagcucugcacuggugacugacaguugugacauucagcaguucuauuacaaucuacugaccaaauagagcuuugagcaaacagauuucacaaaaggcaguggguggccauugaguuguuuguuuucugcuuguaucugcuuagggugguauuagcagcaguaauagguauaucuucugauguugauucuggaauuuguuauuuguugacuuauucucaucaucaucaucaguucuucuuuuguugauugcugaccaugucucugcuguaaucucugauggcuaauuugcauaaauaaccgugcuaaaauaaaauaguacagagcuuuguguguccacuguaguuuuugucuacagguucugaaacuugauuugacuaggcccacuuguuuguauguggaaauugauguuaaugaaugucuggauagcauuuuacuuaaugccuuuguguguaucauguguacaacaacucugugagauagguuauuucuucuauuugguagagaggaaaauuauaugacuuaguuaauauagcacagcuagcaagugguagcccaggaucuaauauccagaucuugacuaacucugauuuuguguucuucucacucuacuacaccuccucuuuuggaucaggaaggcuuucagggagucucauuaauuuacaaaaagcugguagaaauuauuagauguuuucacuagcccucaaacuuuuccuauaucuguuaguauuuaauaacuuacaaauuaucauuccauggcauauugguaagcaguaaauugccaaauccuuuccuucugacuuuuacgacauuuacauucaaauuagggaaagcagggagauuuggugacuauagauaauuauggaacaagaguuagaucuucugucacuaaaacuuuggauuuugugaguauaugugccagaaagggaaacaagcauugucaugugcgguucaucuggauuuagcagucuuuaaugguaagaagugaaaaaaugcaguagugaggccagauaucagauuccucagagcaggagucugagggcugaaacuccaggcauggacaccuuuguccccaugagcccugauaacacuugauaaauuucaugggauagggauguuaucuuaacuaauuuuauuugcccaaucagauuuaaggugguuucuaagauuuuuaguuuuacugauuuucuuacuuacuaaacuaccuguuaggaauugggauuuuauuuaggaaauccuugucugaaaaaugaaaagugaaggauuauuauacauguaauuuaaaagauauuuacuguuuuauauuacuuuuuucuuuuucuuauauaaauuucaugggacagggauguuaucuuucucuaauuuuaucagauuuaagguggauucuaagauuuuuauuuuacugauuuucauuuccuuaaaaaaaaccacuguguaucaguagaaaugaagaauaagaaauucauuggcagugcauugaaacaaacagaugaauacauaaauauaguuuguuuauaaugaaaaccuccaggguccucucaaguauuuuaccuagaaaugacauauaaauucagcguaugccaacaguucuuuuaaaucaugguaauauucugaacauacaauuauacuacauuauuuucccaucucuagaauuuuugugguuauuuuuauuuauuccuccguagaaacacuuguaucuuaguugcucuuuuaagauaucucuacuaaugaucaguuguguuagucuguucucacacugcuauaaaggacuaccuaagucuagauaauuugugaagaaaugagguuuaauugacucacaguuccauaggcuguacaggaagcaugucugggaggccucaggaaacuuacaaccaugacagaaggcgaaggggaagcaggcacaucuuaccauugcagagcaggagagagagagcaaagagggaagugcuaccacuuuuaaacaaccagaucuugugagaacucacuaacuaucacgagaacaucaagggggaaauccaccugcaugauccaaucaccucucaccaagccccucuuccaacacugaagaucguaauucaauaugaaauuugaguagggacacagagccaaaucauaucaucaaucauugugaacuuggagacaucuguuuugcuaugcauauuuucuuaauaaagauuauagucauuuaucaauauuuucucagagaaauuaccuucuuucaacuaauauuuaugaagggggacauauaauaacucugggacugacagcuaacauuuaugaugggaaacuauuaauaacuaacaauuacuaauaguaggcacauuacuauugaguaacaugcuuuucauauauauauaaucucauuuaaucuuugcaacaauacuauacuacaaauacuuuaaauaugagauuaagggaaaucgagcgacuucucaagucacagaaugagucacugacagguggaggugcaucccagcucuucugucccuacuacacacugcauggcucagcuacuuggcuuacucgguaccagacauugacuagaugcucaggaugcccugggccuugugugucucaaggccuaguugguaugagauguuugggggcagggaacuaaggaauaggggcacaggugugcucuucacuacagcuguggaauaugggggagguagcaagagauaauguagcuagagaggcucuacuggugaggcugcuguccuguuuuggauaagggguagcuagucauuguaggcugggcaaugggauugguuaauuugaggcauugccacuuucuucuuccacuaaaucucagcucuaacaaguaccuuuuaauuuauuuaucuacuuuccuucuuccaaaguaaacucauuuugauucaucgcuggauccaagagccuaugugcucuaaagcuuugaguuuugaaaaaaagugccagcuuuacugagauaauaaaaauaaaaauuacuuauauauaagguguacaaugugccaacuugaucuaugcauccauugugaagugaugcugacaaucaagcuaacuaacacaucccauuuaaaaccuuauuuggagagcuuuauaagaguugugcagcuuucucuccugaagagagaaaugcgcaugcccucucuccugaaauggauucuguccaucgucgucuuugcugagaggaucacuugcaagucccuucaggagauuugaaaacuuuuggcucugcugugcccugugaucucuccacucaugccagucaaacucaaccacuggagccuguauggaaacuagugcuccucaguccaggcauucccaggccaaggaucuacuaugaguaaaugagccagugggcucugcagccagauugucaggguucaagcccuggcccucccauucacuagcuguauggcauuaggcacauuauuuaucuucccugugccucaguuuucucuuuugcaaaauggcaguaauaguaccuucuucacaggauuguugcaaggauuaaauaaauuaguauguaaauuuguaacuugcauauuacuaugaacacuuuuaaacacaguagucaguacucaguaaauguucaaguuuguucucauuaccauuauggcaucaauccuuacgaaguguauaaaaccucuuaccccuucccauugagggcagucucagcuuccucucucaaacaccuggcugguggauuuuuaggggggcauuucuuggagcaaaggaagcuguuaauccuuuccuggggaaccauucuuuucaagugagggcagagaaggagaaaaauaccuuugggguguuucucuccccacccccaaccccguccaguuuccugcagcaguuagaacagaaauuagucucucagaagauuauccugccacauugacuuaaaugugaugcauaguaugaccuguaggauaacaguggaaaacccuaaucaguuacuuaaaccugccacagacuaauuuuuagaagucucagaggugggugugcauauuaaaagagaccagguccuuucuguagaacccugagcaaauguguauugauuaacuuaauuaaaggaagauuaugacuugugcacugcacuguguguuaucuuacuguaugguuuaagggaucuuuaaagcauaugugcuaauggccuucucuuuuaaaccagcgugaaucugagguuauuucauuaaugugguaagcaaaugauugccaagaacacagaagguaaaaagcauuuucuucuguaaauaaauuauaauacuuuaagcuguuuuuuaguaauaguuuuauauggaguuugguucaaagagauccuuuuuauuuuucaaauauuaacgaaaggaguucuuuaccuuuuauuuauucuucucaucuuaccucuuggcuugagcuagggucauagaaccaugaagauuuggcugggccauuuauuugcaaaaccuccaaugucaguauguuuaggucuuuugucuuagaccagacuccacagagaaugauucucuaaucugccuucuggagauugaaggucuggcugucaauaugcaggaaaccaaaugagaagaggguagaagagaggugggaauuuuuggcauccaguauaugugaauucacuuaauauuucuguuuucuuccacccuugaucguucaugcaaucugccaguccagagacccucuauuuuauuccuuccagaaaauaagccuucagguuuuugcuagggugaagagacaguuguccagugagggccugagggaucuagagaucugacuacuucuuaaauagacuuucaaguaauucuuuuaugaaccacucccucccuuuugcccccacguccagauguaccuggggcugucgggaauucaaaauagagauuagguuguuucucagccuucccuccuauucacacaggauuccauuuucuugagucuauuagaggaacugaccucucuaaucugacuuccagcuuccaaaauuacauugcuuuuguuuucucccuucuguucuccuuacccuuguagguugaugucuugggaaaaaauaaucucuuuaucaucauuucaaugggguuucaagagggagggagaauaaauguguauuuuguaucugcuuucuuuaccuagaaguaaauucuccccucgauaacaucucuccuuccugcucccugugcccugacuuaaaagacccugcccugccucucccagcaggcaccuggaggaauauggaacacccgcccccgcccuucuuuucuucauaugcaugcacugcacguccagccuuucuaguuacccucccugaaggcccaacugagaguguaacuugucuagaaagccauucuagagcacucagggucaugaugaacggcacucauauauaccuccugugggcagcugaauuccuguguaugcaucuuuucuguccucuucaagaagacucaaacuagaucaaccagauugcauuugcucucaugccaaugccuugccugauaauucuugaaauacauugcaacgugguauaauagaaagagcaggccuugggguaggaccagccugggggcagcucugggcuccuccacuuacuaguuguguucucuugggcaaagaacuuagccuuucuguagcucccugucuucaucuguaaaaugaggcaugugaggacuaaaugagaugaagucuugucccugcuuagcauaaucccuggcauggaggagguauuuaauaaaaauuagucuccugcccuuucuauccacacaucuccauagcauagugcauuccuuguaguaggugcucaagaaauauucacuaaaugauuguucuggaaaaagaauuugguagaaguucuucauuagacuuacucuauuuguauccagcuguaccacaucaacuauggcaggaaaguagaaucccuucucuaaacuggaaucauguggcaggaaguucuuaucacuuaaggggcacgagggaacagaaacacaguguucaauaaaacugaaagggccucagucucaguguuggcuucaccaaagccaaccugaggcuuucagcugugccuucucuuuccaauuauaagugaguacuguguuagcuaacucccaguucaauccacagcuugccacuugggaucuggaagcuagcugauuuuuugauccaaggugcucugcuagguaggguugccaguuguaauuauauguucaaaugucaauuagcagaacauccuauuauuuggcaguuuggaguaaugagauggaucuugcgcuaaucuuucaauucagcaaguguuugauaaguacuuuauaaguaaaauucuauacugugcuauaucuagugaagguugcaggaagagcuggagguaaaagauuguuaagugugcaucccuuuaugagcucaugaauuuucaaauaucuuaagcaauaaagaaaaaggcagcagguuuuccauuaaaaacauuuuuuucucacacacaucucccuaccuccauuuguacucaagugacaaaaauuuuuaaaauaguuaccucauggaacagauaucauggaaauccauuuaguggaaaauucuuccugaguaugauuuuacuagacuccgugcuugauucuggggaaaacuugagugagacagaugguugcccuccaaagauuucuaguugccuuugauauuugacuuuuucuucucuaccagagcugucugugcaaauuuuucucagugcuacauccagcuuuuugcauaauugguuuucauuaaacucuugaguuguauuuucuuuuuacacaguugauuauuguggcucaucuaaagagggucauuuuaugaaaugucuguacuccuucuugaccucuguuuccugugaguacaaaucucaguagaacagagaaagaagacacaagaccucgcuuagagaguugaggguagguggcaagguuguuuuguuuaccacucauggccuauagccugguagagaacacagacucagcccuucucuagacuugccuucucaaacucuuucacacuugaccucuuucgccauucuucaaguuagaguggguauucgguuuuucauaagcucugucauuuuuguuuucccucuuucugcauuuauuuccuagccaugguaaauuugggauguugugaagaucaagucucaguucacucuccauccacuuacuugagaauagagguacucgguagucguacucacauucgcugugcuccagggagcuaguugucaaauuuucugaaauuuugugagcugguuguuaaauacagccauuauuaaaaagcaaauucuguaauaugacaaagguaauaaauaccaagacucaucacuucuuaauuauuuuuuaacauuucaggauuaucuauguucuucaggguaucugcaugcaucuauuguugcugauagcagaguuauuauaccuuauuacuguuuguguugcuuuucaucucuucccaacucugaguucagcaacauuuuuaaguucagugacaucucggugguagcuugaaaccagccacacaaccaaaaaaaucaccacaaaaaccaccaaacaccacaaaccaggaccccuccauuucccuggagagcugcuugucaaaacauuuaccagcacaccgcuagucaugcucuucuucuguuccugccagucaugagugauugugagccacaccaauuaccauucaucuuaaagauggcaaaagucuuccuccaaggugguuacaccaaccuuacacguuuuccccccacagccuuaugaacacccagcccagauuuuuacucuggauccaugguuacuccuaggcugccucucccuccaucuuucucauccccaaugauucagucauuaauuucucucuuucucccucuguuuccacuucccauccucuucuccuuccuccugcuucacauucuuccucuaccagugguuaagagcaagggcucuggagacagacugacuggcuuugaaucugggcuucaugaucuacugguuauguuaccuugggguuguuacugaacuuuuugugccucaguuuuauuaucuguaaaguggagauaauaacaguauccaccuagcauaguuaugaggaccaaaugaguuaauaauuuuaaaagcaccuacaauaauggguggcuuauaguaagcaauauguacauauuuacuuaauaaaauaaacacuuauauuugucauccagcccuuccuuaugugcuaauguucaaggccagaaggagaacagcaacagaacacaugagaauaaaagaagaggcaaaauggccugggguuguaucacagcaauggugugacaguucucgggaacuaggaaaagagucaaugaaaggaacuggaggaaagguggggaucaggaagggagacaaauaagaagaaaauuacauuucaaaauaaucugcaaagauuaaaauauauauaauauuagcuuuuaguauuuuauuucaaauauaaaccccaggaaaauaaagggauauuuuuuauaaaugcauagaaaguucccauuuugauguuagcaguuaauucaauuuuggucuucauccaaggcagaaaugugguagccacauauuuaagguacuuaggcuaaaucaacuguguauugaacaagagccauggggacagagugagagauguguguccauaucuaucaaaaacgcaagccgggagcugaaguacucauuugucugaccaucuggaaaucucuaguggucuaggcacuuaauuuuacccucauugcuagaacaaaagggaaacaauaaaagaagaaaaugggcagcagggacauuuuacuuuucauuuaaaaaaaaucuuagugauaaaaggagcagagaguuuaaaagaaaaaaaugagaaaccauuaaaaugauuugaaugcucugucuauauuuugcggugagcucuauuguuuucaguuacaugggaacugugguaauuuuaugaaucauuagaauguguuuccaaauuauaacugcauguucuuaaaaucccuccuaaguaacccacaguaagaggcuguugaacaauuucauuuaacacuuuuggaucucauauuaauuuuauauuuuaagaaaugcauacuuaauagccuaaagauaaaaucaugauaaccgagucuuuguauguuuucuuuccucugcuuuuuaaaacauaugacccuaucucuguucuccuccgcagucuagugacagacuugagaaaauagaaagccugguuugguagaaugacuuuucaguuaaaagcaaaagcucaguugggcacaguggcucacgccuaugaucccagcauuuuggagggcccagguaugaggauuauuugaggcaggaguuugagaucagccugggcaacauagugagaccccaucucuacaaaaaaauuuagccaguugugguggugugcaccugauuguacuacugcacucuggccuagguggcagagucagacccugucucuaaaaguaaauaaauacaaauaaaagcaaaaguuccucugccucaccccaaguugaaaacaaucacaacggucaaacguuguuuuucggcauaugucucaucaggcauagucaucugugaaauguguacucuguuaaugauaccucacaccucccuccuagaggaugguucacaaaagccuguucacuuaccuggggcagccaguccagcaugugauccucagaaaauggggaaagugacgucaaaguaguggguaguguggaugugugugaggcaggguaagugugaagauguuaaguuuauuuucuuagaagaggcuguccuuuuugcugauguuauuuuccuccuguuuuugguguuaaaacgucgccauuauuuuaugaaaacagugguaauauagauaaucucccuuugcuuuguuuuguuuuaaacauucuaacuugauaaaaugaaaaauuggagcuauauucguccauauuuuuuuccugguuggugaaaucugaaaguuugaaaacuaucguacauucuaaguguugguugucuccuucccaggguguagguguuuccugugugaagagauugucucaaagggaaacuuagcaaagcuuugauauucugauuuuuaaccacuaacuguucuuggacuugggagaaaagcugcuucccugggcaguacaugggugguacuguuacuguuccuuucauauaaacuugggcaggaugccacugaguuuaguuaaucagaaugcauucuagugauuuccaguaucauauuggccuaucucuugacaaauuaugugcuuugauaacuaaaaucuaggaaauaugacucaucuccuaaacucagggagacaguuauguuaaagccuaagguuacuuuauggugggaaggcuggagauaucaccaugguucauaaagaauaucauaacccuugcaaaugaagaaaaggagagcaacuuguucaauaucucaaagucaauguuaaaauuauguuuggagcccaggucuccuguuggcuagcuauuugauuuuugcccaguggugcauuuuguuuugcucugcauggaaaagucauauaaagcaguuaaauuuauuuuuggaaugagcuagaaugcuggguucgcaacaaccaguuuuguuaaaaacaagaacugcuuugaaaguucauuaguucuucucaaguguuauugucccucccaguaggaggcauauccaaguugaaucuccacuccugaacaaauuuucccuuguguguguacacuggcacacuugcuugcacacucucucccucaaacaguuccauauguucuauuuuacuggaagccaagcucccugccauucucccccuuagagggcuccagaucucaccucugaggugcacgcguaacugaggcugaaacaauuuguagggaaacuugucagcaaaauugauuauuauguggugugaaccaccaaagacaggugagccugcacauagcggaacaaauguauauguaguaugcaucucccacugcaucuaaccagacuuccuccucugacauguugauugauacauuuguaucucuuuccuaaugaaucaugccccauuguggguuauuggagccuccugcugaauagaccucaccuuugcuagcaaaaggaauaguaaagguucuccucugugaauuuugggggcuguuuauuggcucuaaaggaguggcugaggacauguaaucuuuaaaaggacaaaauaaucacauaaaaugucuaaauaacauugcuacaucaagaggagcuucuguaacuacagaugcuuugcgacaugacaaacuaguugguguggaaugcgaaucugagauacaugaagaaaugaaagcauuucagaccaccucugguggcagcuugauauucuggaguucuuugaaaacuuuuuucuaguguuauacuuguuccuugaaauggcuuuaagugugagacuugugauaaaauagggaugauaaugacugcucuaguuucucacagucuguuuggguauugauugagauauuugcaaguacucugaguucugaggaagaaggguguuaggaaaugcuaugguguuguuuuuagcaggcguggaaaccuaugcuaaaauaauuucagaaagauaaguuugaagacagguuggauuauuggccuguaccuguaugacaaucguauguccuucuggucuauccuuuugucuuagguaucaguucugagugaauuuagagggcaggguuugaggaauguugaaagagagaagagaucucgcuggccuaaaacugcccacgaacugucucuuggcugcuggcauuggaguggccugugcuucccgaggcuggucacauagaauggucuacugaugaucaggaggguccagucuucacuuccuguccugacaccauccuauccacuugcugaguuacuucacaccuuuuuuucacugaagaaugucuccaaugacagucuuucuuccuguaccacacacuaccuucacagcuuccuguaaaccuagcuuuggccucacuagucccaccauugaaacugucaucugaggaaggucacaauaaccuucuuccacaagcagucuucauucaugucuaccaugauacaccuggcaucauggacuaccugaaaagauugaaguuacugcuuuuuguuuuuacuggaaacaacaaaaaauagugguuaagauacgggcucuggauucagucugccugaguuucagucauaacaguauaaacuguuuugcuguuguauucgagagcauagcauaguagcagugccuggcacauaguaggugaucaauaaauauuggauggauucacagauagguagguaggcauaucuguuugcuauaagcucaucuauauuuguggcuuuucaugucuuuuaacuuuuauauggcuucuugcuauuaauauuuuuccuuuaguaaguuacauuuaaaaaauuaacucauauugcuuaggcuaaggaaaagaaugaagagguguguguguguguguguguguguguguguguguguagacuguagagcagggaaucauauugggcccuuugagcaggaaaauaauauuuggaaauauacaacugggaaauaaaauuucaggggacaucauuaccucgagugagucuucccagguuguucuuucuucauuggaggaugugaguaggugguuucuuucuuaaaggccaaauguccauacaugauccaaggaacucuuauguuucuuagcuuagcuuuuaucacgcuuacucaucgucuucuucuucuuccuucauuuuucuucuucuuucuuuuuuugaucuauguucuacuucuuuuuuucucuguuggaucuucuuuuuucucaugguaccacagugcaagccacccuagacuacugccagggcuuuagucagaugccuuacugugaacucuuacuucuccaggccaccccagugugucugccaagucuucaucgaguaccauuuucccagggagggggcacaguauagggugguaaagagaaaaucaaauugggacucaaaaggccuagauucuucuuuuuccuuucaaaucucauuucuuucuuucuuuuuuguuuuguuuuguuuuguuuuucuggcuguuuuuaagauuuuucuacuuaucgaugauuuucagcaauucgauuauuugugacuuucuauaguuuuuguuaucuuccauuugagauuuauugagcugcuugaaucugugggcuuauacuucaaaucaaauuuggaaaauuuccagccacuauaucuuuuuauauuuucucugcaccccccacccccaguuguguguauauuaagcugccugauauuguuucgcaguucgcugacucuccuauuuuuuuuuuaaucauuuuuucugucuguguuuuauuuggaauaguuucuauugcugugucuuccauuccuguuucugccguguuuauauuuuccauucuguuuuuagacauaggacccuauuccuaauagcuguuuuaaccuccuugucuauuaucugugucaucccugggucuguuucucuuaacugauuuuacuucuccucauauauuuuccaacuuauuuccauaugccugguaauguuuuuauuggaugcuagacaugcgagguuuuuuuuacauuguuaagugcuggauguuguuauaguucuuuaaauauuguugaacuuugggaacacauuuaagcuauuuagaauuauuuucaucaugucaaccuugcuucuaggcuuuaucagacagguccagaguagcuuuuacucuaaggcuaauuuggccccgcuacugagacaauauuguuuugaacacuaccugacacccuaucuauuaggagguucuuccacuguagcuagugggaacauggaccauucauugcccugugugaacucugggauuauucugccugcuccauugagguaguccucucuggccucaguaguguccuucacacagaacaguacuuggccgaagguucuacacggaagaucuacacagaucuugugcucacacaugcucccguuugcacacaugugcucucuuucucuccccacccuccucucucuuugcgaagcuccccacucuucaguauuuugccacaguagacuguagcugccuuggucuuccaaaacuccaaauucugucuccucaaccuaagaagacugccaggcucuguccaggucccuucuuccugcaucauggcccagaaacucuucagcuggggcacucagagggcucacgucauuuguuuuucaucucuggugucugaaacuacuguuuccuauauuuugucugguuuucuaauugcuuaaggcacgauuucaagcuauuuuauacugaaauacuuuaauuuuacuucccugcagagcaagagcauuuucuucauuaucauuaaugcauuaucaagauagcauuaucacuaucacaauuagaaaaaguuucuaauaucuccauauuucuaauauguagucaauuuugcauuuucccagaugcauugucccagaaauguccuuuucagcugguuuguucaaacuaggauuccaucuaggaccauaauuguuauguggcuuaagucucuuuaaucccuaacagucacauuuuucaugacagugauacagugaacggaaccagccagccaugcuguggcauguuccaucuucuguauuugucugauugcuuccucuauuuccuguuacuagaaguuaggucugaaagcuugauuagauugaaguuaaauguuuuuagugagaauauaucauagaugguguuauauucauauucuaucucauccauagaccuguaagagcuggcuuccuuacauuaauuaggccaagcucgaccccuggaugaggcuugugaccuucuaaucccuccauuguguaguuugauuuuuguuguggggaaguaauugauguucuauaacauugacccuauguggauguucauuucugcaauuuccuggucaacuuucauuuuguuuuuuuuauguuuguuuguuuguuuuugagacgaagucuugcuguguugcccaaucuggagugcaguggcgcgaucuuggcucacugcagccuccaccucccagguucaagugauucuccugcgucagucuccugaguagcuggggacuacaggugugcuccaccaugccuggcuaauuuuuguauuuuuaguagagaugggguuucaucauguuggccaggcuggucucaaacuccugaccucaggucauccaccugccuuggccucccaaagugcucggauuacaggggugagccacugcgccuggccucaauuuucauuuugucuuaguaccaauggauaaccuuuacuugaaucaguuguuuuauuaggggccacaaaaugguuauuuuuuauuuauuuuuuugagacagagugucgcucugucgccaggcuugaguauuggugcaaucauagcuuaccugggacaccuggacucaagcgauucucccacaucagccuccagaguagcagggguuacagguacacacaaccacauccagcuaauuuuucuguuuuuuguagagacagggucuugccauguugccuaggcuggucucaaacuccugggcucaagcaacucuccgugucggccucccuaagugcugggauuauggguaugagccaccacauccugccuuauuuuguaauuauguuauuuuuucuacauuuauuagcugguauucuuccuuaaaauaggacuuuuugaauuugguaaugcugaaauauaauuccuacuugaaagauagcacaaaugcauaauuuuuuauuuaccaaauuucaaagacaauuuuguuuuaauagccaccuuaaauggugacaaaugaguuuugucugacuuucucucuucauugauuuuucauauuuuucauuacguguaauuaccuguaauaauuuauucuuucugaugugcuaaucaucagcuuuggccagagggacucacagagcuggauucuagauuuugaaguaucauagacuaucuauauauuuaauaucuuugacacgcccuuuaauauuuguuaugguucuuuuuuaagccagagaauuagacuagauaauaagguuuguuuucagcucuagaauuaggauccugagcucugcuaccaaauacacugcccugcuucuguccagcugcagaaaacccucagccugucugucuuucaggccuuccacaagcuggcacccccauccauucaacccuuucucgauuccuugacagaaauucccuucuccagccacacuugucuccuaacugcuacacaugaccagcucauccuucauccccagccuucacuuacaccuuuucccuugccugaauaccuugccucugccucucuaaguauccaaaccuccccguccuccagaucccaguucaggcucccccaccuuuuuauuccuguucccuuaccuugucuuuuauacucacuucccucuucucuuggacuaucacuguuuccuguucuaauugauguuuucccaaguagauuaccaucaccccugaaaagaaaagcccaugcuuuuuaccaagaacauugcuaggccaguaucugcuaaugucauuguuauauuucuauaucuucucuaacauguagcaucuucuauuuagcugaauaacagccuuaaggugcuuuugaagugugcauggguauguguugggaaaggaggguguuggggauauuucuuauaaaugcuaaugcuuuccuauucauugaucuauuucuacccauauguaaugaguuccauuacauaucaagagguauugacaacuuagccguagaguugcauugauucaaaauacguaagucaacaauuacuaccuuauuauguaauauuagcuagggaaagaaagauggccccugggaucauauggucuaauuaagcacaacuguuguagacuuuuucucccuuuccugcuguuauguuuuguuuuguuuuguuuuguuguggauaugaaaucacaaacccccaaauaagccucauaaagagacagcugugcuuauaagauuauguucgucacagauuuuauucaacgauaauuuauuucuacccaaaauguuaaaaauauauauuauugauaauuuacaucauauacauuuuccauguuuuuauuggcaaauaaguuuaacaguagcuuaugugaauucuaaaggcauauaguuuuuuugauugucuaaaauuugaccucauauuuuuucuuuaagccuguuuguaaauucugccuaacucuuuagccugacaaacagagcuucagaguuuguuuguuauauaaguauauucaucuuuucugaacagugaaacuuuuugaaauuaucuucuguacuugaaguggaucaucuagugauuagugacaucagguugaauuaauuauuuauauuuucuugcuggaaaugagugauauuccaaauguucaaguacucuguguguguauguauguaugucauaaaaggacauucaugacuuggcuucugacugccucacugagcccucccaccugaucacgcauacauacccccccaaccccacucccccacauacccccuucaccccagccaugaacaaccacucucaguucccugaaucccaugcuguuucauguucauaaugcugcaucuacuugaagugcucuuuuuccaucuuuguucuuucuacaaauugcaauuauuuaucuugcaggacucaauucaguuauacauucuuccuucucaccucugucucucugccuuucaccccaguccaauuaacucuuucuucuucugugccucuacuguacaauaugcagaugcccaucauagcaccuaggacauuuuauuguccuuauucgugaacuuauuuucuuaucuugcuaguaucuaagauuguuggagggcaagaaucuuaucuggcuuuguaucuccugaaguuagucuaguguuugguauagagaagguacuuacuuauuuauauauuuaaucaauuagcugaguucccugcuguuuccccaaacaacuuccuauccucuccagaacaguuuucaucugguagucaguaguaguauugccaacaauacugcuaugucuucacauuuuaaaaauauaucacaaguaaaaaccauuguauuagaauagcaauacaucuaaggauuguauucuuaaagguuuucaaagaggugccuauuuguaacaaugguuggaaauaaauuguuuaaaauugaggcuuaaccugcauucauguaaccaccaaccagaugccuuucccagucaauauccuccccacacugcucuaaaaaaaaaauaaccacuauucugauuugucucaccguguauuagcugugccugaucuugaccuucacauaagugagaccaaacaguauauaucuuucugugacuggcuacuuucauucggcauuaugucugugauauuuuuccaugugaauucuuguguuaacugcuaguuugcucuuuuucauugcucuguaguaucucauuguaugaauaugucacaguuuuauuuaucugcucuacuguugauggacauuuggguuauuucuagacuuggccuugaacauaaaguuuuguuugagaaccaaacuacagagcauagcauuagaccugcuuuuuguccuuucucugccuucugauaggugaugaauugaucuuaauauaggauguacuuaacuuuacucacucaguuaagaaauauuuauugaguaccuguuauguuccagguccugaguaauugucccucccuucuggaaucucacagaccacuggggaaggcagacccuaaacaagcaauuauaaguaugcuaaauguuguaacaaagaaauagaagauguucuagguguuuauaacaggaagaccuaaucugguacgaggguuagggagaaucuucccacagaaaggauaugcuagcuaagacccgaaagagaaacaaaaguacuguugggaaggaagacaaggaacaccauugcaggaagguacaagguccugaaaugguaaugaagauugaaagaagccccagguagcugaaucauagagagggaaguagaaaaugguaggagauggggcuggaaggguagacagaagccaugucauuaagggccuuaugaguuaucugagcaaugugaguccucauccauuaaagaguucuaaucccacgaacggacauaacuuuaaauuuuuuucuuuugauguuaaccuuacaaauucugaagugcguaaaucuuaagcacaaagaauuuuuccauacauuuuuacuaacacaacagcuauuccaucaguaaaauuccagcaccuagaauguccucuccuucccagucaauacccucucuaaggguagccacuauucugacuucuaucaccagagguuacuuuucccugauuuugaacuacaauaauaacaaaauuauccaguugugcaccuuugggucagacuacuuugacucagccuaagagcugcacaguucauccacguguugcauguagcaguagcuugucuuuuuuauuauucugcagucuuccauuguaugaguauaccacaauuucuuugcccacuuugcccacuuuauugauugacaugagaauugcuuuuuuuuuuuuuuuuggcucuuguaaauaaaaugauuaggccaggcacaguggcucaugucuguaauaccagcauuuugggaggcuggggugggaggaucauuugaggccaggaguuuuaagcaggcugggcaacauagcaagacuccaucucuaccaaaaaaaaaaaaaaaauagccugguaugguggccucugccuguagucucagcuacuggagagucugaggugggaggauugccugagcccaggaguuugagauugcaaugagcuaugaucacacuacugcacuccagucugaccccaucucagggggaaaaaaaaaauuaagcuagagcugcaauaaauaaauaaaacuguugugaagauuuguguucaugucuuuugauugacaugaacacucauuucugugggagguagaauuuucaaaaagauuacucugcguucaggguggaggcugauuuggaagagagcagagguggcaguuccucaggcaccagcucuuggauguauagccuuuugcaagucaucuuaguaaaaacaggacacauucauaacaguuuaaacaucacacaaaucaaagcguagauuaaaaaauggaaagcauauuuccuuuuggcuucuaucauuacugucguuuucauaguuauuaucauuguuuacagccagcuacagcuuagagcugauaguaacuggagagacaauaugauaugacaaguuuuacugacuugucauugaauaugccccaauaaacaaaaccauuauugucaugaaacauuugugaagccccguuuucacgauugcuucuuguugugccaaacccuuguuaaccucaauaggaaaggcaccagguucaagaggucaaagaagagacccagagccagcagauaagacaugacguuuuauuaugggcuuacauacaggggagagaguccagugggggcgggcugggcaggaaaaccgcaaccaccuacaaacaucaugcaguuuauagagcauuuccacuuaccacccucgcaccaacgaccuccaccuggcaaccuuaauguaacccaaaacucggggccucaaucccccauauggcugguguuccaugaaaucggccaagggccucagauguuuauccuagauaaggaaggaaucuccagguuagccacucccaaauuaccuagcucagaacacacauucaggugcaucagccacacaggaucauucuaaggagaugcuuaaauuauugcucucaggugugcuugcccuaugcucugugugugugugugugugugugugugugugugugugugugcgcgcgugugugauggugcuggagaugugugucugaagucauagacauauuucucugaccauauagaaccuuagauucuuagcagcaucucugaacuguccucucaggagcuaaaacaguacagauacagagcauucggcaaacuaaaguuguuuugcuuuugguuuuguuucugaauugugaauuuauuuaugucuuaaaacuuuaaaaucagcacauuuugaauugagaauuuaugucuuaaaacguuaaaaugagcauauucaguuauauauacauauauaaugaauugccauuauagaaaauaauacaaucaggugaaguuaagaguacuauuguagaaauacccaagacuuucagccacaauaaauguucaguccuuagaaccaugggaauuaagauacagcauaguggccaggcgcaguggcucacgccuauaaucccagcacuuugggaggccgagacaggcggaucaugaggucaggagaucgagaccagccugacuaacauggugaaaccccgucucuacuaaaaauacaaaaauuagccaggugugguggcacgcgccuguagucccagcuacucgggaggcugaggcaggagaaucacuugaacccgggagacggagguugcagugagccaagaucgcgcugcugcacuccagccuggugacagagugagaccccgucucaaaaaaaaaaaaaaaagauacaguguaguaauaaggaguuaguggucugauuucaccuuaccagaucaggcucuuauccacuacuccaauuauacucucccucuuuucacccuauucugaaugugcugugcaugugcauuaaauuaacaaauauuuauugagcaccugcaauaugccagauaccuugcaagguguuagagauaggaaggcacagucacugaucaacaggaauuagcagccuaguggaagagauagccaauugaaccagugauuaccacacuccagugagagugugggccaaaaugccaggguccucugguggcacagaagggacauuuaaaucagagcagguaacccuugagcugauucuucaaagaugagagucaugagcuaggaauaguauuccagacacuaagaugaggaggcacaaaggcacagaggcagaaauuagccuggugcaggcaaggagucacucguaauuuagugugguuggagcaagagaugggcauguucagaggaacuggagagaagcauagaggaaaauaacaauaauaauaauuuuaauagagaaaaaaacuuuuaaaaagagagagagaagccuagagagggguaggcaggaggcagaacugaagaggcuuggugcucaggaaggggcuaaguaggaaggaucgagaaguaagaggccuguucaagcucacccuguucacagugguacuccucauguguccuuaagcaugucauugggccucguuaguauaaccagagaacuagggaaaguucccaaaccaugaaacacuguccaguagaugugaaaagaugggcuaugaacaaugguuucauuacuuugauaguuaagggaagacugaauacugcauuggccucuuuaagacucaucaagacuccagcauauuaaagguuucugaaguccuccaguaaaaacaccacuucgguuuucuuugauucaguauuuuccaaauuauguggaccgggagccaauuuucuguaacagaauauuaguaucaugaggcagagccccauucuggcaaacaguggacuaguucucaaagguacaaucauccuuauucauucacugauuaaauuuuuuuaagugcagaaccaaacaacugguucacuuuauacuuuagauuaacagcguaucccuguaauaaacuuuagguauuuauuuuccacagcaauguuuuuuuuuauuacaucaacuguccugggauuuauuuuuucuuuucucauuuuucaugucaugcacagacuuuauuaccugguaauaaguugcaagaaaugugaauugaguuguuucuaagcaaauaucaaucauuuaugauuuguuuaauagaaauuauaaugaagaaaaucaggguuuugcuuauuauaaagucauuauagucaacauuagcaaaucucaaaauuaauaaugugucaguaaauuauuugcauugcuaaagagaucaaauaaauaaaaacaggauugaccuuguuagaaauuugauauuuucaacauuuaucugucagagccacugauuuggaaauuguuauaaauucuugaaaaauggaaacuuuuuucccuguaaaaauacccaucauuuggcaaacuacagugucauuuuucuugaagagaauguagugauugauuauccagagugcuaccaugacaagguaaaccaacugaauagcuggaaaauuguguguaaucauauagcaucacagaggcucugcacugagcacaaccauuagaauuaaaccauggcauucuaaucauucccugcugguacuuccuguucauccccaaaaccuugaccuccaguggguaugcagagguguucgcagucaucccuuccccuccaaaugcuaucagcacaauucucgucagcugaaagcucugcaauaaauacaaaccaaacccaaaccacccaaggagauuucaaaaugcaaggugucugugucuaaaaucccucauauauaugacauucugagauuuauucuguguauuaacauuaaucuaguuucuuuuauuaaucguauuguccugagaauccugagagauuauaaacaacugagggaagggaaggaugggagauggacaaaaagaaaagaggaaugcugaucccucuugagaggcugauaaucuauucagaaagacgaaauacaccugagaugacuugagagcaguuacacaguauucgcccagugugaaaguaccaguacacaaauuuaaugcaugagucaugggggccaacagaguaaaggagcaauccaauuauccuuguuuauuagagaacuaaauugagucauaagaaaggaaggggcuacccaaaccuaccccagagauaguuaucaauagcauacuugggaccagaacaaggcccuuucucccaauaaucagaggcaucuccucaugcucaucuucccugcaauguuuuagauuuuaaacaggcuuuguuaggauggcugaacuccagucuccuuuauuaauugcugcccacauguuguaggauauccuguguucugaaucaggaugaggauuuuaaauucuucuuagcguagggacguguagccaggcagaaucaauuccugucacucacacacaaauacagaggaaugggauuauggaucagggugaagcugcagugcuuuaaucucaaaaucaauacagaaaaggaaguugaacuucuggggauucuauagagacuguaauuuggcuuccuaugagguuugccuuauagaauauagcugcuccuuccuuuucaccuucugauuauuuuacuggggugggaaaaaugaggggaaggggaaagaugacaagaaacuucuaccaccaaaucuucuugaauaagcaugcaaguguaacucguaauucaagcuaauccauuguguugagaagagcuauacaccuuuguuuauucuuuuagaaaauaauuagccaaaacccuguaccccauaaucuguauuuaagcauaauaaaaaugccuuugauuuauucauaguucacugucaagacuggaaaaguauuuuuuaagcauacuuuuauggcuaagcuuaccauagccuauguaauuuuauauaaauacaaaaucaacaaaccaguuauugaccgaaggauuccaagcugcucagccugugauuaauauuuaccccaguguauuucugcuucuuuugaaagaggcaugaacuaaugguuuaaacaacucagucuuuucuuaauaaaaaauuuagaauuuguugacuaugcgucuuuuucagauauaacacugauuugcugcacagugcugucggcaucuagcuuuaagaugggcuuauuuuuccuuucagauaguuuuuuuaauucaguuuuaaaauaugucugaguguguuuggacccugcgccuacaguggugacagcaauaugaaacacuguaaucucgugagaaaaugcacugugggcagcagaacuccggucuggcucugaggcagaaugguauacuuagaggagcaaagccuggagcuccuucuuuauuuauuucaucuuucuaagcuuguuuccucaucuuuaaacuggggaugauuauaggauacaccugauagggguguugagaggauuaaacaaaauaaaauauccaaagugcuuaucauuguacuuugcacuuguaagaacccuuuaaauguucaugauuaucaugauuauuaugugagucucaagugagauaacauaugcuguguaugugaaaacauucuacaagcuguaaaacacaauacaaauguuaguuguuauucugaauagauugaugguuuugaaacuuuuaaaauaaaucauggaagguuuuuucuuugugcugccugucauaggucccuaaucucaaaaagccuuggagugauaaaucaggcuccaacugaauaugcauuuucugucuuaaaagccagaguuaucuugugagugucaagaauuccaugauagcgacuugaaaaucccuauucuguguccuuccagagaaaaaacuugcucaggucuugggaagaccagcgcuguguaagauacuuauuugguuguuguuuugaguucauauuucuuuuuuuuuuuucagaguccacagagcuauuuuauuauuauuacuauuauuauuauuuuuuuuaauuauacuuuaaguuuuaggguacaugugcacauugugcagguuaguuacauauguauacaugugccaugcuggugcgcugcacccacuaacucgucaucuagcauuagguauaucuccgaaugcuaucccuccccccuccccccuccccaccacaguccccagagugugauauuccccuuccuguguccaugugaucucauuguucaguucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcacguguuguuuccugacuuuuuaaugauugccauucuaacuggugugagaugauaucucauagugguuuugauuugcauuucucugauggccagugaugaugagcauuuuuucauguguuuuuuggcugcauaaaugucuucuuuugagaagugucuguucaugucccucgcccacuuuuugauaggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuugaguuuaauuagaucccauuugucaauuuuggcuuugguugccauugcuuuugguguuuuggacaugaaguccuugcccacgccuauguccugaaugguaauuucuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggugaugcgggcucuuuuuugguuccauaugaacuuuaaaguaguuuuuuccaauucugugaagaaagucauugguagcuugauggggauggcauugaaucuguaaauugccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauagugaaugggaguucacucaugauuuggcucucuguuugucuguuguugguguauaggaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauaaauagcucuuauuauuuugaaauacgucccaucaauaccuaauuuauugagaguuuuuagcaugaaggguuguugaauuuugucaaaggcuuuuucugcauguauugagauaaucaugugguuuuugucuuuggcucuguuuauaugcuggauuacauuuauugauuugcguauauugaaccagccuugcaucccagggaugaagcccacuugaucaugguggauaagcuuuuugaugugcuacuggauucguuuugccaguauuuuauugaggauuuuugcaucaauguucaucaaggauauuggucuaaaauucucuuuuuugguugugucucugcccggcuuugguaucagaaugaugcuggccucauaaaaugaguuagggaggauuaccucuuuuucuauugauuggaauaguuucagaaggaaugguaccaguuccuccuuguaccucugguagaauucggcugugaauccaucugguccuggacucuuuuugguugguaaacuauugauuauugccacaauuucagcuccuguuauuggucuauucagagauucaacuucuuccugguuuagucuugggagaguguaugugucaaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuguuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcaucccagagauucugguauguugugucuuuguucucguugguuucaaagaacaucuuuauuucugccuucauuucguuauguacccaguagucauucaggagcagguuguucaguuuccauguaguugagcggcuuugagugagagucuuaauccugaguucuaguuugauugcacuguggucugagagauaguuuguuauaauuuguguucuuuuacauuugcugaggagagcuuuacuuccaacuauguggucaauuuuggaauagguguggugugguaaugaaaaaaauguauauucuguugauuugggguggagaguucuguagaugucuauuaggucugcuuggugcagagcugaguucaauuccuggguauccuuguugacuuucugucucauugaucugucuaauguugacagugggguguuaaagucucccauuauuaaugugugggagucuaagucucuuuguaggucacucaggacuugcuuuaugaaucugggugcuccuguauugggugcauguauauuuaggauaguuagcuccucuuguugaauugaucccuuuaccauuauguaauggccuucuuugucucuuuugaucuuuguugguuuaaagucugcuuuaucagagacuaggauugcaaccccugccuuuuuuuguuuuccauuugcuugguagaucuuccuccauccuuuuauuuugagccuaugugugucucugcacguaagauggguuuccugaauauagcacacugaugggucuugacucuuuaucgaacuugccagucugugucuuuuaauuggagaauuuaguccauuuacauuuaaaguuaauauuguuaugugugaauuugauccugucauuaugauguuagcuggugauuuugcucguuaguugaugcaguuucuuccuagucucgauggucuuuacauuuuggcaugauuuugcagcggcugguaccgguuguuccuuuccauguuuagugcuuccuucaggagcucuuuuagggcaggccugguagugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccacuguuagucugaugggcuucccuuugaggguaacccgaccuuucucucuggcugcccuuaacauuuuuuccuucauuucaacuuuggugaaucugauaauuaugugucuuggaguugcucuucucgaggaguaucuuuguggcguucucuguauuuccugaaucugaacguuggccugccuugcuagauuggggaaguucuccuggauaauauauccugcagaguguuuuccaacuugguuccauucuccgcaucacuuucagguacaccaaucagacguagauuuggucuuuucacauagucccauauuucuuggaggcuuugcucauuucuuuuuauucuuuuuucucuaaccuucccuucucgcuucauuucauucauuucaucuuccauugcugauacccuuucuuccaguugaucgcauuggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugauggucugaagccuuccucucucagcucgucaaaaucauucuccauccagcuuuguuccguugcuggugaggaacugcguuccuuuggaggaggagaggcgcucugcguuuuagaguuuccaguuuuucuguucuguuuuuuccccaucuuugugguuuuaucuacuuuuggucuuucaugauggugauguacagauggguuuuugguguggauguccuuucuguuuguuaguuuuccuucuaacagacaggacccucagcugcaggucuguuggaauacccugccgugugaggugucagugugccccugcuggggggugacucccaguuaggcugcucgggggucaggggucagggacccacuugaggaggcagucugcccguucucagaucuccagcugcgugcugggagaaccacugcucucuucaaagcugucagacagggacauuuaagucugcagaguuuacugcugucuuuuuguuugucugugcccugcccccagagguggagccuacagaggcagguaggccuccuugagcuguggugggcuccacccaguuugagcuucccggcugcuuuguuuaccuaagcaagccugggcaauggcgggcgccccucccccagccucgcugccgccuugcaguuugaucucagacugcugugcuagcaaucagcgagauuccguggguguaggacccuccgagccaggugugggauauagucucguggugcgccguuuuuuaagccggucugaaaagcgcaauauucgggugggagugacccgauuuuccaggugcguccgucaccccuuucuuugacucggagagggaacucccugaccccuugagcuucccaggugaggcaaugccucgcccugcuucggcucgcgcacggugcgcgcacccacuggccugcgcccacugucuggcacucccuagugagaugaacccaguaccucagauggaaaugcagaaaucacccgucuucugcgucgcucacgcugggagcuguagaccagagcuguuccuauucggccaucuuggcuccucccccuguuuugaguucauauuucaaaaugucacauucuugcaggagagcucagguaccuuaaauuaugacauacuuggaguuguccuuccuuguccaacacauugacuacagaaaucucauauccucucuuuguuguucauuuccagagcacaaucauuguggagaagacaguucaagaccuccugaaccugaugcaugacuugagugcauauucagaucaauuccucaacauggugugcgugaagcuccaggaguacaaggacaccugcacugcagcuuacagguagagcuucuguuaggggcuaagcaaaguaacguuugagccugauggugguuccaauuggugaaauugcuucaauagccuaauuuccaaaaggaucaucucugaguuugucaagagaugagaacaugcaucauggaaauagccuccuagaccuuuguguagucagaccaacagagagaaugaaagugaugaagggacgcagccacuaggacuaccaaugcauggcucagauuaugugucagccuugauguucaugaaaaccuagaaugauaagaucauguuccucaaggaaauuccagaucuugguuagucuaucuugugguuaaaaagauccuuaaaguagagcaauuugaaacucuuaauaaucuuuaauaguguuuccuuuuaauuaaaaauauauucuuccugauauuuaauuuguagcauuccuacugucacaaaagaacaguuaccccuguuuucagcaucaguagcaaugaaaaaccauuguuaugaacuugaaaaccauuaguuaucccucugauuuccuuccuuagguucaaaaaaaucucucugggcuuguggaaaagaucauagcaauucucuaagaaagcuaauaaugggaacaaauuauaaucugguucacaagacaugaaacaauuagggaagaaaagaauguauaauaaaauacuaaauuauaugugauauauaaugaaggauagauagguaaagugcaguacauaaucaggugcuacuuguacaguauagacugugagggcagaaggaacaaaaaacaagaaagagaaagggguuguagucgggaaugguuuugcaggugagguaugugcuggacucaugaaauuuacggagguggagagaaacauaaaggcagggguggaggaagcaauaagacaguugcccccuauuuuauuuuauuuauuuuauuuauuuauuuauucauuuauuuuuugagaaggagucucgcucuguugccaggcuggagugcaauggcacaaucuuggcucacugcaaccuccgccucccagguucaagcgauucuccugccucaucccccugaguagcugggacuacaggugcgcgccaccaugucuggcuauuuuuguauuuuuaguagagaugggguuucaccauguuggccaggcuggucgcgaauuccuaaccucaugauccgcccaccucggucucccaaagugcugggauuacaggcaugagccaccacacccggcccaguugcccacuauuuaaaggggacaaugaggagauaguuugacuggaacagaguuccuauuagaaucuaguaggagauaauguugaauaggaagauuaagaccaacuaaaaaggggucauaaaaaaauaacauucugaaaauguagauguuggauagcagauauggaaucauuauaagugagcaaggaagcaguguuuacggaagaugaauuuggcagaggaauacaacauagauuaaugcuuauccuuccucauuccagcaagaagaaugauccacaguuacauggacaaauuaaacaacaaccaucucauugagaugcagucccaauaaccuuuuauguucaauaauuauuuaucaaaacuuauauuuagguuaaaaucauacauauacuuaacaauuaugucaauugguuguguacuaaauaauaauuauaauggcaauucaaacaaaagaaaguuaaaauuuagccuugugguaacagaaaauuuaaaguuuuuggauuuuaauuuauacagauagucuuuuguaaaaagcuacaauggaauaauaaaauaauuucaagcauaaaaauauauuucauuaggauaaauuccagugaggaaaugaaauagaaauaauaauucaaagagaaaaaggaaaagcaaaacauauccagcuguuaaagaagagcuuguucauauguauuuuaaauguauaauggaggguaucaaaucccuauggcauugagauucuauuggaugcuuuuuuaaaauuuuuaauugacaaauaauaauuauauaaugagcuacaauuggauguucugauauaugaauacauuaugaaaugauuacauucaaucugauucacauauccauuaccucucauacuucucuuugugugucuuugugcugcagacauuuaaaaucuacucucagcauuuugaaauauauauuacauuauuguuaauuauagugaccaugauguucaaucagucucaaaauggcauuccuucuaacugaaacuuuguaugguuugagcaacaucuccccaccucaccccacacccaccccaaucccccagcccccagccuccagcaaccgcuguucuacccucuacuucuauaaguucaacucuuuuagaguccccauauaagugaaaucaugcaauauuugucuuucugugccuggccauuggauacauuuaaaauagugauuuuuaacagugucagucuuuaggguaugccaaaauuuauaucuguugcaucuauuuaaaugcaggcuaaaaaaauuaaaugucaacuuaaaaagggaaggagaauauaguuuuucaaaauuauuuuaaaggauacaccaauaacaauuguaaaagccacuauucuagguuaauugccugagauuggaauuucugggccauuagagucuuggauuuucaguuuuacaaaaccagauuccaaagugguaguaccaacgucucaucuaccaaaagagaauggaauaaaauauuuuaacuauuaaaacuuaggcccgaugcaguggcucacgccuguaaucucagcacuuugagaggccgaggcaggcggaucacgaggucaggagaucgagaccauccugguuaacacggugaaaccccgucucuacuaaaaauacaaaaaaaauuagccgggcgugguggcagcgccuguagucccagcuacucgggaggcugaggcaggagaauggcaugaacccgggaggcggagcuugcagugagcagagaucgcgccacugcacuccagccugggcgacagagcaagacucugucucaaaaaaaaaaaaaaaaaaaaaaaagaguucgagaccagccuggccaacauggugaaagcccaucucuaccaaaaguacaaaaauuagccagguguggugguguaugccuauaaucccagcuacucgggaggcugaggcaggagaaucgcuugaaccugggagguggagguugcagugaguugagauugcaccccugcacuccagacuggaugacagagugagacuccaucucaaaaaauaaaaaauaaaaauaaaacuuaaauauuaaaaaguuuaaaauuuuuaaaauaauugcauuuuaauaauauuauauuuuaaauuuauguugaaccuccauuaaauauaaagcuuuuuuuuuuuaaguagggcaugcccucuuuuucuaguaaguugucugauuaugggcacccaauaacuuucuuacaaauaauaauguugauaaauaguaauuauaguggagauguugcguaaccugaccaugauaaggucaaguugucucuagaauguaaaucccacugauagccguuuauauuguauuauugauguuguugucuugaaagacauguuuuaaguucuugcagcuuggcaccauauucaucaugggugauuuuuuuuccaaucauuuauguuccugccucucaagaugucaaguggcuggaagccacugcaucugcaaagcagacugaucauuguugaauaguuuucaucuggaaguuuucucuuuguuugaagugauacucuccuguccauuggacauaguucuuuucucugaaugauaacaaaucaguuuaauccuuuuaugaaugcccuugaaauauaugaagauagcuaucauaguccauuuagucuugcuuucccuccuuaaacugaacauucccaguuucugguaugcccuggucuaugaacuaucucagucaucuuucuccauuacccauuagcuuggcaguguccaucuuaaaaaggagugccccagaguauacccaguguuccagauguacucuuuuuuuuuuuuuuuuuuuuuuuugagacagagucuuuugccagagcuggagugcaguggcgcaaucuuggcucacugcagccucugccucccggguucaagugauucucuugccucagccuccugaguagcugggacuacaggcacaagccaccaugcccaacugucuauuuauuuauuuaguagagauggaguuucaccauguuggccaggcuggucucgaucgaauuccuggccucaagcgauucucccaccgccucggccucaccaagugcccagaugcacucuggguguugagcagcaccaucacuuuccuuguucaggacccagugcuggacacaaugcuucuuaguguguccuaucauugcauuugucagguauuuacugagcauuuaccaagaugcugugaggguguguggggauaaagaaauuaaucagucaagauucuaccuuucaugugcucauauucuuggugaagaauagaaagggaaauaugggacaaagaaauagaaagcauguauccacagcauuaauucaugacagaaaauauggcaagauagguaaaaaugccuugcugugggaggaagaaauuacgaaggaggacagggaaggcuuagugaaguauaugaacuaggcuuugugaagagugaagaggaauuagacauagguuugaagaagagcacgaacaagugauaaaugucuaggauguggaaaggaaagcuugggucagacuggaggaucgcgaaugucagacucaaggaacuuugccuuuuuaaauuagguagcgaggagccacugaguggguguuaagcauggagugccacgugcacaccugugcuuuagggaaauuuuucugaguuuuguguaagauggauuugaaaagcaagaguauagagauagaggggagagagacauuaagugccugaaucaggggacagggaaggaaaauggagaggaaggaacagauuaagagauaguaaagagguaaacuugauaagacuuuggccacugauuggcuauagaagaagaaauacagauugaaauuaguauuaucuuuucuaugcuguauuuauggugauuuuuguaaaacacaaauucaggaucucacauuuauccauuaaauuuaauguuauuuauuuauuuagagagauucucacucuguugcccaggcuggagugcgguggcacgaucucagcucacugcagccuccgccucccagauucacaugauucuccugccucagccucccaaauggcugggauuacaggugcccaccaacacaccuggcuaauuuuuguaguuuuaguagagaugggguuucaccauguuggccaggcuggucucaaacuccugaccucaggugauccacccaccucggccucccaaaguccugggauuacaggcaugagccaccaugccuggccaaauuuaauguuauuuuuaagucaccauuucagccuauugagauauuuuugaaucuucauucugucgucaaaaaaucuuagcuauuccuguaaguuccuugucuuccuugauuacauaagcaaucuuuuuuuuaugcaugucauugaaaaaauguccaacagcauaagacuaaguugagaauuggggagcuauaccuccugacacuuccuuguauguugacaucuguauauuacuuagugccucaggaguucauauguuuuucuaacuaggaaccugggcuuuagcucaagagcaggcccuacagcuuaaguuuaaaugccagcuuuucuaccuacuauuuauaugacacugaaaagcuccucagccucucugccuugauuuccucaucugcaaaaagguaauaauaguccuuuccucaaagcguuauuucaaaaauugucaaucuuuuauaacugguuuuagcgaagugauaugcucccccaaaaaugauuugcugcuauuuugauaaugauaauaaugguaaugacagugauugccuuuaccaguucccaugacacuauuccacauauuucauaaucugcccuauaaaagauugaucagguuucuugcuggugucuucccagccugauucuuuuaaugcagccaacccuuccucauguuggcaugcaggccuguuauggacaauacuagauauuuguucaagaauccucccaucccuuuacuguuaggacccacuucucccaacugaagcauuccuuaagaacucucuucuugggcagcuuucaaauuaccuuuggaaacaagaucaagauaaccaagagccaaauuuaccaccgccccagucaguuaggaaaggaucaugugaccuauucuucgugagauccuccuagcuucuagugaguaccacuuucuaauuauucaugaacuauguuuuaauuaucuguucagaauuuugccuacaauuccaaauucaccucauuucuguaauuuacguugcuuuucuuuuaugaacaucagggauuugcucccaggcauuuucuccugugugucaggauaccuucaaaaaugaucagcagugguucugugauuccaugcuuugaauuauuucggcaucacaagauccuucccuaaauuuguuaaaccuuucaggaauuuuuuugaucucaauaaccauuaacaaacacaguggaucacugcaucuuuaaaacaauuuauucacuugguuucuagaauuccauuuauucaacaaauauuuauugagugcuaguacaagaguuuguagauauaacagugaacuaagcagauuaaauaucugcuuucaugggguuuauguucuguugugaaugggagaggggagauagacaauaaaugaauguaauacauaaacauaaagaauuuuagggccgggcgcaguggcucacaccuguaguuccagcacuuugggaggccgagggcaggcagaucaccaggucaacagauugagaccaucauggccaacauggugaaaccccgucucuacuaaaaacgccaaaaaauuagccagguguguuggcaggugcccguagucccaacuacucaggaggcugaggcaggagaaucgcuugaacccgggaggcagagguugcagugagccgagauugcgccacugcacuccagccuggcgacagaaugagacucugucucaaaaaaacaaaacaaaaaaaaaaagaauuuucgaagauaguaaguacuguggagaaaagaaauggaguaaaguagauagacucaggagugugagaggagcagguuguaguuuuaaauaggaugccccagggaggcucuguugaguugagcuuagaggaaaggcuccaaggaguugaaagaguuugaccagccaucuggguagagugcacuggcacagggcaaaggccaggaggcaggacgcuccgggacacuuuuaaggaacagcaaggaggccagcaugguuggaguaaagugagcgagaggaggaaggguauugaaggaucaccaagagggaauggaggucuugguaagccacucuagggaugcugaguacuacucugagugaaaugagaagccauuacaaggauugugcguaggagcagcaugaucuuacauauauuuuaaauuuuaaguauugaaaauaggcuuuagguagucaaggauggaagcagugagaccaccuaaaggccacagugguaacccaggugagaaaugaagacucuuugcacuguugguagcagcagagauggagggaacugggugaacucugaauguauuugaaggaccagccagcugaauucccugccagauugaagauagggugugagagaaagaaaggugucaaaaauaacucucaggauuuuauauuugagcagugaaaagauggauggaguugccagcuauugugacggaggaugcugcaggucuaggcaagcagaucagugcuuaaauuuagagugucucuuagccaugugggggagggaguuggacauaugcaucaaaacaagagaggucuggccuggagauagauauuuggcagccaucaacauauaaauaguauagcuaaauggaauuuaaaacuaugggacuagaugaaaucuucacaggagggaguauacucauggcaaagaagaggaccauggacuuuuaugaaguuugcaagaugacgagaaaccaucaaaggacauugacaagcagcagccagugaaggaggaggaaaaucuagaaaauacaguguuguaguguugccagcauuagaacucagcacggacugagugauaaauguagcacggacugagugauaaauguaaauguuuuuguggaguaguagggaugaaaacuggauggguguggccuuaaaaaagagacugggaguagaggaaggguaaauagaggcaaaacuuuugcacugaguuuugcagcaaaggcgaacagagaaauggcauaguggcuggagaaaugaggucacaggaagguuuuuuuguuuuauguguuuuuuaagucgaagaaauaaguacauauuuguauuugaagaaaaggacuugggaagaaugaaaauuuggugauguaagaaagaaaggggaaaaucccugaaauuauguuuuuggccagggaaguagcgguggaggaggggugugcaacuggagugauugguuuaggcgggaacauggauaguuuugccugcgcugucuguccguucuauaggaauuguguuauuucucugucauucauauuuuaccgcuuuguccaaacagcaaacucuaucucucuuggacuacuacucuggaacauggccauugcuuugguuuuugacauauucuggucaucaggagcauuuugauuccuucccguaagaaacucuacugcuguggcaucucugcuagccacagucucugaaaugguguccaccuguuggugcccacugucacaucucaggggauuaucugggagggaucuaccauaguugcugaaugauggaccuggguuaaauuuuucucaggauugggaaaaguauucuuugaggcuuugaaagggaauaaauagaaaaucaucuuucugguuguuauacaacaaugcacacucaaaggcacaacacaugcccccacggugcuguugcugcugguuaaucagcguauucagguuucuggagaaaguguuuucuuauuguaugacucugaagaugcaaaguguccuuacuuccucucuucccauuuauugcccucccccagauuggcaccugcugaggacuaauuagggcaguccuaauuuggacggccaaauccugauuacagugaggggaaaaacaggaaauguucuaguuuugcugccagcaaaugacugacuuaaauagaaagccauauacaauucaaaugauccaaaaugguauaacacuggggaaggaggaagggagcaggaagacguugcacucugauuuucucccaugugauccucagcagauauccuucagagaaaucaucaaaucuagaaacucacaaugcccucugcugaggguuggcuuguuuuccaagcuucccaugaaaaccugggcagcuccugggagcuuagagaucugaggaaaggugaaaaacauaucaccuuucuaugaguaccucacucuagagacagacugugccucagguaaugucagguuacaugcuuuggauaaagagggguuuccuaaacagggaaaugagggcuagaagucuuuucccuaauuauccacaccccuuggggcuuaaagggaaacucagcugugaauucuguacugcuccucauuaggaaucaggcacuuggcccaugaguugccuacuuccaagcagagugcuucccuccccuugccuguccucuguccugagauccauccagcagcucaugugucccaaaauaauaauuuaaagauuggaaaucgcaguuuucggaaguuucucucuguuccaauuuacuaucaguucauuaaucaauuuuuuuuucuuggaggugggggauaaggaggcucucugccuuguguugggccuggcagagaauacaaauaaaaccucuucccuaguguuagaggcucaguugguuugaguugauuuaagacauaagcauguuaccuuuagcacaccccuuucacaacuucagagaggagcuagaacucaugcuggacaugaagaaagagugagaggaggagaagccugcacucgcugauggcagacaucagagcuggcacggggcuaggcagcuuguugacccucgguaugcucauugaggaaauuucuaccagacugaacaggacgagcaagcaguggagcagcauggacgaccauggugcgugggagaaagguugagaaaucacagugacuagaguggacagugugguuggguagaaaugggcaggaaaggagaaauuucuuguauuagguaaaagagugcuuucauaggucuugguaagaaggaguacaugaucgaagugguguuuuaugaucucacuggccccacugugcuaaauagcacagacuagacacuagggacucugguggcuucugaagcccuucagguuuccuguguagccagaggccaggguccuauaggaaugagacucuccuugagcuggccuuggagcuuuugccaaccuaacuuaacuuugaaccucagagugagaggcaggacuagcuggauuucuuggccaacuaagaaucccuaagccuugcugggaaggugacugcauccaccuuuaaacacgggggcuugcaacuuagcucacacccgaccaaucagguaguaaagagagcucacuaaaaugcuaauuaggcaaaaacaggagguaaagaaauagccaaucaucuauugccugagagcacagcaggagggacaaugaucaggauauaaacccaggcauucgagccggcaacggcuacccucuuuggguccccucccuuuguaugggagcucuguuuucacucuauuaaaucuugcaacugcauucuucugcucuguguuuacuacggcucgagcugagcuuucgcucgcuguccacuaccgcuguuugcugccaucgcagacccaccgcugacuuccaucccuccagauccggcaggguguccacugugcuccugauccaccaaggggccuauugccgcccccgaucgggcuaaaggcuugccauugcuccugcacagauaaguguccggguucguccuaaucaagcugaacacuagucacuggguuccacgguucucuucugugacccauggcuucuaauagaacuguuacacucaccgcacagcccaagauuccauuccuuggaaucugugaggccaagaaccccaggucagagaacacgaggcuugccaccaucuuggaagcggccagccaccaucuugggagcucugggagcaaggacccccugguaacaagaacggccaaggguguauaccagggaaacccucugcaagcuccagcuugugaucugucucuugaagcuauguuaucuccuaacacugauauauauucauuucuauuaaacauuaaauaaguaccaaaaacauuauaaaauauacacaauaucuguuucauagagggcauucagcaagugagcuuuuauugugugcuccuauaauuuauuauguguaacuuuaugcugguauuuauuccauuguauuguaauuuagacuuuuaaaauauauuauuucauuaguuauugguuuaacugucuuucuuuaaaaaaaauauuguuuuucaauuguagcuucacaucaagguuauuuggggaaacuucaaaacauacauccuggguuuuccauacuagguccacugagaguugggcccgggcaaguuuaguuuaaaaauauccucaaagugauugucauguguuacugguuagaaaucacugaucugggccaggcaggcaggguggcucacaccuguaaucucagcacuuuggguggccuagguggguggaucaccuugaggucaggauuucgagaccagccuggccaacaugguaaaaccccaucucuacuaaauauacaaauauuagcugggcaugguggcagguuccuguaaucccuucuacucaggaggcugaggcaggagaaucgcuugaaccugggaggcagagguugcagugaggacucggucuggaaagaaagagagagaagaaggaggaggaggaggaagaggaggagaaggagagagaaagaaggaggggaaggagggagggagggagaaaucacugcucugaacucuuagcuuccagaaguuauuaugucauuuuccacacaccugucugcaguaucuugcauggugucucuguauaggccuugcacucuuguuuuuugaucaagugaaucccuucacucauccuuuccaguacauaucaguugcccuucuggccaaauacagaugcugcccaccuaaccaguuguccuacaaauucuguagcaagcagccaguccucauuucuccuacccaacucacucuaccauaaucagauaggagucuguugcagugaccuugacacaaaguaacaaggaccuagacuggaaagaaaauacucaguaaaguauuaauacauagucucugugcaagggacuuuauggucacagcucaucuagucagucacaacaauucuguugaauuagauucucugccuuucagaugaagaaacagagguucaggaaaguuaauaacguggcaaaggccacagagcauaaagugguagugcacaugugaaaagcacuagcucugucucagucuucagcccaaagaagaggcaauggaauuaaagaggaaauaggaaaccugaaaaaugcuucacaugcuuuagagagacaguguaaugacuaggaaaauagacugcagaacagcgggucuggguucauuucagguucuaccuugcuaguuggcugaccaccauccaguucccagccuucugugccucuguauuucgccuaucaaauggaaguaauaauaguaccuaccacgcagggugguugugaggauuaaaaguuuauauaugccaaaugcucagaagaaugcauagcucauggaaaagguuaaauugucagccaauacaauuauuuauuguugcugcaauugguguuuuguauuauugacuuuuaaauuaauucauugaugauauuauugauauucaauaagaagacaguacaagaaaguuuuuuuaauuuuuuuauuaucauacuuuaagugcugggcuacaugugcagaacaugcagguuuauuacaucaguauacacgggccgugguggugugcugcacccaucauccugucaucuacauuagguauuucuccuaacgcucucccuccccuagcccccuaacucccgacaggccccagugugucauguuccccuccauguguccauguguucucauuguucaacucccacuuaugagugagaacaugcggugugugguccagaaagauauuuuuaugucguuuguuauuuuccuggcguuuugugcuucaguuaugucauucauuccuucaaucuguuacucauucaaaaaucauuuauuaagcacuucuaggagccagcguuauucuagggcuaaaggugaagaagugaauugacuagguaagguccuugcuuucguggauuuuacaccuuaauggagggagcuagauaauaaucaaguggaaauaaacaauaaauuucucauuaauaaggaugaugugauuaaacaaaacaacagguucaagugaggagaguagguucagggaagacgccgcagaggacguggcauuugagcucaguucuaaaggaugagaaggagccauguggaaaugugggaaagagcacuccagguggagaaaggagcaaguccgaagaugggaacuagcuugaauucagguuaaugagcaaagagaaugaauacugagugacauuagacagguagaggggucggaucauuugggucauuucuggcugcacaugagaaucacaugggagcuuaaaacauagccagacugagccccacuucagacugugaaacugauguauuuuuaaaaugcuucccagguguuuucaugugcagucaggauuaagaaccauugauaaaggaucuugaggcuagagaauuugaauuuuauucucaguucagugggaagacaugcaagguuuaaauagggagucaucugaucugagaucuacuuauaaagaucuuaaugauauucaaacacagacuauauuuaaauuugcuuuauuauaagaaaaaucugaacauugacgguugagacagauuuuuuuuuuuuuuuuuuuuuuuugaggaguuuugcucuuguugcccaggcuggaaugcaauggcgugaccuuggcucucugcaaccucugccucccagguucaagcaauucuccugccucaaccucccaaguaacugggaucacaggcaugugccaccacacucagcuaauuuguauuuuuaguagagacaggguuucgccauguuggccaggcuggucucaaacuccugaccucaggugauccacccaucucggccucccaaagugcugggauuacaggcgucaaccacugcguccagcugagacagauuuuauaugaauucuugguccacuuccuguguuacaguauaauuuuuuucuucuugaucuuuuaagugucaaacaguuaugauccuucauaugagaacuugucuauuuaaagguuguuacuaaauuauccccaagaguuaccuucuguaaacugucauugcaaagccuuuuucccuugguccucuuggaugguuucuguuuuccaugggccuucuccagaguuaucagaaguugucauucucagguagacauauacacuaucauaaagcucucugaccagcauugaguauggugucaaagauguucugauguuucuuuccucuuuuccuauguguguugcuccaucuuaacugacuuuuugguuuuguuuuuguguuuguuuuguuuuauuuggcagcauaauacuauuaucuuugcaucccuaauugucauuaucacuuguguugcuggacauuucacugcgguuucgucugcugcagguccagucauucacagucuaaauuggacgacggcacuuuacuuuggaccagucuuguccaagguucauuuguugagcuuggcuccuaguuuuugaaguaucuugaaagauucagucugggaaaguacacaucaugcccuggcugucaccaaacaauugaauccaauuagccccaccugcaccugguuguuuaccuaaugaaagacucagcaccccagcuguguccagggaccaugcacacucgcacuucccaacuguuccagagaggaagcgguacacaucagagccaggcgacaccagcagauguuuucugaaugaaauucacucagcuguaucucgaggguggaccuuucucuuggcagccucaucaccuguaccaaaagguacaccuauuuuccucuuccucuuggaaacagauacaaauaguuacacaguuggcucugucuguggcucauugagcugugaauuaaugaguacauuaugguucugguagggaugauuaaccuugcuucuccuauggaauaauuuuuggacauguagcucuccuuuuuugaggcuauuuggauauguccuggaauucuguaacccacaugaucugguuuaccagaaaaucaaaaacaaauaaaugcaauuagucaggguggacuugccacuugaguaaaaaauuuucuuuaggguaauuguuuauugcugaucaaugccaguauuucaaauuagaauauuuggaauuacuuuugggauugguguucauuccaaauguacuaacauauuuauuguugagggcaguauguuaguagccuuuucauucauuuggaugacuauuuuuuaauaaaaugggaucgaugcauauuagagauaauguaaucuugaauuacugaauuaauccaguccuuuaaaaauauguaaguaaauaauguggguaccuuuaaugucauccaaccuaaccuaauuuuuuuauuucagcuaaugcuaaaauggaaaauucuagcccuucaaaauguacgguaccaucucacaccuacagauccaacuauuuccugaaccugagggcagauaugggccagcauggaugcgcucaaagacguagaugcugacaaaaugaguugggcuugggcuucucacucuguggaacagaauuugaccuauagugugggucuaagaggaauugaaccacacagccaagauucuuucuagauaugaguggugaaaucucccacagccaagauucuuucuagauaugaauggugaaaucucccacagccaagauucuuucuagauaugaauggugaaauugaaauuuuguauaauuuccacaugucacaaaauauuguucuuuuaguuuuuuaaaaaccauuuuaaaaugucaacaccauuguuagcuuacaggacauacaaagacagcugauggguagguuuggcccacaggucaugguuugcccaccccauuguauuagacagagugcuaauugggaaguuauggauaagugcaaaaggagggguuuuguuuguuuuguuuccaaagggagagaucauuguaggcugacauagucaacaaauucuucacagagaaagugaguuuuugaggagacuuuccaauaauaggccaccuaggaauaaguagcguagaagggaaaggcuugucaauaaucgcucuuugguucauuuguuuuaugagucaggacuauuuuacauugggguuuuucaaagagggacacaccuguauucauuaccugauuuguauugaauccagagaggcauggugaagggcauggcacagagugaucuuugauuugguuaaauaccaaaugacuugacagcucaucaaaguuguuuagagcagagaauaaaacggaaaccauuaagaugcuuuuaguguaauaaguuaucuagacuuuugaaauugaagagggcuucuuuuuaucucuacuucaguucuuauaugccuucuaaauaccagguauugugguaggcacuagggacagaaaaacuaagaagaaaucgacucuguccucauagaacucaucauccaauaugggauuccagcuugcaaaaaaguguaguaggaccaguuaaaauagacguuggcaaacgcaaagguuguggcccuugagugcacauuuaaaucacaugggaaacuccaaaaauuucuguugcuugggucccgcagcccagagauugugauuuacuuggucuuggguauggcuugggcaucugguuuuuaaaauagcuugcccaagugauucuaaucuuuagucaagguugaaaaccucugguauaggggugaugaggcacaaaaaaagaggacucagauguaccaagggaggagcuggggcaaugcuugacaaguagaggcaaacaaggaggaugagaaaaaggcuuucuaggcugagaugacacacagaaacaggaaauaauagaucccauuuggaaaacuuuggaauacucaucauggguaguguguucaaccagcaugggcaagagauuggcuaggaaucgugaacagacacaaaggagaaaaggaauagcaggagauaaagcugaaaagauagauguucaugccuugcuaagucuagccuuggucuuaccuggaauuagaagucacugaagacuuguaggaaggguuauaacaugauuggauguguaguuuagaaaaaugacucaucugacugauguggugaguucaacugauggucuuguagcugcaggcgagaagcccaguuacaagguuauugccaaguccaggugaaaaaagaugaggguuuaaauauagguuaauagcagugaaccuggacaggaaaugacagauuuauuaagauauuaaggagauagaauuggcaggauguggugacuggguaauuaggaugacucugcauuccugaguugaauaacaggauggcuugaauagggaacauuagaugcucagugguagagagagagagagagaaguaguuaguaaauugaguuccucuugacucauuuuaacuugaaaugcagauggaacuuucaaguagaguucuacaguaagccuuuggauaugcagacuggaaacuuagaagagagggcugcccuagagauaauaauuucagagucaucagaauauagaugguucaagcugugcaagaagaugagacugcccaagucagcaaugcagaauucuguggaacacagcauuuaaaguauggauggagaaaaagagccaucaguuuggcuaagaaagguuaggaugguagguaaagaacgugaugcggaaagcaaaagaauaguauuucaagaagagaguaaucaaaaguguuggaugcuuuagaauagucaaagagugcgaagaauaaaauaaaaagugcucuuggguugguggagcaauuucaguggaguaaugguucuagaacccugacugcaguugauuuaagacuggauuuugauuuccugucagaaguuuggugcgaauagauuuaaaaagcccuuuucuuguuucuaacuuguagaaauucuggauaaaaaaauuauaacuuuaaaaauauuuuaaauauguaaccaaacucaaaaggaugaaagagaauucuccagaugccaugaaugaaagaggaauuaaaagccagaaacagacaaauguggaaguugagugggcuacagagguuucaggaccacauauagaggucaaauagaggcuagcaucuugacaucuuccaggcagggagggagcuuuaucugugcagaaguuaugcaaagaacuguuucauucauauuucuuaguucauucaugaauggaaccaagaaaacuugggacuuaagaaggagcuacccaaccuggaguagaaaaguagccccuaaaagaaaucagaaucccacaccucaugugauaugugcaaguaagaacucaauuuguacuaccugcguagggagaaaaagccuuaagccaaaaauaaaaaauaaaaaaaaaggaaaaaaaaauuacaaaccuauuuggaaccaguguaacucauaggacccagaagaggcaaaugcagacuacguaacagugauaucuugaaaauucugggcaaaugcaagauuccuacagaggauaaguuccauugaaguagagcuuccagaacaaaguagcagaccacaugaggaaauacaccaucaugagaaaagaaggcaaaugcaacaaacaggacacuugacaucuacaagaacuaccaaagaauauaaagccacuucauagaaggaacuuaaaaauuguggauuucuaaaacauucaaggagauaaagaaaagaacagauuccaugauacaagagcaggacaguuuggaagggaaaagccaguagauuuguaaaagaggcaaauagaaaaucuagaaaugaaaaauauaauaacugcaaauuuuucaaaaagcaguagauggguuaaaucguaaaguagaccuuggagagagauuucaugaaugagaggugagacagugaagucaauuagugcaggcugcuccuuugaugauugccuuugaaggagagggagcagcuuuguuagagaggaaugcagggaagagauucauucauucauucauucauucauucauucauuuuuaaaauaacagaggauuagggaauauauaguggaaagaguaaaaauacaggaaaaaggggagauaggucggggagaaaagauccccaagagccuaacuagaggaauuacuggaaauuaaugaggaugaagcagauuugaacauauuucuguuggggguaggaggucaaauauuugaaaguauguaauuagaucccuuccuucucugucagauaagaaggauaugggcgguaagcaaugaggagauacagaaagggcaaauguuuuuuuaaagaaauagcuacuaagauaaauggggagaugaaccugaucagagacagguauaaagaaugucagagaacauugagggguacaccugcaacagucucuuaucugaggugguaccaugcuauaagauugcaccuagcaaugcaaguauaagauuguaaaaguuagauuguuggauuaguccauaaauauuacagaaaagaugcaaggaaauaacaaaagagggaauagaaaauaguaguaagaaaguaauaugagagauuggagggaagaaguuucuguaauccaauuuuugugucucugaccaugguuacuaugagaaaacauuugcuuauagugaauuagaagaauucuagaaucuguuuuccuccugccucaccucauuucccaugcaagugugccuugagcucaaaacuuuagaagaauaagagagcaaauaaauagcucucuuauuuauucuaguuuauuuuaaaagaaccaggguaauauuguucccuacaacagugguccccaaccuuuuuggcaccagggacuggggugauguuuugggugagaaaaaggggaugggaugguuucaggauguaacuguuccaccucagaucauaagacauuaguuaguuucucguaaggagcaugugaucuagaucccucgcaugcgcgguucacaauagaauuugcgcuccugugagacucuaaugcuaccgcugaucuggcaggagguagagcucagguaguaacgcucacuggcccgcugcucaccuccugcugugccgcccaguuccuaacaggccauggaccaggaccaguccguggcccagggguuggggaccccugcccuacaacaugaaacuauguuaccuuaagucagucugucaugaaucaagguuuguaggcuucaacuuuuuguuuuuguuuuguagagaaggucaaucuguguugccgaggccagucuugaacuccuggccucaagcaauccuccugccucagucugccaaagugcugcagucauagaugugaaccacugcaucuggccuaggcuccaucuucuuuugucuacaaacauuaauugucuguugggucaaggagguaucauacauacaugccauauauauuguuuauuugcaagugcauaaugccccccagagugaccccuguacuaaaagagauuccugccuaugauggggcaaucuccuggagucuuggucagccccagaggagaagcagcuaauuggcacuccuuucauaaauaaaugucauuucugucaccuaguauugcugacgaggauauuuagaucguugaaauuaguuacagugacacauguugaaccgaaagaaaagcuuuuuaauuaaguugaaauugaacauuuaagaugaauuuacagguaacauucugguaagagcaguguuaauagcuaacccaugggcccuaugaaaagacuugaagccugucagcucuaggucacuagucagagcccacuggagauggcaguaaucaaaggcuuuuucugccugacaacuggggcugaggguuucuuaaugaugguauauuggcugugaagagagggguguccaugauucaagcaauacccucaacuagaacuaauugauaguuuaaaccaaggaguccagaguacaaccuuuuguaacacuuccgucaccuuucagguacuaguuauguugucacuuaauagcauucuuuuacaugguuaucccacuuuuuauucaacauuuucuuaaaaggucccccccaaaacauaccauaugcuuuuauuuauccuaagggaucaaauaugguaagaggagcuaauuaguuuuuucaacugucacgauuacucaacaacuaagaaacuaagaaugaaaucuagaaauguuguuucccaguaaugugaccuauuaauggguaucauggacuccaacuuagauaauggauuauguucaaaggagagaugagugugauuucuuuuuuccugcagcaaagguagaugaaaaugcuaacugaauaccaggcaucaugcuacagugucucuuuucuauuggcuguguuuagggguauuguccagucagaagaaaaacuugucaucagugcauccugggcaaaagaugaugauaucagcagacucuugaaaucucuaccaaacuggaugaauauggcucaacccaaacagcugaggccaaaaagagaggaggaagaagauuucauaagguaaaagguccauuuucuaaguuguccuaaacauagggaggaagcacaucuguuuagcuaauauuuuuuuacaugaaauuuaggcaaauucuaaaaaucaagcagcaauuacuugaacuuaguaaaauauguuuuccuccugucucaccucauuucccaugcaagugugccuugagcucaaaacuuuagaaggaaaaaaauuaaugugagucaaauuuggaacauugcuaaauuggauuaaaauaucuuuuuuuuuuuuuuugagacagagucucacucugucucccaggcuggaguacaguggcgcaaucucggcucacugcaaacuccaccuccuggguucacgccauucuccugccucagccucccaaguagcugggacuaccggugcccaccaccacgcccggcuaauuuuuuauuuuuaguagagacgggguuucacaguguuagccaggauggucucgauauccugaccuaaugauccaccugccucggccucccaaagugcugggauuacaggcaugagccaccacacccggccuaaaauaucuuuuaauuuauagguucuucuuuccucuuagaggaaaaauagaauucagugauucauucacucagcaaaguuguuuguagcccccauaugggccauacccuuucaaacaugagaguaagauaaauuucuguccauacagaauauguuucuguccauacagaauauguuaugauuguucuuaacauguucuccaguccauagaacugucaguuggacuuucuggaaaauacaaaugugcuuccuguguguguguucacauacauuguauuauccgugauuguuuucuauguuucaacaaaaguagagucuuucuuuuaacuuuaucacucaacauuugccuuuguucaauuuaaauuauuuacuuagccaugaaaguguggccuaauuugaugaagcuacucauuuccauauggcuggcuugccacagugaaacauuuucaccucugucacuuauagagcuguguaaaguagaaaaacaauggugguaauacuuugucacaucaaaguugggauuaauauuaucuucuuuugccuaagugaaugaauaagugguaaaaauaaaauaaaagcauuuuaaagaaacaaagacuagaagaggaauaaaaggaauaagggcccauguuuucauucaucacagaacuguguucuuaucucucucaaauugugcaacuguagacaaaucuuuacugcucacaaaguuaaccuauaaucauacacuacagugccauauuuuuaugaacuuuuuauuaugaaaauuuucuguagcaucauguuaaacuuucucaaaaccaugauucuugaaagugcauguguaauuuaaccuaaauucuuccuguuuauguuuuucuuccuuauuauucacaguaucugaaagaaacuuguuagcuaguuaauuauauaagaaaacugucucucuccccaccuuuauuuuuugaaggagcaauuuuagguuuacagaaaaacuugaacaaaaaguacagaguugccauagauccccuuacaccucccccaaccauuuccucuguuuuuaacaucuugcauucaugugguguauuuguuauaauugaugagcuaauacugauacaauauuaaugacuaaagucuguaguuuacauuaaggaucacucuucauauucuaaauauaucgguuuugacacauguauaaggaauacauccaccauuauaguauuaugcagaauaauaauuuugcugcccuaaaaacuuccuguguuccuccuauucaucccucccucccucaacagccugaaccccuggcaaccacugaucuuuuuauugucuccauaguuucgucuuuugcagaauguuauauacuugaaaucauacaguauguuuccucuugagaaugacuuauuuugcuuagcaaugugcauuuaaguuuccuccaugguuuuuuuauuuugugguauuauugcucauuucuuuuuuaucucugaauuauguuccauuucauagguguaccacucuauucacucaucuauugaaggauaucuuaguugcuuucaaguuuuggcaguuaugaacaaaggugcuguaaauaauuugugugcugguuuuuauguggaugcagguuuuuaacucauuugaguaaauaccaaagaaugugauugcuggaucauaagggcaaaauauguuuaguuguauaagaaacugccaaaauguauuccaaagugguuguaucauuucacauuccuaccagcaaggaacaagagcuccuguuucuccacauucuugccaacauuugaugcugucaguguuuuggauuuuagccauucuuaugaauguguagagauaucucauuguauuaauuugcaauuuccuaaugacaugugauguugaacaucuuuucauaugcuauuugcugucucuauaucuuuggugaaguguuuauucaaaucuuuugccuacauuuuaauuggguuauggguguucuuguucaguuuuaagaguuauauguauauuuuggguagcaguccuucaucugauaaguauuuugcaaagauuuucucccagccuguaguuugcccuuucauucucuucacgaugucuuuugcagagaaguuuuaauuaaguccaacauauuuuugugcuuuucugucuucucuuguuuuaauuauuuuguaugguuccauuuuuucuugucuuuuaccauauuaguuauacuucuuuuuuuuacaccuugcauucaucguauacauuuauaacuaauccaagucugcuuucaaugacacuguaccacuacacaggcaguguaaguaccuuauaacagaguauucccaauucuuccucccuauccuuuguaacauugcugucauugauuucauuuauccauaagcuagaaucauugacuacaauguuauuguuauuauuuugaacaaacuguuggaucaaguaagaauuagaaaagguuuauuuuuaccuuuguuuauuccuucccuaaugcucuuccuuucucaauguagauccacguuucugaucuguaucauuuuucuucucucugaagaacuucuuuugacacaucuugcaagacagaucuacuggcagcaaauuccuucaguucuuauuugucugagaaaguguuuauuuuuucuucacuuaaaggauaauuucacuagguacagaaaucuagacugauguauuagucaagguuuugcagagaaacagaccuaauaggauggagggagggauagacagauagauuaauugacugauuauaggaauuggcucauuaaauuaugaggccaagaacauccaccauccaccauuugccagcugcagaacaaggaaagucagugguguaauuuauuccaaguccaaagcccugagaacaggguuagaggguggggcuaguguaagucauggagucugaaggccugagaaccaggagcuucagugucugaggacaagagaaaauggauguccugcucuagcauacagagaaugaauucacccaucuccaccuuucuguucuauucaggcccucaauggauuggaugauacccauccauguuggugagggaggaucuucuuuacuaagucuacugauuaaaaugcuaaucucuucuagaaacacccucacagacacaccagaaauguuaaaccaguuaucugagcaucucuuagcccagucaagcugacauauaaaauuaaacaucacaacugaggauuguuuuuuuucucuuuuaacaacuaaauauuuuacuccacucucuucuugucugcaugauuucugaagagaagucugauauaauucuuauccuuguuccucuauaggauuuuuuuuccucugguuucuuuaaagauuuuuuuugucuuugauuuuguauacuuugaauaugauaugccuagguguagaauuuaugguguguauccugcuugguguuuucugagccucccagaucuguaguguagugagguaucucuaauugauuuggaguaauuuucaguuacuauugcuucaaauauuuauucuguugcuuuuucucuuucuucuccuucugauauucccauuaugcauauguuauaccuucuuaaacugucuuauaguucuuggauuguauguuuuuuaacuaucucagaguucuuagauauucuguuguuuuauucuucuuuucucuuucugguucaguuuugaaaguuucuauugacauuucuucagugucuccaguucuuuccuuggccauauccagucuauugcugagcccaucagaggcauucuucauuuuuguuacaguguuuuuuauuucuaacauuugcucuugauucuuucuuagaguuuucaucucuucuuacauuaccuguaguuugcuuuuuauuggauaucuauuuauuauauauacauacuuuuaaugaagcauaauaaauauaugagaaugugcacauaucaaagucacaacugugccaauuuuuacacuguucacuuuuguaaacaauacucagaucaagaaacagaacuuuagcaauaagaacauagcaacaaagugccuucucguccuccuucuuucuaguuacugccugccucuucaaaaguuacccuugcugacuuguaacuacuagacuaguuuaaucuauuuuuggaccuuauauaaauggaaucaugcaauuauauauauauauuuauuuuuaugacuggcuucuuauuuuccacauuaugugagcaagauucauccauauugcuguauauagguucucacuacuucauaaucuauauuguauuucauuaugucacuacaacaagguuuuuaaaaaauuuauacauggccgggcgcgguggcucaugccuguaaucccagcacuuugggagaacugagacggguggaucacgaggucaggagaucgagaccaucuugccuaacacggugaaaccccgucucuacuaaaaauacaaaaaaauuagccgggugugguggcaggugccuguaguccccagcuacucaggaggcugaggcaggagaauggugugaacccaagaggcgaggcuugcagugagccaagauugcaccacugcacucaagccugggcgacagagcgagacuccgucucaaaaaaaaaaaaaaauuuauacauguguguuucuauguguguguguguauguguguacauguaauuguguauucauacauucaucauucugcugggcucuuggaacuauuucacauagugcuauugugaauauccuggguuuuuuuuuuugauaaccauauaugugcauuuugguuggguauauccuaggaguagaauuucuggguaauacaguaugcauauguugaguguuaguauacacugccaaauaauuuuccaaaguggugguaagaguuuacacuuuuuuuuuuuuuuuuuuugagacagaguuucgcccuucgcccaggcuguagcguaguggugcaaucucagcccacugcaacugccaccuucugguuucaagagauucuccugccucagccucccaaguagcugggauuacaggcacccaccacaacgccuggcugauuuuuguauuuuuaguagagacaggguuucaccauauuggccaggcuagucucgaaccuugugauccgcccaccucggccucccuuauaguguuguaugagaguucuaguugccccauaucucaccagcacuuauuuuuuuauuuuagccagcccaguagguuuguaaggguaucucuuuaucauuuaauaugcauuuaucucuugaacaaugaacuugaacacuuuuuuaugcacacguauuuauuggccauuugaauauccucuuuuguaacauauuuguucaaaucuauugcccauuuuaauuagcuugucugucuguagcgauuuuuaagaguucuuugcauaucuggauguaacaucuuugagauagacagauagaccaacagaucuucucccacuguacaggccaccuuuuuuacugucuuaauggugucuuuuacuaaacagacuuuuuaaaguuuuaauaaauuuaauuuguuauuauuuauggacaagacauuuugaauccuauuuaagaaaucuaugauuuaccaaagucacagagauguuuucuucuaaaaccuuuauugugcugaauauauuuucccccugcaucugauauaaaugauaagcuuuuacauuuuuauuuccucuaccuguucucuucccuucauuugcaucauguugucaugacuauaguguagagaguaacuugaggguuuuuuuuucuaucaagacagguaaagaaugauugagagaucgauugguuagagcccugaguagaaauaauuaaacugaccuuaggauaaaggucaggccacaaggcuccacucuuucacaguauuaccauaauauuuucccacugccagauuuugaagaugccugggugaacauguccccacucguucuccguaagcauacucaucuaacuacagcugucaaccuuaauaguugcgcuacaagcaguuucuggaagaaaaauuauuuuuucccaacuuuacagauuauuuuaaaugacuaaauaucuuuuucuucuuguuccucagcuuauuuuuguguaacuccuuaauuguauuuuaugcuugacaaugggauuuuccaucagucuuauagguaucuucaauagcuuaaauugaagggaaugcuuucuagccucauuccagaaaagagaauacugauccaaagaaaugaauuuuuacccuucaugcuucugauuuaaaaaagcuagaaucaagguccuggcuuucuuuauucuuauuuugcucacugaguuguaucacuuucuaucuuaaauuugaaggcaaaacaaauuaaauguauauuucuuaauacaugaagcaaaguguaaucuuaaguguauaacuaaauguaauguuauaucucauuauauaccaucccagaucaaaauauacaauuuuucuaguaucccaaaaaguccugcucucaaaguaaccacuauucucacuuucaucccauaguuuagauuuacuugucuuugaauuuuauauaaauuuaaucauagcauccaauuuauuuuguucaacauuaugccuaaaggauuuauccauguuuuugcauguagagauggcuugaaaaacaaacuauauuugccuuaacaaaagaaaaguaacuuuuaggucuauuugguauaugauugacucuuuccuuuuaaccugucacauucucuaucccaauuagaagucgaaagcaaaguuaaguagaagaggacacucuucauugauauuccaaugugguagacuugacagagugccuugauuuagcacuuuagaguaccauagaauauggcaugagccaaaaagacugaaaagucacaaucucccccuauaauuaguuuuuaaagcucagagggcugcuuggcacauagaugaauauagaauccauugcccuuugcauugaauaaagguuacguucccuucauuacuaaaugaggcucuuuucuauucuuguuuuuuaacuaaaaaauaaaauguauuauuuccaggcuuaacuuugaauggagagaggaaaaauaggucacgcaagggcuuucauagaaaaaagaaaaauagcaaauauccuuuuauucccaaagaagcugaaagcaggcuuucuagcccauugucuuugcaccugccauauauauguauauauuuauccuuuugagaucaaugauuaucugcugauaaaaggcauuccugcuuucuggagauguaauuaacagaagggauaagguguuggggaagcaaagaggacagggaaggagcuagggaggccauguguauuagaaaaacagcccccaccccaaaugguuacccucauuucauucauacccugaaugaaagaagaagaaucaguucucuggagccugguuugaaaauucuuaaguggauaggugugauugguaggaccuggagcagaauuuucaggugauaaaggucaagcaauauauaaaaccuacagauuagucuugaaagaugcacaauaaagaauuaagauugugccuguaaucccagcacuuugggaagccgaggcgaguggaucacaaggucaggaguucgagaccagccugaccaaaauggugaaaccccgucucuacuaaaauagaaaaaaaaauuagcugggcaugguuauacgugccuguaaucccagcuacucaggaggcugaggcaggagaauugcuugaacccaggaggcggaaguugcagugagccgagauugcgccacugacugcacaccugccuaggcaacagagcaagacuccgucucaaaaaaaaaaaaaaaaaaagaagaaaagaacuaagaucaugcaguuuauuccagcagucacagcaauaagaguggucagugccuggcacaguauagcagcaguacgaauuuucaggaauuauuauuccuacucaacauaugaggaaacugaggugcagaggaaguaaaugacuuccccaaguucacacagccacuaagugacagggcuagaauuugacucuagguaauugacucugacuuccagagccaccacacuaugcugaccagccuaaaaauggaucaggaauuuguggauuuugacauuugaauuauuccuuuauuuucauugaucaucauaaucuugacugauauuugagucauuuuaugcuaaugucacagacauuuaucauauaagcauuuugacucuagauuuuguuaucauugguauucauuauauuauaccugauguauuauauuguuacagguucucuccuuuccaauaacagguuguuaaacagaauauccagcuauacuuggaggaaaaauaaucuauugaauauaggugcuuuaaaacugcuugucuuauuuuccucugauuuauauguuugacuaaucaaugcaaagaaaaaauaauaaucguuguugaagaugggggaaugaaacauaaaaaugauauaaaauaaauuacauagauuuuggguagagggugaugcaguccugaaucaggaagagagacuaaaggacauuuuguagcuauuuuuacuuauugaguuauuuagaaaauaacuucuuuauuuuaucuggagaaucaaaugagugguauguuuacuaugacuaccuuuugugguuuuaugaaauuaggaagucaacaugauuaacagcaaaauauucauuuccagcaagcaagaugguugaucuuaaguuauuauuuggcacgagucauauauuaaauguucagugaaaaaggaauaaaagcagaaagcagguuugcacuuuuacuuuucuucuguggaauccucuuaguaugcuaagagguccucguaccauagguccucaguaaacguugaaugaaugagaaggaucagccccuccucaaaugaaagaaauaaaauguaaaaaaaaaaaaaaauggggaggccucagccuucagugaacucucugaaaguuacaugcauaguaagaaauucccuuuggaaagccacuggccuacauucugguccucagcaccaucauuaacuaguuuguuuuguuuuuguccuuaguaggucuuuauaccucuucaauuuuuucauccaauucagauuaaacaauucuaagagaugcagaaaucuagcagagccaggaauguguuuagauguggaaauuagaugaauaaaguagagcauaaaugauuuucagaaaaguuccuguugggaauuugaaagguucucaacguaauauaagcaacagcuguuaaaaguuuccagcuaacuauagcuauugaagaaucuucagauaaguuugaaggaguaaaugaaaggggcgaagcaggaaaaaaagacuuuagcuaucuugaacaaaguguucauauuuauguucauaaauuggagacauuuauuucauuaucucuggaugcuuaauauaacuuuuaaaauauaauuauaaaaggaaagauaaaucagaaaacaugaauauauuaaauaagugcaagaguaaaaaaugcuuuacuaaaauauuuucuuugcugcaguuaaaugagaugaaggucauagauggauauagaacgcugccaggcaagucuggaugagaagcugacuuaaaucucaaaacuaaacagaaaagacaggucauuaacuggagacucagcugcaaacauaucaauuaauguucaagaugauugaauuaggcauuuuguuauuauaugaaaaugauaccauucuuguuagcauaagaguggcaguaaauggaagaaaacaaaauuuaaaaucuccccuacacaucacauuaaugcuaguguauuuggacaauuauuugagaauuauaauuaucuguuaguaucauuaaagugucacuaauuuguuuucuaaauuucauuuuuauuuaauuuuagauauaauuauuuaauuuuuuuccauuaagguggacauuuaauaccauuccucuuucauuugaggcuuaaugaaagaaaaaaaugcaauucuuccaagguagucccacuuagcccuugagaaagucaggcuggcaguggucaccugugccauugugguggugggcaggaugccugugaucaagccuggguagguugcaggcagaaguguuccugagacaagggcaagcggugagacgcucuaguagcacugccgaaagcccgugccugcuguaaucuuggccccacucugucucugcugaugccuguucucugcugcaagcugaaauucccugccagcgggugaaggaccauuugccuccucacaucugucuuucucucccuguugaauuguuuccacuuccuaguccaccauccucuuucauacucaccuuugccaucaagauucagcuuagguaucaacuccuccagcaucuccucccagaaacccuccucccgcuccacgcugcacccuccuccccucacucacagucugugggugagucaaaccaguaagcagacccuuaauaguguggugagugcuacugcuggagggaaaaauauggauaaaccuacacagaagaggccagagaacuaaaaagcauuagaaagaggaaggggauggaguuggagcucagaggaggggguccucacccauccaucaagcaagaggucagaagacagugucuaaaauuaacaucaacaaguagccguuucaacagauucuuuagagagauggugaaaaacuacuggaagaauuuagaaacaguaguaccuuuuuuuuuuuuuuuuuuuuuuuuuuuugagacggagucuccaucugucgcccaggcuggagugcaguggcaccaucucggcucacugcaaccuccgccucccggguucaagcgauucuucugccucagucucccaaguagcugggacuacaggcacgcaccgccacacccggcuauuuuuuguauuuuuaguagagaugggguuucaccguauuggccaggcuggucuugaacuccugacuucgugaucuauucgccuuggccucccaacgugcugguauuauaggcaugagccaccacgcccgguuacaguaguaccuuuuuagacaguuauauaugguuguuucuggggcacaagacugagacuggggagugguaggacaguggggucacuacugauuaguguagguuauuuaaccauggguaauuauuccuuugguuuagaauuguuauuuguuuuaaaaacaauucuccacacauccucaaacccugugacugcucugauaguuaccuacugcucccaaauacacugucauucuaacacuucuaucccagaaaaaaaaaauggaucaucuuaagccauuuucacuuuuuugccaauuuuacacaaagcauuuacucuucuuuauaguaucucuguuuuuuuacuuuccagcuuuuauuuuagauucagggguguguaugcagguuuguuacauggguaaauugcaugucauggggauuuagccuacagaauauuuugucacccaguuaagaaacauaguacccgauggguaguauuuugauucuaacccuccuccuacccuucacccucaaguagucccaugucuacugcucccuucuuugcgucaauguguaucucauuuugccccugccaagguucacaucucucucuuccuuccuccuaaaacccccuccccugcucauuccucaucccuucucuucucuauuccaagagaagagaaaccuuaccugacaccuccuugcuuuugccugaggucaauuguuuaaugucucugcucugaacagauuucaauucuucaagaggaaaucauauggcaauuugagaaauaaccaggauaaucaauaagcugguauacucaggggaaggaguucaaugcuauauaaaguauggcuuuuaaaccuauacucaguaguggaaaaaucagaguauaauguguucaacuuauaauaagugauuauugguuauuuuacuccuaucaccugguaaucuauuuugaaguucaggaauucuuuuuggaaaguuacuguuauaauuaugcacuguaucaugcauguuauacagugacuccuggcagaaaaacugcauaccuacagaaguccuagcgccuaaagaaaaaacaugaaccuaauuguuuauaccuaguguugcuugacaauaucuaugaagcaaaguuaguggccaagcuuauuugagugucuuagcuaaagaaagaugcauucuuuuuccaaacucauagagcauuuccaugcaauuguguuccaagucuacauaucauaacucugagcuggugcugucagcaucaaaguaacaugcugcuuugcaguuagcuuuuugcuuaguuucuaguaucaguuuucauggaauuuuuucauugucuuuacccacugauacaucaguguacucuucugcuugguaccaaaaacggggauacaaaacguggagaaacccugggacugagccuuggguuccugcccucugugccacuaacuccccguguauccccuccuccucugcaccuccagcucuuccucuguaaacgacaaccugugagucuccaacuuauuggcuauuuuuuucuuaagugauguuuguguguguguguauguguuuauguguauuuauuuguuuuaacuagccuguuaggucuuauuuaacauccaguaaagcucuguuuuuaagccagauauuuaugcuucagaguagguuggaaccccuuguguaaucaccuaguauauuucuacccauuuuguggaacuuugaauauaauuguacuauuuuuaguuacuacuucagguucuaguuuacauuuauggcauuuuuuuuuucaagcauucgucauuuauuugaugucucagaaacacaaccuucaauuguaaagcuguuuuaaaagaaaauuuggucaauuauuugauaauuaacuauuuuccagugagguuuccagaaaaacauugucauacaaccaaaagcugccuguaauugcuuuugaaaggaucaaguucuuagauaaacucaggauucaacacugauaucaaaggcauaagguuaaugaccagggugccuagccgguuuuauuguucuagaauuuaaguguuuaaugacagacaucauaugagucacccaauaguggcucaauaaauacuuguugaaugaauguaugucuguauucaugugcuacuugauauauaaguaauggauucaaauaagagaaaggauaguguaggaggaaucucagaauauggaguacaaagacuuaauuguuugcccaaauucugagcugcaguuuuauauuggcaauugaaaauuacucagaaauaaaaaaguuaacuauuuaaaauauagaauauauuguuaauaauauaggcaaaagaacaaaaguuaugcugcuaggaaagaaaaacuguaacuuaaacuaaaaguauaaugauagagaaauuuuaaagaauuucuucucauacacguuauauagagcugagucaaauaggaacagguguuuucaaaacauaauaaaucucucauacuaaugcauuugaacuuaucacacaccuugaccugugauuaacaucuuggccucuaauuggagaagcuguucgaauccugguguucugcuaccaacccagccuccauaagggugauguguuugugucuuucuuuuagaccaggagccugcaugguggcaaagcugccuuagcagaauggugucugcaauuuacucucuagaccuuugccucugccauagccuugguaacucuaaccuugcuucuucuagaagaggcuaaauuaugcauaauaguuuuucugugcucagccuuaagaacacagcacauaaaccacuccaaaauacuuacacaaggacagaaagauagacugacagaagaaacuaugcauuuaugcguuccuggauugaacaugucaaaacguaacugacugucauucuaaauuuucucucuccaguucugaaauuaaaauggcagagacaguuugcggggauucugauugcuuucguaauauugcuuaaguuuguaauuggugcauuaacuucuuaucguacauguuauauuuuguguaaaaccuucauuuccagaaacagcacgcugggaagaaacuuaaagagcacugucaaggggucuauguggaagugauucccaggagcucaccaucuuaggaacuauuuuggacaggaguaggagagauacugauuuugaaaaacccaacaaaaaauucuuuuucucacuucuuauuuguucccugagcuuaauuaacucuuuguuguuauuuuagaaauuugaaaaauaguaaacccacagaaaaguuaacagugcagugaaugcauauguaccauauacugacugagauuuccugaccacugacaucuugcuauacucacucuauacuaucuccaaauauauacacacauuuccuugccaaaccauucaaaaguaggccacagacauaauggccucuauucuuaaacucuuuagcaugcauuucccaagaagaaagacauucucuuauguacccauaucauuaccauauguauuaguuuuauguugcggccuuguaaccaauuaccacuguugucaauagucuuggccauuugagucuguccugaccuuuccccugcucuguucuuuauuacaggggaacugacuuugcaggcagcauuuccuaggcucuuagggcaguuaucucaggucugggcucagcaauaggaaguggugaugaaagauuuggggaauaggaccaggagagagagagagagagagagagggagagaaaauaaauaaaaugugaucagauacagcacaggucugcagaccaaucccugaaaccuuuuguaauguuucguucauaauugcaucaggucugcugaaagcgcagauuuuuuuuuuuuucuuuuuugcuuuccuuucaguagcuaacagaauucuuuaaagacuaaauggagacaauuuugagcaucuuuggcaaaauuuccuuaaaugaauucuugucagauagaccuuuuuaaagauuguaauugugugguaaaauuaaguuaaauagguuuaacacuccuggcaaaauuaccuuaaaugaauucuugucagauagagcucuuuaaagauuaucaauaauuaugugguaaaaauuaggcuuaacagguuuaacauucuucuuuaguuucauaggcuucuaugugagccuguuggccaacugauuuggaaggcaaguccucagaugggauccaguacccaaaacauucauguuuugaguucugauuucugcuccuggcugugucagaucaucuuugagcaauugcugagugccuguuaccucugaguuucuguuacuucaccuucugaagacaauguuaauuugcugccuguuucacucaaaaauacauagugucuucauuaaauaauguguuaucauaauaagcagaagaugaaggguacauaaaaauucaggccuagaaaguggaaauaauacuguccaguugccaggcagcagccauucuggcugcgaggucuucugcaggggacaagugacugugucuuccgcaagccuggagccaccaguccagaccagcuucaggccagugcgcccauugccucccaccuuggcacaaguaacuaauacccaauguccuccaguuuuaugugcugggauuccuggcgugcccauuugaaaguucucucauauguggugagacguuccguuuuucucuucacuaaaacgugaaguuguuuuuuggagaacauauggacaguauagaaaagcacaaagcaugauacauuucugcaguugacauuuuggcauauagauauccaaccuuuuuucugcucauauauuuauuuauuuucuuaauaucauacaguaccuauaguuguauaaguuuauuuuacacaacugcauaucauaaugaaaaauaagcuacaccaaacauuuuucuguguuaccaaguuuuuuauauacauaauuccuaaugacuucaugguuuuccauaguauagauagaucauaauuuaauaaaucagagggauuggaaaaaaaucuguagucaaacagcuaaagccaucccuuuaaaguuauucuaacacauaaaaaccuuccaccaagcucuuugacacacacaaauccucgaaggaaugauuuuuugugugaaaugguuauagcugucaaucacuuauucucugugucaugguuucugugcucuuuucagguuguuagggggugauuauggauuccugucaaaugagaugucugcuguguauucaacaugaagcaguuuguauuuuucucagucuauugcucuccugucugaggagguuaagcaaaucccagugagccagagggaaacgggauaggcaucaagcgcuggcagcacacggcagacaugcccagggcccaagauccccacucaagcagauuagacuucuuacauaaauacauuugucuuaauugucgcauuccaccuagggcuacaccuaauaugcauaaaaauggcuccaagccugguuuucaaagccauuugccccccgcuguugcuuuuucaccacccagcucagaggcauuuuuuguguuauaucuaucacagaugauuaaggggcucgaagaguugauauauaagggcagauuaagaaaacuaaauauuuacaaccugacugagugacagccaagggaaauacuguaaaugucuucugggcucaaaucacggaggagacauuguuuugcuuuuccuaguaaguggauuuuagagcuauccaaauucagagaaaguuuucuugggaugacaucucguaugcuaauuagauaaaugagucagcuagaaauugcauuuagcagcuacuaacagaaacuugaaauagcaguggcuuaaagaaguaggguuucauuuuucucugcuaugacaugaagcucaaaagcauuuuuauugucugggacugcacuauugcuccaugauggcaucagugcaccauugccccaccaucuuugggcuccauuaugcucagcacuggcuuccauacucaaggucacccgauguuugagaagagcuacugcagccccaguugccguggcuucauuccaugaagagagaaggcaaaagagucucugccaacuaagauugcuuaagagagcuuccuugaugcccaucuacugauuucaguuuacaucucacuggccaccacaucugcaagaagggcaggaaaacuuggugggguuuuuuguuuuguuucaucuuaaguugggcacauugcugaccccaacaacaucaggguacuuuuaccaagaacgcaugggauaauggauacuggguaggcagcuaaugguuucugucacaauaauuaacaucuugaaaauucugaugaaagucugggcuguaagacgcugugguugguauuuguaaaacuagcccuugauauguaacauacuuccuccugcucacucuuaccuaaauucauucaucaucccacuaaauaaacuagccaucucaacagaccuaagaauaauaacaacaauaguuuuuaccaaguaaaaacuguuugcacuguguuaugcacuuaaaagcauccccugaaugauuugccuuaaaauauucuaaaguggugauggggaggcauaaauaaggauaaauggaauaagacuuccaugaguugcuaauaguugaagcuggaagacaguuacauggggguuuguuauacucuucuuucuacuuucauaauuauugaaauuuucccaaugaaaagcuuuaaaaaucacacuuaauccuuacauuacuucauaucaggucaguucuuuuaccuccagauaauaaugcuuggaguuaagcagugucacacaacaagcaaguggcagauucaguauucaaaccuggguuuaucucacuuugaagucugugucccacccuugccacucaaggaaaacacuuuucagacaagcagccugggcaucaccuggaaaucaguuagaaaugcagaauucagggccccaccccaagaccuuuuccaagccccucagaucagauuggugcacacccacauuccaugcgcucgguucacugcucuucauugccucaacaucaacugugacguuuccuuuaaaaaagauaacccucggcuaaaauaaggaggcuagucgugacucauuacuugguaggauaaacauuuuagauaacgauuugauucacagcaguuguuucuuucaacauugggcaucugcuguagugcugggcacuaaacaccuaugugucaauuaagcaucuuucuaugugucaacaauuuuuauuaaucacugcaugcucgaaacuuaauuuggcuuguucuaguuaaauuaagcccuugcuucuucucagguaaggugugugagauuuuaaaagccuugggucuuacagaaaacucuccaggugccuauuucaaccuccuccagcaucagcucugcuuacccaccuguguguaacuuucuugauuuuuuuccccuaacauucucagucaucuuuuuuguuuuguuuuguuuuuguuuuguuuuuuuggagacagagucucaugcucuguugcccaggcuagagugcaguggcacgaucucggcucacugcaaccuccgccucccggguucaagcgauucuccugccucagccucccuaguagcuguggcuguaggugcaugccggcacgccuggcuaauuuuuuguauuuuaguagagacgggguuucacuguuguugcccaggcuggucucgaacuccugagcucaggcaauccaccugccucagccucccaaagugcuaagauuacaggcuugagccacugcgcccggccuucagucaucuuuucuaauuuuagcccucuuccuuuuuaaaaggaaagagagcuguggaaauuaggaagccugaguccuagcuuugccacucaugugucauguaggcagaacaguuaacuguuggagccuccaguucuucaucucugcaguggcugagcuauaugaucucaggucccuuccagcuucauccuuuguaacccccuguaacuugauuuuucaaccccgcccugcccccugcaaaacauuuugaagauauugggcucugcgugaaacccacuagauuauauuuuuccagucaguaaaaggaucccagcauugauuuuuuuuaauugguuucuuuuuccaaaugcuaaaugccuuaauacuuauacuuuauguguguuggauccuuuuuagaacaacuaaguaaaugaauaaaugaagccugucauccaucucaguuguaaccuccucuuuuaaagaggcuggaucgucuuugcuuuugaacauuauucaauauuuucuaggugccagauuaacuugguuauuuuauuuucacuacaauaaacuuuaaaccauguacauauuuaacacccuaagcuguuuaucaacuucuauagcauaagaagaggcaaggaaaacaccuacaggagagcaguauagacgccauccccaggaaccgucacuguauaaaucaggcccauacuggucccuguugaaggcacaaucauuggagucacuuauuucuucuuccaagaacuuuuucccuuaucagaaucauguuaagcaggcaugugauaguugucucacaaaguuaaaccuaggaaaaagagcacgcuguaaaauagugcucaugucaguccuugugcuaggugugccuaaaacaguguugcccgguccuaccuuuuccaugcuguauauaugaaguguguuucugauuugcuuuucagggcagcuuuuggcaaggagucugaaguucuuauugggaaccugggugauaaauuaaucccuccacaagacauccuucgugacgucagugaccucaaagccuuggccaacaugcaugaaagccuggaaugguuggcaagucgaacaaagucagcuuucuccaaucuuucuacaucccagaguaaguaucuaguaggaagcuguuguggggacaguugaggaacuagacugaaugcauucauugaaagaugagaguguacacuggucaccguaugggggcgugucccaagcugucagaagauccugguuagaauucugcuuguguugcaccucuuguacuuugugauucugggaaaggaacuaaucuugguuucccuguguggaaugugggaauccaggaaaggcccauguuaauguggcuugauauuaacauggccuuagaaacauaaauucaucuaggauugagccauuaagucucaagaacagaaagcaauaccuuuuuuccuccuuacaacaacuucucaagggcagaaacugucucggagcucagggcuguaugcacagcugacauucucauuuuacuugacauaaagcuaaucuuuuuauuagucauagaagugauuaaggugcuagaaaauagagucaaugaagacaacaauuauucuggaaaaaagauggcuaagagauagcaauuacagauuucaaagaaauuaaggaacagaacaugaaauuagggggaaccucuuuuucuaugaaggaccagugacuuagagaaaaauaauuugaaaacuuuagggcacauaaacuuuaauaacuauaaaauuauauuuaaagcauuacuucaggaguauguauaacacaguuaaaauagagacaaagaaaacaugauaugaagaaggcauaaaggaaaaggcagauuuauucuuuauuuguugagacagucucacucuguugcccaggcuggagugcaguggcacaaucucagcucacagcaaccucugccuccuggguuaaagcgauucucaugcuucagccucccgaguagcugggauuacaagugugcaccaccacaccuggucucaaacuccugggcucaagcgauccaccugccucggccucccaaagugcugggauuacaggcgugagcaagcacguccagaccaaaagacagauuuagaugugugaauggagagauagaaacaggauagaaaaagcaaaagaaacagcaggaaggauaaggaagcaaaaucaccucugaauuuaauauuagggcuauuagacaguuauuagaaagaaaacacauuauuuggacuguacaugucagagugagcuuuuuuuaaucaccgucauuugagaagguauuauuacuugauuaaccauguuuccagccuagagauggaaagguguggauuaaauucacagaguaaauuauucgcuuauccucuaagagucuaaggaaccccuugagugcucacuacuugcauggccucaugcugauucucugccuaucccaagggccaaugcagggugggaagaagggacugaagcagugggcuucagagggagaucauagaaucugcaccagaaaucuccuuaaaauauuacugcauauuuauacuuuuauucuuacgucuuuuauugaaaauacuacuuauuuuugagacagucuugcuguauuacccaggcuagucuugaacuucuggcuuuaggugguccucccauuucagccucccaaguagcugggacuacaagcaugcaccaccaugcccaacucuaaaagacugcuuuuuaucugaugaugaaauuauacaaguuuauucucagaaaucuauaagaauagaaaaugugucuaccaauuaaggauaguuugggcacaguauuacuuuugagcagauuuuacauaaggagguauccguaaaggccccuuuaacuuuauaaucccauaauaucaggcaguucuauuacaagcagcaguuuaaauuauccauuuugucucccaaacccacucugcucccuucuccccucuagaaaaagucagaaagaacuaauuuuuucuuugcuaauugcaaaaugagcagcucuaaaaaaggggccacuugccucuuuuccuaguuuucuuugacuugcaaaugcagagcugcuuagguaguuuauuuaguaauguuuggaaggggugcucucauuuaguaugucauuagcaucuaauauuuaaugcuacaaucucuuauuucuaaugacauaccauucuagauuucuauucugcccauucuaaaagggcuucacaaagcaagauaguacauaaccuguguagcaagccacugagugauuuacacaggcuaaccuggcaucaacuguuuucaaaaggagaaagaugcauucugaguuaugcuuaacuuuguaauugcacgauuuagcuguuguguucaugucacugaaaguacccaguaaaguugaugucuaauucaugccuauaaucaucucuguuauucugacaaagaucucaucuaccacgccuguuaauccuuugccucaugugcucaguuccauuuuauaauauaaguuguacccucucaguuccuugcagggugauuauuccacccagugagugauuuaaguaacugucagcauuuugaggaucagugcaaaacccaagugaacuguaaucacuacuuauggugucugcuaaaacaaagcaucaagcaagccugguuuauccuacuaacagcaagccuggcucacccccacuuaugugcucuuugaauucccaggagagaugcccauugauguuuauaauuugaacaaagcaggggauucucugauaauggcuuacuuugauugcccuaugucaaugugacucuagaaagggaacaaggggacagcuuuuuauuauuuuuuuuuuuuugaaaagugaaccaaaugauuacugcaacaaaaguguuuccaagucuggagacuagagaacaugaggaaaaugcucagcaggaugggaagaacucaagaagaucuucaguuuauuucuuguuccacauucuguuaacuauuugguaugguaaaggccauguuuuauuaagcuuaagaagcuauugcugugauaggguggaaaaaguuugcagaaaauuauuuucuuucuuuuuuucuuuuuuuuuuuugagauggauucaugcaguggcgcgaucucggcucacugcagccucugcuucccagguucaagcgauucuccugccucagccucccuaguaacuaggauuacaggugcccaccaccacgccuggcuaauuuuuaguauuuuuaguagaggcaggguuucacuacauugcccaggcuggucucgaacuccugaucucgugauccgcccgccucggccucccaaagugcugggauuacaggcaugagccacugcgccuggccgaaaauuauuuucauaguagaauaucucuucagauaggacaguaggagucucauccaccugaacauuucaugucagguauuacauuuagaagaaaguagagaaaaaaguucuacauuuuaguugcagagcauggcuggcuauacauuguucaggagguuaaaacuaauuauuuuuuuccuaagguaauuuuuucaucucuuuuaguguuugccuaaauguuucucuaucuccuuuacacauaaaagggucuccugguuguaucuagcuccugaccacaccaaagguaccacucuugcauuuccccuaccacacaguacacaguucccuguuccuucuccucugguauucuccccucagucuuucugacacuguuucugcuuaagauucuuucaguugaaagucacagacuuaauugaaggaaaaagaaugcauugacucauacagcagauaaaucaaaggacuucaagaguggcuggauccagagguucccaaaauaucgucaggucccaggcaugcuuacagauucucucucucucucucucucucucucucucggaucuaaguuucuacauguuuuccugcauucaucacaauuucaaccuuguaauaaaggcacaaauaaugcuggcucuuuguaaugccugcuguuuguaagaucccuaaauaaagacuccaaaauuguuaucauuaagaaaauucucagaacaauauaugaccuacauaaaaauuguuagacuauuuuucaguuuaacaguagugauuuucuuuugcaucuuauccucuuguuuuaaagauggauuguuuuuaaaaauagacuacacagaauuugaaggaggcucaagggcuuauuuugucaccauggcuuccuuagggaggcccuucucucuaucuuggauucuguaaaaaucucugggauuagagauucuacaaccuccuugauuauauauucuacuccauaccaucuaggaagucuuuuuuuuuuuuaagugaagccccugugcuucagucuaaaccucauucuucuuuuguacucucuucagaaauuaaauaauuacuauuaaugacuauuuucucuauaaaauauuguaaugcauccaaaaauauuucuguagccucuucuaauuuuuugggcaaauaaaucucauaguuuugguugccagaauugguuugugaauugcaguauuaguuauacaauuauuuauauacuuauuucuuacagguaaauuauuguuagguaucuuagaaaucaucuggucuaacucagucauuuugcauaugaggaaauuaaggucucagggugguuauaucaccugucugugccaaacugagauggagcaggucuucagaaucccaguuuaauuuucuuucuacuacgucaguuagagccacuaauuggaccguucaugccguauuccuauuaaaccauuccagcaggguuggcauauuuuguuuuaauggaagcacuuuaaugcuuacaagcaaguuguggucauuucugaucauuuucuugugccuaaacagaauuucuacaccuaaauauauggaauuauuguacaaaccccucuugaauuucaucuuaguugcaauaaaacauuucuguaauuugccacucucuauuuuuguuuugcaaguauuuucuaaguuagaaacuccaucugucuuguuaucaugccguguaauauauucuagauauugcauugcccuauauauuagccacuagccuuguguggcuauuuaaauuuaaauuaauuaaaguuaaaaauguaguuccucugucauacuagccaugucucaaaugcucaguggcuguuauauuggacaguauagguauagaacacuuucgucaucacagaaaguucuguuggccagugcuguagaucaucacugaggucauugauaaagguuaaaaauaaugccaguccauauucuuagccuuugaaagauacuugaaaugccuaccuaguucuaucaaaacauggugaacuacuuuaauuguccagccucagaucacauguacccuccugaugaagguugauguuuuuggcucugcauuaucaaaauuucuccuauugauguuaacuaaugcuaaagggaaaagguuuugugaucaaauagacuuggaaaauauuaaagcacauuaaauauaauucaauaccagaaaaccucuaaaaucuuuacuauauuaaccagauaauuacagcaguggaauguuucuuaaacuuacuuuucagugaaauucuguugucccagcguaucucacggggcuuuuuauccaugaaacaacuucugggugacacugcccaaugcuauauuuauguaauuuguuuagaauauuuuauuucucccggcaccaucaggcucagggcagauguuccacuauugcgggaacuuaauuucauauuauuggcaaauuugcauaccaucagaugacuuauuuugcaauuugguuauuugauuauuugauucauuuagugauuuuuagaaauguucaagucagccaauauaaaauaaccaugguuucccuuuccgccuguuucaggcuuggcuacugcuauagugacccuuuuccagucauugugcuuuucucacaauucucaaagauucuagcugcaauuuuauaacacaccccaauucaugcaauaaugucaauguauccaugguggggguccugggauugauuuaugauaaaaauuuuguuguauaauauuuuuagauuuaguguaaaguugcaaagauauuacagauaaucuccuuaucucucucauccaguuccccuauuguuaauauauuaguaugauacauauguuacaaguaaugaaucaauauugauacauuauuauuaaugaaagucuauacuuaguucagauuuucuuaguuuuucccugaucuucuuuuucuguucuaggaucucauccaggauauaucacauuuauaccacaguuuucccauaucacaguuaucacauauaucacauagugaugucuccuuaggcucauuuagacugugacaguuuccuagacuuuccuuguuuuuugugaccuugagaguuauaggaauucugguuggguauuuguagaaucuucuucaaucuggguuuaucuggugucuuuuccugauuagacugggcuuguggguuuucaaaaggaaaacuacagaggggagguaccauucucaugaaaucacaucaaggguacauaucaucaguguaacugauuacugaugaugucugggauugacuuugugccuccaauuuguguaguccucucuaggcaguuccuuccaaauuuuggauugacucuccacuuucugacuacaaauugcuuaucuuucuaguggcuauuuuuuuaacaugauagaagcaucuuauuauaagcccaauguuuggaugaguugaauacuugcuaagaaaaaugguugucuaccuuaaacaauuaugcaguugauaauggauuauaaucuugugggucugaaagacucugugggaggagcuguuuuuuaauaccuugagccacuugacuaaggccuguagcuacuuuuggguugcuacaugugcuaaacaucccuuaauaaauguauacaaccauauuaauuucaaacaaaaccaugcugacauuaaaagaguuuaacuaaauuucuucacuaaaaauaaagucuuauuuuaacccauuuuaauuaaacuguaaugugcauuguugacucaaaacccauucacaaguggaacucgcuuccugagauaaguccuuuuagaguagaauaccucauaauaccgagcugcacaucaguuauaaucaguuagagagcuguaaaaauacugauguagagauuuugauguaauuguuccuagguaugacaugggcaacaggcuacaccccagaccaaucaaaucagaggcagagaaaccuauguuguaaaggagugguuuucagccucaucgcauuagaaaugccugugcuuuuuaacauauccccaggcaauuuuaacaaacaaccaagguugagaaccacugauuuagagccccuaaaaauuucuucuuuaauuucugucacucucuauauuugggaaaugcuuuguaauuauuuugccaguucuucuauccucuggagcuugagauuaacgugauuucccauuuuacagagaagaacuguaggcauggagauacgguacuucguguccaugccagagucgggaccacagccuugcuuagcaguuguuagcuaaacugucacccaaaucugauuaacaacaaaaauguuccucuuacacuuuucaagccagcuaaaugagaagggcacaaggaaucugugucucucaacacaaaaggcugcaauugccaaaccaauggaaugaauguagauaugucauugaaaauaaauggaaaaggccgaggugucgguccacccccaucccccaaccgcacaguugcgcaauauuccagcauguuuuuuaugcauucccgauggugacuuaauauuuucuaugagauggaaugugaauauucucaugcuagagcucacuaucauggacucuuugugccuuaauaguaaaugaaaaauaaaaugcaaauccuccagcuguuuguuuuucugccuuggcacaaaugaaaauaaaaauuucccuacccaagaucucuugggaaucugucguguuucagguuugcuuuugucagaccauuaagccggaguuuuccuugucauaauuucaucugauucuuuuuaauuagaacucuaugcgugguaauuccucucucgcuucaguauuuacaaguuucaaauauuuguugacuguuaucagacaguuccuccucagccuaccuuacauguuuaguuucucuaaucaccuuucuaugguuagacuuuccgugcccuucaucguuuuucauucuuaguaguugucauuuuccuaagcugacuuucauauuguggcuucauuucugucauucuucuuuuauugacgauaccuuccaaacucauugccauugguugauuucaugaucaugcuguugacuaagaaaauuaauuuaccauugguauuguauuuuguucaugagcuucccacccccugccugacucuaaauauauuuuggccuuaucucauuaacauuacuuguacuucuguugagccuuucucucuuuuaaaaauaauguccaaauauauuuccauguugugcucaaugucucaacuaauguuuuguaggaacaaaagcaccaacugauaauuguaugaugauccaguuuuguucauuuucagucuuaaauguacucugcuuauauuuacaaacucguugaaacuuaucauaaugaagaaagaauuguguggaaagccgcugugcuuagcguguucaccugauuauucuuagcugucuucugaaaucuacguuauuacuaggaauggagaugcugcuuguucuuuuauuuucuaaggaauaccaucuagaccucucugucuccuucuguuuaucgugcaagcuucagacugaccccagugggguuccccguguuccuugguuuugagcauauuugaaauugcugauaacacaagaguuaccccuuuuuuaaaacacaucuacucugguuuucccuuuccugucauugaguguccucccuuggcuccccaaucaugguuacuuuugacucuccucacauagccuugucuuccuauuaauucauagagucuuugucauucuuauuccuuagucuaggagacauauagcacauauuugacuuugaagucugacgaacuuaaggacaaaucaggcaaguuaggguauaaccagggggaaacuauuuggccuguccgagcuaaauaggucuucucaccuguuaaauacaaauaaugaugcauacucauuggguugcucuaacuauuaaaugaucugaugaacuugaaguucuuagcagugugugauacacaguggggcucacuaugggguuucugggcuuccuaccaugaaucuuaucccuggagcucucauucauuguacugggucuuccccuuccuccugccccuucaggcuucucuuuuaucucaaguugugugguugcuuucaaaacuguuaauauguguguuccuaaaucauuuccaguaaaucauggcucucacucaccagagcucccaaaauguuucugaggucauggaagugugucugagaaugggccugcacuggagggccuacaggugcucaucugagaagccaggguugaauuugaaaaaggcaccuuuuguucuucaaaacuacaaaaacaaggcucagcuauuguugaaaaacaugccaaacccaaccacaauucccucugucaaucagcuggucguuaguagaguucauuguccugugcugauuagaaagcaguaccccaccccccuccguaaggaggugauuaucaacuguggagcuacagaaggcuagugcugugggcauuucaauguaauuauggaguucuaaguacuugcccauaaaaaauuauguggcuguuucuuuggaaaugccaacauuuguacccauaagggaaauauuuuauuaaaauaugauaauaucauggaugcuuaagugugguggcuggaagcugccagcugaaugauuuuaucuucaagcaaaacuauaaaauggaaacaacaagauaugaaagaaucucugggaaagaggagagacagaaggaguuagaaagcaagagaaggcucuaaaauggcaugcugaaauugcaaagccagacagagaagaugguggaaaugcagaaucaccagagccugagccgacacccagcacagcagagaggaggagcggcugcugcagcagagugacuugaacaagacaucugaguggauugauuugguugccacacagaaccacgaguuccaaugaggagcaguggaagauuguaccugaaggcgcugauugugcuauucaaucuggccucuuaucuagaaaaacccuuagacacuugggugcuuuaaaaccugggauaagcccaggaaccagugugaaaucaugacuuaaugaacuccucaccagagaaagagugugucuuuccauucuucacccuugaaacuaaguuuagaucuacaaaaugcagugggugagggagacagauccugacagggaaauccaaaagaagauggagggcuggcugaagugacauggaaggacucuccauuacuuggugggauugauuuuagaaaaauguucuaaauauaaacuggaugugcuuuuuuucaaacagcuuccuuauuaaucaauagugcauaaagacuuuuuccagacagcccaggaaaauguagcaaaggggcgagaugugcgaauuguauguguguaacagccccaaaggauacuacgguaaugauaauagacucaacauucagauuacauuucagacuuucaagaaccuuuguaaccacucauucuuaaucucuuaucccugccucaagccguaguugacagaccagccuuuauauucucaguuuuacaaggcaugagcaugaaaugcaaaaguuuggcaguuucccaaggucaaaaucagucaaugacaaaaauccagaccacaucugucuguucucagagugcagaccagagugucuggaaaaacaacauaaucaccuauuacgaguuacgagugacagaguuacaagcacaccaaaccagcgugccuuuguuuccccacggaggcaaugcuguuguucagcuaucucccaaagcuacagcagcaaggcgaaugcaaugcugugugccuaauauaaaugguauuuaauaauacacuuuaaaaggaggaguggagaaaagugagcuuaacauuauuugacucucuuucagaagcugagauguaaaagcugcaccucuuacccccaaaggaccuauuuuggacccaaauuugguagucaugcauucagggagagguucucuuauuaucuuaaauucaauacugugauuuauauuaaauauuguaaauuauacaauaaaagauuuccuucauauggguacagagauagaucagguauaggucucuaaggcacaguguuccuuauuaauagcaguuaauucuguguacuaacaucuuugagcucuggucguugaauccuagguggauuugacuagaguucuuaaccaacauuuuaauccaauuuuuaugaaaggaagaguaaugaggacuuuucucuaagacugaugaaaaaccuaagugucuuuauagaagccaagaauaucugaucagauucuucaaggaagcaaaaauccuguaaaugucagaaagaugaugcuggaaaaccccuuuggucaaauucaucuaaagaagguacuauuuguaggugacuuuucagcaagucugucaaaagcuucuugcuacagauaaaaauucaauaaccuuucacuguggaugugccacaauuaucacuaauuuaaaaacagucccucuaauagaguauuuuaucaugccggacagucucugcauuguucauuauuuaguguuugcuaagcugauggcacuuccaccaacuuuucuuaucucuacuucuucagaauuggauuuuauauuuccaaaccagccagauaugacaagucauuuucuucucucuugucuuuuaagaaacgcaaacuugauuuuuuuuuaacaaucaccacuuaaaagauuaaaguuauuggcaaugucuguauuaacuagcauugggaugugcaguaaggccuauugcauuuuaauugcaacuggggucuucccuucuucuuuuuuauucuuucucuuuuccaauacauguguauguauucucuaucucuuuggaacuccccauucugcuaaaacacacaguguauggcaaagaugagguauuaugaagccugauguaguuagaagacaaggcaaggagaguauuaucagaacuauuauauuauagaaccuccaaaagguggugauaaaugguauaaguagaucuuucaguaaauauagacugucuuuauaugagaaacuuccugaaaggaaaaugauaaagucauuauccugacacccgagggauacaugccacuucaaacaacaucucuuucuauccauagcucauuauugaaauuuuuaacuauuuuaagccugaaaaaauucuacuagcugugauucugaaagauuuuaaaagaucuguauacuuuacccaagcuuuggaccacgauaagacagccacacaucuucugucauugggaacucucuccuuaggccucagggcaucuucugucauugggaacucucuccuuaggccucagggucugcuccucuguccaagagagucucucccaauuuucagggaaguauagaacuucguucaagaaguuugaugauaagauuuugaccuuuuagggguacagucuuucaauagugauaucagaaugcugaaaaagauuguguuagaaaaucucaccaaaauauucauuuuaagauuuguggauuauuguuguaagcaucaaacagaaauagcauuguagucagucuucauacauuaauaauaagggcugcccuuuaggauuggcuuuacaaagaaaaauauuugcucaaacuuuacccagagacaggagaugccugucacgucugcuucuaaaagagggagugugacuaaaaauccaccaucuuauuacuuguuuaaugguaccacaaguccaauuaacgcauuuguucaagccaacagccuuuuagcuuuucacagaaaucuuggaagugugcuagagaaacacccccacaaaaagguuuugcauaugcugcuguaucugccucucuccaggaagcggagcaugggucacugacagacagauggcugccacaagcgccaccagcggccagaaacuccucccaccagcucccauuccugcaaaacaaaugaggaggggugcuuuucuugaaugcugugccuggacuuucucucccuugacccagcccuacccauggaauaccaaggcaaccucaacaucuguuacacuccugccuuaauucuauuccucagcaccagcauaacucaauagaggaguaugggcuuguccuuggacaagguacuugacauugcugaugaugucgucuguauuauaaaucccucauagguuauuuggaggcuaaggucaacuaacguauacacaacaccugguacaaugccugcaaacagugaucacgugauaaauaguaguuucuucugcuccuucuuuuuuaagcucuuuuccucauucuuagucuuccugagacuauuuuauuucuugcuuucucauuuagcuaccaauauuugcccauagugguacucaacaugaaaugcccaaaucugcccucuguuuauuucccccuacuccuguccuuccuguugauagcugggucauucugcccauucugccugauacuuuaacuucaucucaaaagaucuuugcuguauugcauuugaaauuagauuuugagcucuuaaauuuaacagccuuccaaaauccacauggcuugggaacacaggcauaggguaaggucguauuuauucagggccacaaugagugaaacuuaagguuaaccuccagaucucauuaaaugacuuccucugugaacuuguaugucagcauaucgagaaauauggcaaugaagaagcugcugaauuggccaggugcaguggcucacgccugaauccuaccacucuggggggccaaggcagguggaucaccugaugucaggaguuacuagccuggccaacauggugaaaccccaucucuacuaaaaauacaaaaauuagccaagcgugguggcaggcaccuguaaucucaacuacucaggaggcugaggcaggagaauugcuggaacccaggagguggagguugcagugagccaagauugugccauugcacuccagcccgagcugacaacagugagacugugucucagaaaaaaaaaaagaaaaaaaaagaagcuguugaauuguggcuucaguaaaaacuauaacaaaaauggcagaccagcuaauuucagagcccacaguagcucugggacucagaccuuuuaacaucaagggaaugauucugucuguauugaagugggcuuuggaauagcuguaguuaagaucuacccaagcuucagcugggcauccuccacaggggugacaaugaucugguuagcugcuuaccccuucucugcugccuaauaacacacuuacaggaauucugggagucucaguucugcuaggaucuuaggaguguuagcuaggaauggaaauuuguguucuuuuuuguuaucauuucagccauuuuuaaauguccaguuugguggcauucaguacauucacauuauugaguagccaucaccaucauccaucugcagaacuuuuuucaucuucucaaacuaaaacuccauauuccuuaaacaauaaucccucauuucuccuucccuccagcccuuggcaaccuccauucuacuuccuaucucuaugaauuugacuacucuagguggcccauauaaguggaaucauguaguauuuguuguuuugugacugacuuguuuuguuuagcaugaugucuucaagguccauccguguugaagcauguguuagcacucccuucuuuuuugaaagcugcaugauauucuauugaauggcuguaccacacuuuauuucuccauucauccaucaguggaugcuuagggugcuuccaucuuuugccuauugugaguaaugcugcuguaacauggguggacaaauaucuguucaaguccugguuuucagaucauuuggguauauacccagaagugaaauuguggaaauuagucauuugagauuagauguacugcacgucuuucuacuucuucucaacucucugauugcuuauauaagugacgucuucugaaggaaaguucagcauuuuuucucagauaugauaauaauauaugcuaagaucuuggccaggcacgguggcucacaccuguaaucccagcacuuugggaagccaaggugggcggaucacuugaggucaagaguuugcugccuucaaaucaaucauuacuucuuagcaccucuugaaauagaaaauaaaaaauuuggccaggcgguggccaggcgcaguggcucaugccuguaaucucagcacuuugggaggcugaggugggaagaucucuugagcccaggaguuugagaccagacugggcaacacagggagaccucaucucuacaaaaaagaaaaaaaaaauuaauuagccagguguggccccauuuguacaaaaaaaaauuuuuuuuuaauuagcugggcauggucauguacacauguggucccagcuacuagggaggcuaaggugggaggaacgcuugagccugggaugucaaggcugcggugaggugugauugcaccacugcacuccagcccagcaacagagaaagacccugucucaaaaaggaaaagaaaagaaaaaaauguaaaagcccuagauaguacccuccuuucacuccuagagaauucaaaauuuacaauggaaauuuaagcuuacugucuuguucucuagaucagcuguuuacaauguuggcuauaugccccccaauaauuguguaaaacaauacauugaagcaugggaaggaaacaugagaccauuuauguaugcuuuuuaaaaguaaaacaaucagaaacauugcaaguuuuacuaauauuuaacauaagagaugacaugauagcccucauuugagccauaugugaaguacuauaugggaggaauccugcaggaaccccaaggauuccucagcagagagaggcucaaucuucugccauuuuuaaaaauuuucaacauuuuguaauauguuccaggugaaguagauuuauggauuacauuuucuaguuuuuacuaaacuuaccuuccccaaauggauaagugacuuaaaagggaaacuguggauugacacuauaagcaaaaaugaacaugagaaaauggcagaacuggcauugucacuguuccugguggggaucuucaucagucacauuauaauuaucuaagcaguaauaaucuaucagaugacuggaaacuggcaaaagaacuugucaaggauauuauuuggaauacggauuuacaucuacaauuauuaacaugaaccuugcucuaaguguaugugugccuugaaauauuagcuaauacauguugaagcuguaaucauuaggaagacauuuaagaauaucacuuguuucaucuuuagcuuacuuuuuauugauuucuuuucugguuauauuuuuaaacuuauauaauguauuaguaccaguauauauaaauaacuaaauguacauuuacuauuaaucuggacacaaauauuuuucgcuguuggaauauauaaucaaagagguuuggaaauuguuguguuacuggauccuuggggugucccuucaccagcaggaagccucuguggccacuggugccuuugcccgaguuuugcucaggaccacugggcucacuugaccuggcaggcugugcuuggcuuggcuuggcuugugcuaccggccuggaucccaugccugucaagggcaaguggagcagcaagaggggugugagcaagugagcaugggcuccagccacugcucacagccagauacacuggcugcagugggauggacaacuccagggaccagcauaggcaccagcugucugugaggcugcagcuaaaccaggcauaccacaagcagcuuccacaccuggcaccagggaacacggugguacacggaaguuuggagacaccaggaacugcggagccccaaaggggaugucacagcccuggcucggggagcuccuacaucugggcuucccaaggggccgcagcucuucucuccucucuucuguccuuguugcuugcaacuuggugagcaaggggagugucucagcccuguuuauguuauaccucuuuuagcccugccauucggcagguccugauuucuuguccugcauccaggaagaaugaguuacauguucaaguguugugugagcagagugaagaggagcuuuauugagcaacaaaacagcucaguggagaccugcaguggguaacuccuuucuguagcaaaggcaucccaaugaguauucagcucucagcauagaggagacccugugguggguagcuccucucugcagcugguugucccgucaaguguucagcucucagcagagaggagacccuggaguggguagcuccucucugcaggcaggucauccugucgagugcuuaagucuggcugagucuggggcuuuucugggcuucagaggggaggaaguguguguugauugguccaugggugagccuggaaaaaguaacauaaguucccacucugguccaugggacuggcagccuggcccccaggcuucagaccuuucuuuacuuaaagguggggcuucaccggggaccuggcccugucugcccuggagcuugucugccuccugcugcuguucauggugcccaggcuguuugugccaaggggcaccuacaggccugcaccaugcugcccucagcaccccaucugccucccuccugacaagccagcacccaaaggccagaaggggcuggcgugucagcacuucccugagugcgugcauacgugaccagguugcaacagugcccaggcuuagccucaacuuugcucugagaucagagugggcacugggagcagggagaagccaggcagugagaguaggcacuucugagccuucaggggcaguuggggggcuucccaggccccugagaguccagagaugcccagguccacagcuccaguuuggguggcagcagcugcaccugggagggcagggcuccugccugcuccuggcccccaagagcacagggaggccuggguccgcagcugcaacugggggccaucaauugcuuuagacacuauugucuccaaaugaaguuguaaugggaccacagggacaguaguaccauugcuuuuuauguucuuuuuuuuuucuuuguuuuguuuuuagaugaacacugugaauuguagcugauaauaugacauaauuaggaguuuagcagucuccagauucuuuccauaaaacuuaaaguaaguguuaaaagauagaggcggcucaaauaggaugggauuuucugacagacaagcagacuaacaacaguucuuccucccuggaagcucuuuugucuguuuuaaucauugcaaagugaagcauauaauggccaaugcuggaguguacagaaacuuggccuuucaguuaucuguaccuaguauuagaacaaaccagcccagauacuucucgcaauucagugaguugacugagcagcuuuucuagccagagcuccucaaguagcugugcucagcuggcagcucagugggggcugcaucaugugggggaacugggggccucucuccaugugguccuuucaucugggcugcuucagugcacacaggucucagggcagcuccaagaaggcaaagacugaagcuagaauagcuaaggcccagauucugaaacucacauaacagaacuucagccauauccuaucagucaguguaagcuauaaagccaaucaagauuuaagaggugaggaaaagacucuauuucuuaauggggaaaagcugcaaagaauugugaucauacuuauuccaccacacugguaaauuaggaagaaacaauaccaaaaaagauauuuauaauuaaucacuuuggccuguacagagagcauguuuucuaugcauuuccuuauaaaaaguguauuuuccacgugauaauaccauugauuuuuuuuuuugucaaugugagaacuauauagagaggcuaaaaugugcaacugaaaugaugcaucuuuucaguguuccucaguggcauucucaaaaugaucguuauauucauggcuuaaaauuaacuaaauuaaguuuucaaugcaaguguucccuaaagucaaagcuuuucuucauuucuucauuagagauuaauuuguagcaugucucauugaauggauuguucacagugauuguuuuucaguuagaccucuuagaaauaguuuuauuuuagaaaggcagaauaauuauagacuguuaaaugucuaagugacccugaauaguucuaggaagguguacagaauacugauacuuccuuaaugccauauaugcuggaaauuuuagaguaaauauacauuaauuaaaauaucuaccauaacuuucaagcacuuacuuuugaauaacuguagucuuuagucuucaguaaaauccugaugcaaaguacaacuuagucuaaauuaggauuuuccugauagagucuaaggaguacaagccacucuggucuuuggaaagucaagauucuuaaauguuaauguggcauuuccuguguugaccauuuggauaauggauuacuccaucauuucuuuuguauacccacccuuuauaaggauuauuucuuaauccuuauauguuucacauacaucaugaaacaacaaaaggcuucauuaucaggagcuucuauucgcuucagcagaaccauuugaaacaucuaaacaguugagaaaugcaucccaguaauauacucagaaggccuaggaaacaagaauagugaaaauagcuauuaacucaaauucauuagggguuaauuagccauguugcaaucuccuuaauuuucuacuuuccacacugaauuagucauguguauuacuuaacccagccacuauugccagaucaguuagcacuacgauuccuuuuccucagcaaugcuucauauuaugacuuagaucauaaaccagagcaccagguagaaaucacagccaaucugagugugcugcauggggccucgugauacuuccuguuaauuuagauguugacagggccaguaucaguaaugaaauuaguucagggcauaacuccuugaacauagcaggcacuuaguaaauguuuuaucaaauugaauuaaauuaacaaaaugcuuccagugagggccugaaaucuucuaccuugcuuuuauuugccaaauuggcuacuuaaucaaaugaaucaaccauuuuucuuauuuuugcaaguacuaucauuucuuuuccuuuuuuuuucucccucacauuucaaaaacugauaguaacaauuacuaaugucuuauaguacugggacguuccucucuagucauccauuuaucucugcuaagaauuucucuuaggauuaaauaguaugauuacuauuuccacauauuuccacaguauuuuggucauuaacauacauauuuaaagcaauauauuuaauuauaugccuauuuuaucccuugcuaaauguggauuuuauuuacugaaacuguucucucugacuuucuacuuugacuucucuuucuuuuucuuaaacaaucuuuccuauaguaccuacucuggcacaaaaaacacuguuauauuccagaaguucuuuuuuaacccaaaaguuagagaauuggcauagcuacugacauugaaagaggaaaugaagauaaggcuaaaaacaggaggacuuguuaaaagucuguuuaggauauauuuacccucagauuuuucucucuuacuucauauaccugugccacugcuucuaucagaauugcagcugagcacuggaguuuuaguuucugaaaaugguaaaauagagauuccuuggacugagggacauaagucauagcugagugugagggcuguuauucugaaaucaggcaaaguuuacauuaaugacugcugacacuucuguucuuuuuccuauuggcuggcauccaggaauauaacuucagacaaaagacuagaaagucuuuucugaaaaaucugauaagcaccaggauggugcagguguaggcgggagauagacacuaacaucagugguucuccaauaaaagagaccagccagaucaccuacaaagacaacuacaaugcaucagccuuaccuccagacacaaaacuccagucagccccacuuaaauaugagcagacagccaagaagaguaauguuugaggaaaccuuauaauaggaaacagagaccaaaacaaacaggaaaagcaacuuagaggaaacagggauuauccagaaauuaagaaaaacuuaaaaaaugaaaauuaauaucccuagaagaaauaagagaagauauuguauucaugaaacaagaguaguauaguauaugaaaggaacuuucagaaaacaagaacucuuagaaauaaaaaauaaagugaaauaaaaaucucagaagauagaacugaagaaauauccaugaagguggaaaaaaaagacaaaaaagaaaaaggacccuaggaagcagcaggauauuccauaacugaauuuuaggucuacagagaaaaaaaggagagaaaauagagagggccauaaaaaaaauuaagaaaaauucccaaaauggaaaacaggaauucucaaaaugaaaggacccaguggaugaaaacagaccuacauccucaccaaggcagucaucucaaaauugcagaacccucaaguuagaaagaaaacccuacaacugucagaagaaaaaaaaaauaaaaguuuuucuagaaaguacaucuagaaaagaagcagaaaagcaaugauuugucaaaaguggcagaggaaguuaggugacaaaaagaaaaaaaacuaucagauucuaagaaaauugauuuucaaccuagaauuguuuaucuaaccacacuaccaguuccauguaagggaagaauacggacguuuucagacauacaaguucucagaaaacuuaucuuccaugcagucuuccauagaaucuaccaaaccgaaggaguuuacauaaaaauaggaaaacaugggcuacaagaaauggggauucuagaguaguuacggaaagagaaagaucuccagagugaucaugacaggauaugccaagauaacagcucugccacaggccuaggaagcagcuagcccagagaggaauagcugaucucucaggagagcuuuguggaggagcaggauguugauuagaauaccuaauguguuaggauuuauugaaaaaaaaaauuguccaucauaagagaguuuggaguugaguacuuuaaacaacgaauaaaacuguuauaaggaauuuagcaucuauguucaucaaggauauuggucuguaguuuucuuuuuugguuauguccuuuccugguuuugguauuagggugauagauacuggcuucauagaaugauuuagggaggguucccucuuucucuaucuuguggaauagugucaauaggauuaguaccaauucuuugaaugucuggcagaauucugugaauccaucuggucuuggacuuuuuuuuguugguaauuuuuaaauuaccauuucaaucucacugcuuguuauuuaacauacacaagucaauaaaugugauacaccacauaaacagaauuaaaaaccaaaaucacaugaucgucucaauaaaugcagaaaaagcauuugacaaaauccagcaucccuuuaugcaucccuggugugaaacccacuugaucauggcggguuaucuuucugauauguuauuggauucgguuagcuaguauuuuguuaaguauuuuagcaucuauguucaucagggauauugcuguacgauugauuauaagaucacagaacuugcaaguuugacagaaccucagccaguagucagcugcaaugacaagcacugccauuuauugagaauuuaugauacacaagaugcuauacugcagauuuuaggauaucgucucuaaucuucacaauccuguguaaguuugguaggcagaacaaauggcuccccaacgauguccacguccuaauccccagaaccuacaaaaaugugaggcaaaugacaauuaagguucucggcucaccugagaauagggagguuaucuuggguuaugcaggugagcccaguguaauuuaagggcucuuaaaaguggaauagggagacagaaaaguagauuagaguaaugcaaugugagaaagacucaacccucauugcuggcuuugaagaugaggaaggagccaggcagccucccaaagcuggaaaaggcaaguaaauggauucaccccuagagccucugacacuuauuuaaaccaaugagacucaugucaaacuuuuuuuuuuuuuuuuuuuuuuuugagauggaguguugcucuguugcccaggcuggagcgcaguggcaugauuucggcucacugcaaccucugccucccagguucaagcaauucucaugccucagccucccgagaagcugggacuacaggcgcacgccacugcaccuggcuaauuuuuuuuauuuuuaguaaagacgcgguuuugccauguuggccaggcuggucuugaacuccugaccucaggugauccaccgccugccuuggucucccaaagugcugggauaacaggcaugagcccccgugcccagccucauauccaacuucuaaucuccagaauuguaagauaauaaauggauguuguuuuaagccauaagguacaugguaaugucacagcagcacugggaagcuaacacaguaaguauuaaugccuccauuuuucugaugacaaaacuaaguuucaaagauugaguaacuuuacaaaaaccaugacuaaguaacuggcacaggcaggacuggaaccuaggccaguguaacucuuagaccagacucuuucaacagcaguaauaguuggcauuuguagaacaccaaccagguaggaagcaggcuguggucuaugcacucuaaugugguaccucaucuaguccuuacagcagccuaugggggaaggugguggccgcccucauuucucagaggaggaaauugaggccaagcuugguggaaacaggauuuaaagcuguacagucaaacuccagugcccacgcacuuaaucucaacaccucuuugcuaucuccuagcaguuuaugaaugagaaaaccgagccaggaugucugacucucuccugaggucacacaucaaggugcugccacagccagaucuagaacccagguuaacucuugucucaucuagggccuugucuucuugaagaacauacuuacuguggaaauacaggugaaaauuccgcaucaaacagagauaccaaauaacagcucuaaauagacagugaugcauuugcucucuccuucuuguuaguguaguuuaauuuccugagaagcuuuacacauaccccugagcuuuucugucacagcuaauugugcaacuuccaaguaguuguccugccuauguuuguuacuugggcucauuaacauacccuuuaccguagaugacacucucauuagguuaaauuaauuaaaagaugaucauuggggcuacauagcuucagcccgggcagagaugugccaccuucgacccucugguucccuucgacagccucuguggagauguacccccaagacauuuaaaaggcugugcucuuauuuucugucacucuuuauauacuaucuaaaucuuaccacacaaacaacauuuagcaugcaaguuaaacagauuuaaauuuaagcaaaauugagugucaccacaugugcuuaugccagaucuguauaauucuuuugagguuuuuggaaacgugaaccaagccauuuacgcuucauaggaacagauuauaucauuugaaauccucaauaaaaaugcagucucauauucuacagaugggugucauuuaauuaaaauauguauuuaaaaugcaaagggcuacguuaauuccacacuguggcugagauuuuaauugcacucaaguuaggaaauucggaguuaauguuccccuggcaucucucauucagccucuuagaacagauguauugugauccaaagaggauuucaauauguuuucacaugcugcacauguaggaagggcuuugagauacaggguggcagcaugauaaaaacaggaguugaucccgagcaaaggaagggaguaccgcagccuguggcugccuucccuguccccgcacuucaccagguagcccuugcuaaucacucacggcaguugugccucgucccacuucccuagaucagguaucacagaaagguuguuggggugcucccauuuuuguuuugguggggcagaggggaggcaucuguaguacucagaacuguaaaaaugcucauaaauuaaaaacucagugaaugcuuuuuaguuguagaguacauuuuaggguauacauuaaggguuuaggguacacaucagccucgcauaaguacuguuguaauacacuagaaaaucuauuccacagugcaacacacacauuuugaacccucaggaauuucucuuuagaccaaaggcagcccggaggcaaaagaaacgccaacaccugaggguguuucugacaaggcaaggagugaaaggaaagugacaaauagauguugugggccucagaaccccaugaaauaacugcagugugaaggauuugggggaaacacugguuuuacgcuuaaauuauuagagaguuauccaugauauuaaagugucaaaaaggaaagaauugagaauucccaugaaagcagagaagaacgugaaauuggcacugaguaagaaaguauauugucuuuucauucauucuguuacuucaauccuuuaagccugcucugugcccaggacuguguuaggcauggggcauucaucacugaccauuagauauggugucacuuuggggauuacaaccuaauggggccauuaucuacauaagacaugaguuaaauuaaugcagaggcuucuguuuuauuuuuaacgugguuaccuaggaaauacagacaauuauggagaaaagaagaaaggaguaguucaucuugaaaggaugacuguuaagaauguuaaguacagaaauagggacuugucuuauauauuuuaugagaauguuuuuauuauguauguaugccccugugaaaucuuuuuaauuaaaaucugcaaagcuaguaugagguaauauaugagaaagaacuuuaaguucuuagaaaaauaggcaguguguaagucuuuggggaagaaaguaaaccccaaaccuccuuagaaaaaucagcaaaagaaccagucauagaauucagaccuccuggcuccuuguccaguucguuaugucagagucacaauuuuuuauauugcaaaacaaagccagcuaaguugaagaaccaaccauauuuuucucuugaguuuuuuuuuucuucuucuuucuauauacuuuaaguucugggauacaugugcagaaugugcagguuuguuaccuagguauacacgggccauggugguuugcugcacccaucaaccggucaucuacauuagguauuucuccuaaugcucucccuccccuagcccccgaccucccgacaggccccagugugugaugauccccucccuguguccauguguucucauuguucaacucccgcuuaugagugagaacaugcgguguuugguuuucuguuccuguguuaguuugcugagagugaugguuuccagcuucauccaugucccugcaaaggacaugaacucauccuuuuuuaugucuguguaguauuccaugguguauaugugccacguuuuucuuuaucuagucuaucauugaugggcauuuggguugguuccaagccuuugcuauugugaacagugcugucauaaacauacaugugcauguaucuuuauaguagaaugaguuauaauccuuuggauaucuacccaguaauggaauugcugggucaaaugguauuucugguucuagaucugugaggaaucgccacacugucuuccacaaugguugaacuaauuuacacucccaccaacaguguaaaagcauuccuauuucuccacauccccuccagcaucuguuguuuccugacuuuuuaaugauugccauuguaacuggcgugagaugguaucucauugugauuuugauuugcuuuucucuaaugaccagugaugaugagcuuuuuuucaucuguuuguuggcugcaugaaugucuucuuuugagaagugucuauucauauccuucacccacauuuuguugggauuguuuguuuuuucuuguaaauuuguuuaaguucuuuguagauucuggauauuaacccauugucagauggauagauugcaaaaauugucucccauucuguagguugccuguucacucugaugauaguuucuuuagcugugcagaagcucuuuaguuuaauuagaucccauuugucaauuuggcuguuguugccauugcuuuugguguuuuagucaugaagucuuugccaaugccuauguccugaaugguauugccuagguuuucuucuaggguuuuuaugcuuuuagggcuuacauuuaagucuuuaauccaucuugacuuaauuuuuguauaagguguaaggaagagguccaguuucaguuuucugcauauggcugccaguuuucccaacauuuauuaaauagggaauccuuuccccauugcuuguuuuugucagguuggucaaagaucagaugguuguagaugugugguguuauuucugaguccucuguucuguuccauuggucuauaucucuguuuugguaucgguaccaugcuguuuugguuacuguagccuuguaguauaguuugaagucagguagcaugaugccuccagcuuuguucuuuuugcuuaggauugucuuggcuauacgggcucuuuuuugguugcauaugaaauuuaaaguaguuuuuucuaauuccaugaagaaagccaaugguauuuugaugaggauagcauugaaucuaugaauuacuuugggcaguauggccauuuucacaguacugauucuuccuauccauaagcacggaauguuuuuccauuuguuuguguccucucuuauuuccuugagcagugguuuguaguucucuuugaagaguuccuucacaucccuuguaaguuugauuccuagguauuuuauucucuuugcagcaauugugaauggaaguugacucaugauuuggcucucuguuugucauuaaugguguauaggaaugcuugugauuuuugcacauugauuuuuguauccugagacuuugcugaaguugcuuaucagcuuaaggaaauucugggcuugagaugaugggguuuucuaaauauacaaucaugucaucugcagacagagauaauuuaacuuccucucuuccuauuugaauaugcuuuauuucuuucuuuugccugauugcccuggccagaacuuccaauacuauguugaauaggaguggugagagagggcauccuugucuugugccauuuucagagggaaugcuuccagcuuuugccuauucaauaugauacuggcugugaguuuaucauaaauagcucuuacuauuuugagguacguuccaucaguaccuaguuuauugagaguuuuuagcaugaagagguguugaauuuuaucgaaggcuuuccugcaucuauugagauaaucaugugguuuuggucauugguucuguuuaugugauggauuauguuuauugauuugcguauguugaaccagccuugcaucccagggaugaagccaacucgaucaugguggauaagccuuuugaugugcugcuggauucaguuugccaguauuuuauugaggauuuucacaucaguguucaucagggauauugcccugaaauuuuguuguuguuguuauguuucugucagguuuguguaucaggaugaugcuggccucauaaaauggguuagggaggagucccucuuuuucuauuguuuggaauaguuucauaaggaauggcaccagcuccuuuuuguaccucugguggaauucagcugugaauucgucugguccuugcuuuuuuuuggugguaggcuauuaauuacugccucaauuucagaacuuguuauaggucuauucagggcuuugacuucuuccugguuuagucuugggaggguguauguguccaggaauuuauucauuucuucuggauuuucuaguuuauucacauagagguguuuauaguauucuuugaugguaauuuguauuucugugggaucagugguaaucuccccuuuauaauuuuuuauugcaucuauuugauucuucucuucuucauuagucuggcuagcggucuaucuauuuuguuaaucuucuuaaaaaaccagcuccuggauucacugauuuuuuuuuugaaguguuuuucgucucucugucucuuucaauucugcucuacucugaucugaguuauuuauucucuucugcuagcuuuugaauuugcuuacucuugcuucucuaguucuuuuaauugugauguuagggucucaauuuuagaucuuucccgcuuucuccuguggacauguagugcuacaaauuucccucuaaacacugcuuuagcugugucugagagauucugguauguugugucuuuguucucauugguuucaaagaacguauuuauuucugccuucauuuuguuauuuacccaguugucauucaggagcagguuguuuaguuuccaugaaguugugugguuuugaguguguuucuuaauccugaguucuaauuugauugcacuguggucccagagacgguuuguuaugauuuccguucuuuugcauuugcugaggcauguuuuacuuccaauuauguggucaguuuuuagaauaagugcagugugguacugagaauaauguauauucuguugacuugggauggagaguucuguagaugucuauuagguccacuugguccagagcugaguucaaguccuggauauccuuguuaauauucugucucguugaucugucugauacugauagugggguguuaaagucucccacuauuauugugugggagucuaagucccuuuguaggucucuaagaacuugcuuuaugaaaucugggugcuccuguauugggugcauauauauuuaggauaguuagcucuucuuguugcauuaaucccuuuaaccauuauguaauguccuucuuugucuuucuugaauuuuguugguuuaaagucuguuuuaucugagacuaugauugcaaccacugcuuuuuuuucucuuuuuuugcuuuccauuugcuugguaaauauuccuccaucccucuauuuugagccuaugugugucuuugcaugugagaugggucuccugaauacagcacaccaaugggucuugacucuauccaauuugccagucugugucuuuuaaauggggcauuuagcccaguuacauuuaaaguuaacauuguuaugugugaauuugauccugucauuaugaugcuagcugguuauuuugcccauuaguugaugcaguuucuucauagugucaauggucuuuacaauuugguauguuuuugcaguggcugguaccagcuuuucuuuuccauauuuaguacuuccuucaggaacucuuguaaggcaggccugguggugacaaaaucucucaacauuugcuugucuguaaaggauuuuauuucuccuucacuuaugaagcuuaguuuggcuggauaugaaauucuggguugaauuuuuuuuuucuuuaagaauguugaauauuggcccccacucucuucuggcuuguuggguugcugcggagagauccacuguuaaucugaugggcuucccuuuguggguaacccgaccuuucuuucuggcuacccuuaacauuuuuccuucauuucaaccuuggugaaucuaacaauuaugugucuugggguugcucuucucgaggaguaucuuugugguguucucuguauuuccugaauuugaauguuggccucucuugcuaggcuggggaaguucuccugaauaauauccugaagaguguuuuccaacuugguuccauucuccuugucacuuucagguacaccagucaaacuuagguuaggaguuuucacguagugccauauuucuuagaggcuuugaucguuccuuuucauuuuuuuucucuaaucuuggcuucacgcuuuauuucauuaaguugaucuucagucucugauauccuuucuuccacuugauugauuuggcuauugcuacuuguguauuauucacgaagcugucaugcuguguuuuucagcuccaucaggucguuucuguucuucucuaaacugguuauucuaguuagcaauuccucuaaccuuuuucaagguucuuagcuuccuugcauuggguuagaacaugcuacuuuaccuuggaggaguuuguuauuacacaccuucugaagccuacuucugucaauucgccaaacucauucuccauccaguuuuguucccuugcugaugaugaguugugauccuuuggaagagaagaggcauucuuauuuuuggaauuuuuagccuuugugugcugguuuuuccucaucuucguggauuuaucuaccuuguucuuggauauuggugaccuucuggugggguuucuguguggacguccuuuuuauugauguugaugcuauucuuuucuguuuguuaguuucccuucuaacaggccgcucugcuguaggucugcuggaguuugcuggaaguccacuccagacccuguuugccuggguaucaccagcggaggcugcagaacagcaaagauugcugccuguuccuuccucuggaaguuuugucccagaggggcaccugccagaugccagcuggagcucuccuguaugaggugucugucgaccccugcugggagguaucucccagucaggagacacgggggucagggacucacuugaggagguagucugacccuuagcagagcuugagugcugugcugggagaucugcugcucucuucagagcuggcaggcaggaacauuuaagucugcugaacuuacaauuuucccacagcugccccuucccccaggugcccugucccagggagaugggaguuuuauccauaagccccugacuggggcugcugccuuucuuucagagaugcccugcccagggaggaggaaucuagagaggcagucuagcuauagaggcuuuggggcacugugguggucuccguccaguucaaacuucccaguggcuuuguuuacacugugaggggaaaacugccuacucaagccucagaaauggcagacaccccuccccccaccaagcucaagugucccaggucgacuucagacugcuaugcuggcagcgagaauuucaagcuaguggaucuuagcuugcugggcuccgugggggugggauccgcugagcuagaccacuuggcucccuggcuucagcccccuuuccaggggggugaaugguucugucucgcuggcauuccaggcaccacugugguaugaaaaaaaaaauccuguagcuagcucagugucugcccaaauggcugcccaguuuugugcuugaaacccagggccuggugguguaggcaccagagggaaucuccuggucugcagguugcaaagacuguggaaaaagcauaguaucugggccggaauucacuauaccucacagcacagucccucacggcuucccuuggcuaggggagggaguuccccgacuccuugcgcuuccugguugagaugaugucccacccugcuucugcucacccuccgugggcugcauccagugucuaaccggucccaaugagaugagcugguuaccucaguuggaaaugcagaaaucacccaccuucugcguugaucucgcugggagcuaccaacccgagcuguuccuauucagccaucuugccagccacccuucucuuggguuuuuaaacuucacugcuucaagauggugagcuauagagucaccaggaaacugcagguuccaaaugguuuccccugaccugccuuccuuuucuucaucuacugacuucucagcccugaaaaaugauucccaaauugcuucuaagucuuugagaaaugucuucucaguuaaaaacccccagagaagcugguuaaagacugaagagagaaccucagcccuaacuguagugccuucaugagauauagagguuauaaacuccagagaaaugaaauaccauuaugugcaucagaggcccgggcuugacuuucugauucugcaaggguacagaagguuuagagaaccuuggcaaauggaggaaaaccuaaucaucaggguuaaugugcaggacuugacgaguaagagauugauuucucuuuguuacgaagaccaguagggcuucagaguuguugguuuuuuaaaaaaaauauucccagcuccuugaaccuuggcucuuauaagaaauguggggaaaauguguauauauauauauauauauauauauauagagagagagagagagagagagagagagagagagagagagaaagagagagagaauauguauucuauguaagaauauguauuguguauucuuaugagaauaugugaauauauauacacauauauacauaaauauauuuuuucuuauagaagauugucuuaccucuuauuuuuuauuaaauagauuuuucuaucaagaggugaauuuucuuaaggcaggauguuugcagaaacuaauggaaaacaaaccuuuuuuaaaggaguaauugccuccuuaaaagugcugauuuccaugugaaauuuaugccuucuuccagaggcagugaggaguaccccaggcaguucgaaggagacaauucauuacugguuaguguacacacaccaagaaggacauuaauucacaaaaugaaaaacuaauagaguguuuagcugacucuuuaucaccaguggcagucugcacugucucuccaucauuaguguuuacugagcugauggagaccgcagucaggccugcuuaucacagcucaucuuagaugacuuuacaucacuuucagagcuacauggggcaucccuccucacuucuuugaaaugaggaauccaggggucucaaggaagcuaugaaguuauuguguccauuuuuaaauuuucuucccauucucuugacuuucugauacaucccaagcaaaaacucuagcccuguacaugguaccuuacgcuguagucaucccacagccacuuucugagcuaauuagaaaacuaccaucuuuacuccuguuuuacagauguaaaaacugaaguauaaaagguaugaaccaucuuuaaccaaugagagagcugggauauuaaccugagagcuacauuacuuuuuauuaaacuaacaagaaauuuuacccugcuucuuuuucuccuucuuacauucauuauuuuccauuuuuucaauaccccucauguaaaugauuagucuguccacuauauuuaugauuucuacuuucucaugugacagaaaaauuuuuaccaauccgucaucugaaguacaaagcaaaggugucuuuucuucugaaaauguguuucagugauucuuggacauacuuuaacuuucuggauuagggaguucguuacuuaucuuccuuaucuuuuaaguuguuuucuuaacuaauacaaauagguauaaugacauuauaacaaacuuaaaauaucagaauugcuuuauuaaguucaaaguaaauuugaaaauauagugugguaggaauaugcaaagagaggaucauuuacauaucuuuauauugaaauaaagcaaugcuuagauaaauauugcaaauacaaaaccccagaaauuuucacugucuacauuagagaauuuuuugguaauuuuguguguuguggguuuuuugaguuauagagcaugaggaagugcugaaaguggucucacuuggaaaaggaaauuuggcuucccuguuuuugccuuugaucucugacuuccauauuauauucccugggucuguccccugugucacucuccaucuucuccaguaggcauccccugcugagggaacagacagauacauagucaaucagcuggguagccacaacuguuacacacauagacagggauucauacaucauguguucuggggaauuuuuccaacagaaauuaaaucaguggugcacuaucuuaugaggacauuagagaagauauucauuuauucaggaaguauuuguggauaguucaguuuaacaaauaacacaguaccagcucugucccuaggcuacagggacauggauaaacaagacccagccucugccuacagggaguuuaaaagucguggaaaauacaggcaugaaaguaaucaccccauaauaugauucggcgaccauggaaaaagcacaacauauaauuggaauauaugauguauacaucuuaaggggaauguaaguaucaaggaaggcauucuggagaagauggcaccugaucugugucuugaaggguaaauaguaauaagccagacaaagagggguuauuuauuauguuaaauuguuauuacauuauagaagucacauuauggaggguaaacuaagugaaaggaaagaaaaggcuaugaaguggaagaaaauauggugaguucagaguaauucacauauucaguagggcuacauugcagggcuuacuauaggggagcagcaagaaguaacgaagcuagagagguaggcaaggucaguugagauuuuauguggaggacaaugucaagcuauugaaagauuuuagacuaaaagagacaugaucagaugguguuuuggaauuauuucuccaguaagaauacaggguaaugaauuggaaaagaauaauucuuaagguaagagauuauuuagaaaccugaugcauuaacauggaugauagauggcaaaagauuugucuuagucuguuuugugcugcuauaacacaauaccugaggcuggcuaguuuauaaagaacagagauuuauuucuuauaguucuggaggaugggaagucccaaauugaggggccugcaucuggcaagugcauuccuauugcaucacccccugguggaagggggaaggcagaagaugaaaaggcaagagaaaaagggacggggccgcaaacucagccuuuucauaacuaacccacuccugcuaugauggccuuaauccauucaugaggguagaacccucaggccuagucaccucuuuaaggucccaccucuuaacauuguugcauuggggauuaaguuuucagcccaugcuuuuugagggacacguuuaaaccauagcagacuauaccaaggcagagauagugggguuggauucaagagauauuaagaaagaaugauauagggaguacaggaaacgggcaucaaaaguguuuccaaguucuuugucuguacuagucacacuguggcuauauuaagcacugugcuaggaugcagaaucaucuaugccaaauagaaccauauguuaaaaugacauuuauuaaaaugaaacuugaccugcacaucacacauguguauuacagcuuaauucuaaauacaaacaacuaaagaaaacuauccaaauuauuuaguugaacuagaacuuuauacaguuuuccuuaggauauacuguugauucauagaaaucucuuccaguauaaagauauuuguaguaauauuauuugaucgguaguacacaaaucuaaucuuagauauuauucuccagacauaccuacuagaagcagcaacauggacucacuugaauggcauuuuguucgugcccuguauuugucccauucgggagauagagugaaacaagaguucuguuuugggguuaacaggcagaauuauaagcagcuaagcaaccuaaaauaguucaaaacacaaaggcaaggaaggugauucucacccuaagcaauaagcuuuugaaugucccuaaaguaacucagcuuguuaguagucauugugaaugguuuaaugaaaguaaaaguugaugguacuaacugaaauaaaauuauggaauucuuguguaaguuucacugagaauugaaucuauugauuuugcaaguaguaaucaacaucuuugcucuguguauaaugcuuucaccccaaauuauggcaaaguaccagauggaccauuugcagcaacuaaguaaauucaagcgcuguauaaauuccuauaccuuuuuuuuuugaguucuguaucgcauauggaggaaagcacaaauauuuauucaccauccuuguuuauaaguacagugugggaaauauuuuguggaaauucaccucucugagaaguuagaaaaaauauucaaaugaagauuaaaauaagugaagaaggaagaagcaagugauauuuucauaaaaguauacuauucacucagauagagggucuggaucaugcuuucuugacauaaaugaugacacugauauggggauaguagggaugguuucaauuagcuugacauuuccagaagucaaauucagccaaacuagaauacuagauaaguucuuaacucaucuuuugggugauuuuucuucuccagagagaaacacuuggagacucaacauuuugugcauaauucugaccaaaaggaagaauucaugggaaaguaaaaauuuauaaucuuuaaagaauguuaucauaucauauuggaauuuacacagcaaagaaaguaaacacuaggcauagcuagauguuuaguuuuaagaaaguuaaauuuuuagacauuuggagaaaauguagguaugaucucgugaauagaaaccuaucaaagggaguguaauuuaugaugaggggugggagauuauacaauauaacauuugaacuauaaaaugcuaaguaauuuuaacaaaaaauaauagcaaacauucaaugacaagguauauucuaaaaugcgugugcacacacacacacacacacacacacgcuauucacuuucaccauaacccaagaaguagauaucauaaucuucauuuuuacaaauugggaaacugagucacagguagaguaaaauaacucaaacaaggacacacagcuauuaaauggugaagccaaaauuugaaccuauuuaguaugccuucacagccugugcuuuuaaccaccacacuauuguguagcauucagagaacucucugaugaggucacguagaagaagauguauuuuaaaaaugaaagaaaagcccugcagucaaucacagaugagugcauauagcaagcacacaaaauguccggggggccugcagguacaguguuggagacacuaaagccuagaaugacuuaauggucaucagagauguuaaggaccacaaaaugcaguguguggcuauguuuaggcacaaagagaacaucaaacagauagguccacagauuggugaaguagugaauauaauguuaagaaaaagcagaaccacucuaaccucucuuuuguuucugucuuauuuagaaaggggccugcucuucaaauguaaggauaagacaaguugugauaagaaacagcugugaggaaagcgucagauggcaucuggcuucuuuagaguagaacuuaaacagaucaaauccaaggguguuaaggaaauuugcugaauuugagaaauuguggagcauguaaaaggugacagaauacccagauuacagcagauauuccuauucucaaaacagagugaagaagaaauucuagaaacuacagauuaauguuagauagugaaccaauaugauaguuagcacauggaaaagaauaugaugagugccaggagccaacaugguucacaagagggagaaaaacuaucauaggugcccaaggacuacugaaagaaaaugaacaggccuuaccauggaagaaacacgggcacuaugcauauguccuuguaguuaccagucagagaccaagucuugccacagucucaaauaccuuuguuugguuuacaaauugguaugaauauguauuuuuuuaacuuagcucuuauguccuaacaaaucaagguuuaccaguaucagcccacuguuucucugaaaaucaaauuugacuuaauccagcaagggaacaugcaaaacuuuaaguuucacuuuuuaaaagugaauguucugaugaaugagccuuagaacaaagagagcuaagcuuuucugccuugauaggugguuccuucucaauuucauaccuuuaaccuaauugccaaaggcuugcuugaggcuugguggucuaaccuguggagcccagaaauuguaacacacugagugugcucaugggcauggacuuuguuuggaagauacauucagucuuaagcugaagcuuuuacagaauaauugaaagcagcuccaaauugagugaccuugcuaagaagucuguuuugguggggucuacaucuuuaaccugggauucuagaaaauaguagagaaacccauggcauacuuuucuaaaaaguuaaaaaguaaaauaguccugugaaacauuuucugaaaggaauguugaaucuucuuugcaagggcaucuuguguguguuauugagaauaagagcaauucauaauguguucaguauucacuaaauccaaaaaaaaagauacuagaguuuauguagcaaaaauaaugaagagaaaggagaaagcaaaucacuugcuuccaaauaaauauuauuuauauagauuguccucccacucguccucagccuauaggaacggugccauaauuugaauguuugacuucuaucccugccuuggcucacagcuagagaguggagugcaguaggaacuuguuugcugugaccaaaucuuuccuuuucaaagauagugguuugcgagcagcugguuuuuucuuugcuuuggguugguuuguuuuguuguugugguuuauuuguuuguuuuugugugugugguuuuuuguuugaguugguuuuguuguuuuguguguguguguguguguguguguguguuuguuuguuuuagcagcagaacccuuucuucuagcagaauuuuacuguaaagucugaauuggguaacaaaucaaaguggagccucucugacuaaggaagcagggaaggcaagauggagagaauggagacugaaaaauguuaaauugaauuaaguuuggcccaaagcugccucuguacauguuuuaaguuugaccaaaagguuucuuuguacauagugaacuguaaccuaacuugaugugcaaacagacuagaacuuacucuuguaacagguagcugagucucagccagucacagcagccaagcuucagucagugauaggcagccaacucuucaacccagguucaaaugaggcaaacacugagcuuuaaccaaguaugcauccuuuguacaucccucccguuacaugucacuuccuuuucucuggcuauaaauauaaucuacacaugugguagagcagagcauucugaaccauuuuuggucugggcugcugcacuauucuagaaucacaaauaaaagccaguugagaucuacguuuguuguaauuuggucuuuuaacagagauuaggaacucugcagggcacuuuccaaaaauccuugccuuagagguugcagcauugcauuaaagguagcccagagauccuuggugacccuucaucucacuacuuccugguccagucuucucugagauuuaaagugccauaguucaaaaaugucucaggaguagaagguuacauucauucaucaaggcucaguugggagaacagaaaccauuuuagguauuucaagcaagaaggaauuuaauguagggaauacgauguuuuagaaauugcugaaagggcuuagacagccguuggaaggauacaaaaagcaaggaaucuagcugcugccuuucaggauaaucaggaaaugcagccggggauuucaccuuccugcugcgaggaagcagcugucugcaggagcucuucuggaagcugcugcaagcuucugauuugccagcugccugagcaucuuucugccacuguaagaagagaauccugccuucccuuucuuuuugccuuacacagcuuuugggaguacaucucaauggcagaauccaaacccaaaaccccuacuggcaagaaguuguagauguuccuaugcuuccaggaaaguggcuagaggugacacugaguugacaacagacaaagcacaaggguauguucccauuucacucuguacaguaaauuuagucuagaguaauaggaaggugaacguauuuccaagaaagcagauaaaauaacaagucuccugugguaguaaauauaaaaagcaucuuuccaaaauaauccugauucagcuguuuuaagccuuaguggaaaaccugauuugucaguguuuuuauguauauauuaaaauaauuuauaauccaauuucugucucuucaggugaauauaacacaauuucuaucauuugaggucaaaacuucauagguaucauaauggcuguuuagauucagaaucauuacugucuuaccuuuaccaccagguaaagguaaucacacuugagugugauuacacucaaguaaucuucuucccuucucauagugccucuuugguagaaaggaaauaaacggcggucaggaaauaaaugcugacuccaggcccuguuugaguaaggcagacaugaucucucaaucacaugaacaauuuacaggcuuuggugaauauucuuugaauuccuaaaauaaccccuaaguugcggcugggugcgguggcucacgccuguaaucccagcacuuugggaggcccaggcagguggaucacaaggucaagagaucgagaucauccuggcuaacauggcaaaacccugucucuaccaaaaauacaaaaaaauuagccgggcaugguggcgggcgccuguagucccagcuacucgggaggcugaggcaggagaauggcgugaaccugggaggcggagcuugcagugagccgagaucgcaccacugcacuccagccugggcgacagagcgagacuccaucucaaaaaaaaagaaaaaaaaacccuaaauugccuucguuaaagaaccuagcuuggcagacauccuuuccuuggaaagggagaugccugucauucuucaaaauaauguuaaaaacacugauuuaucuccucccacgcugcuccucaacaucauuccuggcuuuccuaccaaucuaccaccuaccucaugccugaaggccaucucuaccacugaacuggcgacuggagaaaggcauucuccccuuuuuauguaugaaaagauaaaauuugaaccugcccucugccuuaaucccuuuucucuccugcguauuuucacuaauuuaaacauugccagaauccugugcuguucucauacuucuaugaugccuuauuuuaaguucaaaaugucaugaucuuacccaguguguauguuuaauggauuaauguaucauuuucuuucuggccauuagccacaugaacaacuaggcccacagcugucagauuucuugcaagguuuuucgaggagugagaggaugagucuaggaaucucacucuuccaggauccucaccaggggguucaauaaagaucacuucaaugugcugagcacuuacugugugccgaagguuguucuaaaugcuucauguguuuuauaucauugaauccuuacaaugacccuuugaggcugaaaauguagucacuucaauaaacagguuuaacgauuuccccaagguuauccaguuaguaagugguugaaucauaauguaacuacuacuuucugggccaaucaaaaagaaaugguugucaauccaaaagaaguguuguauguaagaauuugguucuuaguuaauaggagaauacucauauccuuuuacuuagcgaaaaauauuuagauuuugaaguaauauccugaaauuguguagucaacugauagagaugauugcuucuccauguagcuuacucucaacuggcauaaacacagauugauuauuaaucuuuuacuuuuuaaaaauugauucuggaagcaucuauaugaacuguuaauuauucuagggauuauguggcaaaacuggaauggaugugugaauaguauucauguguuacuaacguauaaagacagaaauauagucauauauuauuaaccuucacaaagcauuagucaauauguguaucacaccaccucaucaaucagccugcacagggacugucugacaccagacagauuaaaggggagguacuuaacuauuaucuucaccccaugcugagagguggccacacuuguccucacugaguagaaauugucuuagcaagauuuacaccugcaaagucuguaccaugugucaacuaguuaauucucuguuuuuuacuucuaacaugcuucagaggagcccccaccaauuacacagcuacucauggugaugaucuauguacuugguggcagggucagcuucuucuuccagauaaaucaguuguccagauguuauccacauggcagucagaguggccauggcuucuaagauucugccuauuuuccucugcagucucgauggcucucagauuuugcgaucaaauguauaaagcuagugucauuguuucagugcccacauaaaacuguagauggagugaaaaauacuggguuuuuaauuuacaagaaaauacaaccccauaaaaaagugggcaaaggacaugaacagauauuuuuuuaaagaagacauacaugcaggcaacaagaaaaaaaagcuaaaagucagugaucuuuagagcaaugcaaaugaaaaccacaaugagauaccaucucacaccagucagaauagcuauuauuaaaaagucagaaaaauaacaaaugcugguaagguuguggaaaaaagggaacauuuauacccucuuggugggaguguaaauuaguucaaccauugugaaaaacagguggcgauuccucaaagggcuaaaaacagaacuaccguucuacccagcaaucccauuacuggguauaugcccaaaggaauauaaauaguucuacuauaaagacauauauauguaugcaaauguugacugcagcacuguucacaauagcaaagacauggaaucaaccuaaaugcccaucaauggcagauuggauaaagaaaaugugguccauauauaccaugguagaccaugcagccauaaagaagaacaagaucaugucuuuugauggaacauggauggaucugcaggccauuaucuuuagcaaaguaaugcaggaacagaaaaccaaauaccacacguucuuacuuaugagugggagcuaaaugaugagaccucauggacacagaagggaacaacagacucugggcccuacuugacggugagaggagggagaggaucagaaaaaauaacuacuggguauuaggccuaugccugggugacaagauaaucuguacaacaaacccccaugacgcaaauuuaccuauauaacaaacuuacacagguaccccucagccuaaaauaaagguuuaaauuaaaaagauacgggccgggugugguggcucacgccuguaaucccagcacuuugggaggccgaggcgggcagaucacgaggucaggagaucgagaccauccuggcuaacacagugaaaccacgucucuacuaaaaauacaaaaaauuagccaggcgugguggcgggugcuuguagucccagcuacucgggaggcugaggcaggagaacggcaugaacccgggagguggagcuugcagugagccgagaucaugccacugcacuccagcuugggugacagagugagacucugucuccaaaacaaaacaaaacaaaaaaagauacuggguuuuuguuacuuauucaacaccuuuauugaggaggaggaggaauugccauguauuagcaauugugugucaaacgcuguucuaagccuuuauauaguuucucauuuaaucaucagaauccuaugggucagauaggaugauccuccuuucacaaguggcaaaucuguuacagagaacuucuuccaaauaguauaauauaugagaaagucggaaauaugaacucaggucaguccgccuccaaaggaccaccuuccuguucacuauacuugguacuuaccugcugguuucagaaaacacauuauguguuagggauacaaagauaaaagugagguuguaccugcuauugcuuaagagguaugauagucuguucuugcacuacuauaaagaaauaccugagacugaguaauuuguaagaaaacagauuuaauuggcucauguuucugcaggcuauacagaaaggacagugcuagcaucugcuucuggggaggccucaggaagcuuccagucauagcagaaggaaaaggggagcaggcaucucacauggcaggagcaagaggcuggauauucacacgcuuuaaacaaccagaucuugcaagaacucacucacuauugugaggauggcaccaagcccuaagggauccucccccaugacccaaacaccucccacuaggccccaccuccaacauugggaauuacauuucaacaugagguuuagagaggacaccuuuccaaacuauaucaagaagguaaugaguauuucaacuuagauccaaauuuaugagugaugcagcugccucagaaagaaacccaugaaauaaagcaacuggaaaaaguuaaguugaagaggaacuccauaugggacuuccaauucaacugcuuuaguucuauuuccgcuuacuugcugugucauauugggaaguaugcuuuauuucuguuugguucaguuucaccaauuuuaaauuguccuaauguuuccaauuuacccagugaauaagccguucccuaaggcucuuuggaagauuuacauauacuuaagcuagaaggauccuguuugaacacauagacaaauguuaccucucugccauguaauauuuuugccucuaaaauucugcuaagcuuaaaucugugucccuuauucauccaaaaauaccuuguuaaguauugguuaacacuuuuagaugcucuuugaugcaggguuuuacagaaauacaaaaggcuuacaaaaguccauggaaaucuaauacagcaccacaauacugcuuuucaacagaagaacaggagcuguucauuagcccccacuccccuacccacccuguuucucuuucauauccggcaggagcugaauuggccacaccauaugcuuuuuuagcaaaugaugaguuuuuuuaccaagccuuagggaggauuauuuggaauaaaggaaaaaucaaucguaauguuucuccccaggacugaaagacacugaagucuguacuaucaaucacaagguauaaaaaacaugugucuaggcugguuugcacuguaugcagauaggaccccaaagcuaaacguccuuggggaccuagggcuugcucagacuuguuaccaucaagcacuguuuccugaguaaccagaugcaauuuucucucugcagagcugugcaguguguaguguguacucuuggcucacgacuggccucuuauccugugguagccuaagggaacgacuauccauuucuacuuuggcuguuauuuuuguuuugcucaucagaaugagccuuccaugaaucuccuuuguucuuucuauauaguuugauauuuggaacaauucuuccauuucagacgcucauauccuuccuggagcuuuaguuucuuacccugaaacagaauaauguuccaggugaaugaacuauuuggaagacauuaaguuaaaggcauugugaaaauauaaugaaaaaaaugguuauaaaacucuuugauuuguccuuaacuugaagauaaaauucaacaaacauuaucagcagucuacugagaguaaggaagagcuauacacugagagaugccaggaagaaguaguuauuguuuuuguuaucacagaucucacaauccacuaggaaugcugugggcaaauacagugcaagaugaaaugugcuaaguccguaggagagaggcagaguguuaccagggcucgaaggauggcccuuagcuuuguugcaggcacagugcaaggugccacaucucccauuugguccucacaacaacucccuaaguuguguauuugaggaaaacgagacuuagaguuguuaagaaauuuguucuagagguaauaaaaagugcaagaauaaauuauauuccucugggaagcagcaggagaaaguaugguuucauagagaugaaaacgucucuuaagcagcagaguuugguuuuuacucuuuuuugggaggcucauaauaguauauucucaagcgaauguugagacaucuaagacauuaagcugggcagugaauggaacagguauaucuuuucuucccccaagaguuaauguuuguaguuaggguaauauaagauauuucggaggaagcauucuaagaaacacuaaaaaguuauauuguccauagucuuaugaccagugguugggggaagguguaacacaugaucauguaaauaacaaaugguaccgcauaaaagaaaguaggucucugccuccuauacccaaauauaaaacauccccucugugaaaguucauuauacaaauugggucauucuugucauccccaacugaaucaaacucaagaggccacagguaaaaucacucuguguacauuacaccugcuccaagaauuaaauguuccacaagcccagcugcugaaauggccugcuguaacucuaagaccaguuuuaccuagaagcugcuuaaacaaccugcugugacucuaagauugcuuuuaucuaccaccaucacucccagucagagcuugacagcuaccagaagcuccucuagggccaaugagcuuucuuuuaaacaauauguaauauuugucuuucucguaagacucuuaaccuucucuuuguucuuuggacaugucacaaaccacccauucucuguguaugccccaaauugcaauucuuacuuuccaaauaaaauacuuuaaauuuagacauucaucucuauauuuugucugacuucaacaccuccauauucaggaagcauuuuuuaaauauaaauauauuaccaauuaugugacuagaccauagaacagcacauauaauuaagacaccuucucccgauccuccaguucccucauucuuaucccuuuuuuccuuccugauaauuucuuccacuuuucuccaucccaguucuuaauaaaucccuuucaucucucuucuucuucuguaaaagugggcaaaagagagagagcagugaaaaggcagggaaugauugcuccguuauugagauguaaaaggauucauugguuggauguugugcuucagagcguaggcuuuauuuccacaucuggcuauacacauguguaugcaugcauaggaccuaaucugacuaaugugcauuauguccccauccuuugcaaucagaauaucaaugagcauggugguuuucaaaauuaauugauuuugcuauuaauaguucaaaccuaaaauuucugggaucugugaaaagagguaguuauuacuuggaggcagaagaacuauugcuucugaaauaggaagcaaaaugaagagagcuuuccaaauguguuucuuagauaaggcccauccuuauguagaaacauagcaaaagaacuuaaaacuagauuauagaugguuuggaagaugggaaagaacaaguaaauacaugaauugcuaguaguggcagaagccaaguacuguugggaaaagaguaguagcuuuggaaaaagggacucaggaaaagagugaucaaaaauaguuacuaugaaauuuuaguuuggcguaaugacuuaguucaagaagaaaggacaucucuauuccaagaaaguucaaaucaaauguuaauaagcugguauguacuuuagcaugugaagaucaccccucuguuccaaaaaccgguaggcuucauaaauaaauaauuuauuucuuaaacauguauuuagugccuacaguguacaaagcacugggguaaggaaagauuaguuuguacagguuugcaaauaauucaaggcaauaaauaaaauguagggacaguaguacagagaaauuaugaagacuggggguagaauuagcuggcauuaaagcuccagcuuggaacuggaguauuauggugucugacacucaacugugaucccaguguuaggcuugauagcagcauaucccuuaggcauuuaaggagaggaaagaaguuagauggaggggcuccugucacuguccccacugacuuuguaggccucgugaauccuuaauaucacagaccuaaugagcauuccuauuuuuauuuuuuuuuaaguauuuaguuuuguccaggcaacaacaucaaaggauuucagaguugucuuaagaccugguaacauauugcuauagaaguuaggaagguacuauuaauaguuuucuaaauaggaaaacugaagauuaaaaauuaaauauuuuggggcugggcaagguuccucacgccuguaaucccagcacuuugggaagcugaggugagaaaaucauuugaccccaagaguuugagaccagcguaggcaacauagcgagacccuuucuguacaaaagaauuaaaaaauuagccaggcgugguggugcucaccuguaaucccagcuacuugggagaugaggugggaggauugcugucuuagaaagaaagaaaaagagagagaaagaaaagaaggaagggaggaagggagaaaagagauggaaggagggaaggaaugaaggaaggagagaaaggagggaagcggggagggagagaagaaggaagaggaaaggaaagaacuuauuuuaucccaaguuagaguagaaaacuguguggugucuuucaccucuguacaaauaggaagaggauuuggaaaucauuauuauaccaaaauuugaucuucuaaaauguuuucaaugagaaaaucucaugggaucauucuucacugucuuuuucuaucuucuagaaaguuugaauucacaguguuaaccuuuccuuucgugccgagauaaccaucuuucccuuuucaauuucucacuugccugacagcugauaccagucuaagcuaauauuguaacaauuuuagauaauauugcagaugcacaaggacauccucauaugaaucaauuaaagaagucacagugaguugccauugaaaguguggcagcugcauccuugaaagcagaugcucuucugggucugaaugaguccaauuuuaacuaauuuuaagaccuaaacagauuucagucugguuaauauuaggauguggaaccacuugagacauccuaauguccuagucugauuacuucuccaugacaguuuguauguugacuuuccuugagagaugcuggguacuuaaugccaggcauuuuuaugucaaucguaaagagagaccccaagucauggcugcagcaaagugcacugacaacucgugaaauugaaguggcuucuaacagcagcaugauuuauagggaaagaacuugggguauagggauucaccagaauugcuuuaaacuauauuucuguuagauuccugaauccccagaaacaggcuauaaugaacuacuuccccaucccuacucucucucuagauuauacucagaaaacuaaggagaaaguuagaguuguaaauggcaaguugcuccuucuuuuuucugauuuuucuuuaacaaucuguuauuauguucuuugucauauugcauuggucaguuuaauuaaaaaggcauugauugagcuucuguaaugccucuaguuauucugcuggccuugaaugggggaaaauauauauaauacauaauucuuucacugaaguaauuaaugaucuggaagggagacauaguuaauggaauauaccuucuauucuagaauugagagggguaggggaacauccagaagagccauugacccuuccuggggaaucagaaaagacuuucugagccagagaaggcaugaauaguuuugaaagaggaguaagagccaucaaagguguagaaucaugagacagcaugauauguuuaggaaauuugcuuuagacaggugguaaaucaaacggcccaggguuggagaggggauacgcugaagagaaaaaagaaagugguaagagauggagaaaaucuggaggguuggacagaaauaaaaaaucuuggaaagcuuugcuaaggagcuuagacuugaucauauaagccuugggaaacacugauguuauuuauacaagaaauuaacauagucaaauuuguguuuuggguaaauaacuuaucugacucauauuuaauuagauaaaagggggccagguaagaagcagagacaccagucagguaacuauugcaguaguccauggaagagaugggguccaaaccaagaaaguggcaguagauaacagaaaagaaaaaauaaauauuaagaaaauauuuguaaauaaaauugguacaaauuuuucuuugcuagagagagucaaaaauuacacucacguuugcagcugggauucccagauugauguaucaccuauaaaaagagaauucaggauagagaacagaugcuaaagaaagauaaugaguuuaguuuugaacacauugcauuugagaugccuaugggauauacagguagcaguaucuugcaaaucauuaaucaaauaagguuuaggagccaucauuucauggauaauaguguaaacaaugaaaagggaugagcucacucagaacauauuggcaaguaaggaauaccacuagaggaaaaaguccccagaaacaccggcauuauggauggacuaaaggaaggggauucagugaaggaaacuauggaagaaaugccagagagagaaaacaacacccagaagaguaugccauauaagccaaaagaagaugauuucaagaaguaaagggccagugaauucagagauagcagagagccugcaugagaugaggacugaagagcagccaguagauuuggcaauuacaguaucauugauggcuauuaccagaaaaguuuugaauaaaaaggugagggcagagucagauuguggcacacugaagaguuaauaggaggugggacuggagaaagucaguguugagauucuuuugaaguguuuguugaggacuaacagggagcagguaggacaaagggccugaggagaacagcgcgaauuuggaaaaauugcugagaaagggaaggagguagccaagcaccagggaaaggauugacaagugguaccgcaagcuucuuuugaaauuaaaauccagaacguuuuaguggcaacaaucuauacauuuuugucuuuuuaaauuaauauauuauagcuguacguauuuuggggguacaugugauauuuugauaaauguauacaauguauaaugaucaaaucaggguaacugggauauccaucaccucaaacauuuaucuuuucuuuauguugagaacaucacaauucucuuccaucuauugugaaguauacaauaaauuauuguuaaguauaauuaccgugugguacugucaaauacuagaacuuauuucuucuaaguguauuuuugugcccauuaacuaacuuuccccucccccccccaccccuuuuuauuucucagccucuaguaaucaccauucagccuccaugaaauucccuguucaggucccacauuugagugagaaugugugauauuugucuuucugugcuagcuuauuucacuuaauaugaugaccuucaguuccauccauguugcucgaaugacaggauuuuauucuuuuuguuuguuuuugagaugcagucucacucuguagcccaggcuggagugcaguggcgcaaucucggcucacugcaaccuccuccuccugggucccgguucaagcaauucuccugccuuagccuccugaguagcuaggauuacaggcacgugccaccaugcccagcuaauuuuuguauuuuuaguagagacaggguuucagcauguuggccgggcuggucuugaacuccugaccucgugauccacccaccucggccuccugaagcgcugggauuacaggcaugagccacugugccccaccaggauuuuauucuuuuuaugggugaauaauauuccauuguguauaucuaccacauuuucuuccaccauucaugaauugguggauauuuaggcugguucccuauuuuggcuauggugaauagugcugcaacaaacaugggagugcagaugucucuuugauauacugauuuccucucucuuggauauacccagcagugagauugcuggcucauauaguaguacuauuuuuaguuuuugaggaaacugcaugcuguuuuccauaaugguuauacuaauuuacauucccaccaacaauguaugagcauucuuccuucuccacauccucaccagcauuugucuuuuuuauaauagucauucucacuggugugagaugaugcccccuugugguuuuuauuugcaguucccuaaugauuagugauguuaagcauuuuuuucauauaccuguuggccauuuguaugucuucuuuugagaaaugucuauucaggucuuuugccuauuuuuauagucagauuauuuguuguuuuuuuuguuuucguuuuuuguuuuuuguuuuugcuauugaguuguuugagucccuuacauauucugguuauucaucccuugccagguauauacuuugaaaauaauuuguuucauuauauauguugucucuucacuuuguugauuguuuccuuugcuuuguagaagcuuuuuuggcuuggcguaaucccauuuguuuauuuuugcuuuuguugccugugcuuuugaggucuuacccaaaaaucuuugcccauaucaauguccuguagcauuuccccaaugcuuuuuucuaguaauuucauaguuuuuaggucuuauguuuaaaucuuuaauccauuuucaguugacuuuuuuaauaaguuaaaaaaugagcaucuaguuucauucuuuggcauacagauagccaguuuuuccaguaccauuuauuaaagaaacugcccuuuccccaauguguguucuuggugccuuugucaaaaugaauuggcuguuaagugugugaguuuauuucuggguucucuauucuguuccauuggucuaugugucuguuuuuuaugccaauaccaugcuguuuggguuaccauagcuuuguaguacaauuugaaaucaaaguagugugaugccuucagcuuucuuguuuuugcucaggauugcuuuaacuauucugggucguuugugauuccauuugaauuuuaggauucuuuuuucuauuucugugaagaaugucauugguauuuugauagggauugcauugaaucuguagguugcuuuugguacuauagacauuucaauaauauuaauuauuauuucaauccaggagugugcauaucuuuccauuuugugugugugucuucaauuucuuucaucaguguuuuauaauuuuccuuguagaugucuuuuacuuugauuaaauuuauucguagguuuuucuuauuguaaauuggauuuuuuuucuugauuucuuugguggauugauugcuguucgcaucuagaaaugcuacuggauuuuuguuuuguuuguuuguuuuuuugauacagggucugacgcuguugccuaggcuggaaugcagugaugcaaucucagcucacugcaacuucugccucccaggcucaagugauccucccgccucagccuccugaguagcugagauuauaggcacccgccaccaagcccggauaauuuuuguacuuuuauuaaagacaggguuucacuauguuggccagguuggucucuaacgccuggucucaagugauuugcccgccucaggcucccaaagugcugggauuacaggcaugggccaccgcaccuggccugauuuuuguauguggauuuuguauccugcaacuguacuaaauucauuuaccaguccuaagaguuuugggguggagucuuuaggauuuucuaaauauaagaucaugucaucugcaaacaaggauaauuugauuucuuccuuucuaucuuggaugccguuucuuucuuuaucuuaccuaauugcucuggcuaggauuccaguacuauguugaauaaaaguggugaaagugggcauccuuaucuuauuccagaacuuaguguaaggcuuucaauuuuuccccauucaguauauuagcugugggccugucauagauggccuuuaucaugaugaguuauguuccuucuauacccaguuucuugagaguuuugaucaugaagggauauugaauuuuaucaagaacuuuuucuggcaucuguugaaaugaucauaugauuuuuguccuuuauucuguugaugugauguaucgcauuuauugauuugcauauguugaaccaucuuuucaucccugggaugaaucccacuugaucacagugaaugauauuuuuaauguguugucaaauucuauuugcuagcacuuugucaaggauuuuugcauuuauauucaucagggauauuggccuguaguuuucuuuuuuauuguuucacuuugucuaguuuugguaucagcgaacaauauguucuuuuguuuuccugucaaaugaugaguuguagaauugacucaauguuacaugaguuuuaggacaauuauagugaaagaaaaguauucaagggaguugagguuuauggucaaagaguagcucagggaaucaaccaugcaauccaugcugaggauccuaagagggacuuuuucuaccaggagaaaaugaagggauuacagcauuaaaguuauaauggaaaugagggugggagagaguugaaagaagaaaaguuuuugaucugagaauaugauacuagaauuuaaaauuucagagguugaaaacaggauuuaacuuggcagcaaguuauuaauauauauuuuuaauuugcagugauuuaaagagguguuuguuuuucuaauauagcaaaaagucugaagucaagcaguugcuucuuuuggccaaugguccaacaauacuuaguccagcaccucucugauucuuggucuuuuccucuuaauaggaagaugaugcaacuucagauaccucaaucaaaucagaaaagcagggaaagugggagcaagugguggccacagccucaauucuccuuuuaucaggaaaaacaaaagacuucccaaaagccacaaaagacucuacuuagggggucaguggacagacuaugacacacgaccaccucuagcaacaaauagggcugagaauacaaauauuuagccuuccagaaucuguaauggagugagcaagggagagaauggaacuggaaguaacuguugguucgccaaaaaggcagugucugcuccaaagaccaauguucagcuuccuuucguggaacaauguuuauguaguacagaaagccacaaucauccugccacaaacagcuaacuaggugacuuaaagaugcaugcuuuaugauguuccccucccugugcccauguguucucacuguucaacucccacuuaugagugagaacaugcaguguuugguuuuauguugcuguguuaguuugcugaggaugaugguuuccagcuucaucgaugucccugcaaaggacaugaacucauucuuuuuuauggcugcauaguauuccguggcauauaugcaccaugccuaucggggggaggagggcaaggggagggagagcauuaagacaaguaccuaaugcgugcgaggcuuaaaaucuagaugaugggcugauaggugcagcaaaccacaauggcgccugaauaacugugaaacaaaccugcacguucagcacauguaucccagaacuuaaaguaagcuaaaauaaaaauaaaagauggcaugcuuuaugcaguggucacaggaggaacagacauacuaggaaugaucugaugucauccaucccuaguauuaggaaaacagcucaaagugcaugucuucauaaagcgaucaagcacuuacauauuuaaagcccaauacgcgugggcucuucugauaugaaggguaauacuauagauaaauauacaacaauguagccuuuaaaggguauguacaagguuuuguguguguguguguguguguguguguguguuucuaguaaucucauaccuuaacuguaaccucccaagcagauuguguuagcauugcuuuuuuauagauuuucauuugacauugaagagcuaguuaauugcuuuuguggugucuuagauugccaugcuuaguauuucuuugcucaguauauucuuucuuguuaagaaaacuuuguaaguuucaguaagcccugaggaguucacaagccaacuuucuaguagagcucugggcauaauuuuucauguugcuuuaauaaaauguuaucuuuuugccauagauuauggucaagugaaauguacagugugcuguuaccugaaacuacuuuuuaccucacucauucuaaguuuuaccucagcagcuaaucuugccauagacuuacucaacuuagauauuuuuuuaauuuguaauuugacaguggucaauugccacaugauaaaauaauguauuuacaaaauaagaaaugcaaauuuuuuaaguuucuuggcgggauuuguccagaaugccuuugauggaauuuggucuauuaguauagcuuuggaccucagauuaggagugagacuucaaaguccaauuucugccucuucucauugauacguagauaacucuccaugcuacagucacuaucacccaauagaggaacugaagggcugaaaagcccuaaaauguuuugaaauaucauaguuguauaguugcuuucccucuagccuguuccaugaaaauauugcaaaagcagugaucuugucuuggcgaucaaacaacaugauuaaugcuaacguuagagaggagaugcaaugucaugcaucuaggcuccagcagaucaaguuaguaaacaucuaggaugauaccaaggcuggcaauaauuuaaaaucuacauugcuacauucccuuccuccucacccaucaguucccuugaacuacauucuuuuuuuuuauguuugccauguuauuuuaauuuauuagagucugguuccacagaggagaacuuagccuuacauguuagaagccuggauugucuauccaggcccuuuucuggacuuagcaaaguuuaagaauggauauagugcugaaaggucauaaguguagacacuacacacuacagcaagauguuggcucucuacccuauaaggugaaugaccuucugaguuagugaugccucaccaauucccauguucccuaaguccagagagccucuuucuuccaaaggacucuuugaaaaagagaaggauguucauacagaaaagcaaaacauaucagaaauugaauaaagauugauggaauuauuuuguaaguauaugguugcuacagcaaccauuaagcuuaagaccuaaccuggacaaaucacuugcuaaagaauaauaauaauugcuuauguuucuugcuuauauuaaguuuuauauguuguuauucuaaguguuuugccuacauuaauucauuuaaccccaugauauagauacuauuacccucacuuuacaaaauaaaauaauaaggcagagaaaauuuaaauaauuagcucuuggucacauaaaguaaauguuggagccaggacuuaaagccaaacuuugaggcucuagagagcuaagaaaacuuuugaaugagaucaccaaauuauuguugguugggaaucuuugagaaauugugaggacauggggauacaauagaaguuuagagauaaacagauguaguuuuuuguuuuuguucagcuuuuuuuugaagaaaaugucuaaguggugcuaaauauuuuaauaaaucguuuuggaaauauauagaagguagcuuuaucaaauuuuccaaaaagaccuucuuagggcuuuuaguuggccauaagcuauauaugaguugaaguggaauacagcacacuaccacuuccaccucccagaauuuagggagguguaaagcgucauggcaucuagaaaaagggaauugaucauucucucuagacuggucagccccuucuguaguauuuauucuguuuuguccugaguucuacauuucaagggaaauagagaaaaauuggaauguuuugguagguaaauuuugagaauuauaauuuaauucaaucauuagaagaaugggugaagaacuguggacauuccgcauagaaaagggaagacuucaaggaagccaaaauagguaucuucaauacuuguaguacugacucaugugugaaggauuacaaaguuagguaaaauuagagccaaugauuagaaguuaaugaaggcagauguuggcuugauguaagauggucaaaucuuucggagauggaacaggcugccuugaaagguauugaguuuccuuucgccagcauuuguguaagugugcagccagaauguggacagccacuugaaggugcacagaagauggaggcacagaccagaugguugggccacaugacagugaaggccucuuccaacucugagguucuguuucuguagguuggugcaaaaguaauuaugguuuuugacauugaaaguaauacuuuugcaccaaccuaaauauuauuauaugaauugauucaagauaagccacugcacuucuauguguaaucaaauauagaaauugucuaucaugucuuggacuucuaaugcugccaacacuaguguuaaccaagcuaguaaaaacaagaugaacagcaaaauaauaugucauuucagaaaaaucuguaggcaucuaaugaaaugauugguguuuuauccuuaccuuucagugcuuucuccugcucaagacagccacacgaacacggaucuccccccagugucagagcagaucaugcagacucucagugaacuugccaaaucguuccaggauauggcugaccgcugcuugcuugucuuacaucuggaagugagguaugauacagccaagcccaggaccuugcaauuugaaugcacugcgguucauaaaucacuugcuuauuuccaggcaguaucaccauaauuucuggcucauauuauugauguuaucccuuuuuacacugaaagugauuuuuagcuguauucagugauuauuugagcgcacaguguauugugaguguggugauucagagcuggcaugaucuaugaaaucaggucaccuagauuggaaugucacuaucaacuggcuaggugaucuuaggucaguuaauuaacuuuacaaaccacaguuuccuuauuuuaaaaauggaaaugauaguuucuaacuuauagagauuuuauaaaugaaauaauaauuagcacaaugucagccacaaaguaagugcucaaaauaugguagcuuugcuauuguggugacuuuauugugauugauauuuuuacuaaagugcucugcuagucaagaagggagucacauuugaaaaaguagagggaaacagguaaaagaauuauacuaauauauuuuaguuaacccaguauauccaaaacagcauuucaauaggcaaucaauggaagugauugagguauucagcauuuucuuuugcacuaagcuuuugaaaucugcacauuuuguacuuacagcacaucacaauuuggacuggccacauuuuaagugcuugguagcuacaugugcccaguacuagcauagugggcaguugccaagaguggcuggggcugacuaggaaugggauucuuuucuuuaagauaaaauggucagaagaaaugugacaaaguaacaagaaugaucagucuguacaaagaccuagaggaagagaguuucagacagaaggaggcacacucacaaagguccugagacaaaaucaagcuuggcgguuuuaagagcagagaggaggcugauaugcuuguaggcugaugaacaagcuggguggggaggacugaaagaauaaggcacaggagacaggcuggagcccaauccuguggagucaugaagccugacacauuacagggucuuacagaccaagugaaucauucagaugucauagaagccauggaagaguuuuaagaaagggagagauaucaauuaauuaacauuuuuuaaaggucacucuggcuguuguauggaaaagggauugcagggaaaaauacaaauggaagcagggugaccaguugaaaacaacucugagcaucaaggugauagagguagagauaugagaagcauaggauuugggacauaugcugaagguagagcuaaugaaguuuguugacagauuguauuggacacaggggcuggugcaauaagaggaaagacucaaggaaaaccacuaguuuggggccagagcaacugugugccauuaacugaggggagaaacacugagggaggagaaggguggaaaucaaguaugccauugagagauguucaguuugggaugcuuauuaaacaacuagguagcaaugucaaaacaucaggaucagaaagugcauggugugguaauacauucuauucuguauugcuuuggaacaugauuaacauugauagaauauuuuucuuuucauuugaagucuuuacuagauuuagauuuuaaaaauguaaauaggacuuuguuugauaggugacccuugggaauauguuuggacuccaguuagaacuuggauuucuuuccagggugacuccuugugugugcuacuugcuuuuuauccuucauuaccauugcccagugaguuacuuccuuauugcuugugagagccuugugaguggaacaagagaaguaacauugcagauuuagaaucuguguuacguggcauuauuccugauguuauuucucacauuaagcuguccagaaauaaagcucuuucuguauauuuucugauuuguuuuacaauaauuuucauauuugguaucucuuuauuuacaagcggacagagaaaucagguguuuucuaugaacaaauauuugcaauagauggaaggaaaugaaaaauaccaaguaauauucuaaugccgcuguuaccugaguuacaaaggaaaacaagggaauaccaaauuaguuacuaucacaauuccuggaauuuauacuauugaucgugugcuuauacauauucuacauucagaauuguuuacuuauguguaguuaauuccaagugggauauuugcaacacauuugaauaagaucuuuuaaauccuuaaccccuauucugcccuuuugauacaucuuggcaauacucuucuuaauacugaacaugcuuuagucauuaauuuacaagaaacuauacagugcuauagcacugguugccauaucuucuucaacauuagucuaaaaacagaaaaaugucauuuuuaagaaugaauaucaaaaaagacugaauuuuagagcccuggauguagaauuaucuuuccuugaauuuaacucagaacacgaagcaugggauuuuuuuaaauuaaauuuccucacuuccucauguaacaugguuccaacacucagguugcuuucuaaugaguaugcuccauuuugucuuuguuccuuuuaaaguaagguagauacaacuagcagaauacaccacauaaggcucggauagugaauguagaugcacuuacucuauccuggucacguuaacaauuuuuuuucaguuugcacagugaugauacaaaaugaaaaagacagauuucaugccacucuaguauaauaacgcuagaauagaggugucugcuaagugcucugggggcgugacugugguagagaccaucgagcagcucuuccagguguggcuuguucauugugauggcuggcccugaaaccuaauauccugcuguauauaaggugcucaguaaaaaugugauuaagaauuaguugguuugaaaccaaacccagauaaaguaagggcuacuuuacaaaacaaaaccuguugucuuuaaagaaaaugaauugguuugcaguuucuguuuuuacauagcaguccacuuguaaguccacugcauuaucuuaagagguacagaggcuguguggccaauaucauucucaucaacuaauguuuguuuuguucccauccugcuguaaaaaaagaauuagaacguaggcccgguuguccaggagcugguguggugaaaaaguggcugguuagcuccugucucuggcacuuuuagccaagaaaccacuguaauaguacagauagaagaaaacaauucauggaaaaaaguaaugggauaugcuagcaaaaaguccagaacaacuucagaugccaaaaauuggucuuguucccccaaauaucuuuauauccauagcccauauuuuucuuugacauuguuaaaauucaaaccaaaaacuguuuuccaauccagcgcagucuguguugaaggauccaucuaaggaguguuugacauuuuaccugugucauuguaggucacauuuuaaccaccaagcagccccuuuccacaguuugaagcauaaagcaaaugauacccccaagagaugaaagacauggugagcccauuaaaaacuauugagguuuguuuuuucuauuugaacuuuagaagaagaaaauuaaguugccauuugaguccaagaugccaagaaugucaccuuuaucagcugauuuuucucaccaucaggagggcucuaaguagguucaacagcaacugccuaucacuguugggauccuaagugugcacucucugaaaaucauccaccccacuguguaaucagcaguguuugcagaauacguuaaugucaaagucauaguaaggucagcaacaacaggccagaauuuaaauuuaaaaaaauacuuuauuugaauuuggcauucgcugaugacuauuuuaauuucuuuuuuuuuuuuaaucucuaaucacuugggaagaagauaauaccuuaaagaaagguuauaugucuucucccccaguagcuugaaggucucauaagcucucaccuccaguucauaagaauuuccuaacuagucacucuacuuccaguugcuuccauucucugcuauuaauccacuuguauacugugccagagugaucuugccaaagcucaggucugauuauauuauucacuuaaaaucccccuaaggaucccuauggcuucuaggauaaaggcuugauucccuacauggccuucagagccugugcugaccuggccugugcccaucuccccaagcucguggagugccuguaaugugggaucugugugcagcagaaaagaacugcucaccaguccucagaacauccugcauuuauagucucaugcuauuuuacauggucuucucauugccuggagucauaaugucugucauuuacuuuaaaaauacuuuagcauagaugcuuuaauuuuauuuucaacaaagugcuacuucauuuaaauuucaaccacaguagcaaucagugugcuagucaugaaucccauuccagaguuggucaacuuucauucugucagaaagcucacauuccagaggaggcuacaaccagugccauuacugguauucuuaucaaaauuauacauuugugccaauuaguacuugaauaucagaaugaguuuuuauuggugaaauuagucauuaguuaauuagcaacuguuaagaugagcaucuaucaguaaaaaugagcaguagucaagauacuuggauucucuuggaugaacugcuuauaagaauaugacacaucccauauaaaacuuagcuuaaaauggaucauucaacuaaauguaaaaucuaaaacucuaaaacuucuagaagaaaacauaggaaaaaauuuuuaugaucuuuuuuaggcaaagacuucugaaaugugacacuaaaaauaccauccaaaaauaaaaaaguuauaaauugaacuucaucaaaauuaaaaccauuuuugauagacauugucaagguuaaaauacaagccaaagaccaggagaaaauaucugcaaaguccauaucugauaaaggacuuguauccagaauauauaaugaacucucaaaacuuaauaauaagaaaacaaaaaacccaauuuuuaaaacugggcaaaugauuugaacagauauuucaucaaagauauacacgcagaaaauaagcacaugagaauaugcucaacaucauuagucauuaggaaaaugcaaauuaaaaccacagugagauacugcucuacaucuauuaggaugaccaaaaauuuuuauuuaaaacugacaacaccaaguacugaugaggauguggaacaacuggaacuuuuguauacugccaguaaguaagcaaaaugguacagcuccuuuggaaagcaauugguaauuucuuacaaaaguaaacauacacuuaccauaagugagaucuagcaaucucacuuccagguauuuauccaagagaaauaaaugcaaaguuauaugcacacaaaaauguguacaugaaguagcuuuauccacaaccaccuaaaccuggaaagaaucuaaauaucaaugggcgaauagauaaucugugggacauccaauucaguggaaggcuacccagcaauaaaaaguaaugaacaacaugggugaauaucaaaugcuuugugcuaagugaaaaagccaaacucaaaaggcuacauacuguaugauuccauuuauauggcauccuggaaaagacaacuguaggggcagaaaaauagaugagugguugccaaagguuugggaguugaguagggauugacugcagagggacacagggaauuuuggaggagauguuuguguucuguaauuugguucugguggugguuauaugauuguacauguuuguuaaaacuaauagaacuguacacuaaaaggggggaguuauacuguuuguaaauuauuucucaauaaaccugacuaaagaaagaugacaggcaaagcguggucgcaucauuagagauaauaaugcccaaggcuuuugcagccauucauuugggaauauuucuuauuacuugaugccaacuguaaagguaacagaacauagacccuggauuaugucaucauuucuuaccuccggugaaccuuccaugcaaggucagacagagcaccuaaaacaacagaguuaggacuagacugggcuuauggaacagccuguuugaacucugccugccaagggauacuauugguuugggauuuuuuuuuuuuucugcuacggugggggauucaaaacaaauaccugcauguagggcagaauuuggacugaaacacuuugauuacaacuuuaaaaggcuguggcagugcagccaauccauacccaccucagacuuccucagcagcuacuaauaucugccaaaaagcaccugagaauugugugugaccagacugacacaggccauuuucacacagaaaugcccuccuuccucaagcugucagauauguucugugagacucaagcaucaccuucugucaggacccuuuccugauaccccguggcacauuuccauggcacguggauggaugugcuuagagugagaugcuguucucuuuuagucauuuuuuucuuaaucuaccccacuagguuaugggucuuuagggauacaaacugucuuauauuuccagggccuagcacaauuucuuacaaauucauagagguuccauacaugauuuaguuaacuaauaaauuauuguuaauaaauauaagacuagugaugacagccaguacuuacuaugcacgccauuugugccagacacugcuauacuuaacacuuuacauguaguaguuacucacagcaccuuaugagacagguguuguuuucacccauauuucguggauaaggaacugagggauagagagauaaaguaacuugccuaaagucauacagcuggugauugaagccaaaguagucuccuuacacuuuuaagaucuauaaacucggccucucaucuucauugcaacaauaucuguugaaaauuacaaugcuuuucacaguaugccuacaacccuggcauugaagagaauuuuagaacuccuucccaacacuguauagauuaaacaagcaaugaucauagcagccagcuugccccagaucacucaguuguucuauagaauaacuaagauggcuuucugguuaaaagaggggaggguguuuacauuaaaauguacaaggccacagcugcuucauauuaaguguagagcauagugucuggcacaaauaggguacacaguaaguguuggcuaucauggcuagucuuacauuuauuaaugauaauuuauuaguuauuuuggugcucugucccaagaucauugcccucccuggaaggauuuauuauuaacugcucucccuaucucucucuuuuucaggguucacuguuuccacuaucuuaucccucuugcaaaggaggggaacuaugccauuguggcuaauguggaaaguauggauuaugacccccugguggucaagcucaacaaagauaucagcgccauugaagaggccaugagcgccagccuucagcagcacaaguuccaguauaucuucgaaggucagacccugcuucugucucugggaguuugggaggaagaaaggaugaaaguuuuccugauuuucuguauuacugaaguucaagacuuguagaaaagaguuguuugcuugcuugcuuguuugaacuaaaucugcaauaccuagccucuuuguguaugacuagguagacaacaauauggccgccaucugcuccggguugauaaggagauuuaauccaagauaaggcagauggcugccucccugacaugccauucaugagauuugagagaaugugcagacugggccacaaauuaacucaagaggagcuuauaaaagaaaaagaaaacacacauacacaaugaggagagaauccugaaagaucacucauuggcuaaaauuaucacuggaacgggaaguuuucucacagaauguuauaaucaucuggaaagaacagaagccucugauuagaggcaauuuuuaggaaggacguguccauaaaugccuccaaggggcaggcaaggaagggugugagagacaggaagugccaucuaaagacauuacccuucacaauuuggaaaaaaugugauggcacccaaauaauuuuucauggugaauuucacccagaggaucccuguuaggacuccacauuauguucccuuuguccauguuuugguuuguuuguaugaaaacuuguaucuguguucucucacagaauuaaacuaguauuauuuaaaacaacuaagaagguacauuguccaaaggauuguggcaaacugacaauacauggccaauguuugcuuuaugaaaguuauauuccagcaaauuugggccccccaaaauccaauccuuaaauguauauggaguuauaaagagauguguucuguugggguauaucucucaaagacuuuagccaaaaaguguaagugauugaaggguuagcuggcaguuaaccccauggcacuaugaguuugguggcaucuguaauauucugcagcuuucagcugcagugccuaccugagaauucacuuuucuguuauuacaccgaguuuccucugugcucuugacuguggcucuucccagccccugcauaucaacauuuguuuuauuccuauuacaaaaugcauuuaauauauuuauuauaauauauuauuauuucuuauucucuacaaacagcauaccccuucauugcccagucuugcagaccacguuauauuguggcagcaaaaacaaacaaacaaacaaacaaacaaaaacuguaccuaaaguuacagacuugagagaaugacaccaaaacuuggccuacagagauuuuucauauaaauaaguugucuaguuuuaaauguagaaucugcaguuguguuuuucuuugaauaaaaacuuuucuucauauucaaauaguaacacauacaaguuuguggucuugaagcaauguuguuugaguguagcugaagcaagaccugaaugcaucuccucccucauuucuacuuucaccuuaaucaagggaaaacucauuuugaagacauggggagccauggaccuaaagauaagccccgcacucugaucuaaaccucagagucucggggaagggacuagacuucagaacaggaaaacaaccaauagcaaauggcuugcaacuagucagaccaguuuacaguuccaaggaaaauguccugcuagcauccaagaauaagaaagaaggaagaaacguuuacugaauuccauuuagaauuaaaauccagcuuuuaaaaauaguaacccauaugugccucacguuguucugaaccagugucucucaacuuaauuacaugggauauccugaggaggacuuauuaguuugcugauguccugagcugcccuuugcuaaauuuugcagaccauaagacaacccuccagaccuaagagcaaacuacuugugggggggccccaaaauguccacaggugucucacgggaagucaacaguuaauguaugaucugcuuuuccuucacccuuuuuucuaauugugucuuauacacccauugccauuguuaagguauauuagcauuauugccaauaacccaauuucuuauugauuuauuuuuuacuuggcaauguugaaauauauuaacauuauugccaaugcccagugucauauugauuuuauuuauguagcuucccaaucaacuuuugagcccaaaguguccuucucuacuuuguaggaggaaggagaggcaaaagggucauuguauaugccuguggucuucucugcuucccaauuguguauaaagaaaagcgggauuuccuguguacuucaacaguuuauaauaaccuggccucuucucuaaggccuuggcaugguggcaguagguguacauggcaaugcuggagauguggcuauuaccaggcuuugccaccaacaugaaguccacucauuuguaacuacuaggacaauguagaaauacccuaaaauuauugucagaucagcagaugcaaccaucagagguagauuuucuuuggucguuuaaauguauagaggauuagaagacagcaauucugugugcaaguuucugcaggaaugccucuaaucugucauccguuuucuuugccccgcacugugcugaccccucaggccugggccaccugaucuccugcauccucauuaauggugcccaguacuucaggcgcaucagugagucuggcaucaagaaaauguguaggaacauuuuuguucuucagcagaauuugaccaacaucaccaugucgcgggaggcagaccuggacuuugcaagguaggagggaaaacuggguuuaguuucuuaugccaaagcuaagaccucguugccugugaagucauuuuuaaaaauagacucuuggugcagaaaaagcuuaguuuaaaaaaagaaagaagcacagauagauguuuuuagguccuauagagaaaauaauuccacagaauucuauugaauuuuguuacuuuggcagauaguuuuuccugaugucuaacccaaguucuucuuaacuacaauacuugaauaacucuuuuuuucugcauguaaaaguauacaugcucauugcauaaaauauauaagauaagauacaaagaagaauauaaaccuuugaucuagaggcuaagauauuugguauauuuucuccuggcuuuuuugcaugugcuguguuguuuaugugacuuuucacacauauucaagcaugugauugcccuuuuuccaaaacuggaacuguguuaaugcaauuuuauauuaauuuaauuuuguuuuccccuaucaauaacguuguuugaaaacauaauuuuuccacguucguuaauacuccuugaaaacguuacuuuuaaugaugccugaauaaauauuucaugguauaaaugagccauauuuauuuuuucaucacuugcaaauuuuugaacauuugaauuuuucccuuuuuuucucucauugugaauaacauguaucuacuguauuuuuacaggaaccuacuucucauuucuuccaucuuguuccaauugaaacccaucucuucuuguucucacugggaggaaagugagaacucaucacuauccuuucucuucucuaaguuuucugaucuuaauuuuuuuuuaagugacaggguauugcucuguuaccuaggcuggagugcaguggugugaacauggcucacuauagccuugaauuccuaggcucaagggauccuccgaggagcugggacuaaaggcgaacaccaccaugccuggcuaauuuuuauauuuuuuuuauagagacagggucucacuauguugccuaggcuggucuugaacuccuggccucacgcaauccuccuuccucagccuccaaaagcacuggaauuauaggcauaagucacugcaccuggccuugaucucaauuuuuaauguuuuuguacaauacaguuuuucaagauuugagaguuaauuuuuuucucucuucauuugucuuaaccccaucuaaaccuuaauuagaauaucaaaccuuuggugcuuuaauaaaagcuuaagcaauuugaagaugauagaugauaaauauguuaucuucaugcucuauugccguuuauaccugaguggauuauuccguaaacucccuuauuuuccaaagccuuuauggcuaggaaguccuuuguuuuuaauaaugcccaauguuucugccugagauuuaguauuucuguggucuuuucacuugauuuuuuugauucuuugagaagugcaggaaaauuugaaacaauuuauggagaugaugaaauauuauauuacuucaacaauuguaaagacaauaugcugugaucuuuguuuuggguaugaaccauauauguucauuuuuaaccuuucuuccucaaucuguuacuccauuuguuccauugcuacccuguuccucugcuuuucuguccuucuccuucccugucucuuucuuucuauuugugggaaagugagagagagagagaaagugaaugagugaguguguguguuuucauuaaauucccuguuuuaggcuaaauuugauggaaagccuuccuugcucagauuagggaaaccaggugugacugaaugcugcauuuauuuggucgcucuuauggggaaugaucucauuauugaauuagucuagucauaauaacauugacaaggagaaguuaagaacauagaagccugagggauacaaaaacccauuacuaaugcucuaaggaauauaauuccuaaauucaaucauccuauuuuaaaugauuuuuuuuauuuagcugaaauaaguaaauuaacacaguuuuuggcagacagucuggggccugaaaaaccuggcaucugaauaaugcaaugcugacugggcaggauugaaguuggcaucagcaggucaugugccgaugaagcauuucuucaggaacugagucccaaccacgccuugccuuucacagucggauuggugaauugugucccaggaaguagguacaaguggcaugugaccacuugggacauguauugcuacuauuauucuuuauucugacauggauuuuugacaggaaauaggcuagcauaaagauacagcacuggaugaaucuguucuucugauucugcuuuagaagacaucuccuuacuaagacuaagcuccaagaggccgagacucuuuucucagugccucuaccaaaguaaguguuaauuguauguacugaaugaaugaaaagauaucaaaucaaggcuaauuuugguguggaugaagaccuuggauauugacaggucaguuuauguuuaauugccugaaaguuuaaaguagccggcaugggucaguuuucuuauaagcuuguaagaaaaagcguaucuuccuugcaguucguucuuuguaaaacagaaaccauauuguagcccuacuacucauagucucuuucccucucauuuuuucuuguuuucauacagacacacuuuauagccuuauuuuucccccgcuucuuguuuuugguagggacagguuuugugaaaggggcuccaucaauucuaccauauuugaagcuauguaaaauacauaaaacagcaauaccaaaauagccagaaauaauagacugcagcaguguaccucagcauuccuuaagcaauguuuaaucaagcauggacagcaucuguauuuccagcaaaucucuauaggaauguuaucuucuaacacaguaauuaaucacuaguugccgugugucagaaaacuuauuuaacaagaaguugcaaagugcuuguaguuuucuuaccuucucagccuuccuggccaguggaaaauauaacaccuuucuguaauaaagaaaugaaggaucuggagggauuccauugauguugauucuucuacucauaguauuguuaucuugucucucucuuuucaugcacaccuucccucuaacuaaucucuaaaugaggguagaucuugggugagcaaaggaaccagacaacuuguaacauuaccagaaguacagagagccucuguccucuaugguaaugaucauuuaagcucucuuacgguuuuaaccccccuguuaauuuucagagucaaaaagauacuuuauccaggaaaaucaguguagaugaguuagaagguggaagggcuuuaugagugugcuuuuuuaguuccuuucaucacagaucaucuuaacuugagcugucaugcaccuuuccacaugugagucacagaagccaccuaggaguccagaugguggcagcauaacaagagaggucugaacgaacgaugauuggaguccccaagauauaucugacaaccuuucuagcuugagugacgccauuguucaaaaagaauaucccagaguuuucuucccaguucuccccucuuuaccccauuuuguuucuuucucugccucuucagcugucucuuuuuucuccuuuauuucuccaauagcucuacuuccugcucuccuccuucaagguuucauugcuccucaguuuuuccccugauuuugguuuuuuuuggacugguaucuuucauucuuaaaccugcacaagguaaggaaacaaaagcuacgauucgggaagcgguagggcgaaaaauuguaacacccaagacagauuccucgcccgguuauuccuucauuucuucauuccuucaucaaauauuuauucagcguauguucucuguagguccuggccucaugaaacuugcauuacuguggggcaagaugcaaaguaauaaauaaguaaaauauauauaaaguauuucagaugauaauauaugcuguaguuaaaaaaaaaaaaaaagaguaggcauggggaggggaccagagggugccagagucuaauggagguaauccgaaauuuuagaguguuaauggaaguccuuaaugagaugguaacauuugaggaaaaaccuaaaggaagaguaggagcaagccaugcagcuaucuagggaaagagcguaccaggaaagaacgucuaagggugaagagccagagggaggcauacacuuaacaucugaagaacagagcagaaaggccagcauggaugaagugagugagcaggggaagaguaagagaugaagucugagguuugaucuaaggagcugagaucuggaaagucauuguaaugacacugaguuuuacuuugcaugagguaggaagcuauuagaagguuuggagcagaagagugcuacauaaugugaaucagucuggccgcgauguugaaacuaacaucacaguuguuaguuggggaggggagguuguaggcaaaggcagaagcaggaagcucuguuagaaaacuguggcaauaaucuucuagguaaaagguaguggugauucaaagcaagaugguagcauuggagaggaugagauauggucagaugaggauauauuuuaaaaguugagcuaacaggauuugcugaggaaucagaagugaaccaaagacuacaaaguuuuugaucugaacaauucaaagcaugaaguuuuuauuuacuguaaugaaagugaaccagaccauaggagaggcuauugaaguguguggagggcggagaggggguucagauagagaggggauaacaagaaauguuugagaugccuguuaggcaccagaauagacauaaaaagggagccggcaauacaaccuggaguugagaugagaguuuuggagucaucagcauauaggugggauuuaaagucaugagaaaggcugagaggugagaucucaauaggagcacaaguagaugaaaaagagaagcuguccaagaauuggaccuuggguaccccacuguugagacgcuggagugcuagcgaagaaccagcagaggaaguugaggaggcagccaacagaauaggaagguagcuaagaaaggguguugucccagaagucaagggaaguguuuuaagagaagugugucuucaucugugucaaaugcuguugauagguuaaauuagcucaagacagagaacuggcuacuggugggcuugacaagaggccugaaaugcuuugguuugcauuccuuuaucuuucauacacaacuuaccuaaaguaggaauacgcuucaaauguauauauuugggaauaaguuccucacuccucaagucuacgguaggguuugaugucaucagggcaaaacaaaaaugcaauuagaguauuuuuagugugcuauaugaaaggccaaauuggcagccucucuuuucucaaggucaguaucaacaugcauaaaucauguugacaguaugucuaugugcccuugacaugaugugaugaaaauggcacguuaccaaaaccuauuaccucaaucuaaucaugagaaagacaucagaaagauuccaauagagauacauucugugaaauaccugaucaguacucauccaaacugucaaagccaucaaaaacaaggaaagucugaaaaacuaucacagccaacaggagccuaggagacaugaugacuaaaauguacuuugaccuccuggaugggguccuggaacaaaaauaacauuagguaaaaaccaagaggcccugaaugaacuauagauuuuaguuaaaauaauguguuaauauugguucauucauuguaacaaauguaucauacuaauguaagauguuaauaauagggaaacuggguacaaauuauaugugaacucuguacuaucuucucaauuuuucugugaauccaaaacuauucuaaaaauaaagucuauuaauaaaaguauuaggcaaaguauuucagagaacauuuauccaaugaaaauauacagguggcuaauucauauuaagcaugaaaaaugcucaaauucauuuguuauuagggaaaugcaaauuaaaaccacaaugagacaucagucugugcccagcaggauugcuguaacaauaaaaaaaaagaaaagacaaugaaaauguuggcaagguuauggagaaacuagaacccucauuugccgcugguagaaauguaaaauggugcagcugcaucauuuccucaaaaaguuaaacauagaguuaugguaugaccuaggaauuucacuccuagguauauacacagauaaaugaaaacauacaugcguacaaaaauacgcacacaaauguucauagcaagcauuauguauaauagccaaaaaguauaaacagguugggcgcgguggcucacgccuguaaucccaguacuuugggaggccaaggcaggcagaucacgaggucaggagaucgagaccauccuggcuaacacgauaaaacccugucucuacuaaaaauacaaaaaaauuagccgggcaugguggcagaugccuguagucccaacuacucgggagggugaggcaggagaaugcuugaaccugggaggcagagcuugcagucagccgagaucgugccacugcacuccagccugggcgacagagcgagacuccgucucaaaaaaaaaguacaaacaaccagauauccaucaacguauggaugaauagaacgugguacauucauacaauggaguuuauuuggccacagaaagacaugaugugcugaaucuugaaacauuauguuaaauuuaagaagcuaguaacaaaaagcuauuuuguaugacacuauucauaugaaauguccaaaauagucaaauuuauagagauagauuaguaggggucgaaaggaaauggggaaauagauagaggagucuuuggggggugaugaaaaugcacuaaacuagauugugcugaugguuguacagcccugugacuauucuaaaaguccuugaguuguacccucuaagucugaaaauuauaugguauaugaauuauaucucgaugaaggaguuuaaaaaaaaaagagguugaguuuuaagacuugaaaaauuaaaucauucaucauaggaaaugaggagccaaaguuuuauccucccauuaguggggaaacuuuuaaaaggaaauauuuggcucauuuuuuaguuucccuaauccauccugagagguagaagauaaaggaagaauuuuuggagaaggaggugauacuucauauuagucuucauaggaauuauccagaauagggagaaagucauuuggaagagaaaggguaguuccggggacuggagaagauguucaaggaaggagguggugaaagaagagaccugagucaucaucaggccugaagucagggcuggcuuuggguaagccacaaaugccaccuuauuaaggccuucucuccugcacuuucaaaacaugccuuccucccccaccagcacucccuauuguccuuaccaugauuuuaaaaagcguauaucugacauauuucguauuuacuuauuuguuccucaccugucuacacugaauagaauguaagcuccauaagcagggacucuuuuuuguucacugcuguagccccaggaccuaaaccaguaccugguauguaguagacauucaguaaauacuugugggguguuaaaguuauuuggacuuuguccuguacguaacugaaggauuuuaagcagaggagugagauggucagauuuauauucuaaguacaucauuucagcagcaguauaggacuuggauuugaggaagauaaaacuggaggccuugccaaucaacuggaaggugauugcuaagaaagugguagggggcuaggcacgguggcucacaccuguaaucccagcacuuugggaggccgaggcagguggaucacgaggucaggagaucgagaccaucuuggccaacauggugaaaucccgucucuacuaaaauacaaaaaauuagccaggugugguggcacgugccuguaaucccagcuacuugggaggcugaggcaggggaaucacuugaaccugggaagcggagguuggagugagcugagaucacgccacugcacuccagccuagagacagagcaagacuccgucucaaaaaaaaaaaaaaaaaagugauguguagggcuucaacaauguaucagugcuuggugguggggggaguggggauggaggagacauauuugagaagugugaaggagcuaaaauuggcaggucuuggagagugauugaauagugaggguaaagugaaggagucaaggaugacucuccaauuucuaacaugagugucuagccagaucacacuacagucaaguaagauaaggauacaggaggagagaggaguaggucugauggagggaagaucaucagugguuguggugaguauaagauggaugugggacuuccaaguggagacaucuaacaugcaacuggauauguaaacuggaagcuugagggaaaggccgggagugaacaaacagauauggggaaucaucagcauggagcuauuuaaaaccauuaacggagaucaaggcuguagguagauggagaguaauccccuggggaagacccaaaagggcaugagaaggaagaggagccccugaagaagauagggaaggaauggucucauagcacaaggacagaacacagcucaugaagaccaaagagagugcaugaucacauagcugccugcacagaaaugcuacuuucaccauaaauugauagagcauccuucuucccaauaaauggaagcauuuucucacguuaacuucuccaacucuuuuaauuaaacuguccagauacuuuccucaagugacagagugauaaagccagccuagcaacuaaacauacagauucagaccccugcuuuauccuugaccuuguaccuucacuaaggccaggaaugaucucuggcauagcugagaauguugaauuccucccaggggagcuguuuacauaaauuuauuuccuacaaaccuguugcaccgggaacauuacuuuuguuuucugcaggaaagguugugaguuuuccuauuuggaaugaccaaaguguaguuugauagaaggggauuagcaaugacaugcugccaccuacuggaacugcccacagacagccagacugagaaugucuguggucuccuaaaucuccccucacucuucugaaucaagaguggguauugccccugaagcggacuucaaaggugacuuggcuugaaaaugugaaaugccccaccuaucaaauaaaaauuuaucugacugcuuugcuagaagaacaauuuuguuucugagaaagaagcacaauauuugucacauccuuuucucuguuugcguuucccagcuuuauucugccauuggucuuguuugccuucccaauucuaggggcaccuauccuuuucccaagauuugccuuuaauaccccagauuuuugacucaagauuauuagccguguagauuugggauuaauuuuguagaagagacuagucugcugccaaaaaaauucuuuuuuuaaugaugaugccccuuaaaaugcuguuaaaucucuuaaauuuaauagugauaaaaagcuaacccugauuuuccuaggggccagaguaaauugggaaaugcgaugguuuacauggcuuccacugccagauagaaagaaauauaccaguugauaaaauucaguaauaaaaccaaaucuuguacggccugaucugauggacuuuuuaaagaucuuuauauaaauagauuuaaauaauauuacaucucuccaauuaaaccuucauuugaccuugcugucccguuucugaccaugccgcuuuuuucugaucucccuuuuuuuacauuuacauuaggucccgugcauuguaacaauuaauugaucucuaauuaaucauuuaauuaggacuccuugaaugcgggugagcaugccuuacuggucugcauauccuucacagagcacuucagagcaauaaauacuucuaagccucucaaaaaaaucucucaguaacugacguuugauuccccauaaacauaucucaugugugaggcuuugauuaaguaagauuucuuuugauuaugcucaauuagugucaccauauuuuguauauauauauugucaauguauaauuuaggguuccucgagauuacuggcagacagugacacucuucccuuuguagcacaugugcuggaauuggaaugauucagagauuagcauagauagcgaguauuauuauuauccaguaaagaucccaaggaacagaaauaagaagugacuuguccagaaucugucaucgaauccugcuguuuauauauucugcaguaccuuuguauucaucauaguuaguuaauuaacccacccagggaggcuauuuuucugccagggaaggguugcauuguacugaaaagauauuaagcuuguucugugacugaagcccaagaaugaucauuuaccgacucuauuagaauucucacugaaaaauuugaggcuggaagcugaccuuucuuguuuucuaaauaaagauguaguguuuaaauuuugaugcuugaaaguaggaaacuggcacaaucgcugucguaaaagcagagcuacagccccuguaaaccacaucaugccagacuucccauccugccccucccuuuaccugcuuuaucauauacaggaagaaagcccuucucuucauucccaccuccugcuuuacugaacacccuuugcugauccaaacagaaaaagaucagaguacugaaggaaggucacauggccacagugaauucuguggccagcacuccgcucaaggaccuuuuguucucugaaaccuucuccaaugugccuggcccauaucacuugcucuuuuuauaauccuuuuuuuuuaauuuucuguacucuaaaauuaauaccucauuaugugcuauauuguucuucauuuguucccaucuuuuaauauuuuauucaucuaauuuuuauuaacauguucucucucuacugaauuauaaaguucuugugacuaguuaccaugauuguauuuuguuuauuugguuucugggugguuuucccccuuuuacuucucuguaauagacuaccugucagcaaucugaaguauuuaugaaaauaauauggguuuuaaaauauguuugauauguauuacuuucgauguauguuuguuuuuguuuuuuguuuguuuguuuuuuugagacugacucuugcucugucacccaggcugaagugcaguggccugaucuugccucaugcaaccuccgccucccagguucaagcgauucuccugccucagccuccugaguagcugggauuaaaggcacgcgccacuacacccggcuaauuuuuguauuuuuaguagagaugggguuucaccauguuagccaggauggucucgaucuccugaccucaagugaucugccugccucagccucccaaagugcugggauuacaggcaugaggcacagcgcccagccacgauguauguuuuagagagcaucuguagcuaaauacaaauagguuaccaagaaauaguuuuuguaccuagcuuuacagaccuuuaacuuuaaacuacuuucucuaaaacaaggaaagcuccugcaagacaugugauuuuuuuuuacaaaccauccuagaggccuauauuggugacuuucucucagugaugaugaugaugaugaugaugaugaugaugacauauuccaaguauaauaugaguaauuauaauuacuguuauauaaugaucucagcacaugacaugaacguuaguaaaugcuuuaccuacauugguucacugaaugucccugaaacucuauauuuagcuauugcugcaaaaagaugagaaaacuaaagcuuaacgaaguuaaguaaauuccuaguuuacauaagaagagaggccagauucaaacuuaggucaauccaaccccaaagucuauguaugcucuuaacuacgugaaguaaggcuaccauuuuggucaauguugggucucucuuuugcuuauauuaaaauaugauuuuauuuuucaguuauucucuuagcuaucaaacauuucuuuuuuccuuuauuuucucugguugggugucuuucccccuugauuuccacugagcucugauugcuaacuguuuuaaucagcuuuaaugggcaguuugacggcagaggggucugcagacucuuccuaccuuggugguguuaugggguugguuuugcucagcugucagguguucaugcugcuugugggucuucugcuggccuuccaaacaacuguccuuggggagcaacacuuagacccgagaccacucucucagaaucucaccacaaauuagcacgucaucaacagcacugagcagcaccaucauuaauccaaaugcauacaccugugcuuuuaagacaauaagcagcuaaaccaagugcuucccaaagacuagaagguauaagaauuucccuaucagcuacagggucucuugcagggaaauuguuuuaaguggaaacucuuugacuccaucccuaaaaguucugauuuagaaggcugaggguagggcuugggcaucugcggcuuaacaagugcucaggagauuaucaugcagaaauaccggcccugaccucguuuucuuugagauucaugcaauauccaggccaucgucuuucaaccucauguuucuccuuuaguccccuuuacucuuaucuccuacugcaggcagcaaaaguaaaaauaacuugaaagcacuuuucuagauuauuuuaaauuauuaaaaugacacacaagguggucaccauuauuacucucaguuaacauguguagacauugaggcagagucggguuguauucuuggaaauuugggaguaaacuaaauagcauuucauucaccuaguaguuggcuaauaaaucaaccuuuaauuguugcaugaauuugaguaagucacuucagcucucuuggcugaaguuuccucaucuauaaaaugaaggguuugugccugaaauggcagcacuuugggaggcugaggcagguggaucacuugaggucaggagucugagaccagccuggccaacaugguaaaaccccgucucuucuaaaacuacaaaaauuagccaggcacgguggcaggugccuguagucccagcuacuugggaggcugaagcaggagaauggcgugaacccaggaggcagagcuugcagugagccgagauugcaccacugcacuccagccugggcgacagagcaagacugucucaaaaaaaaaaaaaauaugaaggguuugauuagaggaucaacuauagggucucuugcagauuggacuugccuagaguuccaugacauaaagccagagagcgguuugagagaucuagagcccugccucaacuccuagcucucaaaagagacuaucacaggaaagcuaucuaagaggaaacaaauuagcucccauccaauuccauaaagauacuguaaacaugucugagauaugcaguauauaacaggcauuuuaauauuuguugauuggacaaacuaaugccuguguguauggaugaauuaaugaggaaggaaguacuguaggccuguuucuuuucauagucaagaucgugcuuaaagcauuugcucaccacacguacaggagaguaaaacagaucuagacgcuggcuacugcuuuugcaugaccuauaaaggucuuauaaggcucugaacaguaauucaaaauguaaacguguagguacucaaaaacauaaaugucacaucugcuuuagcucuucaucuccauugcugugcuguaguuuuccaauugauggaaagguuuuauucagaucagccauuucucuuuuuccuggaggcauucuuaaucuccguguucuaaccuuuaacaauauaggcuucaguugccgugugaugauuuccauugccuggaaucuacauguuuaaauucuuccaaagaauugugcaccuucuguuuuucucaguugcagauggagucaaaccagaaaaaaaaaaaaaaaaaaaaaaaaguggaguaggagaggccagcucuugauugacuucuuucucuugacacacacggucaggggaaggaauggaucaauugccucaacuuuucagcaggcauuaacacugcaucucauucuccuucaggcagucuguuucgcagagacacugauuaaacauuugggguauuggggacagagggagggagggagagguuggggauuuuuaguggcuagagccuuuuauugacaacauuaaaggcuucaugauauauuugaccagaaauuaauuacagcccaguuccccauuucucccuuaggugacagucuucuguugaugugugcugcugugaaaguaauaauagguuucaaauguuugugaaaaacauaaaguaauuacuugcugugguaaaucagucauuugaagcuucagcuuuucucuguucuauguguguggcagucuguuucuuuuguuaacuuuaauuauacaacauaugagaauuuguauuuuucaguuuucagaaguuuugcuuuuuucauuucuuggugcauaguucuccagggauauagguauugaaaugauaaugacacauaaccagcauuugaacaagggaagcacaugugugugaggaagcugauugcuuuaguuaaguuucguagcuauuggcuaucagcuauuugccaguuuucuaaugggucuuaaauauuuacugucuguuguacagaggggaagaauuggcuuucaggcauuuuaaggcuccuuccaccaauagcacuuguuuacauuaugggcccucaagccaaagagucuguaauagcucuuuccccuuuuucaaauuaaaaaaaaaaaucuguuuuuuucuauuaaaagcugcagcuccuugccugggguucuugccuuccaguaagaucuguaaagaucugccuggauaauaccaaccucuauguugacucaccuggacaaagagagagaaauuuccuuuuggcagcuguuuuaacagggagccuugcccagacagaauagugaggccuguauacuggccagcauggcauauuaucacacaucaauuuccuucugucugcacuaaggcuagcucacuccucaaaauaggaauuguucacauguauuuucaacucaaauaauucauguuaaucuuguuucucuauuuugucuaaucucucuuguucauuccugaucagugaaguauccuuagucugcauuucaaagguuugcuuaauuucccauaccaagcugccccucuuaaaacaauguuuuccccauucgauguuaaccucuuucuuugaacuauuauuuauauuuagaaccaaauauaagaacaguaagaacugguuaucaguaauuccucuguauggaaaauugugcuaaacuaggacucugugcuuuuacauugcagugauaauugggauucaugauguuugcccgagucuagaauaucccauccauuaccaaagaagaauacuacuacaauuaguauaguuagcauuauauauauuuugcuguauucugucuuugaaaaaucaguaacucaauaugauauaucugagaauaagcaagaauaucugauuaaaaauaccccucauguucuuuucauacugcaucguagaguauuuauagcucuauaauugucauagcauuucauuucuuccauaagacuagguaguaaugacaaacugcuuaaaauaauuuuauauuacuuuauuauuuuuaauauuaauaacuacuaugaauugaguauuuauuuuguauaacuuaugugauuuacacacauugucuuauuuaauccuuauacuaaccuaguauguuuacgaauuaacuuuuucauuuugcaaaugggaaaacucaaacucugaaggauuaaguaacccggguucuacacugugguaaaugacaagaccaugauucaaagucaggucuaucugcaguuuagccauugcgcuauacagcuuaugacaauguaauacauuaguauuucaagaaaauguaccacagccucaauguucuuauugacuguauugcacaguauuccuagucaaaagaacuuaaaggagggauggcaguguuuuaucuucccagagaggaacugaaaggagauguuguauagucgaccugcaggguaaaacaaaagaagacccaagaagaugaugaaggaggauuuuagcacagucccuaaggccugucuaggaaugaccacagucauugaugggcccaacacaggcaugaagugguguaagaccucagagagaccuggcauggcagcaguguuaggggugcccaaauccaggaggaaggcuggaccacaccuuacagggagaaugaguccaccaaguacaaaccucaauucccacaguaucaguagagcuccuaccuagggugguaccacagugacugaugaaagugucuuaaaauagcucuuaaaaaguuaguggccagauacgguggcucuugccuguaaucccagcacuuugggaggccgaggcaggcggaucacgaagucaggagaucgagaccauccuggcuaacgcggugaaaccccgucucuacuaaaaaauacaaaaaauuagcugggugugguggcaggcgccuguagucucagcuacucaggaggcugaggcaggagaauggugugaacccgggagguggagcuuccagugagccgagaucgcgccacugcacucuagccuggguuacagagugagacuccaucucaaaaaaaaaaaagaagcuaguauguuuuuaauuaauuuaaaauauucacaaaggaggagaaaucaagaagcucugucuuuuguuauuucaauagaaaauccagucauuuuaaaagaaaaaguagugauauauuauugacacuuguccauuuuuggcuaccccuccucuaaaaucuauguuuaaggaauuccccacaaccuggucuuggagugaaacaaagugcaucuuccaucauaaacacacaaaagcccaagcuugcuuacugugugggggacaaccucagcuucgcccaucagaugcaugcacucugaacucugaucggggagcuaaggacuccaagcacaagggugacagagcaccacagaaggcucccucagcagcagugguaacuucugguuaccuaagguggcggcaguaguaguggcagugguauggccaacauccacuucugcuggcagcagagcaagaccugguguucuguguuuagcagcagcuguggugguaucuucacaaaacuaucuuugaagagugauucuggagagauuuuggccacaaucccagcugcugucuagcuuuguuuauuucugcucccuuuccaagucucauucuccagccuuccuggcucaucuuggaguugcccaguacccuuucaauaauuccuucucugcaacuuugaacccugauuguuacauacauauauuuauguaaaaucuaguaauaauuguuaaucuuagcuuuuaauucuggcaguccacagugaaguuuggagucuuacauuauuauuauuacuauugaaguuucaacccacauuguaucacuuaucuuggucaauuauauaacaaacuuaacugucuaucaagaguuuuuauuuuuuaaagaaaaagcaaaauugacuggauugcaugcccugaagcaaggcuacccagaucugggaaaaguuaguuauuggaucuacacauuuguuucccauaaaucaucccaaagcgcaguaccuaaaacaacaaccauuauaugaguucucuuaguugagcagauugacuggggcccagcuguaagguucuucucuggacugccuuggguucucuccuguggcugcagugggauggcagcuagggcuggagcauccggaauggcuugccucaucugucuggugauuugguggggacaacuggaagccuggacucagcugggagaugggcauggcucaguuccucucucuguuucuguguagucucagagauucccccucuccauguagauuuuccaugugauuucuucaucaggguaggcauaccucuuacaugguuacuuggggcucccaaaagcaugaaaguagaagcuaucaagccuuuuuaaggccuagacccaggacgagcauaguaucacuucugucacuuucuuaaagcaagucacagggcuagcccagauuuaauguaggagaggacuaaauagaggcaugaaugacgggaggcauguuucauuaggaguuaucuuuggaauuuagucaccacuauacuuaaacuucagccuccaguuaugugcacccaacgcagugccucauacaguagacauuccaucuauuugucagaaugcuuucagugcaaggagcagaaacuuaauucaaaugauuuaagccaauaaaggaaauuucuugaaucaugaagcuaagacuuucaagggcugguuggcuuuaggcuugcuuuaaccaaggauucagaccguaucagcaagaucgcuucuuuucuuccuccaacuccugcuucuauuugcaucugcuugucuuuauaacuacauagccugucuccccacgauggcaaaguaguagcccagacuuauacucauagcuggaaaucuuagggaaagggaaaucucucuuccagaauccacggaaggacucuugaugggcucugucuauuucugagccaauuccuguggcccagaggaaugcagcauucugauuugacaauuucaaaucacccaccugcaccuguggugaaaaguugcucaguguaaucuggaucuagaagaacauuuucuagagaaaaggaagguuugguuaccaaagaagagggauagauacuagauaaacaaaaacgagauaaucccuaagcccaauagcaguuugcugaaugaauaaaauguagcuuauaaaugaguggugcagacacuaccauacugaguuuauuaggugucaaagaagauagacauuuaaaaacaaugcuguuauggaaagauauuuuuauggaaagagguagaagugcugcuggaacauuauucaaaguggguugaaaucguuagagaaaauguuguagaagcaguuuuugaacuguacuuugaaaaagguaagauuuagaaggaaggaggauuuuauaggcagagcaacguugcuuucuuaaaaaacaaaugguguuaauaaaagagaagguuacagaguauaauuuuaggauguuucugauccucugaaacuauacauguaagaaaaucaagaguuugguuguuacaguauguugaacuauauaguuacagauuuaguugguuccaaaaagauuuuuuuuaaccuguauaugacaaauggguguuuuagugauuaaggggggggauucacacaaaaauaaaacuaucaaggugauugcuaucaaggaaaagaaaacuccuuuaaaaauauauaguauauucauuuuuguuguccuuugucacuuuaacaguagaugcugaaauuaccagaaauaacaguaaucuguauuuauaguccuccugugaaucugaagguuuccauaaauguaaauuaauuugguucuacucucaugaacuguggaggaaacagaagcgaaauauucccaacuaccccauccgcacuucugucugagaaagacagugaaagaaggacugagaauaugaggaaaaaagcagcaaaaacugaauuggcuggcugggcaccguggcucaugccuguaaccccagcacuuugggaggccgaggcgggcagaucgcaaggucaggagaucaagaccauccuggccaacaugguggaacccugucucuacugaaaauacaaaaauuagcuaggugugguggugcaugccuggaaucccagcuacucaggaggcugaggcacgagaaucgcuugaacccaggagguggaggucgcagugagccgagaucacgccacugcacuccagccuggcgacagagagagacuccaucucaaaaaaaaaaaaaaaaggaauuggcugagcugacuuuguaguucucaugggguuagugaaggagaaagaagcagagcucagagacgggauuugaauuugguaagaauagaguccugguuggcucagaucacuagaucguacugucagaagcucagaaagucuuaauugaguaggaccuuagagaugguaucuucuagccccuucguuuaucaggcuggagacuugcucugagagauggaguaacuggccacaaaugauccagauagggcuagaacccagauuucugaacucguuuuucugggcucccuccuggagcucucaacaccccuuacagacucaugucaggagcucucagccuuauucacauucucccugggaagagugaugcccuagggcaacgauaggcaacccaggaagaugauuacuagaauccucuggaggaggagggucauuuugugguguguuucugauacaauccuaagaguaucauguuaaccccauuaaccauaauauccaccuucucuaauacuagaguaacauugcuguggacacaucuuuacaaacaaaaauuacuaugugaugauaauuaugacuucuguucacauacucaaguccuuguugcuaaguaaaugcagaaagauuauuaguuuuauuagccuuugauauugaaauugucauguucucucuuagcuaugaagaccugcucugcccacaucaacuugguuauuuuuucguaaggaaauuaaaguagaaauuauaacacaauuacuaucaaaauucuacuaaacuauaagucgaaacaaaauauaagaaccgcaauuaugugagaauaacaugugggaaacuguuccugcugcugagaugcguaaagugaagucuuuggaagaaggcauggaguuacuagguagccgcaguguggaggguggcuggacuucucugucgcuagcaaugggcauggugccauugccaaugcuuggaagaugagugucuucaccuaacuuguuaagugccaacuagucuucugccuccaaugaagauuucuccuuugugugcacagguucuucuacugagccccaggaguuuagggucaucaugugcccuuaaaguguggagugauaagagagaaucucuauaccucugaccaauuuggaggaaagcagagauuuaguguuggggccacuuacacguaaucuucuuuuucucacuuuuucgcugagaggaauguggucuaaucuagacaccuacuggcugccuugaaagagcauucucagcuauacuggcagaucuagcaaagagaugugaaaggauccucagguggccccuucaggggucuuucugaggagucaggaggaaccagccauugugaugauaagacacccacccaggugguuuucucuuagugugauaaaggaagcugacccugucgaggccaagauguucacccaguggguuauccuucuuaugcagagggaugacguacccucaguauccaaaacauucuaaugucuucauugucuguuuacauuaugccuccuccucacugugggaguuccaagaaguuuugcgucuuucccuauaacuuuuauaacuuuugccaccacccugacugaucuccuacaacauacaacauggguaaaccucaaaaacauugugcuaaaugaaagaagccagucaaaagaaaccacgcacuuuauaauuucauucauaugaagguccagaauagggaaaucuauagaaacagaaguagauuaguguucacuuuagggcuggauggagaauagcggggaaggggaugagcacuaaaggauauaggguuucuuuuugguggucuauugauugauugauugauugauugcuuuuauuuuauuuauugcuucaugaaugacaagguuuuacucugucacccaggcuggagugcaguggugugaucacggcucacugcagccuccaccuccugggcucaagugauccucccacuucagccuccugaguaccugggaccacaggcagacacaaucacucucagcuaauuuuuuaaaauuuuugaagagacagggucucaccauguugccuaggcuggucuuaaacuccuauucucaagcaguccuccagugucagccucccaaaggguugggauuacaggcaugagccaccaugccuggcugguggcccuuuuaaaguagccuuuucuuaggcucuuacauaucuuuggaaccauccacuauugggagcuucucuccacugcuuucuaaaaugagaauagccauguacaagcauaugauuuaaacuguuucaauaucuggaacguuuccuaaagaagucacuugcuugagguuauaacagauuggcaaggggucagucauuccauucauacaucaaauauuuauugaauaaaugugagagcuagucauuccuggagcuacaaagauaaaaauaugauuccuauuuuuacacaguauagcacaguagaccucaguaaugggagcagaacuuugugauaagaauuaagagagggaaagcauuaagguaagaaaggagguuaaaaccucguaagaugcccuccuagguauauacccaagagaaaugaaaagcauguguccacacagagacuuacauacaaauguuuauagcaguagguaguauucauaauagccaaaagguagaaacaacucauauguccaucaaugaugaguggauaaacaaaaugugguauauccaugcagcagaauauuauguggccauaguggacuugaaguacugauacgugcuacaugcugccaagucuguccugcagacucuggccaagcgacagauggaagaaguucacuggcacagguauuuugccuaacaaugcggcuagaggaccccacagcuuagcaccgcugaugagagugcagugcagccacagcagcccccauaagguggagacacuugcauuuauuucguacagauuuaaugacaaaggcuuggagcaaauacacuuuguggguaauaaaccuuguugacccgcacccccccucugcccccccagcucacccccccgccccgaguagagagcaguccugcacacgacugaucaaagguugguuucuggagagaguaaacaaauuuaucuagauaagucucuuuacaguccuuuguuaucgacccuuugcugucaggcucccaauaagagaauuuggcugccuucagccaaauuuucuuuugaagcuuuugcaaaaccuccuggccuuccaagaaguuuugcaucuuucccuauaacuuuuauaacuuuugccaccacccugacugaucuccuacaacauacaacacggguaaaccucaaaaacauugugcuaaaugagagaagccagucaaaagaaaccacacacuuuacaauuucauucauaugaaggaccagaauagggcaaucuauagagacagaaguagauuaguguucacuuuagggcuugauggagaauagcggggaaggggauaacagcuaaaggauacaggguuucuuuuugaggugaagaaauguucugaaauucauuaugguccugguuguauauaucuguaaauagauuaaaagccauugaauuuuacacuuuaaauuggugauuuguaugguaugugaauuauaucucaauaaagcuguuuuuugaagaagaaaauaagagcaaaaacugagagcagugguagggaauagcagagaguuuuugguuuuguuuuguuuuuguucucucuguuucucuaaaaggggaaacauuuuuauggguuauggaaagacagacgcaagguuuauaacccugccuggaaguaaggaaaugguuuugguagucuuggugauuuuagugucauuacuaucaucacuguuguuauuaagaguugauuguggagcuaacuaggacuaaggagcuuccagguagaggaggaguagauuacacuugggaggguagagacaaguauuacuaguucagaaucugacaccuccauccagcuggaagaagacuugcuuaugcuagaaaaggaacuaugcugccauaagcuacugaagaaauagcaauuccaaaguuagaauggaugcauccaaagaagagaaggaaacuucuaugcaagugaaucuaagacuccauuauaaacccaugaaguuaagaagagcuaaagaagcauacagaauuauuuuguuugcaacaaaguuuuuuuuguaaguuuucauuuguugcugaaucucucucaguugugguuauuuuaauaagcagugaguuuguaaaguccugguuuaaaauacuaaaugucugaucucccuauuaaccccaagcaucugagauuguaaaucaugacucuuuguugccaccugaugacaacaaagaguacagcccuucuggaaauacuagccuuucuagaaacaaauuaauuucuugaaagcugaaauuagcaaucagugauucagagauguugacaaaggcuuuuuauaaguuccuugaccuugauaugagaaagaggccucuugucauaggcaucuuaacgcauacugaaguuuuuucuuauaacuacauuaccuagaaagcaacauccuccauauugaaagugauuuucaauauauuacacuaaagcauucaguguguauugcccuaagucugucaacaguuucuccugcaguugucgcugaugucacuguccaguggcugcuucucucaugucugaacagcugcaagccuguucuuacuguugcugcugucaucaccaucacacacaaacuguugccccugccaccaucuuccugcugcuaaugggacugauuggcaccucuccacaccacaucaaggugcaggagcuauuuccccugccaggcucagagccaucugacaccucuuacugccaccauucauuaucacccucacagcagugaagccaacaggaacuagcucaguccugagcuggggggccucacuggugaagggagugcgguggccaccuuucugccugcagaagcagcugggccucucagacuggaccuggggacucaaaaaauucuguacuuuuaggggucagcacauuagagccccagcaugucucuucuguacugguuacuggagaugaaagcaauuagaaaauuauucuguuuaggagaguggacagcaccaacagcuuccuccucaccaugugccugcauagguaacaaauaagcaauauucugccccuuccugaccacugggcaaagauuaaugccaugcauugaaaguuauuuuuaaauguccucaauuagcuauaauauuuuuaacaaagcuuguaagguuuagguaauguguaggguauaagauggcagacucauuacuguacuuucacagagaaacaaaaaggaauaaauccacaacugagaaagaauaggaggauuuaccaauaaauaaaugacagcaacuuucuggaugauaggaagaagauggaacauuguuaauggauaaaguaguuggggaaaaggaaacccucagucuggaaugugcaacgaggaccuuggagaaguuccauguucauaaucagcaguucaaaaaaaaaaugucagagugccaagagaaaccgaaaauagagacuaaugaaaauuuucuagacauaaaaauauauauccuacaggacuauuuucuucaccccuccaaaauguugguauccagaaguuguucuugaaagagccauccuaggaaauauuuagggaaagucaagacuucugguguggaugucagaggaccagaauaaaacauucauuuuagcacuggagggagaggucccagccugacaguuggcaucccaccugcucauccuaaagagaaacccaccuguuagcaccuucugcaccaccccacauaacacucccaggaacucccucccucuaagaaccuuuuuagaaacaugaucuugccuauacuuagaggcccaagauccaauuggaguccgaggaaaagagaacagagaaugaaggggaggggaaauuacugaagaacuaguaaaaaugcuuuucuagaacucaggaagggcccaagucuucauauuaagagccuguugggugcccaguucagugaaugaagaaauagccucaccuaaaacacagccucaugaauuuucagaaugccaaaaguaaacuuauaaaagcuccagagagaggggcauaaaaaaaagucagcugguaucagacuuaugaucaauagcacuaagugcuaagaaauaaugaagcauucuuucucagcuccaagguagaaugauuucaaccuagaauuagacauccaaacaguguaucggccaauuuugagggugcaauaagggcaucuucagauuuauaaagacuuggaaaguugacuuuucaugcucuucuuucuagggaacuuuuugagaaugcauuuaagcaaagcgaguaaauaaaccacaaaaaucagaaaacgucgugucuaaaagagacuugauccagcucagaacagugaaaagguaaccaugaagcaggcuuagagaggaaccaguccaaauugggauaaugagauacagcuguucuggagaaaguucucugggugggaaaagacucaagaaaauagguaguaugauggagagguugaaaaagaaccuaagaugugaaaaacucaaguaguacaagagaaaggaaaggcaauuggaaauuuuuaggaaaaaaagcaacuauacaggaaauguguggccugcaugcaaagugaacuucuagaagcacccucuuugagaggccucaaggcugugauauaguuaggcuuuguguccccacccaaaucucaucuugaauuguaauccccauaaucuguacaugucaagggagagaccagguggagguaauugaaucacgggggcaguuucccccauguuuuucucgugauagugaguucucaugaaaucugaugguuuuauaaggagcucuucccccuucgaucagcacuucuccuuccugcagcuuugugaacagggugccuugcuuacccuucacuuucugccaugauuguaaguuuccugaggccuccccagacauguugaacugugagucagugaaaccuguuuccuuuauaaauuauucagccuuggacaguuccuuauagcaguaugaaaacggacuaauacagguuguaagugacugauagagaaggaaauauaauccuuagcaucacuggccaagcacuauuuguguauaugugauggcguaaaugcuuuuuauuguuuuucgugaaucaucaugcaaacaaagcaugaaagacuccauuguguuugcaggauaguauguaaauguuuaucuucacccagcaaaaguaagaauguagcugagagaaaauagaaggugagagacagaaauaugguuugggguaaagaaggagauaaaaagguuuuuuuucuuuuuucuuuucuuuacuuuuuuuuuuuuuuuuugagacagagucucacucuguuggccaggcuggagugcaguggcaugaucugggcucacugcagccuccaccuccuggguucaagccauucuccugccucagccucuggaguagcugggauuacaggcaugcgccaccaugccuggcuaauuuuguauuuuuaguagagacaggguuucugucuguuggucaggcuggucuugaacuccugaccucaggugauccaccugucucagccucccaaagugcugggauuacaggcgugagccacugcgccuggccaaaaaguuuucuuaaaagggucauuaauagugucaucguaaaagugggaguaggcaggagauuuguugaaguaaaaauagugguuuagguaguuaauuuaaauuacaaagaacagcauuuucacacaaaaaugcuaaaauauaaccauaaaauacuagaagaaggagagcaguauuacagaugagccauaucuuugucuuccacaucaggagauuuaucuuuuaggauacuuuuaacugcguguaacagaaaacacugacuuaagugacuuuaaacuuuuuuuuucaaguuuucucucaucuaauaugaagucccaagguaggguggcuugugggugggcuaauucaguagcccauugaugucaugaagaacccacguucuugccaucucucugcucuuccuuccuuaagguguguuggcuucauccucugaagcuacuccugugguacaggguugccugcugaguuuccaggcaucacagagacacauuggaagaagaguguuuccuucugggcuuuaucuucaucagcagggaaacauuuccuagcaguuccucagcugacuuccucccauguccuguuggccagaacuugaucacacauucccccuaaacuaguaacuggcaacggaaauggagagcugcuuucuuacggccacucuucagcagauuugauuugguggaagucccuggaaauagcaauuuguaucucagcaugaaccuaagacuuaaacgugacaacuguuaaucucaccuuucccuuaauugauaaguguucauaccaguagaccuauuacagacaaguugucugugcugccccuguaugaguuuaaugacaaacguaauucagaaaaaaaggccacggugacuuucuaguuuccuugaucaguaauuuucccuugagauauagaaagagagcauccuucucuccagcuuauguaucauaccaaaauccucagagcugcccgggugcaauggcucaagccuguaaucccagcacuuugggaggccaagauggauggaucauuugagcucaggaguucaagaccagcccagcaaauaugaggaaaccccaucucuaucaaaaauacaaaaauuaucugggugugguggugcaugccuguugucccagcuacucaggaggcugaggugggaggaucccuugagccugggagguugaggcugcagugagccauguucaugccacugaacucuagccugggagagauagcaggacccugucucaaaagaaaaaaaagagagagaauucucagaacugcugaaugaauuuuuucuuggauuaaacagcuuuauauaauucauagauucuagaaguuucuucaucucugcaaaucuauagauuuuacauuuacauauguagauauucuguagagacagaagguuucugugucacuucucaaaguuuccuuguuuugcuuggugagguggaaacagaaugcaaacuagagcuugaaucccacauuuuacuaguagcugcuuagcccccaguaguuuuuaaccuuuuaauacuucgguuaccuuaccuauaaaauagagaugauuucuuuacacuuuagggugguuguagauaaaaugaaacugcaaguaaaaugcccaguacaaauagaagggggagauuagugauuauuuauucauucuuauucuuccuauuguaauguguaagaggauucuagcacuuaguuucccaguuuuuauauuuuugauaguagcuucauguuauugaaaagugagucaaauuagggggcaaggcagaggaauuuaauucucauuuuaaacagcaauauaguaacaagaggagagaugaaaggcagcaaggauaaagaccgaagguacaagauaucagugguuuugacgaaguuuucucaaucaaagacugcaagcugcucccacguugcccagauccggauccuacagagcuccauugaaggggauuucaguggaaugguuuccucacagaaggagaccagggugacuuuauuucuucacugaaacacuuugauuauaaaaagaaaucagaugaucaaaaagcaugagaugaugggugaaauauguuauaugauuauaauucaauaauaauugaauuucucuagcauuuuucccuugugggaggcucagagaaguucagauguauuaucugaauucguuucggcauacauugguggagaggggcccuguguuaggcuuuccauucuucacacccuacccaggccaugagaccggagcaauguuccuguagcuuugguacccguggcuuuauaaacaugaacgugaacauuuuaggcacaauuuagaaggggauuauccgcaucccuccucagggagaguccuugaguagaagugucaucuuuccaguuccuucugaauccccuucgagcaauugcucuagguucaaacaguucaugaaacagaaugccacaaugaaacugaagacuuccuaugaguuuuuacaaguucuuauuucccagugaugucccaggaguucuugauaaaaaggaccuuuuuucuuucuaguauuccaauuauaagauagcgauccucagcaucuugcuacucaccaacucagguguucucugauucugaucccggggaguuuuuucaaaaugccuagaacugugaauaacaaggugcaaacauagauaacuuaucuuccacuguuuaccuuuaaaaggucaagacccagugcaaucuaggcccccuauaccuacuauggaccacucaguagaacagacaucacauuuccugaggcuagucugagaagcaugggcuaaggagucgcaguaucgauuguauaaggauuagcauaucuggcagaugggaacugucugaacucauucaacugagaggcaucugcaucaggcggauuggcauugcugaacuuucacacggcaaauugaggauuuuaacaugcagcccaacuucuccuguggagauccagugaacacauaaaaagguuucagucuuuaugaauuccuggauauauuaggcauuacagaauaaaaauauuuucccaagugcuguauugauacucuaggcaccuauacuuaacauuuauguucuucgggaaccacuccauguagucagauauucagggauuguuggacucucguuucuuuuauauauccuuuaauugccuuagacugcugagcuucauuaugugggucaauuagucuuuuuugagaaaucacuucuaacacacuaauuuuauucucuauugcuuccuucugauuccucaucucuuucccagucuccacccucuaacucauucucauuuuuauuuuacuucuccuguuuauuuaccuuauguuccuucgcuauccuccacggccccaugcccucaucuucccagagagugcuugaggccuagaccaagcagagcagccacaccacaggcugcucccagucugugucacuuaccauuggcaguaacuaggggcucuuggagcaucccugagcuaucaguuggaaacaagcucuuccuaggucuugacuaggucuaggucaggaugcugagaaucaagaugaauggaaguuugcuuaccuagcagucucaaagcacuccaaaugcacauguaaagagauacccaugugugucuacaugguaaaucccauaaccuguguucccacuucuggagauccugagguuucugccuucauuuuccuugggggaacauggaaagguccacucaccuuuacuuuguuccccucuccugcuucuguguauggucugaguugacaucuugcuuaaucagaaauagaaaugggugaaagauugcuauaugaggccauaaugaucaauagauauagauaauagauaaauguauauguacucacguagguaugguauacaccuacguaaggaguauaggaguauaaaccauguacuccuaacuuggagugcaugauaaagcuucagggagugcauaauaaaccuuggagugcaugauaaagcuucagggaguccauaaacccccaaaauuauaugcaaaaucuguguuuauauagaugugaauuuuuucuggcaagauaguccaugauuuuaccaaauuuugaaaaggugcugugagauucuaaauccauucucuuuggcuggcuguauuuacuuucuuguucuuagaauucugaacaaaacauuagggaucagaacaggcaaucacacauacuaaugcugaaauaaaaucauauuuccaggucugcuaguguugucuccuucaccacugcccuccaucauaguccuccauucagagcugaccucuacccccagcuggucauauugcuuuuccuugcugccccaguacaaugagcaaccaugggaauacagucucaggauacccagguuuucacuauacugaagaguuuacaugcaaagcucaucaucuucucucauacagcagguccccauuucuaacuuugauagcauucucauucaggagggaagucuuggaugguuguucacuccugauucuuuuuccucaucuguaucugguccuagcaacucuacuuccaaguuuucagauauuaguaacagacuaacagcuucauuaacuuggauuuugguucucugugaaaguagccucaagaucugccaaaucugaaucuuaguuccauauuccaucccuuaaccuuagauuucacauuacacaaauugccaacaccucucuauggcucacccaucuguccugucagcccuucauauccuguuaaacacauagacuuguugacucuuucuuccuccaaaucuggaauaaagcgacagucccacagcugauguucaugucucuuggucucuucccuucagccauccuuugugauguagauagacuaaucaucccaagauacugcuucucugaauuuuuugcccaauccuuagagugacuuuuuuauaaauacacuauuuggcccaaauuugucagaguuaaagaaaaacuugccugauaacuguucuuucuuaauuggccagcaucuucucucauuauuuaaacuuauguucccacugauuugacagucuucuuuacaugugacucacggugcaaccuccaugccuuuauucuggcuguucugauucauucuucaacucccagccuucaaaacacaucgcacucccaccccuccucuggaauaauugacugcuccaguugacccucauuuuucagucuuccgaagucauugccauguuacuugaaaccuccauaaugaagcacauggcguaaaacagauauuuaauaaauauuugaucauuucaaagauaguuuuccaaccaauggaauugaagagcaauaaaggcaugucuuggggaaagcagguagugauaauggcaaaguaaucagugcacaaauuuuuagcaauauguagcuaauucugagguaacuaaagcucaauuaacaauauuuguaauauugcaugucagcaaagaaaaauauguaagcaaagcauguuucaggaugauccuucuaaaggauagucaaucaccugugguacuaucaucaaugguacuaguauuggucaacauaugugguauagguggucgggccuucucuuuaacuaaucagaugaauauuuaauauagcuucccaagccuaauccuuggcugaacugugacacaugaucagcugguguguaccucuacccucuaauaaagccgaaccaugcauuuuccuuccccuccccaaacugaugguaaaacccaccaaauuugcauauagccuccucuccccaugauuauggcaucagauguuuauagaugguucuguuugaguugauccuaaauaagggagacuuuuaccauuguaacugcuguucccaaagcguaacauaaacugcuuuagucagcaaaauauauauaucaucuuugccuugguagauauugaauugcugacucucucuucuuuagacccaguagucauuucuuuaccuccuuaauuuaugcaugaagccaaaagaaaaauuacuucauauucuuaauaaaaauggcauaagguuuagauaauuuuuuacuauaugcaguaaaaaugcaaauguguguggcuuauuugcaaauguagacauuaauaacugauauuuaaacaguccagauuagcaauuuuacugauauauuuaagagauuuuuccaauaauuugcacacucaaaaucaauuugaauacaacauguaaauugaauuuaauuuuuuauauaaaauugugguuaucagcuugaaccauuaaauuuacuauuuaauauaugcuuuccagaucacuugguuagaauuucauugcaccuuaucuauauaaauuuaauuaggcuugauaucaucaguauauuauagaacuaauuaaagauuuagauaagugcugagggggcuuauugaaaacuccauaaaguuccauuuggaaaaugagauauucuuccuucaguucauugugagagaaggaaacagcaagaaugcuucuugcaguguuucugaaaaauuauuuaacuggauuuaaagggcuuauuccauucuuugaagagcuuuuuaauuacucucuaucuuugugcaguccaacaacaguuacaaucuuuauuuaaaggcuuuaaaaauccucauuuccaucuucucccacugagccagcuguguuacauucugcugggcauaugugcagguagguaguacaggguuuguguacccugauugcgaucauauaauauguagcagcauuuguggggaagucuaucuaguccucccaagcagaauaaacauugagaaagcucagcgagcgccugccacaaaugucuuaggaaaagggaaaagaaagaaacccuagcccaggaggauaccugggaaaaacugaggcuuccacucaaaagauacagcgacuuuaaguaaucauuuugcagaaaucacuuuuggauucccuuguaucugcaucucugcuauagaguauaaagcauauuaguuuaaaagacuauuauuucaacuaagugcuuugugucuucauuacaaagcacaauaaagcuuuuuaauacaauaaagccuuuauuacuuucaauugaauaugccuggaaauaaagcuuuaucaaccacauuugccagugugcucaaugcucuugucaaaagcacuuuuucuucauugcagauugagugacacagagcaugcuaggaaaaaaaaaaaaaggaaagugaaaggacacaugacaaauaugggccaucuacgacugggcacacugucgauuacgacagaggccugaggaagccagggaaccggauaaauugucaagagccugugugguguaauagaaagguuacaggcuuugggcucaggagaugcagauuuaagucagagcccugcugcugauuagcugugugaccuggaccucaucuuuuccacaccuaaaucuuguuuccuggaaaauggaaauaauaucaguaaugcugcccuggccaggcacgguggcucaugccuauaaucccagcacuuugggagacugaggugguggaucaccugaggucaggaguucgagaccagccuggccaacauggcaaaaccccguguguaguaaacaugcaaaaauuagcuggccgugguggcgcaugccuguaaucucagcuacuggugccgggggcugaggcaggagaauugcuugagcccgggagguggagguugcaguuagccgagauugugccacuacacuccagccugggugacagauuaagacuccgucucaaucagucaaucaaucaauauaaugcugccccuucccccacugcagucucccucauggguucggaugguuuuuaaaugucauauauucuagucuacuccauuuuuuuuuccagauauggaaacugagguacagugggauuguguggcaugaucguaaucacuaguuagcuagugcuggggcaaggacuggaauagaugccucagagaugucauguuaugucugugcugucacacagcacauaaaggagcagauaauuauuuucuuaaugacacccuggcugcauuugguaggggugggauuuuuucccccaagcaacuauuacugaaacacaucacugcuguuuuccugcucaaaugguuuguaaacauuuacaccccccagccugagaaaacauuugcagaaacauuugggucacaaaccaauguuugcuucaccaccacauuugaaauauuucucuuugaaaacauuagaaauguuugucaguaaaacagauucucaacagaaguauaaaucuggaaagggagggacacccacagccaccugguuuggugcauucaggguccuccagggauagcaguuucuuccuggucccuaggaaugugugacaccucccagcaucaccguagacucugacauuucuuggguguaaacuauuaggggcacauugaggagugcaaugguuucgggggagguuuggagguggcaaguuuguucucucaugcagcugugaauguaggguaguuguugagaaggaaguguaaagagaggaggcaggagauuggccagggcagucucuguguagagaaggacaggcugaggcuuacuugauucuuccucaucuuuucccucauuccccaacacagccucuacagcuccaacacaguugugcuaauuggaaguggggccuuuaaaauaaccuugguuuguagcccuggccugaucggugauggagcauggucuaggaacuggaucagcaguuuggaguccaggcagaguggguugaacccuaacucuauuucugacucauggauaaucucaacuaauccaccuugccacugggugaagccuaguggagaagagcucaaaggagccuguguagaguuugcucaaaagaguccuugucaccaccuuccucccauuuuguuuucuccaccaauauccaggucaugagagcagcccuuccucugagccacagggaaguaaucaauaaggccacaucccgcucacugacauccccacugaaacaggugaagcacauguggaaggucaugagauuuuugaaagcacuagaaauuaggagacuaauucugaagguagcaagugugagggaaauggaaccucugcugcguccugccuaccaccgucuucugcaggauuuguaaaaaacuagguucagguuuccaggcuauuuuugcugcuguuugaacagugucuacuuuuucuacuaggaaucagcauguauuuucuuugacaucuguaucugcugagaucacaggccauccuggucaccaccuugcugucuagaacagcgucaacucaacugagcagucauccauuaccacgcauaaagaucugaagguccacucugugaaagagcagacaaugcaaggcaucuccuccuucgcuuuaauguagcacacguuagcacaaugugcacacuuggagcagucaucugcaccucaguuuccagcucccccgauccaaugcuguuaauauguucuugccagacacuuauauucacauagcacuuuacaaucgacauagggcuuucacaaauaugauuucagugagucucuugaugagucaacauuuuugucuccccaagcauuuucugauuugaacuauuuucucacagccuaacucagcaguuuuccuggaaugaugugugggagguaggguaugauaguguauugcuauguagucaaacuuuaacccugaaaguauaaaagaauucaauacugguguuauuguuaacuagccaggugaccuuaggcagguguuuugccuuuggagccucagguugugaggacuaaaucagguguaugugaaaggaccugguauauaguaaguguuaaaugcuaauuguuccauauaauuaugguccuccuuaauaauaaacauuaauagaaucauuagugaaucuuuggcugaauuauauuucuaucauacguagaguuguucccaauucuaaccuauauuucucguaaggguuacucauuacuaguuguuaucaauguuucuugagaacaguauguagggauggagaaaguucaaaggcauuuaguacaaagaugcugggggucaguuaacuuacaaaagcguagagcccugagacaugacuuuaauacauuucuggggcacuuagugaaaaugugagcuggugaagauguugccauaucugucagcuuacagaaucuucugugcacuuaucacaggagaacauggaacugcagcaaacaucucaauuaauggaucaauccucacaacaguauuggcugcggacagaugucuucuguauaguuaagaagucaggguuccaguuuauaggauuugcauuuuuauaacagcuuuaucaagauauaauuuacauaccauaaacauuaacccuuuuaacguaugcaauucauugguucuuaguauagucacagcguuguacagccaucaucaccagcuaguuuuggaacauuuucaucaccccgaaaggaaaccccauauccauuagcagucacuccucauuucccccaaacgcuaccccuggcaaccauacaucuacuuucugucucuguggguuugccucuucuggauagaucauagaagugaaauuacacaauauuuagucuuuugcggcuagcuuguuucaauuagcauaauauuuucaagauuuauaaaauuagcacuugucuuaauaacaggguaugagacaguuaaaaauauacucagguacacaucccaacaccuggccuacagccugcucucuuuuucauuuccuuuuucuguagggguggggagaaggaagcuaaaguguuuauaucgaaguauggcauacacacaguaaacugcacagaucuuaaguacacagcuugauuccucuugacaaagagaauacacccuuauaaccaucacuccuauaaaaauacagaauguuaaaaccaccucagggccgggcacaauggcucaugccuauaaucccaccacguugggaggcugagacaggcggaucgcuugaggccaggaguucgagaccagccuggccaacauggugaaaccccgucucuaauaaaaauacaaaaauuagucaggcguggguagucccagcuaccugggaggcugaggcaggagaaucgcuugaaccugggaggcagagguugcagugagccaagaucguaccacugcauucuagccaggacgacagaguaagacuaugucuuaaaaaaaaaaacaaaaaaagacggcucagaugguccccuccuaagucauggcccucaccacaggcauuuccuaauuuuauuugauuuuuuuuuuuuucugaguuuguuuccuuguguuaucuauuaauacagguaguaaguacgugguccccugagcccgggagaccuuuccccaguacuccaggccucaguuaccugcguucguuaauguugguucccagggaaaacaaagcagcaccaagcacucaggacccauggccucuucuucugaacccagggacucccaugccuuugcauuuucuccucgcuuuuguccccagcuguccuucuaaacaccagcaagcucucagcacaggucauuacaaaaaacaguucaggggaguggggcgggcuguagggggagcauuaacccccgucagggacaacugggggcaaauguugcgcuccaaaggcagauguuuugaggaggacuccuaauugugacaaaggcagccccugcacacuggaugcuggccagccucugccauuaacacgccuaccuccucacuggugugaucaaauugguacugcucuuaugaaauuauguguguuagcuggcucuucagaaauaaaauaucuuuucuuaaagaaauuaagguuucauuuuaaauugacuuuauggccuuugaaaaacuuuaguuuuugugugguccaaagcuauagguuagcauuagcauuuaaauagaggcauuaaacuugccugaagaccuuccucucauaauguagcccuuucugagagguuuuuucaaaucagauacuuuuucguccuaaaaaaugaaugcaaaugcucucuauauuuuuccccucaaaggccuuuuuucuuuauauguagacuuaggagagccacauuguggagcagccucaguauuagucuuuuuguauggaaagggccacguaaaaaaaaaauugcuauucucuccuacaaugccugauuuucucugcugacucucaggauguauuugccuaugguuaauuuuauccuauuguaugucauuccacuccagacaccccccaaaggcacaaauccccauucuacaacuaagaaucuaauguaaacuccugcuauguaacagugacucuaggaguucccaguguccccagcaaauccccaucacuuuaguagaaucagagcuugagcuuuugaacuggaugaacuagaguuugagucguguccaucacaaggagguuuugugaccuucucugacccuuuauuuaucugccaaauuaagguuaucaagccuuucuuguauguuugucaagaguuuaaaugagaucauauuuguacuccugauuuauacucugugcucuuagguccuguaaccuaaccggacagguucuuccugccugcugcacaaauaaagaccauggccuugcgguaaagaaagaguuuaauugaugcgaggcuggccaugccacacaguagauggaguuguuacucaaaucaaucuccccagaaauucagggaucaggguuuuuaaagauaauuuggugggcaagggaucagaaaguagggagugcugauugguugagucacagaugaaaucauagggaauugaagcuguucucuugcacugagacauuucccaagugggggccacaagaccagaugagccaguuuauuaauuuggguggugccagcagauccacugagugcagggucugcaaaguaucuuaagcacugaucuuagguuuaacaauagugauguuauccccgggagcaauuuggggagguucagaauuuuacagccuccagcugcaugacuccuaagccauaauuuugaaucuuguagguaauuuuuuaguccugcaaagacagucuaguccccagguaggaagggguuuguuuugagaaagugcuguugucaucaaaguuuaacuauaagcuaaguuucucucaaaguuaguucagcauaugcccaggaaugagcaaggacaccuuggagguuagaggcaagauggagucuguuaggucagguucucuuucacuguaauaacuuucucaguuacaauuuuugcaaaggcaguuucagucccccucccucacauuucaaccagaccaguugaggaguagguuaggaggaaccuuugaguaaaggguguccucuuauuucuuauguucucacugcuagccuucucuuuccuuucagccaccggccucaucucaguaaaguuguguguauuuuaauggccccaggucacauuugaccugaaggagacauacuagaggugagagccugauguguuguucuuuacugaggugcugccauccuucucucuuugagguugauuuuguuuagcuacaagcuuggggauguggaguugugaggaaaccuucuagaagauuggcguggucugguacuagaaaaaaaaaauagccaaguugcccaacagucugaaggcuuucuuacccucagguccauccuccaugcugcagcuggaaaggucuuucuaaaacaguugucaucaugugugacuucuuucuaaaaucgucuguuuccagauuccucccugucauugguuccagauuccaggguguauguaaacugaaacugauuguccucaucuauacgaaaauuagaaaaauaaugacuguacuuugugaguuucucauaaauaaugacuaaaaguuucugaguuucccacacaauaaaacauguaaccuuuuuguucugagauuauuuucuuuccacuuaaggaguguuaaaauaccuucuuuuaucaaaucuugguaauaauaaaugguaauuguuuuguuugaauaaucuaggcaaaauaaagcuuaauucaccuucauccuuccacucacccaugaaaguccaaaaucuuagcauggcccacaggucuguuaggcucuaggcccagcuugccuugcccaccuuuccccuuccuugcucuuccccacaccccaugcacuccagugaggaauaaaccacuugucguuuuccccaaauaccguauucuuccuacugucccacccaguucacacauucuguuuccuuugcucguggaggacuuuauuuccuucauauuugccucauuguugacaacuucuccuucucuauuaagccuucccuggcugcucucagaaaccuacagcccuuccugccugugaucuuagagaaucuccuccagaccuuuauuauggccacugucacauugcuauaaguacauacagugccuggcuacuuucacaccagacucugcaucgccagagaacaaggacuauguuuuacuuaccucugcauccacaguaucuacuguauacuaccugguuugucauugaugcugaaauauuuguugagcaaguaaacaaauuuaaaaaggacuucgaaagggacuauauaagcagugaggaugauacaaagagucauaagacacagucuuugacaucaaggagccuacagucuaggugagguuaauaaauacuaauaaugguacauccacacaauugaguacucugccaccauuaagaagaaugaggcagguugauaugaacugaaauggaaccuucuccaggcucuauuguuaaguagaaaaaguaaggugcagaacaguauguaaacaccauuuauccuuagauauauuuguguguuuauauacacacacacauucaagaaagacugcuucuauauguauaaaauauauuuggaaggauacccuggaaacuaguaauaguaauugucucuaggaaaggaaauggugggagagaggcuuuacgcuauaugcuuauuuuguaccauuaucuuuuuacguaacaaaaaauauuaugugccaggcgcuguucuaagcacuuuauaaauauuaacuugcuuagucuucuuaacaauucuaugagcuaggugcuaucaauauccucauuuuacagaugaggaaacugaaggcuuacagguuaaauaacuuucccaaguucacaaaacuaguaaguaaauacccuaguaaccuuuuuuauuguaucaucagcucaaaaagaauauuaagaguuuuuuuuuaaaaaagauaugauucuacaggauaaauguuaaguggguuacccaugcaguaagugacagagaagaaauaaauugcucaggauagcuucauagaggguagaggauuuagcgauuuugaacaugaaguaggcucuagauacuuagagcccaaaaguacuaaguauuauucaggggacagugaguagcucaauuugguuugaauggcagguugaagcagggaagaacugggagaaaauguggaauacaggucaagucuuuaaaaggccuuggaugucaauguugaaaguuuggacuugauucuguuagcacuagugaacacacaagguuuuuuuuuuauuauuauuaaauacagaauagugauaugauccaacuaagaacuggggguuagucuaggaggagugagugagugagguggccaguuaagaggcaacuguaacaauccaaugagaagaguguaggaucugugauagugagauuggaaagaagaaaugaauaugaaagauguugcauugauagaccuggugacaacuggaccaaaaaaaugaaggagagugaagauuccaggugacacugagauuuugagguuuugcaagcuaguuccguuaagcaaaauucaguggcuagggaggccaccugacaagggcagcugauagaaaugucugcagacaagugaaaaugacguuuugaucuacugagaaaccagaucuugagaaagacaucugagcauuauauauaugcacagauaagacuuucagaagcagagagagaagaauggagggcccccaccugacuggcaggaacaccugcagcaggcagacacagagccaauagcagaaucagagaagaaacucagagggagcugggagaagugccuuaaaaauguggcuucauggggccaggcacuguggcucaugccuguaauccuagcacuucgggaggccgaggcagguggaucaugaggucaggaguucaagaccagccuggccaagauggugaaacccugucucuacuaaaaauacaaaaaauuagcugggugugguggcacaugccuguaaucccagcuacuccggaggcugaggcagagaauugcuuaaaccuggaggggcagagguugcagugagccgagaucgcgccgcugcacuccagccugggagacagagcgagacuccgucucaaaaaaaaaaaaaaaaaaaaacuuggcuaccugggccgaugcagaggcucacgccuguaaucccagcacuuuggaaggccaaggcggguggaucacgaggucaggagaucgagaccauccuggcuaacacagugaaacccugugucuacuaaaaauacaaaaaaauuagcugggcaugguggugggcaccuguagucccagcuacucaggaggcucaggcaggagaauggcaugaacccgggagguagagcuugcagugagccgagaucacgccacugcacuccagccugggcaauagagcacgacuccaucucaauaaaaaagaaagaaaaaaaaauguggcuccaugacaguuggguugaggauggaaaacugucaaggaaaagaggacuuaggaaaagcugcugugcguguccaugaagacgucauugacgacccuuuucauagacacauuggaggcuuagaaaggacaggcagugaauacaaaugauuuguucaagaaauucaacaaugaaaaggagaaaagacacgaggggagagauggaguggacaugggaucacauaaaggguuugggguuuguuucuugauuuguuuuuccaaaaugggagaaggaggauguuugaagcagacaugaaagaaccagugaaaagggaagauacuggauacaagaguuaaaaauaaaacaaaaacccagcagagucuugaaagcauugggaggggugaggaucaaaggcauaggguuaaucuuacaaaaagaaaaaaagaaaagaaaccccucuucuucugagucaagagggaaggacugauuuuuuuuuuuuaauguaugucagcauggaggaugugauaccucauacaauugugagacccauagagauaauauauacaugaacaauggccaauacagacuacagaggaggaugcaaacaaaguuagcaguuaguuuuaucauuuguauuauaucacauagcagguguucuaucauaucauuugauuaaucuucaaaccuaaugugauguaauauuauuuaucccaugcuuaaaugaaaaaacugaaguugagacagguucagaaauuuccagucaugcaucuuagguaaaagaugugggauucaugccuaaaucugccagagaaugaaaagcugagaaggauuacagaucacuagugaaaacacggaucucuguugucucccccuuuuccauuagcgaccauuauccugaccaucuccccccggaguuacaucagaauaacccuuuguguuuuauacagaucaauuauuucauucauaguuccucuuuucccagugucagagaaucauagacugcuuuuuagauuguaugccauacuuaaugacauguauagacuaucagcugucucauucauucauucuuuuucauuuacucagcauucacuaguuaccgucuucuuaggccaagggguaggagcaaguugaauauagaauucagcccugcucuagagaauggcgugaacccgggaggcggagcuugcagugagcagagauugcaccacugcacuccagccuggacgacagagcgaaacuccaucucaaaaaaaaaaaaaaagaagaagaauucagcccugcuccaguagaaccugcauuggaggagggggaagcagauacuuguuuauguacuaaaugcuucuacauucuuacucugucuagccacugcucuuaaucauuuaagccuuggaacaacccuauguuacuauuuccuuuucucagaugaagagaauaaggcacagagagauuaauaacuugaccaaaguuguacaaauaggaagaggcagaauuggguuuaaaucccaggcaacuggcucccgaguccaugaucuuaaccauuguauaugcugaugaaaguauaucugauuuuauauauauauauuuaaauauauaauuuuaaauauauuuuggaaauauauuuuuuaguuggagaugaaugcuaaaaagaaaauuaaagcucauuuaaaggacaaagcuugaugaggauggagcaaguaacauuuaaaauaagguggucagggaaaaccucacuuacugauaagcagacauuugagcaaaaauugaccagaaucuccuuuaaucuucuauuuuccuccaaccuccugucccuuuaaucccaucugauccucuuuucugauuuucuuucaguuggcuuacaguauaaagcaaaagaagaacuaugaaguacaacaaagacaaauuaaugucacuuccuugcucuauagcugguacuuuuuauuuuaauuuauuuuauuuuuuaauuauuuuuucuaagauggagucuuggucuguuacccaggcuggagugcaaugccaugaucuuggcucacugcaaccuccaccucccagguucaagcaauucuccugccucugccucccaaguagcugagacuacaggugcgcacuaccacgcccagccaauuuuuuauauuuuugguaaagacggaguuuugccauguuggccaggcuggccuugaacuccugaccucaggugauccaccugucuuggccucccaaagugcugggauuacagaacuuguacuuuuaaaauaggaaauaagaaaugcucugguuccauggcccuuaacacccaccccaacacacccaccuccuccucgccacccagugaccauucacccaccuguucuaagguuucucccaacuauugaaugaauauaggagguuagaauuucuccuagacaaauucacuuggguuuuucuaagaugacuccccuuucauuacuugcuucccauaauuccagauuuccuggaguccuugaugugauuuuuccuuucuuguugccauucacagccccuccccguucacuaacauuggccccuuucaccacucuguaucuuccugugcauuaaugaagguauuaagugagaucaguucuaaagccagcauccuuagaauucacuagaugcuucuuuucugcauuuguugacuugccguucucauuacccucuguuuguuuuucagccuguguccuaucgaggguagccauucagaauaaauucauuuugcuaguuauauuuuucuagaggcacugcaucaaacgguucacugacauucaaauacguaucagccacaguagucuuuucauccaccaaauucacauuguuauccaaagcuauccaucacguuugucagaguauuugggucuuuaauuaaaccugcuggauauuguucauauuuccauuagcuccuuucuaguuagucuauuauuuuucuaauugacaucuguucugagucacauguccuugaauuucagguggcccauuuuguagcuuugguuuauuuagguuuucucucuuucauaaauuaccuaaggauuuaguuaauacacccucaaguguuugccacugggaccugcugauuuacauauguuuacgcuucucaaauaauccagaguuuuuugguucuucuacgaaaucauuuuccuuugaggcccuucaguccuguaagaaguagucuugugucucagcaaggcagagagaucuccuacaauuucaagaacuguacuagagucacuaaccaggaccagaaggucaggaaucaggguuugagugacucaaccaagugauggcugaauagcaguccuugcgucuuaagacucccagaggcuguaguggguugcagugaacucuccauucagccucccccagcccugucuuaacaucauugugagguagcuggcuaggggcagagucaacggccaaaaaauagaacgaauuggcaccugccagaaucaaccauuaccuuggccucacuggcaucaugcucaucacgcuuucguugaugggagcauauguucccaucaaagccaugaaguccauuccuguucccacugacuguucuccucacacacccacagguagggcaagauccauuauuauaaauacagaaagcccauuacccauucacuucaccaucucauuuccaacccuggucgucauuuggagcagaagcauuguuuuuaucccuuguccagggcacuccaacucuuugugccuuucuuauguaccaggagacaagggcaggcagggagacugccaagcccuaguuuugcuuuacuuuaaauuaaaacauuugcuucaugccuuggguauuuuuggucugagccuggauuagauuuuaaaaauaaauaaauaaauaaagcuucuugaagccaaggacuauaccuuucuauaucauauuaacauuuaaaauguuauuagaguuuccuaagcauuaguaauaacauuagguuuugcuuugaagaaauccuuugcauuauuuauugaaaaauuaauaaugugauuuuauuacuaaaaauugaaaaagccguagggccucucagcaguuguuucccagauugcuaaucugaaaaauauagauaauauacacuacaagagucuugugcuaauuggguuaaaugauauguagcuuuguggucacuaaaguauauaauacaauguccuuuuuaucacccuaugauauuagauaaauugucuuuaaaaaucagaaagacucucuaaagugauauuugaugaacuauuuucuuaaauugaaaagacucuaaagugauauucagcucagaauagcacuccuuaaccuggacucaccuuuugauaaucaaaagaacauuuacagaaguaugagacaaacacaauuaugaaaguaaaaugaaggcccuaaauaaaaaaaucacagaacaagaggguaauucuauucacucuuucauauuucauuauuugauaacaucagaagaugaauccaucagaauugccuuggcaagugcaaacagaaaugugccugaucaauauuuauaaaaaccuucaaaaugggagaaggaguugagcagacuucuuaauggacugaauaauuauucauacaaaugggguuugaccaaaggcagugccagaccaaagagacacaguuuuaauuguacugaauuuaaaaugcagaucuuccuccagcccuuuuguagaaaacuuaauuuaaaaaauuaucugauguagcagagagugacauaugaauccuuaaguuguugaagaggacaugucaaccauagauauuuauaaauuuagaacguguuccaaagguggggagcaaaguugcuagcuaagggaacaaaaagaaauuuucuccccauuucaaugacuguaacugagccaaggagugugucaucaucucaacggugaugggaauguccuggaggaguuucuuuguuucaagugguuuuauuaucugaagagaaauaaagcaagucucuggcugcugcugucuaucaaaaaugucaggauacguuccugagaggagugaaacagcugauuuuaacuuucagcgucuccccaggagaacccccacccccgcaguacugcugaggcgugaugguuaucaggacaaggccaagagguaacugguaacugccauuuaaggauagugccauugacaaaggguaggugcgugcaugugucacuauauauaaaaaacagguagguagaugaccgaucaaagaagaccgagcaagccuuaaagaacagacucccaggcuaucuuuaccucuugaaugauuuucuucugccaccagcugagggaauauaagcaauauguuuucuaaagaccauuauucacuucuagcguguccugaucagaacaaaaaccuauacaauccguugugagaaguguaaaaaaaaaacaaaaaacuguccugauacagaauauauaccuaauugugccacuaacugucugaaaauuauuuagcuuuucuccaccuuaguuuucucauuccuaaaauggaaauaacuucagcucauuuuaaauuagaauuuucaaucauguuuguaauaaacuuuaagcucuucgaaggggaauacaaauaagagcaauuagauuauacuuuuuaauaaacuaauuuauucuucugacacacaggauuaccauccauuuuauuauuggucggaaaguccauuugagcugagauuacacuuguucagaguguuuucaagucaauugcuacugcgucuugucuaccauugcuugaagaaaaacaacaucagcuaauucugaugggagccccaugauuuugaaggaccaagcaggggacgcuguaaagguuuaaaauccaaaaaugccagugcuuuuauauagcaucuacuguaaccuuucuguuuuggacaugagaaauagauccagauagcuggugguauuugcccaaggucacauggcuaguuaguagcgaagaaugaaagacuuaaccagaaucugaguuuaguugaucucuuaaauauuuaccucacuaaguuguucugcuauaaccacaaucucucaauuauuuaugggaugauuaucugguuuauggguuauucuuuuuucucuugucauuucccuguuauuaucauagauaccauugaguggcuggagaaaacaggaguucacugcuucacuugacaacuuagugacccaucuaccauuggguuuuuauuaaagugcucaaaaugcuguagauauuggcuaaaaauaauguugggagcuacagucaauacuaacuuuuauucagcucaauuuuucucccucucaaauuuguauuucagaagucagauucagcacagaauucacuuguugacauuaauacuagagcuuuaucuugggaaggacuacaagagaaagucuuuacaaugaaaauaauuaucucccuuccccaaaaaaguacugaaucagagggacagucaacuuuuggaaagaaagguuacuucauccauuaccaacuugaaggggcaaaaagggaagaaauaaaaagaggugacaaaaugaaaaagccaaaaacucuugcuuguaaacucccaaauuaaguguuaaauuuacaacaugacugcauuacuugguuuagagcacugaauucccagaucaaauccaguguuguucagauauaacugcaaaguuuguacaaacgaauuugaaucaccacaauacuggcucauugcauuacaaagaaagagcugaguaugggaauuuuauuuaauucauauuuguguacucaagacucaaaugagucagcgauaaaaauauucuuuucaguuaguucuuuugcuuuuuauaguuucaaauauuuuuguauuaaggugguuuuagaguaaauacagggcucaaaagucuuucauuuugaggccuuagacaaaucacuaauacucuguagaucucaauuuucucauauguauaacguagauaauuguaguuccuauuuaaaaggauugaaaugcaccuaaaagcuagacauuauuauuaauauucuacaaucaagacagauuucaaaacccagcaugagacguagcuguauauuuuaaaacacaguuuccauuccgggaucuaggacucugaauucuaccaaguaaaggaaggcaaaaggcaaagcuuuccucagagaccuuggacaguuccccagucagggccuugcugucaccccuacaggcaaaguuuauggaacgccuacaaguacaggaacaagaguugccaugggcgggaauaguuuauguuagugaguauuucuucccucaauuugcaaagaagggaacugaaacuguuucuaaucacuuucagagaugcaguacuaauuuuugcacugaguaugccaacuugggagguagaaccagggaugagaaaacucccuggccucuugucuaugaaaauuuaugaaaagcucuuaaagagaagucagaaaagcacuaauacucaaagauaaaaagauaucaacaauucauuuauacauacacgcauaccuacauacauuaaaaacaaauaaguagaugaaaaauuguuccaccucaugcaaaucaaaagaaugugaguuagaugcugcccauauguuguugauaggaggauaaauugauagagcuuuuuuagaaagcaacuuggcagcauugucaaguguccuaaauaauauacuuaucuuuuaacuaauucuguuuuuagaaaucuauccaugagaaaguaagucuuuauaauuggaaacaauugaaguauccaauuguguuucaaccuaaauauuucaacuauaagaaagaaauuggcuagaacacuacauguggugggggcgaacuacaagaaaauaugccaaacugugguuuaucuuuaugaugaaauuaugagaaaucuuucuguauggcccauauauucuauauggcauauguauuaacuuuccaaucagaggaagauaaaauuuuguuuuaaaacuuuaaaaagaucugcccaccuuuccaaaauacccuguauuuccuuccugguagaaauguuuucagacagaauguaugggggagaaagagucgcagugcaauaccauuaaaauaaagcacaaaagaaaaagccacagagaacagucuguugauaaagcaaacaugaggaagauaagagaaaaugaucuguuugcaccagaacaaagcauaaacauuguuauguucuagacucugcacaugagaccagucugugaagucacaccuccucuucucugucacucuacucccucaccuaucugcuuauaauacuuugggaacugcugcaaaaaggcacacagcaaaggguaggagaagccacagcaaggugcacaucuccuuccagaauguuccauccagcagggugacuugaaacucuuuggucuccagaauaagauauuugguguacaucuagcaauugacugcugaauauuguaggcuaugaagagucugugaagggcuacaaaccaugagccagaaaaugucucaaucaaaugugcauucacugaucccauccaggcagccccagcaaagugucaucaaauggaaaauguguugcccuggaagccacggcugcuauuuuaaugcucgaugaugaagaccaagcuuucaauuuccuggggccucaauaagugcugauaaauuauuuaucccuauugggugacaugauuucauuucagucugacaguguuuaucauggaagcucauucuaaugguauaguuuggggcauuuuucuauuuucucuuuaggacaccugguagcacccuuuccccaccuccaggugaaacuguugcugugucaguuuagucaucuuugcuccuggguaccauucugaaagauaaaugaauuuccuucugucuuuaaauauuuaugauucuuuaugaucuaauauaucagcaugguuauggaggaauuuuuucucucuaacuauagaaaauacaccaucaauuaccugucaauuuuguugaauaacucagcuuugcaauucaggggcacuguucauacgaagcucuugaggacucuuuuagucucucaguccacuucagacugucauuccgggauuuauaaaggucuucauugcacagaggauauugaaacauuaaggacuuaaguggcaugcccuuuaucacucaucacacuguggaagauccaagaguagaaaugcaggcaucuuuguuuuguuguuugcucccagcguggaacaauggccucuguagaaaaccagccaguaucccuggaaacaauucaucagauuuuucaaaagaaauccaauuucaucuggcaugaugggcucaguguugcuucuuaagauaaaugauaaaaauaucaacauccuaauacaaagaaauccaguucuuuugguuuaaucucagugaaaagcaucacaaaccuuuuauugcuucuguagccuucucugaugcguuuagguccuugguugaaggagacagugguucuguaacuguuggucuaccaaacagacucugacugagucguggcugguucagaaccuuuaagaagcacauaucuggggauggggccucaggaaucugcacuuuucauaggcgccccaagguaauucuuagguacccuaaaguucaagaacugcgagucuagaaaucgcagcuuucaaguuccuucuagcuuugaaagaaucgugagccccagauucacucucauuucauuugguaaaucucgaugcacgcaugagcucuucuugggcaauuuuaaaaauguauauucuuaggaaguuccauuaauagacaacucccuccaucaccugugcaucuacaggaaacagaauuagaugacauagggcaucauuucccaaaauaggggccaauaucagugagagccaggggacaugcagagcuguaggauaaauauuaauaugaugcuucuuccugcagcaucaaguuuuucuuagaaacaguguguuuaaauuacagcagauacauuaaggaguagaaugcaaaguucacgugaguuuuaugcuaaacaugaaacuucaaaagauuuacugaucuggcacuggggucucacaccccuggaaguggaguuuuaucuccccuucuaccaaguauuucugucuauauucagggucacccuggaccagugauugcuaugugucugguucugugaugccaaaaugaacacucguuuaaaaccacuauagaaaauuagcccccuguacacaaggaugcugacugauuugcuugcaggagagcuucauuaacuuaccaaucuacaaagagcacuuuccauuucugccacuauuuagaguauauucacaaaagauuauucucuccccuauuuuuaaaagaguguguuaguuagaaaaggaggcuuagcaggaggaaaagaagcuaaccgugugaaaagacaccacaacucuuccugaccacauuccccuuguaccagcaauucaauaaaacaggccugaaauuauggagcuccuagaauguauuucuuaccacaaagauagcuucauuuccccauaggagguucuuuuuuucaaaauguuccugaugagaaagaaacaaauucacggcccugagucuaauaauacaggauuucugagccacucauccugcuaggucuggaagauugcuucgucuccaagaguugccuugagugcacugccugguucuguccccucgaucuuggcaaaguuaccuuucacgucagagagaagugaguaacacucuucauuuugcugacaagcugugauaagccuuccuggcucagagucuguguugaacuugaccuccuggguaauuuggaguggccauggaagucacagcuucagaguccaguagacugagagauagcaguggcauaguauugguuuaaagaauggugaguggucaucuucuccccuuccugacucccaccuucaucuuccugcugcauugaagaaucccuauaaugcauauuucuauuacaggcacaagucuuccuccaccaaaggacagagccaggccaauggccuugccguuaaguggcucucaagucuccucuuucugcuagaauuguaaccaaugcccugccagaccauucugcguuugauugucacaguaaucuuccagaagcacaauuuugaauggcaccucugcucucuggaagaaggaaguccuuuauuggcuuaacuaggucuaaaaucauagccugauguucagaggcucuacccuguggcuucaaaugccucaucccaggacucucugcuauugcucugcacuccccagucuaaccagauuauucuuccaugccuuugcucaugcucuucccuccaacuagaauuucuuuccuggaagcccugccugacagaaucuuaccccacaggaagucuuccucagucccacaccauccccucagcauggugcgauuucuccuccucugcuauuaacgcacgguacuaggaccucacuuauggcacacagaauauucuugugaguugucaaguguccgugaaaaaacagucuugaacuuagagucagaaaccuggggucagauccuggcauggucagucccugucuuugugaugugggcaagcccucuaacuucucugugcuuucgucuuuguaucugggaaaagggagguguagccccuggguggagugagggguaaguggcacagugcucgggaaugaacuuggucaacagcacuggaauccuuaugucucugcuuuucaggaccuuuccuccuugucuccgagcuacuugaggaaaggggcugugucuugcccauccuuauauacuacuauuaauuuuauuacauuacugucacacauuagcaucauuauaguucuaauaauaauaaucuuuaugaagcaccaccauucugagugcuuuauacguauuaauuaauucaacuauuucaauaaccccaagagguagguacuauuauuaacccacuuuauggagcagaaaaccauguacaguauuuuacaaaaccuccaaugaauaaugaaugaaugagggauugaaugagacaaaaccuguuaacaaugccuucucuccuucuucaggcuauaccccuacuuuucuuuccuuucucccaagguaaaugcaaaauuagcaaaaaaauguagaaugagcugagccacagaaagguaugcggccucccuggguccucacuuagacuucuccugaagagagcucccaugagcuccaaaggacagagcuuaugguuguccuguucuuuauucuguugguggggccuagaacacugccugcugaucaaucguuaugaaguaaguagaggaaucaauguauagacagcguauuuguccccucgagacgacguuaccaguggggagccagugagcaguguucucucuugcuuucucaggcaguacuacgagaugcuuuacaacacagcugacgagcuccugaaccuggugguggaccagggugugaaguacacggagcuggaguacauccacgcucugacccugcugcaccgcagccagacuggggugggggaacugaccacccagaacacgaggcugcagaggcucaaagagaucaucugcgagcaggcugccaucaagcaagccaccaaggacaagaagauaacuaccguuuagcagggcguacugcgguuggugacggggguccccucagucacacucacuuuuuuccuugguauguuauugaguauauucugagcuuaguuuucucuacagugauacuuuaguggagaggagguguaaggauucuuucucucugguuuuggcuuuucauauaaaugcuaaaggaaggcgacaguacagaguguuuugguugaacaacuacuuuaaugcagucaaaucuaacgggacuagggugggauagggaggaaggugguaucaaauuguuggacucugaaaaacaaguggauggauuacuaauauuugauuuauuacucaauauauauauaauuccagccuuggaaaguaggaaaguaggcugcuaccuaacuuuuagucccuuccaaaaccauuuaguaggguucuauuacauaaacaguaggguuuuuccucuccugaccuuauccguuuacaguucaaugaaauaaguguaugugcauugcugucugucucuauugccaaaaucaaauaaauggcuucucagcugcuguuuacaacaaacuucccuaaccaaaacagaaccucuaauuuagggcuaggaauagaagucuuuugaucccagucccugggacaguuuuguaugcuguaucuuguacacagguuguagguugguuuauugccauuuuguuuuauuucugcuguauaaaaaccaagagccagacaauuagacaacuauggaggaaugaaaggcaauucaaacaucugcuugauucccgccccgccaccccuaauuucugagagaauaaugguuagagaacauugcaucucacuugaaacauccuuuggggguaaaugauucuuaggugcucacuuggucugagcucagcugaaugcagggaagaugggacagagugacauuucuccucugugcggccuccagcugagccugucucugaauuguucccucccccgcaaugugggcacuuaccauguuccuggcacacuggaccucaccaugucccccggucaccaguccucuugcugcccaugguucauaggucauagaaggcagcaaugcacugacugggccacaucuugaaaacucguggaaagggaaaggggaggagaugggacuuugaccacacacagugaugccucacacccugaaggugggggauuuuguaccuguuuguacaacuuuggucuugaugggaaaaauggagaauuaaaaaguguuuugagaagcuuaaau

SEQ ID NO: 14582 - RNA, 3435 nt, Homo sapiens
aaggagauugcugcaaagcacaaaaaaaccgcagcccaggugccauauuuuuauuuuucuuguuauccaacaacucauucuuccagucucguguuucauauccuguguuguccucaacaaacuccuuaaaggggaagaauauaggagcugaagcccucuaaaguguuuccuuugaagucuguuggaaccucuaggaaacacaagagcugucacugaagcaaagauagcuucugucucacagcuuccugucaagcccuacagcccaguggcaaagcauggcuuuggagucuagggauaugggugcagaugccaacucuaccucugaucagccuuaugacccccaagcuacuuucuucauuccuaaaaaaggaagaucacaggguugucucuaaggugaagggagagaaagaggugggggucuggcacaagucuaauagcugugaagggcucaguaauuauuagcgauuguaccugaagccacagugagcugcagagauguuuuauucuuccuuuccauaaaaggaggggucuuuggagcugaguggaagccugauguccccuuuccgcauagguucugauccguuuccauauccagaggaaugugauugucauccccaagucugugacaccagcacgcauuguugagaacauucagguaaguuuccggcuggucggcccugguauuccucaguggagugggggacaggcagaccuucucacuaggcuucucaccucaucgcugcauugucuuuugcccccucccuucccaccacccuaucauuuuccagcccagggagcuagggucaguagagcugagaugaaugacccaugggcuaaggacauccugggggcagugccugguaaagcccuaucaggucugagcacaguugugccucacaccacugagaagacccucaguugccccugagcagcuaggcccugggccacacacaagaacagacuguccuggccucccugcucacuucccggcagcagaggaggugugaacuguccuuggagaaguguccucuagaagcaccugucauggagcacagggccugugcacgccugggguuuagugccugugagccuggucucccuccccccagaacacugagcacuacaaauacuguggucuuuguguaggaccuaauuuagagaaaaauuuguaucccguggacagaaugggaaaaacuccuguggccaguuugugcugugaaugugagcucccucccugcuagaauggccggcagucuccagccacagcuagaauggccuuacugaugauguauuggaacuccuaccuuuccaggucuuugacuuuaaauugagugaugaggagauggcaaccauacucagcuucaacagaaacuggagggccuguaacguguugcaguaaguggcauggaguuaacuagaagcauugccaggaguuuuucuaaacuaauagaggguuaguuggaaggauuggaaggcugcugggacuacuugugucuucaaauacuauuuuggggcaauuuugaaaguuaaaauugggguaccugggaaucacugugagggacacaucucuaauugcugcucauugucugaacuucuggauguagagcuagaaucauaacagaagguggguugucaauaggcgggaggcagaacauucauuuauucauucauucaaucaauaucucacggucaucuaugugccaggcauuuucuaggugcuuagguuaucauacuguacaaaguugcugccuccauaggcuuagggagggagggaagaagagacaacagaaauaaaucaacucaaaauauagaugucagacagcaacaaaugcuagacagaaaaauaaaguagggcaaaguggauaggaagcggugggugguagugggacugauccuuuauacaggguguguaaagggaggcuuugcugugagggauauaccauaugcauauuugggggaagagcauucuuggcggugauaacagcaggugcaaagucccugaggugggauuguguuuagaacauucaagcaagaaggccagggaggcuggauuaaaucaucuccaaaugccucuuaaaggagguggugcuaacuuuacuuaaaaucuuagauaaguggugaaaaaaagcuuucacucuggcugggcaggcauucuaaaucaucucuuuacaagcaauacuuucugaauaauguaucuaauuaaauguaucaaaaagaguugucuggcauuuauuacugccagaucuguaauucaaugaggauuugaaucucuuucaauguuucuauagccaaaaacgauuuuucaccuuuuaaaaaugauuucggcugggcgugguggcccacggcugugaucccagcacuuugggaggccaaggugggcugaucaagaggucaggagaucaagaccauccuggcuaacauggugaaaccccgucucuaccaaaaauuagcugggcgugguggugggcaccuguagucccagcuaauuaggaggcugaggcaggagaauggugugaacccgggagguagagcuugcagugagcugagauugcgccacugcacuccauccugggugacagcgcgagacucugucucagaaaaaaaaaaaagguuucaguaucucaagcgcugcuugcaugucaugauauuccauaucuauccugcccacccuaaguaucauaggagccuuuccucaucuuacaauggcuuacuuuuauuggagcuuaacaaaguaguagcuacuuagagcaaaaaggaagggugaacguaaagugggacucaccccccaaacuaaacugcuuaccuuccuaugagcaucauuucuggcaauggguagcaauggaggcaauggguuggugggcucugcaguaaauccaccuggccucaaauccaacuuuaacacugguuuauuagcugugugacauugggcaaauuuccuaguuuuuccaaguugguuucuucacuuauaaaguaggaugauaauacuaaucgcagcuaacauccauugaaccuuagcuuagaaugugccaggguccugcgcccuuuuccggugguauuaucucauuuaauacucagaacaauccccaagcugucaauucugcuguuguuuccuacuucaugauguugugagaguggauugggacaagacuugucugucaccucgccugacaccaggcuuacuauggguugucauuacgaguuuauucugcugcccugcucacugucugcccuccuuccgagcaaagcccucauaucgauuugagggaaggucaaagugugggcacccuccuuauguucuugcagggaggaggcuaagagagcacaaauaugauagaguccaccagggaagaauaccuucucaaccagaguuguuguuuugauggaacucaguuucucuguuuuuguuuuuuguucuuuccugcagauccucucauu

SEQ ID NO: 14583 - RNA, 33646 nt, Homo sapiens
ugguaaacggaagagaccucuccuguuccgggaguaggccgggaccguggaugagugacaguucgacuuuccaauaggcagagcccuaggaccugcccacgucugguucaggggcuagaaaagagcgucgaugccggcggcagugaugaguccuaggaggcgcuggcucuuuggcggcucggaggagcggcugcugcugcugcugcugcugcugguggccccuuugcaggugaguggcuuuguuuuagaaaauguugcgaacguuuacauuuuuuagugaugugauguuuuauuuuugggugcggggaaggccaguuucuuuacuucccccgguuuagucguuggugggagucuggugcccacuccagcccucaagcugggacccucacuuaucgccccggucccuuucccuugucccuaucucagaaugagccucgcaggcagucaccguucugucaacugagaggaggagcccgcuuugguagugcuguccuuauggcaagaauauauagaaguuggagggaagauaaacucucuucuggaugucugagguacuguguagcagagcccuuccaauaguaagauccccuggaaggaagcagggcgaugccgcuguauuuaggguucuggcagaccuggcccuaucuaucauuuuguguaguagacagaaaaacucgaaugcggugaaaagagaaggaggugaauauaugcaguguuuucauguaggaaucuggagccaaaucacaaguucuuagaaccacuagaaauaaaaacguaaguguauuuuccucuuuucuaagggacgagcugguauuacacuagagaaggucaaugaaaugcauaauugcaguuaaguucacaguuaagcuuuaaagaauaguugguuguuagcuaacuuauaacucucaucccccuacugccucccuugcaaauuacggaagaucuuuagcuugugagugguacuagaauguuagcugacuaaaugcagacucuuuccaagaaggggaaaaaucaaaagcuaaguuucaccuguagguacuaaagguuuuuuaauagugaaagcagaacucaugucaauuugucuuuuauuuuuuauuuuuuuugaaacggagucucgcucugucgcccaggcuggagcgacugcaguggcucgaucucgguucacugcaaccuccgccuaccggguucaagugauucuccugccucagccucccaaguagcugggauuacaagcauaggccaccacgccuggcugauuuuuguauuuuuaguagagacgggguuucaccauguuggccaggguggucuugaacuccugaccucaggugaucugccugccucggccucccaaagugcugggauuacaggcgugagccaccgugccuggccuugucuuuuuucuuucuuucuuucuuuuguuuugguuuuuuuuuuguuuuguuuucagacggaguuucgcuucuguugcccaggcuggagugcaauggcgcgauauuggcucaccgcaaccuccgccuccuggauucaaucgauucuccugccucagccucccgaguagcugggauuacaggcaugcgcccccacgcccagcuaauuuuguguuuuuaguagagacaggauuucaccauguuggccaggcuggucucgaauuccugaccucaggugaucugccugccucggccucccaaagugcugggauuacaggugugagcuaccgcgcccggccuucuuuuuuuuugaacugccucccgugaguccagggaauagcucuuucuuagccaucuuuguauuccaguagcaccucauacaccgcagaugcuccccaguuggugguggacuucagagaagcauaauucaaacagugucauaguggaaggagcucugaguuagaaaucaagaacauuggcuuuaguccugaaacuguuacuauuugugugaucuuaaacaaaucauuucaacugugacucuuaauuuuugcauuuuuuuuuugagacagggucucgcucuguugcccaggcuggagggcaguggcgcaaucucugcucacugcaaccuccaccucugccuccugggcucaagcgauccuaccaucucgauuuuugcaucuuuagaaagcagauguugcauuaaauuauaucugagauauaaacucuguauuuaaagucuguuuuaaaguaaaaauuauuaguauacaagcagaaucucauugcaguaaauucuguaccaucuauuagcaaguaaaaguucccagcuucaaggauauauucuuguuuuuuaauuuuuaauuuuuguggguaccuaguagguguauauauuuauggguuacaugagauauuuugacauaggcaugcaaugcauaaucacaucagaguacauaggguagcugucaccaaaagcauuuauccuuuauguuucaaacaauccaauuguacucuuuuaguuauuugaaaauuuacaauuaaauuguuuuuuuuuuuacuauagucacccuguugugcuagcaaauacuaggucuuauugaucuuccuauuuuuguccccauuacaaggauauacucuuuuguguuccuauuuaaaccaaaccagauuauuguagaaaauuuggagcauaccgaaguauaauguggcagaaaaaugucacuuagaagcaacuacuguuaguguuuggguagagcuuuuagucuuucuuccucuuuugccugcugugguugguugagauuaagaggcacauuuuaaguaaugauugaugcaccuaaauucaccuggccuucaucuuugugugucuggggccugaagaacagaggucacaaacguguuugaaccgaaugguuucuugaaacauccuuggaaugaaaucugauaugaaagauguuuauauggguggcaggacaaaaaguauuacuuaauaacaaaacccuucugcugaaacuuagccacaaauaugaggaaaacauacuuuguaaaauauaaauuaaauguuaaccacuucauuaaagcauuuggauugcagaauauuaguacuugguaagcuucugagacuguaucuuaccaucaccuucuuccaucccacaauauuugauugcauuccuccuucuaccaccuaauuuaagcauuucuccucuaauuccucccuucauuuuacuuuauucccagcuuucgcuucugcucauaucaucggcaagguaggauugcuuugacgggccugagaucugugccauuauuuaugaguuagucaaagucugcuccauucuaccucucacuuuuugguagagugcuucaccauaaucucauuuaaucuuucugauagcccccugagaacaguaguuucaugauccucaucuuuauagauauggaaccugagguucaaagaauuuaaauaaguuaagaucacauugucagucaguagcagagcugggcucauaucuagguuguuuuuacuuuagacuuuuggaauuugguggacacaguuuguguugauaaaagcuacuacccuggggaagacaaugaccagagauaggaaggagggguccgucaugaguggguguuguccacaguggugaugccaugcaggcuggaacaugcaacaugcccugagcaaaugcacaucucauuacauauguauaucucuucgccaugaguagggaucugccugguaugguugguuauucuuguaacaagcaaucaguaggaaauauuaguagauguaagauuggggaaugagaggguuuuagugucuggaaaacaccuguaagugguaacauuugcuccuguaaaaugauguucuuauaacugcaaguacagaugaaaaaguuucuacaaagccuuaggaaaaguaauagaccauggaacacuuuuagguacaguuguguuugaacuucuaauagugaacuugauuugggggaaggcauaguuuguuaagacauuaaaagccuuggccgagcacgguggcucacgccuguaaucccagcacuuugggaggccgaggcgggcagaucacgaggucaggagaucaagaccauccuggcuaacauggugaaacccugucucuacuaaagauaacaaaaaaaauuagccgggcguggugacggucaccugugguccccgcuacucaggaggcugaagcaggacaauggcacgaaccugggaggcggagcuugcagcgagccgagaucacgccacugcacuccagccugggcgacagagugagacugcgucucaaaagaaacauuaaaagccuuaaggaacugagccccagauuucauuucccuugagaccuguuccuuuuuacuuuguuaaagacaugguucuuuuucucuguccucaaauaauagccagcccaucuucuauaaaguuagauuccucuugcaguggggguuaaaaguugcucaaagccacacaauaagggguuuggaccaaggaaaacgucaucugagugucuaggguagcaacugacuaauauuuaaaugugagcuuugaaucuaagugacucugguucuauuugucuuauuuuauauaacuucaacauuauauugcugaucaaauuucuugcuuaaacguuggaaauacaagaaaaacuagguuuuuaaguuggacuuuacccuguaguuuguccuauuuguccgugaguuguaccacuagggucuuaggcauuauuaacuuucaaacacgugaggaagggaggaagcaaagucccaggagugucaguuuggaagacaggaugagccucaguuauggggaguacuuauaacagaggagccucaguuaugggagaaauauaaugugaaauuauauuucacauaauuucauauguggaauuauauaguuuaaugaaggaguaggaagcagcagcagaugaucaugcuacauuuguugaaaguacuuagggaucucaaaaauauuaagagggguaaccuuaguaaaugcagugccuugcaaguacaucacuccccuaucuacagucccugucuugccaaaaagaaugcuaaucuugaaucauaauuuuauguuucaauuuuaugguggcauuauggaaagaauauucuuugcuuuauagcuaacuuagauggaauuucuauacauuuauagugaaagaucuuugaaaguuauaagucaccugcaaaguauguucuuugauuuguuuauugucaaagcaauuacauagcaccuacuccugagcaaguauacauuccccugaagugugaggcacuaugggauaauuuaugaagaugucuaaugggguaaagugugucaaaaugacagaugauauuuuugaaggagauuaacaggaugaauccuauaguuuuccccuauaguucaaucuugaaccuauuccuaaauaauuuaguuaagcaaaagucaaguacucagacugauuuaaaugucuucaguauugccuucugugaggaauaaaaacaauuaugaaugggauuccauuacucaugguacuugccguucuggccaagaauaaaaucuagugauuucauaauguugggauuauucuaugacgggaugcuuaaagguuaaaaaugcugaugucauuaguagaucuaagugugggauccagcuaggccaauaucggcauauugagggcuucuggccuauaccguuuuuuaaaaaauuuacauuuuuaauuuuaaauuauggaugcauaauaguuguauauauuuauagguauaugugauguuuugguacagauauacaauauguaaugaucaaaucagaguaauugauuuaccucaugcauuugucuauuaccucaugcauuuauuuuuuguguguugggaacauucuaauuccauuauuuuaguuauuuuaaaaugcaauaaauuauuaucacccuauugugcuacugaauacugaucuuauuuauucuaacuauaguuuuguaccuguuaaccauccucacuuuaacccccucgcuccuguuaccuuucccugccucuggcaaccauaauucugcuauugcaauacauucaauuuucaaaauuuuuagcucccacauaugagugaaaacaugugaaauuugucuuuccaugccugacuuauuucaccuaaccuuaggcucuccaguuccauccauguuguugugaaugacaggguuucguucuuuuuaugguugaaugauauuccauuguauauaugugccaaauuuucuuuaucuguucaucuguugaugggcacuuagauugcuuccauaucuuggcuauugugaauagugcugcaacaaacauggagugcagguaucucuucaguauacuuauuugcuuucuuuuggauguauacccaguggcgggcuugcuggaucauaugucuacuaccuguuuuugaacagcccacaaacuaugcauggguuuuacauguaaaacgguugaaauaaauuaauauuucaugugcaugaaaauuauaugaaauucuaauuucaguguccauaccugaaguuuuauugaaacagauuuauucacuuauauauuauguaugguggcuuucagcugcaauggcagaauuauacaauuguaccuaauuauggcagagaccaguauagccuagaaagccuaaaaaauuugcuauuuggugguuuacagaaaaaguugcuaacaucugagcuaagcuauagugucuuucacguuuaucuccuucaucucacuuaaacggccauuguccugguccaagucuuuauucuguguuaccagaauuauugcaaaaaccucucagcuaguguucauacuccuggguuuuccugucuauuucuguaaguaagugcugccugauccugcuaaaaugcaugcuacuaaacuuuuaaugaugucccaauauguauagaaaaaccuacaugcuuuggcacaggcuuuuuuugugucacuauuuuuucuuaucuuucuaggcuagucuucuccugcuuccuuauuauacccuauacuuacaguggccauauaauuuuccaaaugggacacuuaagugugaaaggggcccuaguaguaauuauguuggggaaacaggccuaagacaauacuguucuguaauaaugaugcaugugccucuuucuccuaacuacccucucugucuugaccuugccaaaagaaugcuaaucuugaaccauaacuucaauuuuaugguggcauuuauggaaagaauauuuuuugccuauuaggcaaaucaggauguaugguuacucuagcuauacuccaaccaguuugaaugggcucgccauuuuccauauguaccuguuccuuugccuucacucacuguuccccuagauuggaauuccuuuacuuuuuucuguaaaucuaaaccuugccuuuccaaauccagcuuaaaaaauacuguguccacgaagccuuacucagaaauauucucucccaucccaccucucuuuuacuaaugaagugcuuucucauggugugaauuacuuugaguuuuagguacacacacacacacacacguacugaagaugaagacauaauucuuguuggauuacauauuccucauaggccuagcauugggccaugccuaaaugggaucugcaaaauguuugaagaaugaauuaauuggucaggcuagggcgacugaguauuuggggcuuucaauuuaugagucauccauuuuaaugugauuaaagcagugagaaaaggguuuccaagaacugaagacugagccucagguuucaaugugacaguguagcaaaaugguucagggcauagauacagacuucucgagacuaaauuccagcucugccauuuacagccucuguuaccuuaggcaaguuaaccuuuccuccuguuucuucaucugugaaaugggaguaaucauaguagccacuccauggaauggugguugaggauucaaacagugccaaguaacauugaacuaacauucacaggugagcacucugugaauguuggcuacugugacuaauaugaucaucuucauaguacucuuacagguagguaagaaaaugcagacacccaagaccaagauguaaccguggaagagcuggaggaaaugcuacaccaaaaucuuaguggguuuuuuuucuugauggaaguagucuguuuuagagaagucaugagagaagaugaucuccacuuaguaagaaguaacuaaccuguagucuuuugaggcaccauuucaguagaguggguaaggcacaaguuuggugucaggaaacuaaaaaaggaauggcuagaagggaagguaaauggacaagaggaaggggagggaggauaagauacacagcuguguaaaagauguuuccuuaguaaacuuuuucuucaagccagaucacacuuuaaaaaggaagacacccugggggauaaaucaauaaccuauguguucuuuuuuugacaugauguaaauuauugauuaaaaucgguacuuaagugccaguaacuuuugcuaugggauaaaugagaaaccagguacagguuggugagcuuuuaugaaaaacaaaacaaaacaaaaaaaauaaagcuugagguugaaaaggaauaguuuuuaauuugggauggggaguauuuauucuuaguaagguuccucuuuauaaguuggggugacuauugccuggcuuacuuugugccuugagguuuuucucaagaguacuaauaaggugagcccuccuucauguucaccuuguucguuugcguuugaugaaauggcugccuggguuuggaaggacaaguuggaacuggagauaccccugugaagugaagccaagugagccaagauccucaaaccaugacucuaauaucuccagugggggguugaaggcagaagaccaggguugcaguuccaguuugccauuuacuggccauauguuuuugaacaagucaaucagaaucuccauuuuuuucuguggagauuauggccauccaugaacauacuaaacuuauaguacaaaaguacaaaguacagaacuauaauggauaauuauucuuggcuccuguuuugacauaaauacccugagauucuuaaguuaaaguuuccuaacaucuuagcccugccaacugauuuuacuguggcaguuaccacuaaaacucucaagccuuagucucauguguacaauccagucauuucugucugacuuugguucagucaguacaccuacugagugccucauaugugccaagcgaugugcuagguucuagagauacagcaguaagaccugccuugaugcagcuuacagucuuacagggcacauagccauugaacagguaauauaucucaagggauccaucgcaagugcaccaaaugugguuaagcgggaugcuacaggaguaggucagcaggccugaccuacuucccaaugggugaagaggaagucuaaagccagggguucucaaaacaugguccuuggaccagccaugucaccaucaccugaggacuugcuagaaaugcauauucacagucccaccccagaccuacuaaaucaagcucuggaagugggcccaagcaaucuguuuaauuugauuuugauauacauuaaaguuugagaaccacuggccuacaggaacuaacauuuaagcugagcucuaaagcugcaugaucuagugcgguagccacuggucacauguggcuauggagcacuugaaauguggcugguucacauugagauaugcuuucauuauaaaguacacaccagauuccaaagacauacugugaaaaaaaagaauguaaauugccuuauuaauaauuuuuguauggaucauguguuagaauuguauuaguucucaugcugcuaauaaagacauaucagagacuggguaauuuuauaaaggaaagagguuuaaaugauucacaguucagcauggcuggagaggccucaggaaacuuacaaucaugguggaagggaagcaaacauguccuucuucacaugguggcagcaaggagaaguauaagugaagugggggcaaagcuccuuauaaaaccaucagaccucgugagaacucacuuucuaucauaagaacagcaugaggguaacuguccccaugaaucaauuaccucccacugggucccucccaugacacauggggauuaugggaacuacaauucaagaugaaauuuggucuuggccccucccaaaucucauguccucucauuucaaaacauaaucaugcccuuuccaacagucgcccaaagucuuagcucauuucagcaucaacccaaaaguccaaauccaaagucucaucugagacgaggcaagcccucucugccuaugagccuagaaaauugaaagcaaguuaguuacuuccuagauacaguggggcuacaggcauuggguaaauauaccuguuccaaaugggagaaauuggccaaaacaaaggggcuacagcaggccccaugcaaguccaaaauccaauagagcaguuguuacaccuuaaaguuccaaaaugaucuccuuugacuccaugucugaaugauagcuuuuggaccuauaggauucauguggcuuguagaaaauuuaaaacuucauugugccucgcauuauaucuugauuggacacaacugaucuaaaggaugacuagagcuuaaccuaaagcagggugagacugaaguggcaauggagagaagagaugaagggugaguguucugcauaggguacagugugugcaaaacuacugaggcaagaaagaaccugacaugcucaaggaaauaaaacgaaagccuugcaggucacaugaaggauucugaacauuuucuaagaccaguaggaagaauugagguuuuaaaauaagauacucaauuuucaaggaguuuaauuguuaguuugcaguuaauaaaugagggcaagagaacuucaacugaauauagcaagacuuucaacauugaagcuccccaacucccuaggauggugggggaggggcgauuuggucaguggaggaagcaggacgcugcccaucaccugaaccuaacccuaggguaugaggcaugagcaccccccacuagagagagaagcagugucaccugggaagaggucguuuucaguucagaucuuuuucagugcaauugacacucaaagcugagugggaguuugaggacagagcuaggaauucugcagggcaccagcaaaugguuuggugagggagggcuguaaaggugggucagggagaaggaagcccagagcauuauggggauuagagggucuguccuuugaaaggcuguguugggcaauaacaggaaagcugguuaagugguccagacgcuuggguucugaccgucuccugggguauaguggcuguaccauuuaucuguggccuaggggagguuucccuuuaagucagaggucauaagcuagcagccacgaucuagccugcagaagaaauguuuuguuucacucacauuuuacaaauauacauuaguugcuaauauuuaaaucagauaucagauaaaaauacacguuuucauuuuuuuuuuaauuggaagaucuagaaaccucaguugcucaguaucacagggcaaugggcuggagcuaaguaguagguacuccuuugauuuuuuacaugaauuuuuaggagguuuugaaaugauuguuuuagcuuuuuuaaaaaagacauuuauuuacucaaaguuucucuguggucugacucuaagucuugcauucauccuagucuucgaugucagcaaucccaucuucuuuuuguuuuccagaaaaguucuaagaacagugcuguuggcucagugagaugagguuaucggaaaacuuucuguuuacacaagaguugccuccuucaaagaagcaugcaugguccuugcaggucacugugcccaucacucugcauaguccagcugcacucugcuucacacagcugccugcccauugcaggcauuugaguuugcaauccaugccuuaaacuuuaaaucacacuggcuacagcguuguguguuucuugguaaacacuggguaaaucagcuccuguggauguugacugaaguuucuauguuugcaagcuaauccucagcaguuucuuuguaaguauccagcaguuaagugggaaaaguccguugauaguacuagggaggagagaggaaagugaccuuuuguuuucuugagauagacauacuaguuuaguacuuuaucauguauucaccugcguaaauguauuccugugcuucagagugagggaaggaugcauauuugcauaguuuuugugacugcaguacuguuccucuguucugguguguguguguguguauuuuuuuuuuaguaaaaagaaaacagaacuuuguuuuaaugcaguaagcaaauauaggagaauaagauaccacaaagcuugguggugggugccugaguguccauguugcuauuacuacauuguuuuguccccuugauauaguuuauaaucaaaagaugguggaaaggugcuucugucuacaaaauuugucuaaccaugcccuucuuuaacugaagagagaauggcuucauuagcuuauggagguuucucacuugacaagauaaacugagggugaagguagaggaacaguugauagcuucuuuuuucuccaucccccuccuccacuaccaauaacaaaacaaaaugaucaaugguuacaaaggguagauacaguuuuugauggagcugaggcuucuacuacuugguggauuggggcuuuguaaagaaacacugcaaaaauaucuuccauuugcaaauuaacacacuuacacacaccccuccguguguguguguguguguguguguguguguguguguguguucaucaccugguuucucacaggugaggggcucugaagcuugaacuuuguuagauucaugacuauucugccccugggcacaggcagucaucuggcaaaacacugccuagauaccuuuuguucccuucucuguucugccacccugaugccucuucuaggcuaaggacagagacauugggcuuccuccuugggaauucucagcucugugggaugcuuuaaucuggguccugagcccaggcucuucugguucccuggcacuucccugcugcacaugcacagcaaccugguacuuaacaagaaaggaaaaucaucauccuaacugcuguagccuuucaacuucagucaugcaccaccuaaugauguuucagucaagcauggaucguguaaaugaugguggcccuguaagaugguaauggagcauauauagacaucugauauguggcacuugacauuggcauugcagaucgaguaggggaaaugacugauauucaguaauugugcugggauacuuggcuuuccauaugaaaaaacauaaguaacaauauguauaccaucuagguuuguguaaguacauucuauguuguuugcacgacaaaaucaccuaaugaugcauuugccaggacauauucccuucauuaagcaacacaugacgauacuugcaaaucaccucaauuugauuucuuuccuuaaguccucuguuugccuuccauugaaauauaaagccuuauuuuaaagacuguuuucccuucagaaucucuaggaauuacuaaagaaagguagaaacuagaucuagauuccaaucaauuuugccauugauuguuauuuuacugugggugacucacaguuuaagugggagagaaaaucuccaguuaauggaaguugccaagaguggcagaagaccaggcuguagugcucguauaaucuuuacaacccagugugcaaaacacuggaggagagauggagaggccgggcguguaaaccaagcaugugucagugcagauguguccaccacaaggagagagagaggcgggcugagcagccaugucagcagauucuccgaggauggagugggcccagcagaucuucaggccagcagcuuaaauguaaggaguucagcauagcuugagaguugcuggucucccuuuacuagauucucccccugcuaagacguagcugguguguguaggauaucuggagggcuggggaggaggagguggggccucuuuaucagugugguuccucucacuccugccuaccagaucuguuuguacaggcagcaucccucagcugcuugcauuugauagcuuauuuugcaucuggauuuauuccugcugaaaacucuaucuugagguaggugcaagauuauuuagguacguaccauauuugguguuaaugucucuuuaaagcacuuuuaauuugucugaauguugaacugauguguuuugcauaccuuagauuuucuuguguguuguagccuguggcauugaagagcuaguugccaccagccagugauacauaucagauauaugcaguggugcauugaaauaacauguuuaauaacuucuauaauaagaaugugagacugguaaauacuucuuuuuccaccacaggaaaacaaagugaaaaggaugccuucaguguagagucagcugcugggagcugggaguucccagccacuagucauucuuucagacgucuguaacucauucuauuaaauccuuucuacuguaagcauaaauugccuuuguaucuggcagaaacacagcaugccauuagaaugaaguguuuuguuauuuuaugucaugcaauuaacaugcuauccaaacaucagaaaauuuaagucaacuagauucccuguaaugaauuauuaauaucuauagaauaugccuguaugugucacaguguaugaguuaucacauuucugacuguucaaagggauuucaguuucuuuuagaaauuggguguuguaaagcgauguuucuauuccuagauugucaguugaauauaacuuagacuuguuguucuugucuuucuagauguauugcuguccuugaauauuagcccauuugaaaacgccugggaaguucagccaucaguauguccaaguacaaacuuauuauguuaagacauggagagggugcuuggaauaaggagaaccguuuuuguagcuggguggaucagaaacucaacagcgaaggaauggaggaagcucggaacugugggaagcaacucaaagcguuaaacuuugaguuugaucuuguauucacaucuguccuuaaucgguccauucacacagccuggcugauccuggaagagcuaggccaggaaugggugccuguggaaagcuccuggcgucuaaaugagcgucacuauggggccuugaucggucucaacagggagcagauggcuuugaaucauggugaagaacaagugaggcucuggagaagaagcuacaauguaaccccgccucccauugaggagucucauccuuacuaccaagaaaucuacaacgaccggagguauaaaguaugcgaugugcccuuggaucaacugccacggucggaaagcuuaaaggauguucuggagagacuccuucccuauuggaaugaaaggauugcucccgaaguauuacguggcaaaaccauucugauaucugcucauggaaauagcaguagggcacuccuaaaacaccuggaagguaccagcuuuauauaccacuuauuagagguugccaagugugauaucuaggccuuaaucuagaaauuaagcuaaugaggcccuauuuacacaauagacuccucuaucccccuuugucacuucagauuuaagaauugucuuguucuauaaaucagaucucuuguguguuuucuguuccuguuacccgaagcagcaguuuucagacuuuagcaagcaucagagucaccuggagagguugguguaucacagauugugggucccacccucagaguuucggaaucaguaggucuggggcgcacccugagaaucugcauuucuuagaaguuuuaggugaugcugauacugcugauugggguuccacacuuugagaagcacuagucuaaaggacuguauggcuuguuguagugaaaugaaaggaagcuaggaaaggaaggaauuguugaaauggccuugaaaguaaauuagaguuuuucaagucaaguaaauuaucuagacuucaguuuugcucacguucuuccaacuuuaaacaaugauugcuguuccuagacguagguuuccugagcaguucuuuuguuucaaacuucuuuucagaacaggcuuagucauugacuggaagaaaguuagggggaaggaaacuaaaaggauaguugguuuauuuaucuugacucuaaaaauuuggaaaucagcagcagccauaauuuuaacuacuuuaugucauguucuacauguauacuaaaacauacuguauuguuaccuuuuuaaguaacaugaaccaaaugaacucuugaggauucagguucaccgguuuugagcaucagugauugcacugugacaccuucuggauuucucacuguucuguggauuucucguuucccucucugccuccacucaucccagaugguugugcuuuuugcgugauaugcccugucugguguuuuccugccuuucaucacugucagcaguuagcuuacugguaauaaauagaagaaauuucuccaccauucguuuucauucugcuuuaauuuucuauaagaggcugugacaaauaaaaaggcugaccuuguaugugaaauaaguagaaauagauuauuaguuaaaaaugaaguaaucuuuagcaugugauuauuuuccccuaauuuuuauaacaugaccaagaacuaaaucauuacuuguauagcugacauccauuagucaugcagagaccuaaaaucuacagacuauuagauacuaaaauuuuauuggcuagacauggcacuugauauguguguguguguguguuugugugugugcacgugcgcaugugcgugggcacauguguaucuuauuuacucaacuauauaaaagguucuauucuuguucagaauaauuagaucuuuaacuucauuauuagugauauauaacuucaucauuaauggaccauaguauuuuauuguuugaagaagaguugaggcuucuacuagacaacaacaaacugaaauucagaauuucagaguuucugccagagguguauucuauucaaccgugccaacuccuuuuucagagcugggucucagauuuauuguggccaggcucccuucucucaagaaaacaccacuaucuccuuuaggaucaucuuucuccaccuucuuagcuuggaagucccccuuuuaaaaaaguuuccuacuguuuaauaccauugacucuucaccuaucuucaaauuuauuauagaucucuuuaaaacgauucuacagcccaaccacagcucauuguacacauccccuccugcuagugcauugaugauuuaacuauuuuuuacuguucuuuuugagggaaaucggaaaguuuaacaaaugaugguaaagaagacuauaaccauggugggggcaaagagagaauuacauguagagguuguguuuagacauagcaaaacuuacuuuucuacauuugagggaggcuuugaaacuauuagcaauuuauuuaauuaauuuaaucaaaugguguaccugcuuuggaaaacaaucuggcaguuccucagaagggcuaaacauagaguuaccauaugauccagcaaucccacgccuacccauauagcuauauuagcuucccagugcugccguaagaaaacaaccaaacuggguggguuaaaacaacagaaauguguuuucuaggggcuggaagucccaaaucaaggugugagcagggcugugcucucucugaugacucuaggagacaauucuuccuugccuuggcuagcuucgguguuugucggcaaucuuugauguucuguggcuugcagaagcaucacuccuuggcauucuccuuguguguguguuucuuauccacauuuccccuuuuauaaggccaccaauaauauuagccugccgccucccaccagugaccuccauuuuaaugggauuauucucuguuaaacacuguauuuccaaauagggucacauuaugaggaguuugggacuucagccugucuuuuugaggggaucacaguucaaaccaucacaaugcccaagaggaaugaaagcacauguccacacaacaacuuguaccuaaaccugcagagcagcauuauucacaauagacaaaagauggaaacaacccaaguguucaucaacuuauaaauggggucuaucuauacaauggaauauuauuuggcaaugaaagggaaggugaugcugauacaugcuaccauaugggugaacauugaaauaacucuguuaugugaaagaagccagccacaagggaucacauauuagaggauuucauuuauaugaaauacccagaauaggcaaaucuuuagaaacagaagguagagugguuguugccuagaggguagggaggauggaagauuuugcaagugauuugcugauggguacagaguuucuuguuggggugauaaaaauauucuaaaauugauuguagugaggguugcacaacucugaauaugcuaagagccauugaguuguacacuuugugugggugaauuguaugugaauuauaucucauuaaagcuggaaaaauaaucaauggaauugaaagguuaaaggauuugucauuggccuagaaaacagugggggguggcaaacauacggaagugauaacaaaacugaaaugcauggcuguggaguguagaauacuggggaaaaucaaagugcacauauacaccauggaauacuaugcagccauaaaaaaugaugaguucauauccuuuguagggacauggaugaaauuggaaaccaucauucucaguaaacuaucgcaagaacaaaaaaacaaacaccgcauauucucacucauaggugggaauugaacaaugagaucacauggacacaggaaggggaauaucacacucuggggacuguggugggguugggggaggggggagggauaguauugggagauauaccuaaugcuagaugacacauuagugggugcagcgcaccagcauggcacauguauacauauguaacuaaccugcacaaugugcacauguacccuaaaacuuagaguauaauaaaaaaaauaaaauaaaauaaaauaaaaauuaaugaaaaaaaaaaaaaaaaaaaaaaaagugcagcuuugaccacuggggcagaaguggacuuacagggcucauugggaaauaagcaggcauuggucuucaggcagcuuccaguccuucaucuaaagggcuuuuuauuuuauuuuauuuuuuauuuuuauuuuuuuaaguuggaaguaugaaacugaaugaccuuuucuuuucuuuuagagauuaaugacauuuucuuuucuuuucuuuucuuuucuuuuuuagacaaagucucgcuguguugcccaggcuggaaugcagugguucgaucuuggcccacugcaaccuucgccuccugaguucaagcgauucucaugccucagccuucugaguagcuaggauuauagguguguaccaccacaccuggcuaauuuuuguaauuuuuuaguagagaugggguuuugccacguuugccaggcaggucucgaacuccuggccucaagcgaucuacccaccucaaccucccaaagucugggauuacggcaugagccacugcgcaccuggccauuaaugacauuuuaaaguagccuuacauuauaacuccuaucccuauuaccauaaacaggcuuuauagaaaauguuuuuauuugggggauaauugauguaaaacagugggguugguguagaaagaaguaaauuguaggaaaugacuucaguaggaaguaugugaacacagaaaaagacaugggcugccagagagggagguaucuaugagagagguagagaauaaaaaugaugggguugaugaccaaggaggauggcagauagagggaaaaaauggcagaaaagccagaacaugcaguuaggauaagaccauagccuagaaaacuaauggaauggaugugaggauccggauuuguccacaggaaaauagaaggaugguuuguaaucuugauucucacccauucuggauaugaugacuuuguuccuuuuuggccuauaguaccuccuggugguacuccaauuaacacuaauggaguucuuagauguugcuguaguucucuacugugacuuaacucccacaccuaacauggaagaaauuaugucaugugcaugaaauaggcuggauuggauuucaggaucacugcauaaguuauugucucuaaaugucaaucuguguuaguaaaguuucucuuacagugucuauugaaaaauaaggucccaaguauucuuuuucacaacugcaagaauuaagcauaagugacuuucucaagaucagaagacauaguaugucaucauauuuuuuucacaucauuucuguuaauuuagugagauuuuagcccuuucaaaauugauuguagauguauucacucaccagaauaggcauguuaaucuaauguuaguccucuuguauugcaugucuaacuuuccacagcucaaguuacaggguuugugugcuucuugguaacuuaccaaccuaaaagaaagcauuucauuggauuuagaugcuaacuuuucaagacucaaaaaauuaagugaaucuccccuacuguuuaggggggaaauaaagguuuucuuuuauaggaaggacugcuuugccaguucauguguauguguuuauggugguacaaaauauaaguuaccaucuuaauugccaauuuaugcuuacuaucaaguuacaugaucauacaugcccauuuugugguuaaugccuguuguccgaauguaauuauuaauagcaucuccuuuuacuuucaaaagugccccagucuggaugauaaauuaugugguuaccucacuauaaaaauauugagcuggguguggggucacgcaccuguagucucaacuacuagggaagcggaggcaggaggauugcuugugccuaggcuugagaucagccuggacaacauagugagaccccauuuuagaaaaauaaaaacguaaaaaugaagacguuagcuuucacuacuguuaagaauugaaucuagaaaugggcauaaccaggguuuuauauuuccuguaagcacaaaaguugcuaaauuucuuugcauuuauuauaaaaguaaaaacacuuguggcugcagauucaucugguuccaagccgugcuuucuagagauguuuauguaaacuucucccauauaaaaugggcucuuucaagggacuggaguaauuuuucccuauuuugucucuaaacugcuugacaagcuaaaaaaguuuuaccuacuggggcggagugugguaacggauagcaucaaugacagcauacuguccuaucagaaaaauacuuucuuauuguuugaaaacuagggugggaagaaucaugaccccaguuaaauaacuaauuagaauauuggucuaugcugaaaucucaaauugcuuuaagaucuuucuacuaagaguaugcuaguauuacucaucuccucuuaggucuagucuuagaggugucauccauauaccucaacaguaaagaguguugguucugaagauguuaguuguuucucagauauuugauauuaugacacuguaggcagucauauccugacugaugcuuucuccauuuguggaaaagaagacaggugcuguuggaggaaacugaaaucuaaagagacucuagauuccuuggccgugaucaugguaauuaguuggcaucaagaacucuacucaaaacucaguucacugaggcuccacacacaguuaucaccugggcuuuaaaacuuuuuucuaaaagguagccuuucccuugaccuauucuuuguuuggaauacuguguuuuaagaagcugagucaagaacauccauggcagguaaacuauaaaaagguaauuuaaugcaacuaauugagucuuaaauuauuacugcuguuauaacauuguggucugaauggcacacucuagcauagcuauacgggaugaccuuuauucagugcauacugcaugccaagcacaguuuuaggcauuuuacguacacauguuguuuuauguaggaacuagaacauggcucugaacucacuggaaagcuaugguucaauacugcguuuuacuuugcuguuuaguauauccuggucauauuuuuuauuucauuugaucaaucauugaucacuaagcuguuuugcuuaaagaaacugcuuuaguaaaaagaagcaaacuauugauacacccaucaucauggaugaaccucagcugcauuuugccaagugaaagaaauugggcuaaaaaagcuguguauuguaugauuccauuuaugugccauuugggaaaauauagaacuaucgggaaauaacagauuggugggguaagaguaggcugcugggggcacaaggaaauuuuaagggguugauagagcuguuuuauauccugauugguuauuacacuacuguaugcaguugucaaaacucauagaacuguaugcuaaaaagggugacuuuugcuauauguaaauuauaccugaaaaaagacuugcuuuauccagugaacucaccauugccuuaauugggaccuuaccuuuuguucacaaagguaauagacuacauuagucaauuaggagaauuaagugaaggguugaagguuugcuauaugcaccuaucugugccuuugaaaacuaaccuggagggcauuuguuaugcuuucucaaggcuucaggagccaucugguucugacuuuagcaccuaaaccauggucauuauagggaacugccuuuuaaaguccuucuucaugagaaguuauguuugagaaucuugcuaauguuauagguugaaagcuccucuaauaaagguuuuuuuuauuuuuuuauuuuuuuaucccagacuaucucugcuuauuaucaucaauuucuuuagccuuaauugggccuuccauccccuccuuuuucucuuguaacaaccuagucuaggagcgggucaacaaggaccuccuggagucagcgcagaugaaugguacacugagaggcaagugauacugauucggagcuagauaacacucuuguauaagaauugcaaacacugaaaccacaugucagugccuaagacaggcuuccuggcugauggggaugaccucuccccugucaaaugacuuauuuauauaauaucucugcucauaaaucauauaugcuuuugagauugcuuuacuuuuaaucugaugauaguuaaugcuuucggaagaagucaaaacaagacauacagaauauuauauaguaaaaaaaugccuacuuaagggacugcuuuacuggcuuuuagaaguaccauuauuaugcuaauaaguccagguuaaaaagcagggcccaccucugacugguucagacacacuucucacaaagcaccaccgugaaaacaucuaacgcagaccuaaguaucugaaagcauccuguacuguagcguuccagacaggcguguguuucauucucugugguuggcauagucacuuccuguuuguuuccugcuggcgcacguccaaggaaaagccagguaccaaacugaaacacuggauguagucugcaucuugccagaggaaauggauuguuuagucuggguuuaagcacaggacgaggcaguuucaaguuuggaguaagagugacacacaagacacucaugcaagacagacuugaucccugaagaccugugugcagcugcauacauagcaaggcacagaagugcugagauaaaauuagagacucagggaggaaaggucagcugggacuagcuguggggacggggacugaugaguugguuaccuuuggcauuuuagugugauauuuucagaagcagccaauucaggccucgcuucugugaggcaaguaguugccuauuggugugguuaagcuuucuuuuauaauaauugauuuauagaacccuuuauuuuuuaaacauuauaggcuauuuuaacuauaaaauuaaacguagaauggauucuucucucugccuuacucuaaauuaguggcuguuauuuuaucguguuauucaaaucacccuagcauaucuuuacauauauaguauucagaucuuaaagaauuaaaauuaaaaauagaucauuuaugaaacucugaaucucuaguuucagcucuuauuggccauaaaggaauacagaacucuuaucacagauugucggugggguuugaauugugacuuacuugaccaggagaggaaagugaggaaugaauggguggcaccuuauuaaaugaaugaguugacuggaguuguuucccuuuuuuuucuaauuccaaagaguauacacuaccgaauugggguuucuucuuuccuucucauccuguagcgaaucuuucugucucucugaccaucucuucugguuuucuaaaauucaaagauuuugaacacuuuggagaaaaucaaagaacaucuaaagccauuuaauuugaauuguuuauuuuauuggcacuagauguaaacagcuuuuuguucaaggcuaagauucuuuuaauucuccuuuuuuuuucuugguaaggucauaggagagcacaguguuuaaucaaggcuucaacaauaaaagacuagauuuaauuugaaaacccagagaguucgaauuuauucaauucagguuugcaccuaggguucacuaaaucaggucuuguucaugguacaagggauauagcaccuauaugugaaugagacacacaagguccuuuuguggagcuuuuaaccucuuucugaaauuugucuguacuguaccucugacaaaguccuuaggguguuuucauauauaggcuuuauguuuuaggauuuuuaaauuaacauuuuguucuuuuuuuuuuuuuuuugagauggagucucgcucuguugcccaggcuggagugcaguggugcaaucugggcucacugcaagcuccaccucccagguucacgccauucucccaccucagccucccaaguagcugggacuacagguacccgccaccacgcccggcuaauuuuguuuuuguauuuuuauuagagacgggguuucacuguguuagccaggauggccucgaucuccugaccucgugauugccugccucggccucccaaagugcugggauuaugggcaugagccaccacacccagccuaacauuuuauuccuuauagccuuuaguuauauguaaaaaguagauucacauaauaaauacagcuguaauuacuuaguggaucauauuacugaauaauuucuggacccuagcagccaaaccauaaaaguguuacuuacaguugaauaaacauuuacuaaaucuugcaguggguaaagcacuguguuguaacagcaugggugauacagaaauggaucaaacauuguuccugcucucaaggaauuuauaauccuggugggaaaagugagcauuugcacaagcaccucuaccaggaggugcuuuaguagauguacaguguacauaacaguuugucuuugguuccuguuccugcuauggugacuuaggggaggggguugguaggugcaaauuugacuuccugaaguuauuccucuaugcagaaaauaaaguuguuugacuuucuccccaauuuuggccuugagcuacuuccuggacuuauuaccccaaacuuucauuauuucuuccuuaaaauaucccauuauuuaaauugacugcaguuagcuccuaggugcuucuacaugaagauucgauacuuaaaggcagacuuuaaguauuuaacacagacuuaaagacuuuaacacagacuuaaagacuucaacacagacuuaaaggcaaugguggacccuuaaagacaaggguagcugugaagggaaacaccacugaguucucacccugcaccugcuccucuccacccuacuguagaacacagugccuugcccauugcaagaauuuagugaauguuuguucaacuguaaguaacacuauuaugguuuggcugcuaggguccagaaauuauuuaguaauaugguccacuaaguaaugacaacuguauuuaacuccacaccacuguggagagggguagguacagggugagaacucagcaguguuucccuuuucagccaacccuggaacaauauggauuugaacugcauagguucacuuauacauggauuuuuucccaaaacaacuuggaucaaaaauacuacacuugcuagaugugaaaucuguauauacauaaggcugauaggacuaauucaguuugguuuaauauaguucagaugcauuauucuggccuuaggagcucugccugcuuaacuuucuuaggaugaugaauguaacuuaugccaaaauugaguaaugaguaauggcuucacugugguuuuuccuaauuugcuguuuuaaaauuuuaguuggccgggcgcgguggcucacaccuguaaucucagcacuuugggaggccgaggcgggcagaucacgaggucaggagauagagaccauccuggcuaacauggugaaaccccaucucuacuaaaaauacaaaaaaguagccgggugugguggcgggcaccuguagucccaacuacucuggaggcugaggcaggagaauggcgugaacccaggaggcggagcuugcagugagcugagaucgcgccacugcacuccagccugggcgacagagcgagacuccaucucaaaaagaaaauaauaauaauaaaauaaaauaaaacaaaauuuuagucacuuaagucucauugacugauuauuaaccagucuaaguauuuuaaauauuuguaaguaauuagucugcugugugaauggcuugaguagucauuaaaguggaauguugauuuuauuuauuuauuggaaacauuucuauuuuuguugaacucuccuuccuuuguaguugaaauauuacggcggccuuuguuuauuuggcucuuuaauuuggucccacacaaaagggaccaaacuugagagugcugcuauuaaacaggggaccuguuggauccgguuagaucugaggccauggucaaacaagugaaucccauguauacccaagccccuugcugaagaccuggaacucguuucuaaagucacagacaacaaccccuaaacauggcccaucauaaucgcaguguguuagcuggggaucagacaaacuuauucauucccuuuaccagucgugggaacacuggauggcaucagcagauguccauuuaggacccagccuuucacgagggcagagcauucauauaaacauucuucucucuccuccucaguagucguggaaauaaccauggauaagucaccugaccaggguuuaaauccuggggauuugguaguuuaaaaagguccauuuuuacugccuuaauaguccugugaguagagcagguuuuuauuuaaccacucuggaucuguuuccuuuuuuuuuuuuuuuuuuuuuuaaauugagacagagucuugcugugucacccaggcuggagugcaauggcacaaucucgguucacugcaaccuccaccucccaggaucaagcaauucuccugccucagccucccaaguagcugggauuacaggcguccaccaccacgccuggcuaauuuuuguauuuuuaguagagacaggguuucaccauguugcccaggcuggucuugaacuccugaccucaagugauccacccaccucagccucccaaagugcugagauuagaggcaugagccacugcgcccagcccuguuuacuauuuuuuaacaucuuuauugcguuauaauucacauacuaugcaauucgccauuuaaaguauacaauuaaauggcuuuuaguguauucacaaaauuguaaauccauuaccacaaucaauguuggaacauuuucacuacccuaaaaagaaacccagugccccuuagcuguuaucacccccccaguuccuccccuauuccacccagcccugggcaacaacuaaucuacuuugugucacuauagauucaccuguuguggacauuucauguaaauggacuuaugcaguaagugguccuuugugacuggcuucuuuuauuuaguagcaucaugcuuucaagauucauccaagaaccuuguugugguuugguucaguacuucauuccuuuucauugccaaauaauauucuauuguauggauauaccacauuuaauuuaucuguucauuaguuaauggacauuuguguuguguucacuuuuugacuauuaugaguaaugcugcuaugaagguuuguguacaaguuuuguauagacucauauuucacuucucuuggguauaugcuuaguaguggaauugcugggucauaugguagaucuguguuuaacaaaaggaauugccagacuguuuucgaaagaggcuauagccuuuugcauaccugauuuuacaguguauuaugauuccaguuucuccacauccuuauucacacuuguuuauaaucugacuuuuuauuguugccauccuagaggguacaaaguaguaucucauugugguuuugauuugcauuuccuugauagcuaguaauauuaagccuauuuuuauguacuuauugaccuuuuguauaucuuuggagaaauggcuguuuaaaccuuuugcccauuuuuaaauuugaucauuugucuuuuuauuauuggagacaguucuuauaucugauaaggaacuuguaucuagacuauauaugauauacaaauuuuucucccauucucuggguugccuuuuuauguucuuaauaguguccuuugaagcacaaacauuuuuaauuuuuauauacccaguuuauuuuuuucuuguguaugcuuuuggugucauaucugagaaaccauuaauuaacucaaggugaugaagacuuuacuccuauggcuuuuuuucuaaaaauuuuuacaauuuuagcucuugacucuaagucuuugauucauuuugaguuaauuuuuauauaaaguaugagucagggguccaacuucauucuuucacauauggauauacaguuaucccaguacuauuuguugaaaagauuauuguuucugcauuucauugucuuggcacacuuguuggaaaucaauugauaaaaaauaugaggguuuauuuuggguucccaauucuauuucauugaucuguguguaucuugauuacuauagcuuuguaguaaguuuugaaaucaggaacuaugagucccuugguuuauuucuucuuuuucaagauuguuuuggcuauucugaguaccuuagauuuccauaugaacuuuaagaucaguuugucaauuuauacaaaaaaguccauugagauuuuugauaggauuguauugaaucuguauguuaauuuaggaaauauugcccucuuaacaguguuaugucuucuaauccauaaauacauauuuagguuuucuuucauuugaacacuguguuguaguagucagaguauaguuuuguacuucuuagguuaaauuuauuuuuagcauuuuauucuuuuugauguuauuauaaauagaauuguuugcuuaaucuuucauguugcuuauugcuacuguauuaaaaacccaauuuccuuuucuguauuguucuuauaucugcagccuugcugaguuuauuaguucuaacagguuuuuggugggaucauaccaucugcaaauagagauaguuuuacuucuuccuuuccaaucugggugccuuuuauuucauugucuugccuaguugcccuagcuaggaucuuaaauacaauguugaauagaaguagaauguucagucauucuacaauaaaguccuagguucaagaacuuaagauuaauaguuggugacacugcaaaggcacacaucuaugaguggugaauccaagaugcugauagauauauacacucauaguuucuacuucugguaagcuuuagucaaacauggucacuuuuguuaucuuuuaacaaauuaauuuuuuauagugaaaauuuagauuauuuggagaaaucuauaaaauccauuuuucucuccaauuuagugagcaauaugcuuacagacucuggaaacagauaaagcaugguccuugcacaguagaugaauguaaacaguacucaguguacucaugcucuugugucucuaaggugccucugcuuuucuuaaccauuaagaauaaaauacaggaauguuggugcuagagggacuuauuuuauaaaugaaaaaauaguucauuggagguaaaaucuuggccaaggucacucacacauguucuuccacagaguacuaggaauauaaagggcccucaguuacuaguuagugaaugaguuagguuuggagaccuccagagcuuccccuggauuugggagugagcacuguuggauuugaaaggcucaguggucaccugacuccaaacaacaggcuguugacuuccccuccugcucuuuccaagggauguuugugguggcuguugugcggcuagcugacauuucuggccuguugaagccagaagguguuuagaaucuagaguagucaucucccugcuaaacagcuagaggucuggucugaguagauuuguucucagcagcuguaguuugugaugguaaucuucucuaagguugcagugugaggguggggcuuggcagggcaaaggaguaucuuaguagccuucccauuaaaucugcuaccuagaagggaauuccuaauagagaaagaagagacacuuauugugcuacccuuuguucauguauguucucuuuuaagccaccccuuuuaucccacaacccuuuaaaaugcuggcaaaggaagaguguguguuucuuuucuuucuuucuuucuuuuuuaauugacaggagaauuggagguccagagaaguuacuugccuaaaauucuguauuacauugaagggguacuggcagggcaggugaugggacaguacacuuacuuggaagagacugugucuucugaguuaagauccuuuccauuuuucauaguuguuugaguauggauaguuuguguauaagaguuauuagggagcucuucuaggccuugacgugaaauucuaauaaagagccaccccagcaguaagcauccagugcuacgauucugugacuguuuggcuggugcucacaguuaggaucaauggcuaauuaaaaugaaaaggugcauugauuacuaaccaauaacaacuuauucugccacucucaaguaaagacaaacccuuggacuccccugaacuuguuucaccuagguccuuucuguuaauauagaacaggaagcauauaguuagaauuuagaagucuaugugauuaauaaaggaguguuuuuaaaguagauaauuugaauacuuucaguugucuuuuagcuugcugaacuucaucucuuucucaugccuucccuuugcucacuuugaacucagaaacuugagaggaguuacauuauacaguggguacagaccccuagguuugaauccaggcucugucauuuacucucugugugauaauuguuuacuuaaccucucugugccagaacuuguuacauggagaaauaauaugucaucauauugcaaugaugauuaaaugaguuaauacauacaaaaugcuuaaaagaguaccuggcaugaaauaugaacucagaacauguuagcuguuuauuguuaaaaguacuuauaaagaauauuauuacuaccacugcuacuacaacuacagcucuucugguccaaguugaauuaccuguaauucaguuguacuuuaaaaagggcuaaagguggcuuguguuuuauauauaccuuccuuuuuuagcagcuggaauguucagggaucauaggagagcgagcccuguucacaggcaugcuguaaaaucccuuccugauucccuugacugugcuuucuaagcaccugggaaagcauuccuguuggacuggaucuagcucaggguauugcaagcucacuuagugugggaaaaccaaacacauuuuaagcaaaugaacuagauuuagagauuagcgaaaaguccuaauuuuaguaccagccuggguacaacacauaaaaggagaaauacagccaaugcuccugguucacuuucugauuuuucgagauuaccugauuccuuggaaaacuaguaacacaaaugugggcauagagaaaauaauuuuccuuccuuucggauuuagauaggaaacaggaacagauugucccaaaagguaucuacuguccugauguagcacuugcugugaaucucuaagccuuuuuucuuguaauuucuggaaaguuccuggcuuccaggaauuauagcuggaaucccucaguaccugcauguuucaggcacacaguuaaaugggauuaaagugcaguuauauaauuaaacagaacuuccuccugaguuguguuuuaacaccuggucucuuccuguccugaucaacagguaucucagaugaagacaucaucaacauuacucuuccuacuggaguccccauucuucuggaauuggaugaaaaccugcgugcuguugggccucaucaguuccugggugaccaagaggcgauccaagcagccauuaagaaaguagaagaucaaggaaaagugaaacaagcuaaaaaauagucuuucucaacuguuggcuaagaagaaaugcaaaagaaguggcauaggaguguguuaugggugcugaacucucucucuuuuuccccgauuuuccagagcuaggcuguggaguagaguuuguauagguaacuagguaacuuauuguggcccagauaaggcuuuaggaugccucagugcuuaugucauagccuuaugaguuagcuuucuugcuagcccccuagucggucaccaaacuaguaacuaguggggcuuaaugaaggucauaaguuucugagaugggagagcaacaaguagagaugaaguuaaagguauuuaucauucaagaaaucauuauugagucaccauugacaggcacuauucuaaucaguaguucacuuuaauauuuaauaagauuuucugggauaacaguaagggauauuagauaauauaccguauguauuuauuacuagucuuuuccucuaggaaaagggauacuuugauaauuaaggccagaggcccauuaguugagaaagucacagauauauuucuccaagaaagccaacaaccaccaccacaaugacagaaaugacaacaaggcccuuuaacuugucuucuaguuuagagacauccuucauuugacauuuaguagaauuccucuuuggccacaagaauaagcagcaaauaaacaacuauggcuguugagguucucauuuugguuuguuuuaauuuuuugaacuuuggguaccuguaauuaguuuaaaaauaaaguuccugauaauaaagugacugaaaauggcauccccaaagugucuccguguguuuggugaauuuuagguaggcuucuaaacuagucuuugacucauacuuuccuguaacacucaaagaaagaauugcacuuauuucaacacaacagauacucaugauuuucuauauguugaagcaugaagcagggaagguagaauacagugcauguaacuucauucacauaagcagagggaaugguauauuggggcuugugacauaaauuuguucauuaacuaacugauggcaaaagauuaugguauguagcacggagcagucaggguaggccauggacacgauugcauaucugucuuaaugauacucuuuugcacuauguuuuagaugcuguggguacguaagucaucauuucuuuaagccguugacucuguuucaaagcaggucacauauauuucgaugauaaagucauguaaaacauuuguagcuauaauaccuguuauagauauuuuccauuuuuuucaugguuuuucauuggauuaguuuauuuuuauccacuuuauaguacaauuggcauuugaagaauac

SEQ ID NO: 14584 - RNA, 13958 nt, Homo sapiens
cguggcgugacccggaagucgacgagggguuccgccccccccgcgcauggggagguaggcucggaccggcccgcggagcugcugcaguccuucgcgcccuccucgcccuccccaccgacaucaugcuccaguuccuggugaguggagcugccgaagagcggggcccgcugccuggggcgugccucggaccccauuucccccuugaggauugccgaccccgccgacccggccugggcguggguccagcggucccuucgucccccgcgccuggucgucgccucgcagggcggccguuuucuuccugccuccccagaaaaucccuuugccaauauuuuucugcagccauccaagucccuaaaacuuugaggugucagagagugugcguuuccagagcuucuuauugugugccgcgccccgcgcucauugugcaaucuuuguauuaaagcuugugugguccuugaugacuuuucguaguccgccccccuuucuuucugcgcuccuguuccauuacauggucgccggccggucccugcuguggagcccugcuaguuggcuuuucugaggagguaggaaggccaggaauaaaccguaaauuagccaccucacgaaguccgagaggcuaaguccucaucagaccuuucagaguuggaggaaugagucagacacugguauacaaguaauuuuucccaaaauguguaagcaugaguaagcagacuauuucucuuggcuccuuauuugaguuaaaaacgaguuuucuggcaaaacucgguauauuucaaaaauugcuuggugaagguuccaggaguugcucaucaaauuuucaagugaaaguuuuucugccaagcuauugugcauucaaaacuugaugcuuucaaccucuauuuuuuuuuauuuuuuauuuuuuuugagacggagucucgcugugucgucaggcuggagugcaguggcgcaaucugggcucacuggaaccuccgccucccggguucaaccgauucucccuccucggccuccggaguagcugggauuacaggcgcgcaccaggaugcucagcuaauuuuuguauuuuuaguagagacggguuucaccaaguuggccaggcuggucucgaacuccugaccucaagugaucaacccaccucagccuacgaaagugcugggauuacaggcgugagccacugcucccggcucaaaugcuguaucuuuuuuuguuguuuguuuuaacggagucccgcucugucgccaggcuggagugcaguagugcgaucucggcucacugcagccuccgcuuccuggguuuaagcgauucuccugccucagccucccgaguagcuggugcgcgccagcaggcccaguuaauuuuuguauuuuuaguagagacgggguuucaccccguuggccgggauggucucgaucuccugaccucgggaucugccugccucagccucccaaagugcugggauuacaggcgugagccuccgcgcccggccccaaaugcuguaucuuuaucaaagagauuaaaacacaaaaugcaccccuuuuguccuuuugaaagaugguaauggauuguuaaauccaauuagucaaaagaguguccuuaaucugcccagcuaagacagggcugcuccuuugccucuaggaguuucuguaguguccuaacuagauguuaguuuaggaguucagaauaaugacagucauuuucuuguaguaaacacuagauuaaaagcgguaucacuuagcuccagaguauagaaugauguaauugagcugcuuacuauaucuguugcucauugauaaacugagaggacaugauucaauuacaguuaacuuucuaagugguuuugcagaaugagucuauuugguuuugcaauaaacuuuuacuguguguuaauuuuuuuuuuuuuuuuuuuuuuuugagacaagguuucucuuugucaccuaggcuagaguccaguggcacaaucauggcucagugcagucuuuaauuccuggccucaagcagccuucccaccucagccucuuuaguaguagcuaggacuacaggcccgcacuaccacccgugacuaauuuuaaaauuuuuuuuuuguagagacaggucuugccuaggccucccacaguguugggauuacaggcaugagccaccacugugccuggucagauucugauuugagaauucagaauucucaguauuuaaggagagaugcuaaagcugucaauuauauuccuagcucagaaguaacugaacacugauguucucucacccucuggucuuccaccucauugcuuuuuuuuuuaaauaaguggauagcauuacuuuucacauugauuccaccucugucaaaugagccacugacucuaaaguugagcaaguauuucucuuugugugcagucauuucaucuauuaaaaaaugaccaucauguucuaguguuuaagagauuaaacuucagagucagacuucucaguuugaacucugccucccaucauuuucaagcugugguagcgugggugggcuauugaaauuuucugugcucccauuuccacaucugaaaaugcaaacccaccucacaguuuuguugugaggauuaaaaaugaguuaacacauuaaagaacuuaaaaacaggagcacucaacaaggauucagauaguguucaguuuuucuuuugcaggguucauuugaacccugauugaguuucuucucaaguggggauuagcuucucucagaaggguaggugauaggaaagguuuagaagugaugaaacagucacaaguuaagcagugcguugucauuacacauuuuggaaccgucuaagauguuucuccuacaguugugauuuguggacaguuugaaaaccacugcacuugcuuguguuggugauaacguccuuccauuauucauauuccuccucagauuaaaauauucucccuuugucccuaucuugaagagaccuuguuccugugauuuuccccuuuucuuuuacugcaguuuuuccccuuuauuauuacuauuuuuaauaguggagauagggucucacuauauugcccaggcuggucuugaacucccaggcugaagcaauccucccaccucagucucucaaaguguuggauuaugggcuugagccacugcuccuagacuuuuuuuuuuuuuuuuaaaugcagugcuucagaaauuugugugucgucuuugcgcaggggccauucugaucucuguaucauuccaguuuuaguguaugugcugccaaagugagcaccccccuuucuuuuacugcaguaaaagacaccucuuugcagauaguuaccaacacuaccugagggaagcuacugcuuccuuaaucguaagguuuagcuagaguuauuuuaaggaugcuuuuggcgggaagcuaacaugauggcacugcugggggcuuugugcacacugccuaugauguuguuauuguguuauuguaaucuguugcuuuuuuuuuuuuugagacagaaucucacucugucacccaggcuggagugcacuggugccaucuuggcucacugcacccuccgccuccuggguucaagcgauucuccugccucagccuccggguucaagcgauucuccugccuuagccuccgaaguagcugggauuacaggcauaugccaccacaccuggcuaauuuuauauuuuuuaguagagaugggguuucaccacguuggccagccuggucuugaacuccugaccucaagugauuuacccaccucggucucccaaagugcugggauuacaggcgugagcuccugcacccggccgguuuucccuuuauccuuuuugccuuccuaaauacucuucaaggccccacuuugaucuuuuuccaugaggcccuccugaugacuuaugcuucugaaaccuuuacacuauuaugucuuuguuuuguuuuguuuuugagacagcgucucacucugucacccaggcuggaaugcuguggugcaaucucggcucacugcaaccucugccuccuugguucgagcgauucucgugccuuaccuucccaaguagcugggauuacagacgugugccaccauccccggcuaauuuuuguauuuuuaguagaaacagccauguuggccaggcuggucucaaacuccuggccucaugugaucugcccgccucugccucccaaagugcugggauuacaggugugagccacugugccuggccuuacacuauuacacuauuaugauccauuuccucauuuauuuaggucucaugucuuuucaguaacuucugaauaauuaucuugcaccuuguuuguuauguuuauuucuauuuuguuaauuauuucaccaguugauggacauucaagauguuuccacuuuuggcuaugaugaguaauccugcuaggaauauuuguauacaggcuuuuguguggauauguauuucaguucuguugaguauauacccuaaagugggauugcugcauuaugugguaucuuuaugcucaacuuuuugaggaacuuuuggacuguuuuccagaguagcugcaccguuuuacauucucacuaguaauguaugacggcuucaauuucuccacauccucgccaacauuucguguagcucuuauuguuuuuguuaaaguaauucuagugggugugauguaguuccucauuaugguuuugcuuugcauuuccucagugacuaauguugagcaucuuuucauaugcuuguugacuguuuguagcuuuggagaaauccuuucacaucauuuguccauuuuuauuuuuguuuuauuuuauuuauuuauuuuugagacggagucucgcuuugucgcccaggcuggagugcaguggugcagucucggcucacugcaaccucugcuuccuggguucaagugauuucuccugccucagccucccgaguagcugggacuacaggcguccaccaccaugccuggcuaauuuuuguauuuuuaguagaggcgggguuucaccaaguuggccaggcugguaauugaacuccugaccucaggugaucccccaaccuuggccucccaaacugugggauuacaggugugaaccacugugccuggccaauuugcccauuuuuaaauugaguuuuuuugugucacucaguuguaagaauuauuuauauauucuggauacacaucccuuaucagauauauauuugaaaauauuuuaucucauucuguguguugucuuuugacuuucuugaugguguucucugaaacacagauauuuuuaauuuugaugagguccaauuuuuuuuuuugguuacuuguacuuuuggugucauaucuaagaaaacuauuugcccagccccacucaugugaaacacagauauuuuuaauuuugaugaaguccaauuuuuuuuuuugguuacuuguacuuuuggugucauaucuaagaaaacuauuugcccagccccacucaugaagguuuacgccuaugauuucuuugaagaguuuuauaguuuuagcucuuacauuuaggucuuuaauccauuuugaguuaauuuuuguauauagugugagauaggaguccaccuuuauucuuugcauguggauaucccauugucccagcaccauuucuugaaaagauuauucccagcaccauuucuuggaaagacuauucuuucuauauugaguuccuuggcacucuuguugaaaaucacuugaccauaagccuuuaugguguauuccugggcucuccacuuuauuccauugaucuuuauugaucaauagaaacaauucagucuucuuuccuugccaccacaguaaucggcuuuucucuaauggguacuugguuuucuuaaaaaaaaaauuaccuuuuuaaauuccuacaucuuuucaucaucuaauagguccuuguuuccucagccuuuucugaguauagguaccgggagagugcuucucaggcagugcuuucaucauguugcugagggcagaguagucagugucucccuaccaugauugcaugugaaggaaacuccccugccucugaugcccaggcuggagugcaguggcaugaucucagcucacuguaaccucuacuuccugggcucaagugauccucccaccucagccuccagaguagcugggacuacagauguaugccaccacauccggcuaguuuugcauuuuguugguagagauguaguuucaccaugaugcccaggcuggucucaaacucuugggcucaggccauccucucaccuugucuucccaaaguacugggauuacaagcguagccauuguaccuggcugcccuaccugcuuguugaagcccaacaucuagaccuuuccagcuuuccauacuuaauucucuccauucuuuaacucaaauucucuuuuccagucaggccuguuucuuuuaugccagucaucacauguccauucccaucucgugccuugauuuuccacauucaguuuucuucgcauuuccuuuaccaguuguauuaguccauuuucacacugcugauaaagacauacccgagacuggguaauuuacaugggaaaaaggguuuaauggacuuacaguuccacauggcuggggaggccucaaucauggcagaaagcaaggaggagcaaguaacgucuuacauggauggcagcagacaaagagagagcuugugcaggggaacuccucuuuauaaaaccaucagaucucaugagacauauucacuaucacgagaacagcaugggaaagaccugcccucaugauucaguuaccucccacuuggucccucccacaacgugggaauucaagaugagauuugggugggaacacagccaaaccguaucaccaguuuaaaugugaacacuuagcauauuuagagccuuuaauaucaaccugagguauauauuuuucaaguaugauuucuuaaaagaaucacuuuugugucauucauuuugccacuuaaugcauggccuaguucugauguuuggagcaucuguuaacauugaaaauccugugcaggguccugccuucuguuguuauauaacuauuuuaccuagcauuucuuccuauucaucauauaaguucucuaagggcagagaucauuuuuaauccuuucauggggcuaaauaugagguugauuuuuaguauaaggucugcagucccuuaaucaaaaucuuuaggggccguauguauuugggaaaucagauuucuuucagauuuuagaaaaguaauaagcugcaucauguaccucgguacuuaacacccccagcagcaucugggauagcacuuuguaaucuaaauguauuaaaauuuuuggugugagacauauucuccagcgaggaggucuaaggcaggauccuauauuuaaagauuucuauuucuauagcaaaaaaugauuauucacacuaaagugugauaaugacauaaauaggcuccuguuaguucaggucagauaugcuuuugcuaccaaaugaguuaugaugaaauguaguuuggauugaguuggguuucagaauuguggauaauggauuguggagcuucacugauucuuaguguacucucuauuuauagagcugacaaugcgauucuucuguuguguacugcucugugccagucuagacuucucuuuuggggcucuuagcuccaguaucuucuucccaucuauuuuuccuguacacuacuuuccucaucucaguccucuguucucaaacuuccaguguuuuaccauuaauuguccccaauguuucugugaaaagaagcuacuuuuucauaccccuaaagucucaaaauuauuacagagagggugugauaguaaugcacuuaguguugagcuugggaagaaagcauugcauuccuuaugccacagucuucucuacagggaauacuaaggggugaccaugugauaugggggaagcagggcauugugauggcauucagcugacagaacuacugaugagguuuccaggucuuggccuggaagaaguuaggcauucuuggccugcaaggagguuucagacucauccaagaccuccuauaaucugacuccagucuaaccucucagacugagucacuguuccucagauuuagguuuuacuuuuuugucuaaacuugccuacugaccaucccgugaaugacauacuguauaugcuuuucuggcuucaugcauuuuucccaacauuucucuuagugauauuuuucuuguguauuuaaucuuaugauacuccuuugguagauccgguaguauucugaaacuggaauugauaugacuuguuuagaggcucaugguuuuuguuuuguguuguguuuuaaaauaaucaugaguuuuuuaugugcccugauaccuggcaaaguugccaaaaugaagccacguuagacaugccacauuuauuuagagacacauuugguaagaacuaggaaucuuagcauguuggagcuggacauuacauugugaguauaauguuuuauaaaucaggaagcucaaaucagcaaagcuccagagagguuaagugucuugcuuuaggcacaccgcuugauagugguggaaccagaacucgauuauuuuuuuugaaaguuuuuaaaucccauguuuuuucuuuuugguguuagagcuaauacuuucauuugacuuguuuucucuucuuuuaagcaaauuuaauacuccuucuggauuuggaaaaccauuuccuaccugguuucaacccauaggagaaaaaaaucauucuccuucaaggugcaacacugguaaaaguaggauuuugcaggccauaucugauuaaucaaaugaucagaacggucuaugauuagagauaagauagacucuucuaugauuuuuauugcuaacaacaaaccaauuuaaauuauacuuuugguguuucaagcuuaguaaguuuaaaguguacuaaggacccagcugcauucuguuccccugugugcaucuccaacuugaagagaagguucagucaugccaugugauugaugguguuaagugccacauuuuauuuuuuuaaaccucucugcuguguauugauugaauaaaagcaacaaugauuaaagaaaaugaugaaaaaaauugaugcuaguuugaauuuauaaaaugagaaauuaagcuccagauggagccucuuaguuaccagaggaaaacagggaauuauuaucauuaaaacucaaagcugaggagccuuggcccuuuuggauauaucuaaauuuucaugaaccaguuuuuguuuaggaaaauagucaccaaaugagauaaauauuuaaaguuuucuaaaaauugcacccgucucuugucacuguguuucccaccggccuuaaauguccugccuguuagacuguaccuguggcagagugcuaagccauaugugcucucaguggugugucagaguuuucucuucuuuucuguaaucacauauuuuaguuuuugagugugaagcuaauguagauuguccuguccuccuuguugugaauguccuuggagaagucccuucccauccugggccucaaguuccucuuuugaacuaugaagagauuguaaacugugaagagucccuucauucucugagauccuaugauuugacugaauauuuauuuauuuuuauuuugagacagugucuugcucugucucccaggcuggagugcaguggcacaaucucagcucacuguaaccucugccucccgguuucaagugauucuccugccucagccucccgaauagcugggauuacagaugugagccaccacgccuggcuaauuuuuguauuuuuaguagagacgagguuucaccauguuggccaggcuggucugaaacuccugaccucaagugaucuaccacuuuggccucccaaagugcugggauauaggcgugagccucugugcccggccuugacugaauacuuuaaaaacugaauaauuuuuauuugauuuaaaaaggaauaacaauauccauaaccaaaaaaagacaaaaaaauugcagcaugcaacaagaaaaaucugaacuuuggcuugaguuuccaggacuuguagucaaguauuuauguggguugugaggggauaagagaauuuaggguagcuuuauacaguguuaccauuuauucuuuuuuguuguuuuauuuuuuucuuauguuugguuggugucaccauuuauucuuuuguaugcuguuuagccucuggagagggcaucucuguguuuauagaagaaaaaugugacucucauguuguacacagcccuagacuggacaucaaggucuucuaacuguccuaagcuucuuaggaagauauugucuauguauuuuaguuuggaaucagacuggcacaggacucggcaugcacuauaacucuuacuguucuauuuuuucagcuuggauuuacacugggcaacgugguuggaauguaucuggcucagaacuaugauguaaguggccauauccaugacuuccuugauuccauguaacuguuuuagagugacuuuucuuuguuugagguaaggugugacuuccagcauaaauguaguccauauggcugaggcaaaacuccugaauauuguagaaugguuugccauuguuugaaaaaguaauccaacucaugaaacagcuguccuccauaucaccacaagagggcaaaaucccuucaguuuagcugggcucaugaucauccucagcuguggcuuguuagccgagaguaauauuaaguugggcucuuaaaauucuuugggaaaucaugugauaagugagaauuuaaaaauuaauuggauaauauuuucagccccacuauccaguaguagagaugacuuagaauuuuggagaugcaucuggguagggggacugaaaaauauagaucuauauuccaucuccaaaauucuaaguguagcacauuuggggacagaguuuugugaaguuguauuaaccucacuuuauagguggugauguugaaaaccagguggugcagcagccuaugaauggggauucuggacaggaguuugaaaaagacaagcaagggaaacaugauacuaacuugauuuguuauaaagcuuuucauaugacaaagggaauuccuuugucaaccuucguuugagucauacaguuuucuaggcaaaggcuacauuaugucacauuuauuguuuauauguacaaccuuuacuuggcaccagaucgagcggaaguggguauacaaaaguagaaguggguuucagagaaggagcauacuuaucugacaacuucugauaucuuucacaugcaguuauaaggcuaagaaauaccacuauuggccgggugcaguggcucacgccuguaauccuagcacuuugggaggccgaggugggcagauugcucaagcucaggaguucgagaccagccugggcagugugacgaaagcccaucuuuacaaaaaauacaaaaauuagccaggggugguggcauguccguggucccaacuacuugcgggauuguggcgggaaggaucacuugagcucuggaggucaaggcugcagugagcuguguuugcaccauugcccuccagccugagugacagagugaaacccuaucuuaaaaaagaaagcaaaaagaaauaaccacuauuuagcagaucucuuuuggaggaagauaaaagcuuguaaaaccauuuaucuuuggaggaagagaaguacaagaauauugauuagguagaugcaaaauuauaauaaccuuuuuucucuucaaagauaccaaaccuggcuaaaaaacuugaagaaauuaaaaaggacuuggaugccaagaagaaacccccuagugcaugagacugccuccagcacugccuucaggauauacugauucuacugcucuugagggccucguuuacuaucugaaccaaaagcuuuuguuuucgucuccagccucagcacuucucuucuuugcuagacccuguguuuuuugcuuuaaagcaagcaaaauggggccccaauuugagaacuacccgacauuuccaacauacucaccucuucccauaaucccuuuccaacugcaugggagguucuaagacuggaauuauggugcuagauuaguaaacaugacuuuuaaugaguagugucuucuuuaucguuugcgauuuuuacuaccuuuuuucaaaagaaaaauugaugaguuuuguauagcuggucagauacaaauaauagugacuucacaguuuaguaauuauaauggguacuuguuaaacauuugguacuaaauuauguugcugcaaaguaauuaaaauuaguaucuagagcuaguuucuggugaauuauucauuuauuuuguacuguuguuaggcagcucuguaguugcuaauuuaaccaauaagucaauuugcuauucaugaagaaacgauucugagaauccugucaggaauuggggaaugaaaaaauacacaaaauaauggucuuugucccaguagaguucauagucuauuuagugugcauguuuuuccuuaaugauguauuugaucugacuuuuuuccuucucaaaagaaucauacuugggauuacagguacauuugauguuauaugauggauaagugaaaaguuuuuaaaggagauuuuauaccuuuucacauuaaaaaagguauuuauauuauuacuuuguagugauugucuuaagaaaaaauauagcccaaauguauaguaaaaucagcagcucaagaagaauuucugcuucucuuuguaguugaugcuuuguuuuuuccugcagucagaaauuccuuguauuugucaaauguauaaucagcuuguauuguuuuuaaauuaaaaaaaaauuugaauaauuaacuuuugccaugggacaagauacaaaaguaauuucauauaaagggccucucccaccccuguucucuggcuccuggcuccuguuugacaaguuacuguuaccacuucgccuuauacuuuugagaaagagucugugccuaaacaaacacguguaacacaaauaguaacuauacauggaggucuagcccucgccuuuuuuuuuucuuuuuuucuuuuuuaauggagaucauucuauaccagcauguaaguagcaaggaaccucauucuuuuuuuggcugccuaaaauuuuuuugaauagauauaacauaauugauuuaaucugcuacuggugaaugcuuagguuguucuuuugcuauuacagugauaacuucaauccuaauguuauuaagcauaucgauucaggguauagcuauaagaugaaguccuaaaaguauaauuuagacuaaauacaaauacccauuucgcuagcuguuuuguuucagaggacuuguugagcagcuucacuaauaaugccauuuuugaagacauggcagguucagaaucaauaaacuggaagaauuguucagagcaucuuuuuucagacagugaugacauugauucuguauaugauaaagugauucugcuucucuuugacaacuugcaucucuccuacauggaaguaaguuuuauuccugucaauguugucuuugugugugacagauuaggauuaaauuaugguuugacuuuuccuagcagcgugaucaugggcaaguggcuuuuuuuuuuuuuuuuuuuugagacagagucucacucugcugcccaggcuggagugcaguggcacagucuuggcucacugcaacuccugccucccgguccaagugauucucgugcugcagcuucucaaguagcuggcaucaccaccacaccuggcuaauuuuuguauuuuuaguaacgacgagguuucaccauguuggcaaagcuggucucaaauuccuggccucaagugaucugcccacuucagccucccaaaguguugggauuacaggcgugagccacugcgcccagcuuuuuuaaacuuuuagauucauuuaauagguaaauugcaugucacggguuuguagcuuauucuuucagaaacucuugcauuaucuguagacguggacguaaauauccaccucauaggguuuucauaaaaaauaauugagauaauguauguaauguuucacagugcuuugcagacuaucuaauaaauaguagcuauuaguacaa

SEQ ID NO: 14585 - RNA, 50910 nt, Homo sapiens
uacugaaguuacaguaaaacaaugucaggagacugacacaaaagcaaauccuuucaaagacugguaagguuuauuucaauuaaaucuuuauguuuuauuuucccuccacucauuuuuuucuagaagugggauaagauuaacuaaauguuugagucaaucaagcuucugguauaguuguagagaugacuacaaaaggaaggugauaauaacugagaaaaaugcugcugacacauuagcuguagcacaauucaaguuuauuccauuuguucuugcaacacaaaacuuaaaacacaguauuauuuagcauucggauguacaugaacuaggauacuuaugagaaacccaacugcgucaaaaguaugacauuguggaaaaaaugaacucaaauauaucaaaaugcacaaagcacuagucuuccuccauuaccgcuuagaaagauaugauuguuucuccauuuacaaaauagaaucaggacaauuuaaauuuuuuauauuuugcaugcaaaacacugcaauugcuuauuuauguaggagggcacucucaccagcuucuucuauacacaauugaguauacaauauugcauggaagaaaacagcagcucaacugaaauauuagaaaaaaaaaucaaacagauacauacagauuuaaaauccaguacuugggaaaagauaucaaugaauaaaaggccuacuuguuugcagcuuccacacacugcaccuaccuacuaccucucuuccaugcuuaacuggguuuagaaaggugagcuaugcguagaagaacuacuugggauauucaagugcuguauuugaacgauaagccuauagauaacagucugaagcugcaagggagacuuuguuaguacacuacuauaaacagguaaacuaccuguuuguacuugauauagugcauaugaaaugacugauuuaauacaaaacuacagaacaugcaaaauuuuuucugagauguuaaguauuacuucaguggagaacaaaacuuacuuaaccuuucgcuaaugcauguaguaccagaaagcaaacaugguuuuagcuuccuuuacucaaaauaugaacauuaaguguugugaauuugucugccaagugguucagaaauacauuauaaauaaccuaguuaaaaaaagaaacugugaaccaucuuggucagucuauucuauucuauguuuauauguuauuuucucaagcaaucgcuucauaauuauaggguuuacaaaaaggucgagaaagaaaagcgaaggcgaaauagccucuacugcauuacaagcaacaucaggauaaacuguacaaagaaucacaugguuuccauaccaugaauguagaaagcagaccagguuuaggaaugauaggacaaugcacucucugcaauagccaacuacaacaaaacacuuugaaaguaaaggugaaaauuauauaaagggaaaaauucaagccuuuaaauagcauuaugucaagaggugaaaacaaagguaucaaaacacccuguugcacuacguugauaguuauagacugauagagugcccuccauuuucaaugaggaugucuccauauuuuaguucagugauguaauaaaguacugauuacugauuuuuaacccaacucuuaauaggcugcauuaagacagcaaaauuagccaaauacaacaaaguauuuaaaccacuacuuugugauuguuuucuuggauguaggaaaauuacaggguuaggcuaguuguaagugaaaaagccacaggauuaaaaaaaggacucauggggaaaaauacacacacacacccacacacaccuauacacccacacacccacaugccaaccaaccaaccaaccagcaacugaucaguaaaacuuguuauuaaccagggugacuguucuugauaauagauuaacccugcuguagaaugcuauguugccuuuaaaaaccaauucaauuauuauccacaaucugaguaucagucccuaacccacccuccccuaaaaauuugagguacauucaauuauugcaugacuuggucuuaauauuuuuagcaagcuuauauggauggcaagucaaaggaaucuuaauauuuuaaauguaagauauaaaauuuaagcuuauauauuuuaauuagcuguacugcucaugaaauaaauauuuggaaauauguguaaauauuuucugcaggucauaagaacaccauuuuagggcacuguauuccaagaacagagaauacauuuugaaguugucacacuuuauguaaugcaugauuuauaaaagcaacaaaaauauauuaugcagguggguuggcauauguucagcagaagccuaucaacaacucugggaaaccugguuacaaguguauuuuugaagggauggggcuaaauuuguccaaacaguaaaucucaccccagugauagcuuuggugcaguaaguaaucagccuccaagaugggucugagagaggcauuucaaagaauguuccuuaauucucaacacauaaccaaggucaauccauucaaacagcaaauaaagaaaauccauagguacuaagauaacuguucucucuucauaugauacuaacaggcuuauggcuaugauucuauuuuuaaauccccuuuuacuaccagcaggaguuugaaaguguuucaaugcuauauaaauguaugaaucuagaggagaaaaaaauaugcauacuggaaugguuucuccuuuagacuuccaaaacuuaagauuuuauaaauaaaacuagucaguuuuaucuaaagagacaugaaauccaugugaaaggggagagaaaauccaaaguucagucauccagcaauuuaggagugugccccuccucaccuuaacuaagcuuucacauaaagcuuaaagucaccgaggaaagauuuggucaccaaccuuauaggcagcgcucuuaacuaugccaggaaauccccaguagagugcauucuuaaggcagaaggcuagagcuaauugcuuaucucagcacccuaaguuuacaucacagcagccacuacugcucagacaguuagggcuaccaaauauguagaguuggccuuuguagaaucagaccuucaacacaaucuaauaaauuagcuagggagcugaaaaggucaaauguuacugguguauuuugucuuugcucucccuuggguauaagguguauauuuuauuagaaagggaagaggcuuacuugaucaggaaucccaguaaaagccugaucaugguuccuuuugccccuccuccaaaacaauuuuuuuuuucugguagucggauuuguuaugaauuucucucuccccucaccccucuuaaaguauuuagcugaagaagcuggcagauagagagugacagacagacaggcagcagugugaggccacaggagagucauucuuccggaguuaucaguccauccauccaucacuggagaagagcuuugauugccugguugucaguggcuucaaaggcggucaguccaucugggccuuucacagucuuaucagcacccuggaaaagagaggaaagggcucauuaaaugagcccacaacugggggaagggaauguaagacuagcucacauggcacagguuaauguuuacaucaagaauuaaaaauuccuuuacuaguggagucuauucuacugcagaaaaacaaacaaguuggcaacauuauggauuaauuauaaaaaugccacauuauuuuucaggcacuaagaauuguaacccaggcaaucacuggcuuuuauuuauacuaucauggaugagaugauuaggaagagcacguugagcaaguuagauauauuuaucuaauuaggcuuuaaaaauaauaucccuaugugcaguaugaaacggggaaaaaguaaaucacuuugcuaaaguauuccugugacaaauuauuuuuuucuuauuugaaacacuuuuuguagagugcauucaguauuauauacaucaagaacaaauacuguauucgucauuuuacuuguaaaaacuucgcaguaaaugccugagaugcggacuauaagaagguucccugcgauauuguagggaaauauucagugcagacaccagacugcucugaacgcuuaacuuggagagugcugccuuggaacauuuuaucugcaacgcggcauucugguuuugagaguguguaugugcccuuuugugccuguauguuguuucaucugucuacccuuucuggaugaaagcuccaugggagcaguaauucaccacuguacuccagcacuuggaaaagugccuaggugcaugguagguuaaucugcucccaaaccaggucugauucuuaacucccagagacaacauccuaccaucugaggguucuguuuaccagcucuagcuccagccaguauuuauucaccacacauucucuagaguccugacccacuccccuugccaaaucucacacauucuucugcuuguuccugacaccuacagaauuguuuaaacuuggcacauaugguccuuuagaggcuaacgcuggucagcuuuaccagucucuucuccaguuaaccgcuccaugcucuaauccuacagaauuucucaccaguuccugcuguguuucaugccuuuauccaugcgggcucuagaugggaugccuuauccucuucucuggcaaauccacccauucacucaacaaauauuuacugaauguuuaauaugcgcauacuguguaaaggacuggagaaucaaagaaaaauaagacaagagucugccagucuggcugguaugagagucagacaacucagccaacacaacacuaugggaagagaacaguaacagggaugaguggcccauaaucagaacaggauguggcaggagggcguuuuaagggagaaagucuuccgggaugagguaaaaugccugagcugagucuugacaaggaaguacaggcugauuagguaaaccagggaggagaugacauuuuaggaaguguuaaaugaucacaaaguccuccucaguauuauuauaaaagucucuauuuccucauuuucuaaaugaauuuaacugcuucauggaagacauggaauucagggucaagugggagagacgucagugcgugagaacuucagugcugugagucccgccacaaugguuaagggauaacuguauucaaaaaaguuauuucuuauucauuuugauggcuacuuuuaugacuagcauuaucaacuauaauucugcauuaacaguuacauauuauagugaacuucuguugcuuuuuagcucucagaguuuauuucccuccauuugauggcagcacccuaauuucaucuuggggaaucauuuguccccucuugcuuuuuaaaauuuuaauucuuaauuauuauggguacauaacaguuauauauauagaugggguaugugauguuuugauacaggcauacaauauguaaugaucaaaucagggcccuuaucauuucuuuguguuagaacauucuaauucugcucuuuuacuuauuuuaaauuacacaguaaauuguuaacaaaugugaacaguaaguuguucacaacaguuaacaauuuacuguagcccuguugugcuaccaaauacuagaucauauucauuguaacuguauuucuguuccccuuaaccauucccaggguccucuauaguccugggauuauaaaaccgagaugcuuauuuuccucaccaaauuucaaagauuugaaagcggaauacucucuccuagauuuugaauccugauugaagagaucaaaagagaauauaagaaguuagaacucauuucuggggcaccaccucgaugaaaaagcugacaaguuccugcuacccagagcccugcaguugccacagcucaaucucuucucaaccuggugcccagcuuuuccuguugauucugcaacuaggccagucaucuuuucaaaaauuccuuuucugcuuguugacuaucucugcuauuugcaaccagaaguauuuagauaaaauauuuuuaaaauguauaugucaccuuuuuccuaauuaugaugcaaacuuaucgcagaaaacucguaauucuauacauuagauacaacuaauguuaacaucuuaguguuuccuucuacucuucuauucuaaauauauauacauauauacuucuuuaaaaauaguugaguaauuagaaguagagugacuauauuuauaucagacaaaagaagccuuaagauaaaaaaaauuacuagagacaaagagggacauuucauaaugauaaaagguucacaauucaaacauguaauuuaaaaauuucauuuguaauaccaucaaaagggauacaauacugaagaauaaauuuagggccaggcgcaguggcucacagcuguaaucccagcacucugggaggccuaggcagguggaucaccugaggccaggaguuagagaccagcccggccaacauggcaaaaccccaucucuacuaaaaacauaaaaauuagccucaugugauggcacacgccuguaauccuagcuacuucggaggcuaaggcaugagaaucacuugaacccaggaggcggagguugcagugagcugagaugagaucgugaugcugcacuccagcuugggcaacugagcaagacucacucagccucaaaaaaaaaaaaaaaaaaaaaaaagaugaaccaguuuugaaguaacugaagaauuuaaguauauuuggcccuaucccuuccuugaagaaaccauuuuuuaauuguuuuuaauuauuugcauagcuuuaaauaauauacucaugcugauauuugagcuauaacuuuagauuuuaucuuucgacuuccugcuacauacauaggccuuuagcucaccacuaccacccuuccccagaccuucucaauuucuuauacuuaaaauauuuuguucuuuauaaauguaaacgauauuuauuuaaaccuguauuucuuguuccaucaauucucaugaaguaauuuuauaagauacuuucucaaccuucccaucacucccuccaccuccuaauuugccagcuuuucuauuuugucaagauuaacuuuuauauucuggucuguaaaaacuguguuuuuaucaauucuuauaguuaaguaagugauguucaaauuauuucuagguaaauacugcucuugguggcaccuagcagacuaauaugacuagucauuuucucucuguuguuccaauauugcaacccuaugcaauccucacaaaugacugaaucagaagguaacacuuacaguaacagccugaguuuuccccagucccacaaacuaaugaauuaaaaugguuuggcucuguguccccacccaaaucucaagucaaacuauaauucccaauguuggagguggggccuggugggaggugacuggaucacgggugcuaaugguuuggcaccaccccucacccccuugugcugucuugugauagaguagaguucucaugagaccugguugcuuaaaaguguguagcaccucccccuucacacucucuccugccaccaugagaagauaugacugcuuccccuuugccuccugccaggauuguuaaguuuccugaggccuccccagccaugccucuuguacagcgugaggaacugugagugaauuaaaccucuucucuucauaaaucacucagucucagguaguucucuauagcaguguaagaacagacuaauucaugaaccaaucuguuacucuuaagguaaauugcuaccacagagagaaacuaaaacacaaugaauugaacuaaguuaauuuauuucuugcuuauaaaacagucuuagugccaagcacauagguuggcaggguggcucuguccuuaaggucaucuaaggaccuaaguuccuuccauucuguugaucucccauggguacacuccucacccauaugucuggagcuggcucguccuacagcugcuucuagccuucuagauaaggagaaaaguccacagcaaguggcuucauauuuuguaaugauuuggaagugacacacaucauuugugcauaucccaguagccuaaaaguuaguuagacacacagccauaauuacugcaaggaaagcugagacacaaggauuaccuaggcugccauguggacaacuacaaccuaggguuuucuuucuaaagcacaaggaaaaaucagacaugacagacaauuugcaaccugaccuauacuguucugaaaacacuuugaaauaagucacuaacguccuguaaaugccaagucuagucaacauauauaguaucugaacagugauauuccuaacucauuaugguccuaacucucaagacaguauuaucuccacauucuccugucuagccugccucucccucccacaccaacuccuucuacucuccccugccuuccuuuacuuucucuggcuguccuuuauacaggauucaggucuuuaacacucuuuauaacuugcucaacgugcucuuccuaaucaucucauccauguccaaccuuuauuguccucauucugaggacuggcuuucagacuuaccuacuuuaaguuccauaaauaccuugaauucaaccucucccaaaaugaaucuguaaucuuuuccuauaaaccuugcuccuuuuucaauauucuccaacaaggugaagaacacuaccaucuuccagaagauguggagacaguaugcaguucuuguuuacuuaagucuucagaccauacuauuaagauuucccaucuguccuugguucuccauugcuaccaucacuuuuuuaguucagguauaaacauuuggaugcaaugauuucuuucuuuuuuuuuuuuugagauggagucucgcucugucacccaggcuggagugcaguggcacaaccucggcucacugcaaccuccgccucuuggguucaagcaauucuccugccucagccucccgaguagcugggauuacaggugcauaccaccaugccugacuaaauuuuuuuguauuuuuaguagagauaggguuucacuguguuagccaggcuggccucgaucuccugaccuugugauccgcccaccuuagcgucccaaaaugcugggaucacaggcgugagccacugcgcccggccuuuuuuauuacacaacucuaauucagacucuacauguuuggguguucuuucucaaaugccagucugaucauacuguucauauaccuaaaagccuuuaauggcauucucacgaaauagaauaaagauaaauaacaugacacauaaaggcauaaucuguucacuaccuaccucucuagucauaggccuugcuaaauccuuucuaccugacuguguggcuacgccaaacaacguacuguacucuaauacaucaugguuucuuucuugucccugugacuuuucucauuguugcuucugcuugggauggugccccaauucucuacuggacucuuagacacuaaguuucuaagguucagcucaagugucaacugcuuuaugaaauuacaauugugguaccuggagcuguaaugacauucuuauucauaacacacuauccccuuaacuuccaagaccacaauugcccucuucuuccuucgggucuuuacacauugcauauaacucuugucacagcaaccacaaugcuucaaggcacugauuguuuuacauauuugucuccuuuuaccagacuaacuauguugagggcaggaacaaggcuuauuagucuuugcgaucccaaggccuugcacaggcccaauaagagguaaucaauacauguuuauugauacaggccgggcacaguggcucacgccuguaaugucaacacuuugggaggccagggugggcagaucaccugaggucaggaguucaagaccagccuggucaacauggcgaaaccccgucuguacuaaaaaugcaaaaauuagccaggcaugguggcaggcaccuguaaucccagcuacuggggaggcugaggcagaagaaucgcuugaacccaggaggcggagguugcagugagccuagauugugccacugcacuccagccugggugacagagugagacuccgucucaaacaaacaaaaaaaacggauacaaauaggaacuaaaaauauaaggaacuugauaaaauaauuauaguauuaaauuggcagauuuaaagacagacugcugugaauauaucaacaaagcauuuccauugugaacaggcugccugccuacuagcacacuauauaacauacccacuuauuuucagguaauugcaacauagaagucccuuuauugcugacaucugauuacaaucagaacuagguucauuugccuacagcaugauucugcugauuuuucugaaguuuucuggaggagaaaaagguugcuauggccaaguuaaagugacccaaacagacaggcuguuugucauucuagggaguaaacguuuuuaaggcauugcaaguaauuuauugaucuucaaaugccacacuuguagauaaucaaguauuauuugauagugugaggucaaacaugcagaauguuuaaaaaaacuucaagucaugcuaucuccacccauaaauaauuuacaaucuagcuggaaagauaagauauacccacaugaaacaacaagaacauaucuuuaccugcuugucaccuuuaucuacuucuuacuucagacagccuaauuccccuguauauuaucaguucuuagcauguaaaaauaggccaagaaaacuggauuaguaacauuuuaaggaugaaacucucaaacuccucagagguuaucugacauuaucuugacaagaggcuuuugucaagguuuugaagaugcugauuauaguuauacugauaaauugacagaauaacaagcagcuuuguuuccaugcaaaauuuaaaaaauuuacaaauaaaaucaggcaaaaaauuagcacuucuauauauauauagaucuccaagugcuaacuggauacacacacacacacacacacacacacacacaaaaccucucucucucucuugaaccaaauauaaauacagucaacuacauauauagucaucccucugugugugagggggauugguuccuaacucccucuuggauacccaaaucccuuauauaaaauggcuuaggauuugcauauaacauacacacuuuauauacuuuuguauacuuuaaauuaucuauagauuacuuauaauaccuaauacaacguaaacacuauauaaauacacuugacccuugaacgacauggguuugaacugugcagguccaauuauaagcagauauuuuucaauaaaaguuacauggagugugccugccucuccugucccuccuuccaccucuuccuccucugagacagcaagaccaacccccaauuccuccuccucaagcuacuugaagcaaagaaaaugaggauaaaggucuuuaugguaaccuacuuccacuuaaugaauaguaaauguaguuugucuuuguaaugauuuucuuaauagucuuuucuccagcuuacuuuacuguaacaaugaaguauauaacucauacaaaaaauauguguugacugucuguuuaugucaucuauaugcuuccggugaacaguaagcuauuaguuuuuugggagucaaaaauucuauguggauuuuugacugugcagggguuggcaacccuaaaccccugcauuguucaagggucacccaguuguuauacuguauugcuuuuuaauuuauauuauuuguaauuauugugcuauuauuuuucugaaucuauuuuugaucugugguugaauccauggaugcaaaaccuauggcuauggagggcaaacuguguguuaucucuacauaugcauauggauuuaccuaucuacauauacacacagauaaacacacacacauacccuucccccuuggaauauaaccaauuacuucagaaaauuuucuuuagcaaccaugguuuugaauggucaauucacuuuggaaagaaagcaauuuagaaucaaauacaaaacaaauaucugaaaggacuaagacugcaguugaggauuaaagucaauucaaggaauauuugcaauguuucuaguuuaacauuuuaugacagacacuuaucaggucaggauucuagcaaccuuauguugauuugaacugacaggaagugaauauaaaacuuuaaaaaaccauugaaacagcuuuacagaguucaagcucuucaucauuccauagaagcaugcugguguccucacucagaaauuuuuauuucaaacacagaccuucucagucaaaauuaaaucagaaacagaaaacagaaaggagagaaggccuacugaagacggucacacuaacaacaguaacaucugacaagagcuugacaugacuauaguaagaaagaaaccaagacugagcccggcuaaagcuuagcuaguguaaggacaauuaaccaaaacuucaacagacccccgaggguuggaugcugguaaggcuucaaggaaaucaucaugucuuguuacucugcuuaagagaaaaguauauaauacccuuaagaaauuuucuauccaaaauaguuauuuuuuacccuuauaaaggcuuuuuuuccccccacaguacuuguuacuaccugaaauuaaguuacauuuauugguauaccuguuuacucugccuucccucuagaaaaugagguguuacucugccuucccucuagaaaaugagguguccaagagcggaggaucuguuuaccuuguuaacuccuauauccccaguauuuaaaugaauacaguguguacuuccuuuugauauuaaaugucucaugaagacuucgaaaaacguaaagcaucaaagacauucuuuauucuuucccuggaaccacccaauuaccucucauucaauuguuagauucucugugaagccugcugggauuucccaggcagcuggugcccuggagaucacaggucaguacuguagcucacucagcaucugacacaacccacuuccaacccguucuucuuugcuuuccucuacuacagagguugaaaauaagugaaauccucagacucccuuaaagcuacaggugacuaucugaccuaauuuuggccuuagcucuuuccccccucuuccuguugucaacagacacaaugccuggcgguucaguaguuaucuugugaccauaaggauuggggaaaaugggggcggggggggggggcgggugcguggggcgggugcccagugugggauaucaacaacauacacagcggagccagucacuuagccuuggacugcacaucuucagacuuucucguuuagaucauuguaguaaggguuuuuguuacucauggcuaaacuccaccuuucuuagggaacuuaccacagucuguaauuaaccauuaacagguaugucuuccccaaauuaggcugagcuccaugaaggaagggguccuguuauauuugucccuauagcuuuaauaccuaggauaaugccuuguagccagcagaugcucaauaaauauuaaaugaaaaaaauucacaucugggucauaguaacagaaauauuacccuuagugaacacaagcauccaaauuaaaaggaaaaauuauuuuuuuaaaaauacuaucuugucuaaguauguacuacuguaucauuagaaagaauacugucaauuauuuugaaucaauuuauaugcauuuuagaacagucuugagaaacuacuauacucacaaagaacuccauuaucucaugauuugaggcaacuguuuguaguuccaugguacuaugagaaaauguucagaaucugaaaaccuuacacuguuuaaauauauacuuaaauauuaccauagaacuuaaacauaugauucaauuucggaaacuacuaaaaauggauuugguauuuagugacauuaaaaauuauucaaauaccuacaauuauacauacuuugcaauuuuaucuacuggugcaggaugauuucauagcacauuuaauuucauauuuaauuuacauauugauacaggagacagaguaaagacaauuucuggucuuuacuagaccuauaaggucuaacauaauacaaaacacagugauuguuaccucccuuacauuuuucguagcaguuuugaguuuuuaauguaacaguaaaaauauguaaccacauguuucucacagcaguccccugaaguggacauuguuaacuccauuuuguagacaggcucucaagcucaguuaagaaacuugcccaaggucagucaacaaauacgaaaacuagaaccaucugacuccaaauuuuguauucuauaccacauuuaguugaaaauuacccauggccucuccccccaaaauguuagggacaagacuagauuuuggaauuuauuaccuuuagauaucugcagcuuauuuguaucuuacagaaaauaaaagaacugugggauggcacacauaugacuugucaucuguugcacacucugacaccacagcaucuuuucauagacacucaauucacaaguccauucugugaaucuuuacugaguuucuauuaaguggcagauacagcuuugguaaauaaaauguuacuggaacauaccuaggcucauucauuuacauguugcuuauggcugcuuuugcaucacaguggcagagaugagaagcuuuaauggagaccauaaggcacagaaagccccaaauguuuacuaccuggcccuuaacagaaaauguuuacuaccuggcccuuaauagaaaauguuuguugcccacuguucuagggcauuagggagaaucagagacuaguucucauauauuucauaaauaguguggcaaguacuaaaaauaggaaagaccauuaccuucuuugauucucagaauaauccugggguaugaauacuauuaaacccacugaguucagaugucaagugauuuacuagcuaugaaguuacagaaccaggccuuaaaucuagguuuacuaacuucauugccaagcuccucuaucugcaccacucugcuucuccaacaauggggaaugucauaugaaccaaagcauuuguugagaacuuuaauuuaccaaguggguuaaguguugaugcuguugucucaucucuuuaacuuuuccaaaaauucaauucuuaaaaugucaauuaaaaucuaaagaggcagguacuucaaguuuuccaagcagcugcucaaacuuacucaaaugacaaaaacuaacaaaugagacucacacacaugugagcaaugagacauuuuauguuucguuuuauuccuuauuugaacacaguuaacuauaguucauuuucaguugcauauauaauggucuuggauuuguucuuaugguaccccuaguaaaaauaugauuuuaauaucacuauagcaaucauauuuaacaugaauagaaagaucauuucaagguuucagagaaaaauucaucauggaaauaggaugggcuaaagcacaaacgagccuucaaauuacuccucuucaaggacagucacauauugagcuguuauauuacuuuuuuuuuuuuuuuuuugagacgggaguuucauuuuuguugcccaggcuggagugcaauggcaugaucucagcucacuacaaacuccaccucccggguucaagcuauucuccugccucagccuccugaguagcugagauaacaggcaccugccaccacgcccggcuaauuuuuuuuuugcauuuuuaguagagaugggguuuaaccauguuggccaggcuggucucgaacuccugaccucaggugauccgcccgccucggccucccaaagugcugggauuacaggcgugagcuacugugcccggccgcuguuauauuacuuaaaaggugguacauccuaaguuucagacaaaaaaguauguccacacuugaaagaaaguucuucucauaaaguuaauuuucuucagggaacccucauuccuacagcaagucuuuccuuuccugagaagcacaucaauccuaaagucuuuguacuugcugagaacucaugaugugcucggcauuucagcgaguggcuuauacacauuaucucacuugaguacuuggcuauacugagaggcaguauaauguaaugguuacagacacaggcucuagagcaaaauugacuggauuugaauuccaauuccccuucuugcuaguugugugaugcugggcaaauuuccuaaaucauuuugugccucuguuuccccagugguaaaauggauuaaaaaaauauuuuauaagacuacuacggugauuaaauaaguuaauauacacaaagcccucaaaacuguacuuguacauaggaaaugucauuuaacugugagcuauuuuauccucauaucaacucuaugugauaaauacaggccuauguuacagaagagaaagcuuaggcugagauauuaagaaacuugcucaaacccagaguuauuaagcagaacugagaacuaaacuuguguguguguagguguguggcaccccagcacauagcacagaucacuaacagaagcuaaaaugaugugcuguagucuaaaagagcuaaacaguuaacgacaaugaacuuacaccgugggcauacuuguguaugagauuugugaaaccuaucaaaacagucuaacaauugguucuucaguuauuuaugggguaaaucuuguagauauaucacucugguaggcccuuuaugacacaguuucuuaaaaauaagacaauucaguaaggcacugcugagcucuuugaggaagaccaguccuaaaacuuuuuugaaacccaacuugaccauguuauauggaacagaauuuugggguuccaaauaauccuaaaaugugagugggggaauaucugaagcuauucagauuuuauuggagguaugguaguaauucaaguaacaaauaguaauucaaguaaauauuuguucugccugcaggcacgccaauuugcuuaugcuaaaaagggcuaacuuucagcccuuauaucuuacacauuugauucccaauucaaguagcaauucugcaccacagacacuucccugaggagucaacaaugcugauacuugagagggauauucaaguuuuacuaacuggcuacgugauuaaaaagaaaaagcacagaaaauacauuuaucaaaaacaugaauguuaccagacaagaugguuuuuucuauuuccucagcagacugaauuucaguauuuuuaaaucucuauagcaauuauacauaaaacauaaaacauuuugacuuccuuuaaauaagaaugcaguugaguauaccuuuguucucaagccaggaauaguuaacuuacagaguggucugaaacagcugagucacuaaaauuagcgcugcauaaccaucagugguauauuauauauaguuguuguuguaagauuagaguuggcuuccugaggagauaaauucuuuugacacagaagcagagaaaaaaaggaaaacaaaaaagcaguucuuuugggcuuucuccucucagguauagcucagugugcuaaauaucacuaguaacaaaaugauagcuuauaauaacaaauuaaguaugcugucagauuauuuuuguaaucuaagaauaaaacugcaauguuuugaaacuuucauugaauucucaacucaugggauucugauucucucaugcugggguauaacuuuuucuauuuauuuauaagaauucguauuucuauaggcgauugagaggucauuuuuaauagcaguauauaccauguaaggcauggaguguaaauacaccagcauaaaugacugaaagcuuaucugucuaaauucuaaauuauagcaaauauaacaucuuuaaaugauugauaaaagaaguaaauaauuaggauauuuccccacaauaccccauaguugauuauuuagaaauaguauuccuuaggauuaggaauacugaacuucuuaaaguucuuuauuaaaauuauaaggaauuauguacauuauauggaauuuuaaugaguauuauagaaaauauaaucuucaauauuauauguauuauguuaauauuagaaaugugcaacaugaggccaggcgugguggcucgcgccuguaaucccagcacuuugggaggccgaggcaggcggaucaccugaggucaggaguuugagaccagccuggucaacauggcaaaacccccgucucuacuaaaaauauaaaaauuagcugagugugguaaucccagcuacuugggaggcugaggcaggagaagugccugaaccugugagccgagaucacgccauugcacuccagccugggggacagagggagacucugucucaaaaaaauaaauaaauaaaauaaaaugaaaauaaaugugccacaugauaguguauuaauacuacaggcaaacuacuauuauuucucuuacagaauugucaaaacuauauuaagauguccaauuauauguaacugugaaaaauauaguagucuccuuuuaucuguaggagacauauuucaagaccuccaauggaugccuugaaaccacagacaguaaugaacccuaauauauacagccacaugucacuuaacaagggaauuucaucauugugugaacaucauagaguguccuuacauaaaccuagaugguauggccuacuacacacguaggauauauguuauagccuauugcuccuaggcuacaaaccuauauccaguauguuacuguacugaauauuauaggcagcuguaacacgaugguaaguauuuguguaucuaaacauagaaaagguaugguaaaaauacaguauaaaagauaaaaaugguacaccuguauagggcacucaucaucaaugaagccugcaggacuggagguuguucugagugagaugaguggugagugaaggugaaggccuaggacauuacuacacacuacuauagacuuuacaaacacuguauacuuaggcuacacuaaauuuauaagaaaaauuuucuuuuuucagcaauaaauuaaccuuagcucacuguaacuuuuuuacuuuauaaacuuuuaaaugucuuuaacauuuugacuguuuuguaauaaagcuuagcuuaaaacacaaguacacugcacagcuguagaaaaauauuuucuuuuauauucuuauucuguaaguuuuuaucuaauuaaaaauuuuuuaaaacuuuuuuguugaaaacuaacauacacacaaacacgagccuagaccuagaccuacacagggucaggaucaucaauaucacuuuuuccaccuccauaucuugucccauuggaagauuuucaggggcaagagaauacauggagcugucaacucguaugauaaaaaugccuuuuucuagaauaccuccugaaggacaugccugaaguucuuuuacauuaacuuuuuuuuuaauaaguagaagaaacucuagucuaaaauaagaauaaaaagcauaguauaguaaauacauaaacauauaacacagucauuaccaagcauuauguaugaccagcagugagguagguuuguuuacaccagcaucuccauaagcacacuguugacugaaacgucauuauauggcacaugacugcacuauguuuuuuccuauacacacauaccuaugauaaaguuuaauuuauaaauuaggcacaggaagaaauaauaauaauaaaauagaacaacuauaacaugcuaauaaaaguuaacuguaauaaaaguuaugguaauguggugucucucucacaaaguaucuuaguaauguacucaccaugaccauggguaacugcagaaaagggggacuacuguaaaugaacucugaacuuaggaaaguccaucagcuaauacuauucaagaauaugauuucauguuuagcccccuucuaauguguuugugcaaccuugcuauuauucaaguguuuaagauuuuaaucagaaagaccaguuuaguaaugaacagugaauaucccagauaaguguccuauaaacucuuguuuggcuacauuaaaaaaucuuuucaaaaauaagugcuagcauagucuaauaaaagcauccagaaggauacacacucaccuuguagcacuuagggaagcaucaucuuaccacugaggguuaggguuuuaaaacgaugugccuuauaaauuccaaacuauuuaugagcuagagcagggguuggcaaacauggccuggauauuuguuuuuguauaugaaguuuuacugggaugcagccaugcccauccguuuauguauugucuauggcaauguuacaucagugaccauguaguuugcaaaggcaugccuucgcaaaaaggguaugccuaggaaaaaguuugccaacuuuugaacugaaggacuuuuuaauaccaccuuuuaaauauccuuuucauuccaaaaauuuccugguuaagauuuuuuagggcaaauaaaggggaaccuuauuucacugagauaauuauaauucuaaaugacacaugauuauacaggcugccuauuauugcuuugauaaaaacaggcauugggcuuggccucuccacagacugcuguacuggucaguugcuacuuuucuauuaugagugucugucucauacacucacaucagcuucuucacacucucacuccucugcugcugcuaccucuucaaggaugcuucuugagccugcauuaauuaucugccuccuuucccuuguuucuucuugcuaguuuuaccauguuucucagguacucuggauuuggugaaaauaccagaagcuuugaucaucucauauuauuuaccuuauuugguucuagcuuauuuuuuaaaaacuucaguguuaaauauuuguuuagaguuauucacauacuaauucacacuaacuucuuacuuaucauuccccuucuugcaucucagucuuuccuuuuggguuuaauuugcuucuuccugaagugcauccaacuugucacuccauuuguugcuuggggguacuaggcaccucugggcguggccuuggaucagcucuugccuuuugcaacaauacucucuugcucuuauuugggaauuucuucuuuggcccuacccugcuuguuuucugucuuucaagguuuccuuaucauuucuuguuugauggauccaauucuucugguccaaagcagauacugaucaacucacuuuaaaaacaucuuuucugucacugggggcaaaaagagaacaccacagaaugugcucacaccuaaacuuugaaauggaagccucucaucuguugaucucuacauuuuucucauuuaccagcuugccaauuaaaaaugaggccacaagucuuuuuaccugcagauauguacauguuccauuucucauuaacugaccugacaguacuucugaaaggcaauuucaaguaauaguaagaacacaggcugcugaauccuacaucuuggaacaaaucuugauuccauuacauuguauuugacuuucaagcaguuagaccaccccgagauaaaugguuuccuuauccauaaaagagagauaauaauaccuaaguauuuggguuuauaauaaauuauaaaugauacagcauaucauauaaaguuugauuucaaauauucuagcaaucauguuuguuuuucugauuucuccccuauuaguugugaucauacugaguuucuaaaucccuguuuauuauuuugccuuuuuucguaugcuaaggauaaaucaacuggauaauguauuggaaaugucaaugaaucuggaaaguucuuaaaccaagucuuuucaagugaauucauaauaauccauaagaauucuacuuuugauaaaaggcagaacaaauuagacuuaauauaaacacugauuauaacuuuuaaaagaugcacuggaacaacucuauuuuagcaacuaagaauuuuugaaagaguauaaucaauuuucaaaaaaaaucugccuaacaaaacuacaggguauccauuaaagaagcuuaugcaauaauaaaaucaaaguaauuaauuuugaaaaagcagaacuaaaauguacuaugcugauuucaaaaagaagaaaaucucuuucauauaaaacaacagcucuacaugguuacaaacggucugcuaccaacauagcuaucuccaaaugucacuuauuuggcuaaaaaaagucaagguucagacacaaaagaacaaaaugggcauaagcaaaagaaaaaacaaacuaguuaaaaguaagacaacucacaaucaauaauuuagcaacacaguacacacacagagaaccuucugggaugacaucuuagggccuaauguacaugcaaaucaagccaacuuuucaggaacucauuuaauguuuucaacucuuuaacaacggaaacuuacaaccacaaggucucaaugaccugaagccucauguuuugggaauaaggaguacagaacaaugguuuggguucucuauagaauaaaaaauauauccuguuuuguuuuuccuaggaggacagagaggucuaacacaaagaaaaauuguucugaucuacaguuugagauaugguuagaaggaaagaguacauuuagggcagcucauuuaguaaaugacaagggaccuaagcaaaaaaugaucccauggagguuuuuauuuucagagaacaaaacccuuggcuggguaaaaaaaaggucagggaaaaggcgggaacgaaggguaaggagggaguccuccauuucuuuugagagcuagcagauaggcugaagccauggaaauaaagccaaugcugaggaagagaccugggacaggccaaaaauaaaaauaaaaaaaucagaucauggucaugugucuuaaauccagggucaagcugugccucaacuguacaguuauauaaauuaauaagaucucuuuacuguuuaagccugucugagcuggguucaguuacuugcaagacagaguccuaacuaauacaauauugaaauuauauaaaucuuucauaaacagcaaaucuguuuuugauacaguaagcaaaaauauuucccagggaugaaauuaucuagcaguauucaaagguacuuuguaauccuuucgcagaucuuggggagggaugaacaguaaagagaaagacagugacuggaaaucuuugcgagcacacccuaucacagaugcuggauccacuagcggcaaagaguaauauuuccauuuauuuuggcuuuuggacaaaugcaucauucuuaucaguaagguauaaaaauugcucuugauauauaacccaaacccaaacaacaacaaacauauuuaaagaaauccaguaauugugguuaacaugaagcuauggauagaaaaaacccuagcucuauuuagaggacccaaauuaacugcuuuuagaaccauaucuuuacaaaguugucaauaaaguguuaagagauaaaugugcuaucuucuuucccaauuuucuucguaucuuacugaagcugacacuacaaagcauuaaaauccucuucagccuuaguuauaauaaaagcuacuacuuauugagugcuuacuauguaucaggcacuguggcaaaaugcuuuauauacaucuacucauuucuguuuuucucuugcuucuuuuaguagggcuuaagaucccaaaugaaauauuauaaacaacacuuuccagaguauggucauaaaaugacaaggcugggauuaaauacuagugauaauacuguaacugguaauauuuucugaagauuucuugcuuuccaacaucuguaggauccaucuaauacagcuagaauggcggcaacuaaaugguuaauuucugagucuggauuuugaacuccaucuaagggcuuauaauagcaaagacaaaaaagguaggaaaacuccaaauuuaccacuaucucaagcauaucaagaaaccagauaacuuggagaguccuuacuuaacagcaaacuaccucuaaccauuuugcucgguauguauuccagaaaaugaaacauauacauuucaaaccagugcuacucaaagcaugguguaugaaccuggugccaguccacaaaguguuacuguccaaaaugacauucuucuauaucaucaaguacaaugguuauuucaagcugguuucuguguguguguguguaaaauauuuucuugacaaagaagacugcugauuuauauucacccaagcuccuuaccuaccacaaacugguaacaguuuaugggccagcuauuuugaguaacacuacacuucaauuuuguauauugcuuccaguuuucugucccugcugccacacaaaauucaaauaaauuaacaaucaaauacuuggcuuaaacacaguaauagaaaaagcaauacuauuagcaauugaccucaccuuugacagaagcaauuucacacaggaaacaugacccucauagacagcagacagaagaggaguaauaugauguuuaucuggagccuaugaaauaauaaacagagauaacuuuaucuguuuuucauuucuuccuacuuucuaguuuuaacuagaaaacucuuucuagauuuaccuauuugccuuucuagaaaaucaaucaaucaaucaauccacagagucaagugucuagucucuuaaagcuaccagagacccaagcccacgagcaaugucuuuccuuaggagucauaguaguagagcauagggagcagggcuuugaccucagcucaaaucuuggcucugccacuuacuaugguacuauuauuuagccucucuaagccuugauuccccacaacuguagaaaugccagugugguccaguaagggaaaacagggguaaaacacagccaaagaggagguaaaagggccggguagcauggcauccccugaaauacagaagcuacaaaaggcuaaaguugggagaugacugcgcuuaucugaccacuugcccauugaccuuuguccaauaauccauuuuagauuuagccuaugacugcagaguccuaugcuguauuacaucauagccauuuguuacccacagauagugcuaacuccccaagcuuuagaacuugaaaagcaacagccacaggggaaacauacuaaccuucaauuuuugucagcuuaaaaaagucagcuuuuuuggcuuauuuuuaaaaaucccaccacuguauaucuaaguuauaggcaauuuggcauaauuucagacuguauucuuauuuagaaugaaguuucuacaaauagcuauuuuauaaucuauagaaaacaauuacccauagcauauuaacagaaaauuuuuucaagaaugaucacguccucuacguacauuaauaucugcuccuuucagcagcagaaauuccaggauuucaagcugcccacaaucugcugcauaaugaagagguuuccuuccaccuucuaguguccgguugacaucuucucccugauaagaaaaccaaaugaaaacaauauuuauaugaauggaagacugaagaagugaaaugaggcaccugauacuuuuacuuucuuaaagccgugagaguuucaugaaacaauuaacauuucuugcaaaauaaaauaaccaaaaacuugaaaugaaauucugcacaagaguuaacauacaguaugauggaaauucaagccacaauuaguuaagcugaaaacaauauacaauaaugauaaauauaacgaaauacauuacuguccuccauuucuaaggaguucaaucagcauagugucaauaugugaccacagaagacuagugaguucaagcacugagauuuuacacaguucauauuacauguauuuuaauucuucaaagaaaguauucccacuuugauguaggcagccaucaauaucacaauguaauuucaguauuagguauuaagaauuuauuucauuuaacauucaguagagcccaauuguguagcaggcacugugcuagacaguaggaagacaguggucagcaaaaucagacaugacuccugacuguaugaagcuuaccgucugggguuggggggcagauauuaauaaucacauaauuaaacauauaauuucaaaauacaagugcuacaaaaaauggaacucagggcuuucagaagaacaugacaauccuggugaugaauggagguauagugccagaaaaaugaacuuaaguccaaaaaagucauuuucauucacugaagauuaacagagacuaaaaaugaugacuaccuucgcuauggaccagcugcaauacaucuggcacugugauacacccauuauuucuaaucuucaaacuaccccaagaagagaauaaccuccaucuaauacaugaaaacucuaaagcugaagagguuaaauaacuuuuuacugugguucaguuaguaacagaguagagauuuaaacccauucucuuucuguaccaacaugcuguuucuaauucgcuauuugccccuucccucuuaggagaguucagauuuuacugaggagcaaaacauccuauauucucucagccgggugugguggcucacaccuguaaucccagcacuuugggaggccaagacugguacaucacuugagccuaggaguucaagaccagccugggaaacauggcaaaaccccaucucuacuaaaaauauaaaauuagccaggcgugauggcaugcuccugugguccagcuacuugggaggugaggugggaggauccccugagcccaggaaguugaggcugcagugagccaugacccugccacuacacuccagccugggugacaggagugagacccuggcucagacaaaguuuauuuucucaacaauuguauuauucacuuagcauaguuuggucaacucaucaagccauacccugaaucaagauguucagagcccuaucauuuuacagccacuauaaaccauucuuucaaacacacauacuccaaacuccuccaaacuccccuuccccuuugucacuuaugccugcucccuccuuccuucccauuaauuuaaauacuauagguccuacaagccucaaucaaauuuaagauuuacuuugucuaugaaacuuuccaugauaauggcaagcucucuuucucguaaaacucacaggaaucaguuaguauuuaaauauaugguacccuuacaacuuuguguaugccuucuuucccaacagaaugcaaauuccuugggaguagaaauuauauguuuucuucuuuauauuuuccuacaguaugaugugggaguuaagaacaggagcuccaucaccauuagaucuugggcaaguuacuuacuuucuaugugcagagaugacaguaccugcagcucauggaguuguggggguuaaacuacaugauccauguaaggcacuuaaauaucacacuagcuaauauuaacagaaauacgguuagcuauuaucuauaaguauuaucuauguauguaauagguauacucaaauaugaauuuacuuauuuuuaagcauucugagagaagggugauaucaacugucuaccauagcaaccaauggugucagugaagcauuaagggaacuaaauuauagaguguuuccaaauuccagcccacauguguauuucaaauauauauuuuuuuggaggaucaagaguuucaucagaaagcauuuuccuaccugaaauauuagaugauaaaacaaucuaaguuaagacuacuucaauaauucaaagcaauaauuucuaaaugauuguuuacuuaaguuaauaugugauacaugcauuacaacagggccuccuguaaaucagaaggauauagaaggaauguauaauguauauauguaauauaauguauauauauaaugucuauauaaggauguauaaugugccuaaaaucacuggagaccagguuagcacuccaacucuaccacuuaguugugggaccagagaccagguacuuucuaaauuuugguuuccuuauccguaaaaugggaauagaaaugucuacacuucacaggguuucaguguuucacuggaagagauaaccuaugcaguguuuagcauagugccugacacauuguuuaacaaauguuuaaugaaggcuauuauauuuaauaaagguucacuauuauuuuuguggauuccugguacuggcuuauacuagacaaaagauuauucaaaauaggauuaaggcagguuucugcauaaugguugaaauaugaauaauuaaagauauuauuuauuguaacaugcuuuauauucaaaaucaaauuuaaauaguaagggcgaacuagcauaccaccuuagucuuuauucacaacuacaaaaauguuguugaggcaaagaaugcuuaacaauucagauaaaauuaguuugccccccauuauuaacauuuccuuucuguuaauauuagcuagacaggauuaacuggacgagucuuuagagugagacaaagcaaauaaauaagugcaauaaaucaucaauaagaucuuugucaaagauacuucugugaaccaaaaauguuacauccuucagggcugggcacgguggcucacgccuguaauccuagcacuuugggaggccgaggcgggaggaucacgaggucaggagaucgagaccauccuugcuaacacggugaaaccccgucucaacuaaaaaacacaacaaauuagcugggcgugguggugggcaccuguagucccagcuacuugggaggcugaggcaggacaauggcaugaaccugggaggcagagcuugcaguaagccgagauugcgccacugcacuccagccugggugacagagcgagacuccaucucaaaaaauaaaaaauguuauauccucccuugcacucuuaauaccagugcaaaaugccuaugaaauggaguugugaguuuaaauuuucuccuuuauuccuucagacauuuacauuacaauucuuauuuuagcagacaaaaagacgaugagacugaaaaggcuuugugugacugacagaaaaaaauccuugucagcagggccuuagcaaagcaguacuuauagagaaauuuauagcacuaaaugccuguacuggaaaaauagaaagauuucaaaugaauaaucuuuguauuuccaucauaagaaacuagaaaaaaaauuaaauccaaaauaagcaagagaaaagaauaaagaucaggguaaaaaucaaagaaacagaaaacagaaaaaugagaggaaucacaagcugauucuucaagaucaauacaacugauaagccucuagcaaacgucaucaggaaaagagcgaagauacaaagugccaauauuggacaacagauuaccuccccacaaagaaaccuucagacuccagauggcaccacugugaauucuaccagacauuuaagggaagaaauaauaccaauucuacccacucuucccgaaaauggaagcgaugggauguuaucucaacucauucuaugaguucagcauuacuuugauuccaaaacaagacaaagauguuauaagaaaauacuguaugccaauauuccucaugacaagugauggaaaaauuuuacacaaaauuuuagcaaacguaauccaacacuauguaaaaaggauaauauaccaugaccagugggguuuaucccaggaauaagguugauuuaauauucgaaaagucagugaauauaauuuaccauuuuaacacagagaaagccauaugauugaccaucucaauggauuauaaaaaaaaaaaaacccaauaugcauuugucaucagaauuuagcaaacuaggauaagaaggaaacuuccuuggccuacaaaaaaccuacauuuaagaucauacuuaauuggugaaagacugaaugcuuuccuccuaagaucaggaauaagacaaggaugucuguucuuaccacuucaauguugcacuagcgguucuaaucaguacaaccaggcaugaaaagaaauaaaaggcauccauuucgaaaaggaagaauuaaagcugucuuuaucugcagaucccaugguuaggggggugcugaaugacaauuucaccagguuuucagcagucuugaugcaccggugguagguccaauaguggugaugaaauaggaaaggaagauagugcucuauauaguuccuuucuucccugccuccggccuauacuuuaggccuuagugacauuagcagagauaaagauaccuauucuguaaucuucauucuaacuucauaaaacauuaccaguuacagaaaaaaaugaaaaccuaauuuucuuucccaaauucuggggauagagaagagagauacacaauauuaacacguuccuuagcucacauggaaauguuaccauguuuuccuuuuccucuggcucuuccacuuuccacagauacuauuuuaaaccucuucuacuuauuauagaccuuagacuuuucugucuccuccuuccccuucauucucagcagaugagcccauauccuucuuuauacagaggacaugaucucccucaggaacuucuaucacaccuucuuggaacugacucauccucucauccuaucaaaagccaucccucaccuauguucuguauaucgucccuucuuucuuuuuuuuggggaaaacuucauguuucuuucuuuucuugacuguguuuucaaccuuuccuguuuuauuggcuccuucucaccagcaugugccauucacagcucuuccacuaaaaaagcaaacagcagcaacaucuuguuggacuugacaucugcccuucaguuacuguucucuuuccucccuuccagggcuaaacuuuacaaaaggauugucuguauuugcuaucuccaguguuucaccguccacucuaauuuggcuuccacccucaacacuauuaccauaaccauuuuugccgaggucaagggucuccauguugcaaauacaaagcuucccuuuacucuuaaaacucuuucuuuucauugcaacaugaagucugucaguuauuaaauucagaaccuagauuguauuauauuaaaacauacuaaguuguuuugaagcuauuauuuucucuaaauaugguauauuccauauauguaaucuaaauaacauauauaauguauauacauaacauacauaugaaacacuacuacuucauaguauauucuggugaguaguuuaaauuaaauacauacacuguaucuggaaccaccauagaaaccauaacaugcuuuaggauggguugacuucuggugcuucuaagaguaagaugaggauuuagauuauaguggaaaggagaaagucuaugugaaauucuaaaccaaauggaacccaagaaaggucuuaagauuacauucuggcaacccgagauuagcuucucuugagucuuccuugguccuaaccugaauucuucuuaguguuaaaaaauuggaaagaaaaaaaaaagugacagugcaugaccaguuuacaucaauaaguuggugaguuccaugucagaggagaaccuaauuauuauaucauuuauuccaaugucaaagcauagugcuauaauuuugauguguguccaggaaaaucucauguugaaauuugaucccaauauuagaggugcgggccuaaagagagguguuugggucaugggagcgggaucucugaagaauagauuaauguucucacugggugugagauaagugaguucuuaucccauuaguucuugugagagcugguguuaauaagagccuggcaccuccucccucccuugcuuccucucucaccaugugaucucucuacaccuggcuccccuucauuuucugccaugaguggaggcacccugugacccuucacagaugcaggugcccaaucuuaaacuuuccuagacaacagaaucagaaucaugaaccaaauaaaccuuguucuuuauaaaguacucagccucagauacuccuuuguaacaacccuaaacggacuaaaacacguggcauuuuaggacugggcacuggacagguuuuucaaccuaaaaaaauuaaauacuauugguauuuuccugauauucuugauauauaauucccuuccuuuaauccucauaguucuuguuuauaugucuuucauuacauuuaccucuauucgaucagguauguuauuuauauacuuuaauaaaaacuucauuaaagaaaggacaaugaaagaacaaugucuuacuuguuuauauacugccuacaaugucugugggugacuugugcauagcagucuuauuuuaauaguuucuacagucacuuauaacagcuuugucacagugcaaccuguugccuaccaaacagcuacuacuucacaaagugguauuuuuaaaaccuuauuagggucuuugaaaguuauacaaucucaguguuggaaggggcucugaaugucaucuaauucagccacccauucuauguuuuaauccuugcuugugucugcccaaccuauaacugaguaucucuaaugaaaggcaauucagaaccuugcugaucaguccauuccugcucucaguacuggaaaauucacuguuuacuaguuaugguucuaucucuugcagacacauggcacaagcaauucuuauuuuuacauuagguuauuacuuguguuuaacagucacaacacacuguaacuacaacuaauuauuuucauugauuugcuguuauccugaauuugagucacuaaugggucagagagaccuaccaucugcugaucccugaucuaguucaugacacuuucauccaaucauccuuccccaucauucccucaaggauaucucugaaacauucaaauuucacuaaaguauuucagauuaucuuuauaacagucuagaaacuucaaagaaaggaaauuaguacagcaugauuucuaaccgauccccugauaaguguuauaaaccacuccauugccaccacauacauauuuauaaaauaaaaucuggaaauuaaaaaauauuuuagcaaggccuaccauccaaaauacaaccauuguuaccacucugcuauaauucuguuuaaucuuuuucuaugaaaauaauugcuuuaaaaaguugugaacacacuauguauucuuucacgagacaucauucuugaaagauacauauauccuaucaaguggauguaccauaguuuacuuauucuaauucuagacaugcaauaaauaucaaauacccuguaacacuaaaauucuuauuuuauagaacauaacaguuacauuauuucauugauuccuaagcacacauuuuucuguauuuuaaugucccuaaaauuggucacagacacccuuugccuuggagauuggcggaaaaguacucauggguugauuauguacuuuguguaaacacuaacaaucauucccuaugccuggcuuugcuacugaaaccuauacaugggugggucaagacauuagaguguaaaguauagaauuagauuaagcugacucugaagaacauaaacggugaaauucacugauucgaccugaugauauuauucucaugaaaauuuggugagugugccaucaacuauuuuuaauccagagaagagaaauuaaauauuaaauagaacaugucuuacaucuaauuucugaaagcaauguuauuggcuguauaggaaauaucccuagaguuuaauauaugccaccuggcuauccccacugaguuauuugcuuuuuuaacaguacuacaagcaagggaagauuuuucuaguuugucaguauuauucaggaggaacaucugcuuguuuuuuuuuuuaauggaacaucuguuuuuuuaagaucaagauaaacuaaguguauugccuccugcuuuacugcaacaacagaaugaaaucaaacuuacauaguauacuuuccucuuuacaaugccaaguuguuuuuuccuucuaguauuuuaugcuuauuaaaugguuuauucuaauauuuucccaaagacaucaauuugguuacucaaucauucaugaaacauuuacugauagcuuauaaaguuuugggaacuguggcaagcaucugagauagugaugaaaaaggagucauuccccacaaggaaucuguagccauaaaaggcaagacaacaaguaaaccauucauauaaugugauuaaauuauaucaugugauuaaagcugcaguacaggcuaugaguuuguuuugggaauacagaaaaggagauguaaggggucuaaucaagcuaccaugaagagauaauuaagcuugggcuaagccuaacauuuuuuucuuuaaacauuuuucucuuuuccagucuucaugauuucauguuuuuuuaaacaauguaaugaaguuaugccuuaggcaauagagaauauaaaagaucgggugaacaaaaccaccagcacuaggauucuucuaguacauaagcagguuuuaaguguggucagaggcaauccucacauccuaacugcuagcacacccuaaaucugaauaguauuuccccuuuaaaggauagguaacaaagaaaaccaauauggagguaggguauaaaaaucauauagcaaaagaaauauauugaaaauucuuuccucuaaaauguaguagaaaaagaaaauaaagaaaaaaaacucuaaggaaauacauaccucugaaaugauucaauauaagaaacuuaacuuuaguguuugccucggcagcacauauacuaaaauuggaaugauauacagaagauuaguacggccucucugcaagagugacacgcaaauucaugaaacaguccauauuuuuuugguuuuuaauuaaaaaaaaaagaaaagaaacuuaacuuuagaaaacaucuacagaguaaucaaaauggaauccaaaagacaugggcucaauaaguaagggugucuuaagaagagaacaggcaaacacacacaguaaacaaacugaggugcaggcugauaggaaagggaagcugcagagaaagugacauauagcaaggaaauuaaaacugcaauugcaaaauuaaaauuuguaccgaagucaguagaguugggaaacacuauucaaauuaagaaaacucaauuaaguaaagacuugagaacaaacuuaagaaauuuucccagaauaccgaaguaauaaacuaguacaaauguuuaaagaaaaagacgauuggcauuaggaguauaaaguucuaacuuauaaaugauacauaaccagaacaggaacagaaaguuuucugaacucaggaaagaccugagccuauagauuauaagaacucacuguauuguaggcaaaaauucaguugauucccccccucccaaaaauaguuuuagaauuucuuuagauaaagcaaaaagacucccaaaauuaaaaagucaaaaucacauuaacaccaaaaaaauuaaauuagacuggucucauauuuguggcuuccuuagaacaccgaauuccagaggacuacagagagaaacuaucuauagcaaugauauuuggagagaguuugagauauauaccuuuuuuuuuuucuuucuuuuuugagacaacgucucacugccuuguucaggcuggauuugaacuccugggcuaaagcaacccagccuccccaguagcugggauuacagguucaaugugcuaggcucuuaacaucaaauuuaaagauaaagaaucuugaauuuuguuaaacaacaacaaaaagaaaaguaaacaaauuuccaaccagaagcugcuacugagagauaccuaaaagcaaaauaugaaaaugugaaaaaaauuuguuuaauggucaaaaauauacuaggcacauacaucuaaaaagcuaggaagaguaaucuugguacaugauaaagugauaaaguagaaucaaagcaaaaaaaguaaaugggaaagauguucauuuuacaugaaaaaauguaaaagcuaguuaugaauuaucugaagaacggcaagaaaacaacugacaaaaauagcacuguacagagagacuaucauaaucaucuuagucuuuggcagguaaggacacagcaggcaugauuaauaauuaaugagauuguuaauguauaucaaacuuuguacucuauggaaauuguacguuacuauuucacugaauaucaacaaaauauaauuauaacagaacaaagaaaacuucaauacauucugaagucuaaaaccuuagagaacccauuaucuaaucccagugcaaugggauuagauugcauuaaucuaaugcaauuaauuagauuagauuaauugggauuagcaaaauaccaaaagcguuagcacaaaguaaacauaagaaaaaaaaaugaaugaaugaacaaaaauaacacacaaaacacauacacacaaccaaaccaauacuaaaucuccuaaauuacugauggagcaaagaaggacucaauacuagaauugcagaccauuuugaaaauaaauguuaaaauauuaaaguauucuauuaauggcaagaauauuacuuauggacacaaccaaaucugugaaaaaccaaucuggaggugguuaaauuaauaugaaauuacaugguuuaaaagacuaccacuguucacuagauuuuucccagcuguuuucaauuuuuucucccuuacuuuccuaacugguuuuaauaugaaacauaaacauauuaacaaauaagcgguauguuuuuagaaguuucagauuuucucuucaacagcaaaaucuuuuacaugcuccuccacaguguggcuugguggggauuauucacuagauuaguacuucuuacaggccucuauuacauagcauuagguuuauuugaauaauaaacaguacaauaaaauaguacucuuuaugcuauuucuaagugaaauggccgacuccuacagagaaugguuuuuagaccuuucuucaggugaaaagaaacaaauaauacucuuuguuugaucuguaagauauguacgcauugcugccacugaguuccaagguauagguacauacuguacugccacaagagaucagugucccaaaagcuaccuaacaaacaguagacuaaauuagcauaugugucaccacuuuguaccacagcauguaaacuaaauauuggacaccugacaguagaaagcagcaaaaguauuaaauuuacaaaauucuauauaguugagucgauguccccaauaauuucaguuacaguuacguauuauccuuccccaaugggaauucagaauuccuuaagacugcaguguuuaauauuuaaaaaaugacagauccauuugagaugaauguuauaauauagucccuccuuuccuaauacucucucucuguccuccucccuacccaaucccccagguugaaaguccuuauuuaggauauaacuuugcaaaaaagaaucaccuauuacuguacuggugacugauaucagugugucaaacaauaccacaauuauaaauuacaacacagcaauggguuuauauguaaacucuaccacugaggcggcaaagcaaacaagaaaggugauaauacauuaauacuuuauuuggaacuuuacaauacagaaaaacagacagauggcacaauagaaagaaagaaggucuguaaggacgaaaguauaacaucaaccugcucuuacuugacauauuuucugaaauguuaacgucacaccaaaugaacuuucucuugcugacgucauccucccaaaugcaucaaacuuucaaugauacaaauaugaacucauuuuaaauaaugaauaacaauacauuuguuauguauucuuaucccaccuauacauuuacuuggaaucuucaacuuaggcauuuuuuucuuucaaaaaugacuacuucagucauucaaauuauagaaauuucaguuuuaguuuucagcugauuuacuuauuaaauacacaccauuuuucuucuuuggaagguuuagaagcaauuaauuacacuuagaaauuuucuaauugaaaauggugaaguauuuuuuaaaagcuugugggaaauuaaaauuuuaauaacaaaacacguguuuauauaaagaaagacuaucaaaauuaagaaaauccauuuaaaacauuauaauaugucaauuuggaaaaaauugucaauuuggaaaaaagacuaacaaucaaaaaguagcuucauuuauaagauucuaauucauggcuccacaguuggaggggagggagggaagagaggagaaaggaaccaaauauaacuuuaucuuaacaaacuguauagcugcuuucuaaguguuauccauauuucauguauuaaauaagggaaauaauguauucagaacucauacaaccaucuuaucugcuguauguuuucuaacccuuuuaacuaaaccuaccaaagaaaacucaucucaguggcugacacuguaggugcucaaaugguauuugcugcauuaauuaugaaugaaucagugaaaacugcuaaccagccuucucuuucacuucuggaguuggaaaucaagccagggacaggacucacauuagggcugggaagaaaauuuuggaacguuuuuggugaaggaugaucucaugcagcugaaaagauuucgcagaaucuacuuucaguuuaagaaucuaaauuaguuccuauuuguauauuacaaguaaugauuccucauuuucagaaaucuaggccucuugccuaagguucaaauuuaguauagaaauucuauguuuuuucuuuuagagaauuucauucaaacucccucucucuucucucuauccacaagcaccuuuccaugccuugcuuuuccaguccaacaucuuugaaucauaaagguuucugaauaauguuuuugaaaaugcugacccccaaaauaaguuuuauauuauacauuuuaauuuuuuuauaucucaaaaacuugagaauaaagugaaacuuagacaaaguaguuuuacuaacuucaauguuauguagagaugugcaaacuacggcucaugggucaaagccagcaugcuguuuuuguaaauaaaguuuuauuggaacucagacucauuuauugauguaucaucuaugacugcuuuugcacaacagcagagaugaauaguuaugauagagacugugugacugccaaggccuaaaauauuuacuagcugccccuuuacaaaaaaugucucccaacucuugcuauuaagcauuggccucucuaaaucuccucuaagaucuauacagacaauaauacaaacagcaaauacuuacuacagaauuucaguguauuaagcacugcuuugcaaauuuuacauuuacauuauuuuuuaaaacuuguacacaacaugaauugaguaugaucacaaucccuauuuacagauacaaaacugagguuugaugaaauuaaauaacauggucaagguuaguaaguagacagggcugggaauccaaccaaggucuacugaaauccaaaaugaaaguguaauaucucuuauagagaacuucaaaauaauaaauaauaaaaaauauuuucuaaggacuuaaguuuuaggguccauaugcuuuuauauuguuauaaguaauguggcauuaaguauagguuuuaacauuuguuucuuaauaccaagguaaaaguacugaugauucuuauuuuucacaaggaagcaugcacaaaacuaucuuuacuuuuagugagacuguauaguguuaacaauucuugacugaaauucuaaaaugauagucaugagagguuacaaguggaaguugcuguuauacuaauacaacuguugucacuacaaacagugugggaaguuggacaaaguucauuggguuuaaaacaacaaagaacuugaaaauuuagagcuauuucuaagagaggaaaugaaagaacaucauuuacacuaagaauaucuguuaacauacaaagugguauaugguaaaccaacuuugaaaacaacaaaggaagggauaguuucugcaaauaccaauuaaauacaaauguaacgaaacuguauggcagauaacaggcaaugugauaacuguugaggauacaaagauaauugcuaccuucaaaaaacccacagaauauuaggugagauaaauagguaaaaauuaauauaggguucuuaauuucaagcaacagaaaccaaaucagacugauuaauagacauguaauacauuaacagauauuaaaaguagcucccagaacugcuaggaggauugaagaacaaagcucaguaaauggacagaaaauaaggaugcuuaaaagcaagaaauacaaguguuccucuacuuaugauuggguuacacugaaaaugcauuuaauaaaccuaaccugccaucacagcuuagcccagcccgccuugaaugugcucagaacacuuaccuuagccuaccauugggcaaaaacagcuggcauuacaauacacagcagaguaccaguuauuuacccucaugauugaguggcugacugggagcugcgacucccugcaccaugagaguaccaucaugcauaucccuaagcagggauaugauuuugacuuugaaagcucugauuuugaaagaucaaaauucaaaauuugaaguacaguuucuaccgaauguguaucacuuuugcgccaucacaacgucaaaaaaaaaaauuaaguccgggacugucugugaaaucaaaaucugucacaagaaccaccugggcacagaagagaugcuacaaguggcacauaacgacuucugcuguuuuuggaaagugguguuuuacugcugccacuacaucuuuuauuaugccugagcauuuguaucagcucuagauagacgcauccaauuagucauguuugggaugagcucuuuuccugugugggcaagagaaagcaauuuauuugcccuuuuuggcuuuuguugcggugagcaccagaccuugccuuugaucaagauucauacuauauaaguagggaacuccucaagcacaggaagaagcuucaagugcuaugaccccugucaacagaaaaaugccccacuauaagcacuguagcuuaaagaucugaagacauuuuuuuagggggcuggagagggcggugaagagccucugaauucucaaguuugugagccacuauucaagugacuaaaugguaauaacugauccauauuuauaaaugcaccuugguuuuuucuuaaccagucauuaagacaaaacucauuucagcaguucaaaaauuaaagacauaccccacagaacaagauuuaaguuucuuaagccgcuguuuuucaaauucaagucuaauaacuuguuagucaagccagaagcccauaagcucucaaauuuaagaaaccacaacagaacauaaacacaauaaaaaaguucuauauuagaugucaccaagaaacaauaaacugcacaagcagucagggaaucuaugcagaacaaaacagacaugaauauaaaacuucaggaagaagaagaaauuugccaagcagauguugugggacaaaaagaauaauuuauuagagguaacagcuagcacaagaugacuucauuagcaaacacaaugguguagcggaaaaccaaccaaccaacccucauccaaguucaggaaaacugaauuuaaauuucaaucucaaauagcacuaugauacuggucaagggcuuucacacuuaauuuuuccuuaucuauaaaauaagggagcuggacuaguugcucuguaaguaaucuugcuucuaaacaaauuuaugaggaugcugauuaguaacaacagcuaauauuuacuagcacucaccauaugccaggcacaaugguacacaguuuacacuuauuauguagguauuacaaucauucccauuuucaccaauugaagaaacucaaguucugagugcuuaauucacccaaagugucuaguuaguaagaaggccagaccuggaagaucuaauuccaaagccaacacauuuagccucuaugcuaugguuucaccaauaaugcaauuccaaaucccuaaaggacagugccauaaugagcgucuauuguacuauguuuaaaguguuuacuaccuacaauuuuuuugugguugagauggaagucuugcuauguugcccaggcuggucuugaacuccugggcucaagugauagauccuccugccuuggccucccaaaaugcugggauuacagacaugagucaucaugccuggccuacaauuuuuuuuuaauaccuccauuuuucaguauuuuucagauacuuacuuuaggccuaaguaucaaaaugcucauucuuuuuuauaugucaaauugaaaucuuccuaaaauauguuauacaugucucugacuuuguaaauaagagaaaaguaaccaaguuuaaacuuuucgugaagcucaagguuacgcuuauacauauuaauuauugccugaggccucugaaacuuuaagguaaauauggcucuuugcccuucacuuucuugggucagcuucuuacauuuugguuucuuuucuuucaguaaucacagcuccucuuuacacugguaauuuucuguggacugaaaaaaaaaaucaagcuucuaagcuuaucagaauuauuuaguaaagauauagcugcaaaaaaauuacuuucagccauuuuucuuauuacaagguggccugugauguaauaccauaaacuaacuuucaucaccaauuuugcugugauuugauuaucuaaacacacuuccucuguuuugaaucuuugauauggcacauucucacagugcaugacauccuccuaagaugauucauaaagaauuaaaaguuaaaguauuaugucccacagaucacacgaucccagcauuccagaaaaaaaaaaaaaaagcuuaaugcuuauuaaaagauacagguuaaguuuuagguagguucaaaucauccuaauauuuuucuugagauuaugggaaaaaaaauuuuaaggaaucaccugcaaaaauccuaaagagaaugugagagggagauacuaaaaccuauuuugaaaccacacaucauuaaaucaguuugguauagauagaaaaagagcaagaaaucuguuuaugauaaagaugaugguucaaauuauuaguaaagaggaacuacauuguucaauucccaccuaugagugagaauaugugguguuugguuuuuuguucuugcgauggggauuaucacacucuggggacuguuguggggugggggggggggaggagggagggauagcauugggagauauaccuaaugcuagaugacgaguuagugggugcagcgcaccagcauggcacauguauacauaugcaacuaaccugcacaaugugcacauguacccuaaaacuuaaaguauaauaaaaaaaaaaaaaaagaaaaaaaaaagaaugucagaaauuacuagaaaaaauauuaaacaaaauaauauuuacuuaauacagauaagaaguuuuaaauaugauuuauugaacauuucaccuuagagcuucucagucuuaccaauuuagccauucuaauaguuauaauguaguaucucauuguggauuuaauuugcauuuuccuaauaucuguuauaauauauaccacuuaacgugcaaaaaaaaaaagaggaacuauaauaauaaaugguaugagaacugucaaaaaaaaaguauacacuuauuucaugccuuacuucaaaauaaauaauggaaaggucaaauguccaaaauggaagaaaaaaugaaguuccagaagagcaaauuuauuuguaauuuuacagaagagaaaaggucuuuguaaacaggauacaaaauccaagucacaaaagagaaaaaaagcgauacauuuaaccccacaaaaaguaaaagaccauuguagaauaagaaaauaaaugaagucaagagauuaacugggaacgauauuugcaaaacaugauaaaaaacugauuucccuaauuuauagaguuuauacaaaccaauaaaaaacagaccaacuaaaagaaaaauaaacaaaagacauaaacaaucauuuuucaccuauccaaauggcaaaaucuaaaaagucugaugaugcccagugcuguugauggugugagggaaccaucggucucaugucugccaaugugugccuaagcugacgaaacucaugaagagaguaaugcagauauagucucaaaaguugucaagguauauguacaaaggugaucacgacaauccuguuuaauugcaaagaugcacuggaaacaaaauguuuaucauacgggaauaguuaaauaaacauccagaaaauggaauacuauucaccauuuaaaaagggaagaauaaauacauuucaauguggaaagcaaagugcagaaguguuuacagaacuuuuuaagcgggaaaaacagaugaguaaguaaauuuucaauguuuuucugaaauuaauuacauggaccuguugagaauggcugauuuguucacaggcauuggggaggggagaucuuuaccuuucaguccuaacuguggcauuuuaaaauccacaucugaauuaauuuaauuuuacuuuuuaaaaguuaggaguuaucuaaauaguaaaauuuuggccaauuuuugucuucuuuauucuuuucuguuuuaaaaacaccuaaucaauuuuauauuuuaaagagaggaaccacauagguaggaaaaauagucaaugggauauuuuacuuuauucaauacagcuuugcuuuuuuaaauaacaagcucauaauauuguuauaauuucuaucaguuuuaauucauuaaauuuuuaauuaucugcacuaauaaaaggaaaauguuuagaaucucaaaccaaaacacuuuauauagccuauguacaucugaaugaacauuuauguuccaauguaaaaaaagaucuuccucuauuuuauauauuuuuuaaaaugacuaaaagcauuaauaauuagaaaagaaucuauacuaauguuucucugucuacugagggcaccuguaucuuauacaagcugacauaugcuuucugaauaggucaccagcccuucuguagaaagggcaacacacagugauacauuuuuauaagaaagaaacuaauaauuuaaagaagaaaaaaaagggaagcugccuaaaaccaauaaaugcaaaguagauugaaucaggaccucuuuuaaauuggcuauuuuauuaggaaagugaaaagugaucucaaugagucuuggaauuucuaaagauuagaguugauaucuuucucagguucaagagauucuauccuuucacauggugcacaauuguugcuuuucaaaccuauuagagugucaacggcagauguaauuagaauggaggcuggagggaaaggaaaccacagagaaagggaaguuagagaccaggcuucuauuucacagcaagugaaauagaaguacauguaaacaagagaguacauguaucagaccugcugaagauuaaaaggggcuauuuaucaaugcaacucacaagcacucaccuguaagcauguuggauccucaaaauccaccagaaagcucaccuuuuaguagucucaauggauaauuaccauccugcuaugauuauuuuuacuauuuacucaauaauauaguaccccccuaguuucuggccuuauugagaaaugaaggucaaggguaugcugaaguaguuaacagcauggggcuuuugaaacuccuucagaacccaaggaagugaguucacaucucagcuucaccacuuaagaacuuuaugaucuugagcaaguuauuuaaucucugccucuaaaaucucuaaaaugggguuaacauuauuaauaaugcucauggcuuacuguugauaaguaaaugaaauaauaccuguauacugcaucacaauccucaaauacauaaaauuuaauaaacauacuuuuuucaaaauguuacuuguuuuauuuaaauaauuaugaauagaaaucucaauaauuuaguuauuuuuguuucuuccuaaggcaaacaaacaaaauuuaacuuuuucuggacuguguaggaucacaauuaggaacauaaauuauaagguuagauuauaugugaccauaaauacaaaacauucugcaggcuaucagucacucuuauggacacgucuugaguaaugacagucucugaugagaguuuaaguuuacagagauguuugucucuauacuaauuauuucugaauuguuacauuuacaauuuuuaaaauacgguugccauuuuugucuucauucacagucagagcuaauuaguuguaccggcuucuuacaagccucuuucucguuuucuuaauucuaaaguguuguuagcaaaaaaaaaaaccacuuuuaaagcaaacugauaugguuauaaauacacacgcgcacacgcgcacgcgcgcgcacacacacacacacacacacacacacaccccauguagauucagacaguucuggguuuaaaauccaguuaugcuacuuaguuugugaccuugucaaguuacuucaguucucuaagccucagguucuucauccuuaaaauaagauuauuacuuauacugaaacacugugguaagaagcaaauaaaaacuuagguaaaacaucuugcagagugcuuuccaguaccugacaauguaagucauccagucaaugguaauuauuauucuguaauuaaugaaguaugcugaaauuauugcuaaguuaagaauaaaaugaauuucuuaccagaaacaugauuuuaauguguaaaauuccuuggcgcuauguuggagacagaaagaugaaaaagaauauauuaucuacccuccaggaguucagagccuaaugaagacacauguaaacaaaaucacagcaaucugaugagcaaaacaguaaaagaagcagcacucuaugugaagucaaucuuuuucagccagucucccucacugcccuuaaaauauuaauacuuuugugauuucucauugcuuauuuuaaaagggccaacuccucaucgguaugguguuuuucuguuagaggugauacuuacccuaggaggguaaauaggaguuuaacagguuggggguuagggauugaggugagcagacuuggucagggaggaugaaagaacacauguaaagaucuacaaggaagaaacaggauggcagggucuggagcagagugcuuagagagaggcaaguguagaaaagcaagcccagauaauaguggccuaguacaccauaccaaugaggagcuggcccuuuuaaaauaagcagugagaaaucacaaaaguauuaauauuuuaagggcagugcaggagacuggcugaaaaagauuacaugcuuauauucauguuauugagagaucccuccaccuaaacuguguaaacugaccaggaaggggucaauuuuugcugcuucuuuccagccuggacuauauauucuuucuugacuauuuucuuauagucaagaaagaaaauauaguccaggcuggaaagaagcagcaacugaucuaaaguaguaagaagaaaggagagugaggaauggaugagggagacuaagaagguagucuugguaacccucagaaaucuaggaaaauuucccaguuuccaguuuggacaaaugguugggucaugauaccauuagugaaaauggagacacaauaggaauaaaaacaguuuuugagaggaaaacagcucaauuuggaauuugucugaacagagcuuaugcagucugaaauucaggugaggcuagaauuaacuccaacaggagaacauaaaggcagaaauguaagacaaagucaaaaauaaugucacccaaaagaaacauccagaucaaaaauggggcuaugaauaucucuuauagcugcucaugaauaccuuauuuucuggcuuucacuuguuuuccagccggacaacugaauuuuaugaaaaugagauguuauuuauaauuugcauacuacuauaaaaguaugaauuuuuuuucacgcaggucugcuaaauauagaugcuuacguuuccugaaaacugugucgaacuucuguacuaucaucccaggacuacuaaagaguuuaagaccugaaagaugccuaguaaaaaugaaugaauuaacuaaaugugguccuuaagucagucaagaagccaaauguaguguugaaagacuuuaaaauugcuucagauauugucuuaaaguuauacaugaaacauuuaauguaauaaucuaaauuuuucucuaaauaaucuaaauuuuucucucaauacugucuuuuccauuucaaaauacaauuuucagugguuuggggacugugaacugacuuuucuaaguucaagaacucaccuaaaaccaaugauuuagggauacucacacuucgaacuuuaauagagaagucagaggcagguagaaaaguguaauuacugacuuuuaaaaauacuaauuuauaaaggaaaaacggguucacaccugugaaccagugcuuucacaccuguaaucccagugcuuugggaggccgaggccagaagaucgcuugaggcuaggaguuugagaccagccuguacaacaaagugagauccagucucuacaaaaaauaaaauuugcugggugucgugguguacaucuauggucccagcugcucaggaggcugaaguuacagugagcuaugaucacgacacugcacucuagccugggcgacaaagcaaagacccugucuccgaaaaacaaaaacaaaaaaacccuguuuccaaaaaaaagaggaggaggaggggaauacuaaaaugcuuaucuuacucuuacagguagauucuuagguuaacaauaugagagaucuucacaggaauguugaggagaguuuuuaaaauagacucucaccccugagaaugaagacuagacaggucuaaguguuucuuuaguauuuucuuuguacacaccuacucagauagaugcacauuacagaaacucaaaaagugaguguucacaaauugguagaugaaaaaugugagucaauaaauaagcagggaagacagcuguggggcagaagaaacuguaauaaggaccugaaaguauaaaugggcaccguaagggagcugagucaguauaaacuucaguucuuguuauuauuucucauuaacaaagugaaagauacuuuaugaaaucuucaaaacuaagaaaggauaaagcucaaugcucuguacaucagauuacauuacaguuacagucauaucuuuuuggauaguccaacuuucaauacucccuuuugcuuuuucugaaugucuacccucccucuuaugcaaauuuuuuacauuaaugaagaacaggcuacgguaguaauauagggaaaauaaucaaauugaacaugauaaccuaaccuaauuauaaaacuaauuggaaauaaauuaauccaucuuuauuggcauauauuuucauauaaauauuuuuguguaguugagaauucuuugggcacaauuuaccugccugaauguggacccugggaauguccuacuagaaaucuugguaugauacgcuuucacaauuagaucuuagacugagagauagugcguggagcaguuaaagaguuucaguuuuggagucagcaauuuaguucuugcuucacaauuuaccaucuccauaacuuuucuuaaguauccugcaucucaguaaucuguaaaaugggaccaauaauaggacuuacuucccaguauucacaaggaugacauaaaauaaugugucaggaaaacacuaaauacauuguguuauuuugguagcuguaaguucaguuaguacuuaaucaacuuuuuguauuucaaguauaucaaacaaccuagguuccaccaugacaggaaaacaaaagcccacuuacuuccagaguauugcagugucccaccacugguaaguguaccaaauaauuucuaccuuuuagcuuuauauugaaauagccaauaagucaaguuucaguuggcuaccagcugagaaggcagugacgagaagacagccuguccuaaaacuccacugcaaaaaacuaagcagguaagcagcauccaaaaagucuaaauuguaauggcauuaaauaaaguaaaaaccuucagcaguuugccuugcacaauccuguaaguuuuaagaaacugcuucgcuuacuugcuuccuaacacagccucugaagcaaaaacccaggucagguccuauucuuugaagaguuaaaaucuagacuggguucucacacuuuuagaaggugagcaagaugccauccgugguugucauaaaauuauacuuguuuuggaagauucauuuuagauuaucacuaaauuaaaaucacauguuaaguucucucauaauuacaaaggcacaguuucaggauggaaagacaggcuagcuuggaauuuuaaguuucccacucugccacaaugucgauucaguuuuauauuuggggcugagguuugaguuugucuuucuucaucaugauuuuaccccccaaauacacugccacuaaacugcauugcuauuuacuacacauguaagcauuucaggugaaaucagggagaagaauggaauaacugaaguuaacaugcuuguuuaaaaacuauucagauaccuuaaacauucccagaugccaguugacaaccuuaccacuugaagcaaauauguauuuguuguggugggggaaaggaaaaaggccacacccaaaguuaagacaccacagugaagugauacucaguuucagaauuuuaacuauuucuauuuucgguacucuuuucacggucaaugaauucuucaacuucacaccaggccgagaguuaaaaaacauguuccucugauccuaauuacuuagguuacuucauuuaguaauggguaaguccaagauggagaauuaccucauucaaagaaagguuuaaguaacuuugguguagaagagggccaaacucaaaugaucagugcgcagaagaaacucuggaugagccagacaccacuccuccccucccccaagaggccaggaagucagguagcgccuaacuguauuaacgcagcaguuaccugacacagaacgcuaccaaguuaccuggacccuucuuucaguuuagcuccucccuagacgccccucucuccuuggugccgccuccacccaggaagucucuccucccgcccacccccauccccgcaguccagcucccaucagcuuccucagccucaucuccagcccaccuccguguucucgccuacucuucucauccccgcuuaccuuggccacauagucuuucaccucauccaagucuccguuuuucagggcccacaugaacuccuugucgcacaucacugcagcggggcaggccgguuggccgggcagaagaugaggaggcgguggcagcagcaagcggaugccgccgggcgagagggaggcagggccgcgcgaagccggagaggagaagaagagaaggaggguuaggcugccaggcgggcgaggcaguuggccgcggcgaccguucgggcgggagaaagaaaguucuuuugcggccaccgggcccagcagagagguuccgccuggccgaggagaggcaggaaccuuuacacuuccgguucacuccccgcuaggacccucccccaacuuccucuuccucuucuccuccgcggaacgccucucucugg

SEQ ID NO: 14586 - RNA, 1449 nt, Homo sapiens
ugaacuacauuucuucauuuuuauucuguacauuuccacacaauucacaauacagaaaaaguguccaaaaaguaacuguaacuagucaauuucuuuuucagagauuaguucagucucccaaauuaacuccauugaaaaucucuguagugcaacacagugaucaagauacuuuauauaaauaggaaaugcaagaaaauuagggaaaaauacuuuaugacuuuguuacaaaaaacuucauucuucccuuucccaucccacccccccccccccacccacccucccuccacuucguauuaucugaauccuccuuuaccuggaaauaaaacuuuaaucuuucuacugccacagcugcuacuuguuuauggauuccaccugccagcuggcagcuuugcaaaagcauggcucugggaugugauagggcagaaucagaaaucaugaaaaagcccuuuauaaugugacugcaacucuucauacagauguagccuuugcgaguggaauacccacagccaaggguacccuggaugccugggaacguuuucccacucagaaaucaaauuaaaucaaauauauucauucuuuuagaacugagauuguccucuauuccuuaguuuuucacaagaaugguuuuccucaguuucagucagugguggucuguauaauauucagauucaugguugcccacuuaacuauugguaauuuuaaaaaacagccaagcuaaccuuugcugagacuauuuuggccccugacuuuucaaagauguguuuugcaaaauauucuguuguguuagaauauuuugucuaugagaguucuaaaucuccuuccccaggauggcaagaauccaaacuuucccaacuuauaaucgguaagucagggagagcaucaaaguucuacuugcauuggaaauuaugcuuguauguaauuagagucucaauccaaccaaugauggguggggagaguggcgaauaaaaauucuuugaucuccagaagaucaggagaucaggagccauuugguugcauauagaagguacaacaaauaucaaggcuagaugguaucuuaaaagugauaaaucucaccaacaccuauaaauuugaaauuaccuauaaauuugaaacaaaaaauaggguaaacugacaggacuauccuaucuguauguguguguuuuauaagugaagaguaaagacaauuuguaaacauauaucuaucauuuuuaagaggaaaauguauauuuaaacccaaaauaacaaggucacagucucugaauuuuuaagugaauauauugagauuugugggaaaaaacccuaaauauuccuuauuuuuuucaaacuuuaucagggaccagaacaaguuuguggacaggcauaauguauuauaagagguuggacaaacuccuuccaaaaaccaccucguccuuuggaaagcuccauuaaaaaguucuucuauuagcugac

SEQ ID NO: 14587 - RNA, 127095 nt, Homo sapiens
ggggucccucaaaguuugugucuggagccguagcggcaagugggcuugcggcuaagggauuuuccugggaugagagcgggucuucugccuucauuuuggaugcacaucccgcuuuagccccggcagccuuugguccggcucgugucccuggggauucucggaucuccgaggacaccggacgggagcgcuuggccauccucucuccggcagaggagcagacguuugcuuuccaagugcaaaacuacagacacgcgcgcgcacacacgcaagcacacgcggagagagaggaaccuugccgguccgaggcagcucugcgcguccccuccugcgcuuagcauccucggcccagcgcggcccgcaccgccauggaggugcuggagagcggggagcagggcgugcugcagugggaccgcaagcugagcgagcugucagagcccggggacggcgaggcccucauguaccacacggugaggacccggcgggcggggcaggagggcuuucaaagcgggcaaguguugucacgcgaggagcagcuggaguccugggacccgggaaggcaggguuuggggcagggcauggucagaaucaagagguccugggcgagguguacuuuaaugucugagcagaugaaggcgggcagcuggccccuuuacauuucucaugagaguaaugccacuuuguauuccuuuaacaauucaugcuuuuuucccugaggcuuuuuccaucuguaauaucauuugcuguuguuaacaguacuguaaugcgggagagggaguguguguuuugagaauaacaugccuccgccuaguuugcuauugauuuuuuuuugagguuuucaaaaacuggacaagauuaaguagcauuuccuuuucaucugucucguauucucucucccucucucccucccuuccucuucuuucauauuuauauuuuaaaaaguacacguguguguguguguguguguguguguguguguguguguguguguugaaagggcuccucuacguuagggagaaaggcggcuuuauuugcuuucuuaaacuguacgaccaagaagucuccuuccucccucuucggaggaaaaaccagcagaggaguauggaaaaucugagacaguugcauauuuaagaaaggcucuggggaaggugggacagcucaccaguugcuuguucagucuuauacuaaugccucagagaucucuugggggauuaagcugucccagagcacgcacauuucuuuuaaaguuuuuaaugucaaguuuuugguauuaaguuugcaaaaugaaauuuuguuuucaauagccagcacugaucauaggacuuuaugcaagaucucuuuguuugauucuuauccaugcagacguuuguaauggggguggggcuggggugaggggggacacuaaugagaaaaccacuggaggcuuggcugcuuccccuucacgcuuuuuuaauggggucaguaccaagauauuugaaacuuucgcaaaauggccugcaggcuccaccucuuuggccuuugacucuggcugacguuauuuugagacaaggaaugagggccucccugcugauucccaccgaaguauuugugguggcugagaguggcuuguuuaaaaaaaaugcagagugcagggcugagagggagugguaguucaugcuggggcaaaagccagauguucagugugaucuucugggcuuugcuugcugagcuugucauggggacacuaugugggcagcacggagguugggguaccagaugugcuuccuguccucaguaaagaacuuggaguauguuguuccucaaauaucuuuugaugaaugggugcuccaggaguuucuacugacaggcuacauuuuauccauaugcagaggggcagcccuucucuuuuguucuugaaguauucuuucgcugugacagugucucauccagcagcugcaaugccacagcuaggggguugucuuucagcuggugggaugaauuacgcacaggcaucuaccuugcuguucuuuggcccuguagcuugcauuugugaguucacagggaaaggugcgagaugcuacccgugacuguggcauucacucugggaagaacugcuuggacuggcucuaacuaacaccuuaugcacacuuucagggaguagaggccuuacauuugcuuugauauuaacagcccaguuuuucugucauugugauaaagcaggaaugugugauuauuuuucuuuuauuucuauuuuuaaaaaaugcuuauuauguccuccacuuagguacaugucuguugugaacagcucauuccuguaaaaugcugcucaucauugcugcaagucagugcaacaaacugugcauaugaauuacuguugaaagagguauugguuuagcagcacaaaugauuggguuauauuucucucaaacuaagggacguuugggagagguggggagauaauuuucccaucuguuuccugaacucuguuagauauccaggggcagagcuguuuguuacucuagcugaaucuuuauguagaaaaaggauggccugauuauucauucagucagagagauauuuguucuuucgauuaauauuuguggaauauauaaagcacuuggaaacaugagugaacagaagcagacaaaaucccugacuucuagaagcuuauauucguguguguguguguguguguguguguguguguguguguguaggggaacauaaacaauaaacauuauaaagaagugauuauguuggaugaaauaaguguuauggaaaacguauaaguagaacaaggugagggggauagagaauacaagguggaagaagagcaaacuaugggauugaacugagugaucagagcaagcuucccauagaaaauggaucugaacaaaaauuggaaggagguaagaguguuagcucagcaggaugaagaacuagagcaaaggccuaagguaggugugcauuuucaugagacuguguuaauaucauguauuucagauuacucauuuuggugaguuauuugucuuauaaacucugggugcuucugagacaccagugccuguuuuuggaaugauuucauaaaacuuuccaaguugaagagagccugaggggagggugagguucaaauacgaguugugagggugguaagagaugaugacagcuaccaucuauugaguguuuaucauccgaaaggcagggcugaccacauggccugccacccaugcagugccacgggguccacacuugguuugaugcugugcugucaccaucuugaaaaucuuaauucuuuuugaacuggggaccuuacauuuucauuuugcacuggguuucacaaauuacguagcugguccugcugaaagacauugugucuagugcuuuacaaauauuaugccauuuaacccuuguaaugacccagugaaaugagccauuuuuauuacuuuuauuuuacauauaagaaaaaugaggcuucgugaguuuaagccacuuggcucaguucccacagcuauuuagugauagaaccaggauucaaacccauguuugccugccugcaaguacuugccuaucaggcugucugagugaagaauccugacuuaaagagaaggaacugaauaagagguugggagagagugauuggaauauaggaacugcugagccugaaagcagcuaauguuuaaaugaggcugacaguggcagccaccaaaccuuccuagugagaucacuuuuguugcucuuacuagggauuuaguuacuacaugcaugauugcuaaugcucuguuuuagcaaaccugucacauacuugauuuaaacaauuuagaauguucaaguuacccaaggcugagauuaugauguuucucaggagccuucuguuaaccguuaggagcaauguuuuuuuucauuugguuaguuaugaagacaucuuggucuacaaggacaaaggcagacagguucagagucuacaaaauaaugaagcauauggauagggcaaagauggacugaucauuagauccugaauugcuaaagcucugggcuuccucuugaagcuuaaaaaauuguuuccauacagaugaugaaauguuauuuuaauucagugaguacugauuuuaggaaagcuguugcuucaagauggaauacaggcuaaaauugguucagaaaagauggcaaaucuagaaaucaggagaauaucucuugggguucgguaccaccgugagaagaaaccuugccucuuuccccagaccugccuguauguuggacauuucugccauuuguauuguauuccuauaaaauucucugaaaauuacuuucugggaauugucugugcuuuuguaauuucuauuuuauuuuauuuuauuuuauuuuauuuuugagaugggucuuguucugacacccagacuagagugcaguugcucaaucauggcucacugcaggcuuaaccuuccaggcucaagugauccucccaccucagccuccagaguagcugggaguaucagugugugccaccaugccuggcuaauuuuuuucuucuuuuuuuuugguagaaacgggaucucaguauguugcccaggcuggucuccaacuccuggguuuaagggacccucuugccuuggccucccaaagugcugggauuacaggugugagccacugugcucagcccccuuuugcaauuuaaagagcaaaauaaucuauaaauuuuaaaauguauuuuauauauguauaaacuguaucuggaaggaugcucaagaaguggauaauuuuugggaaagcagcuuggggaaguggaagucaagagaugaagggaagcaugucuacacacuauaccuguugguacuauucagauuuuuaccucgucacuaugucuagaaaauggaagaaauacaacuuguaggcaccauguaaaacuggacuagagguaauuuucaaccaaguguucuugggggaaaaagggagcuucaguacuauauagaaacucaacaccacucaaggucaguggaggcguuggaugaagaacaggggaagugggaaggccccauggaaagaggcuuuagggggagagguuggcaggugguuugcccaugauaaacaucaagaucuugauaauguucuccuuucuucuaucucaguuuagccaucuggaaaauaaaacaauuuuugcaauuuucgccaugauuauauccuuuuaaaaaaguguaucauaaaaacuaagucuuugugaaaguaacaacagaaguucugcuuguuuaaaaugcagaauuccuauaaagccaaguuauuuguaaaaucauuuggugguuaugcuaauacaguuuuauaucugguugguucuucaagugaaaccacuggucccagacagugguagguagggaguugggggaauauucgaccugccugguguccagauggaaaggccaucuggcuuccaugucuuacugagugcugaaaaggaguuggcugaucucacagacugugugguuuccuguuccucccgccuggcccggagagugauaugauuucaaugcgauauugaagcuuuugguuugauguuccacuuuggaguuaacuccuaggguuggccccaggccagguucugaaggggcacccggguccucauuggcugagaauguuauuacuuauggucacaugaccuccacaagcugaauaaauguagugaguucuaacgggagacagaauugggaaguaaguauaauuuuuccagacccuuguggcaccuuucaacauucucgccccuuuuguguuccccuccuuucuuagacaucaaguguucacuguaauguucucuuuccaauuucaucccuucaaauuuugcugucaggaaagauuugauaagcuuucacuagaaauuuuaguguuaguaagauuuaacauguuaacccuaaaugggcauuuauauuuaacaauaauuacuucaggucaaaagggugaaucuccacuuggagaaccuagggcgauagccagguaguagugggcgaauauuuggggaaugggagaggaacccucacugcccuccauuauuucauaauguggcucuuauucauaaggcagccuuguuuauguguugcuaauuugucuaugaucuagaggauuucccuuggcuuagcaaaaaaucuuugacggauuauuuuacugucucugaaauuguucucaugauaguaacauugguugggaggugguagacauaggcacaguccugaaagaugagagggcaguacagaguuuuauauuugcccuccuucucgaaugaucccugaguuacaguguucaugggaaacaggggucucugaugugacauugcuuuugcaggaguuauaagauauagcaucuagauuaauaauugaauuaauuacagugcuugcagcuagaaguaacugaaaauggauucagaucggcucauacaguaaguaaauuaucucauguugcaagagguugugaaauagagccccuggccgggcgcgguggcugacgccuguaaucccagcacuuuggggggccaaggcagguggaucacaaggucaggaguucaagagcagccuggccgagauggugaaacccugucucuacuaaaaauacaaaaauuagcugggcgugguggcgggcgccuguaaucccagcuacucgggaggcugaggcaggagaaucccuugaaccugggggguggagguugcagugagccaagaucaugccacugcacuccagccuuggugacagagugagauucugucucaaaaaaaaaaaaaaaaaaagaaagaaaagaaaaaaaaagaaauagagcuccuuguuggcugauucagcaguuccucaauggaccuugguucugcccaugugcagcuuucauccucagguuggaugugugauggacauaggaguuacagggguuacauucaaaaugacaacauccagaggaagaagagaaguugucucuuucuugugucccuuuuuuagaauggaagaaacuuuucuuacuagcccacuagcugauuuuucuuaaagcuuuauugguaaggauucggucauaugaccauucuuaagccaauggcuggaaaggagaaugggauuuauauuaucagcuuagauuaaucauauggggauggagacucaaccagcaugaccauugggaucauuaguaaaauagucugaguuaacaauucuuuccuuagucaaaagguauguuucuuuucucaugaacaugggcuagcaacuagaaaauuuaaaauucacaguaauuugcccugggcgcaaaacaguaaacccaaguacugugccacucgcagaguucuuuuguuuuuuguuuuuaaauagagacagggucuccuuauguugccuaggcuggucuugaaccccugggcucaagggauccucugccucggccucccacagugcuaggauuacaggcaugagcuaucacguccggcccagcaaaguucuaagaauauuauuuagcugugcuaccaaugcccagugaaagaagacuauagauguagaaauagccucuugaaagugcagggaaaggcuagggaggggugggagccaggaggagauuauggcuaugucuugacucacuaacuaggagauguagaauuaacuguauuaucuggacucuuggcgucagaguagaauaccagggcuggagguagcuagcugagccuguaaucaugcuuaccaugcaggacaagaaugauuuguucuguuugggaucgacagcagguggcaagcuaaaugccauuuuucaaagaagcaauuuuuccaguugcauauggcuguucaaauauugaugagggcacaugugccugucugcagcuaaaacugccggccucagccugacauggcucuacgcugucuggugacucucuugggguaaauagccuuaagccuuagcugggcauuugguaggauugaggccuaugguugcagggcaucugaauuguccaaaugagugaucuuaugagugagggagugcugcccuuguuuucugccccuguggaaucaggauggaaaggaaauaaugagacccacugucucuggaucaaccuugagccuauuucucuuuuucccugcucaguggaugcacccuggccuuucuaaaugaagugcuaagggaucuugauuuuuccuugaaucaaauuguauagguuauucaugaggcacaugggagaagaugggccauuuuaucuauggggaauguaagacauagagcaguagagauuugcucagcacaaguuccuugaggacaggagacaugacugucucuucuauacccucaugguccuuagucaagugcaggaugcccagagaaucguaagugcuugaugcauaguuaaguagagugaggcaguccuggaaaauggauaagcuggguggcuuuggccuguuuuuauauauuuuuaaaacucugggcaagacgugguagcccaugcuuguaaucccagcgcuuucagaggcugaggcaggaggaucgcuugagcccaggagguugaguuuacagugagcugugaucacgccucuauacuccggacugggcaacagagugagacccugucucaaaauaaauaaauaaaugagcaaacaaacaaauaaacucuggauucuuguaaacgguuuugcaaaugugaaaauucaguauaauagugacuuggguaauucaguguugauaucuuuucuuguuuugauuagagaacaaggugggcguggggugauugaaacagucccuguuuccagugggaguggaguugauggcaugguggaaagggugggcuuucaaggcaggccauuuugauguugagggacacaggcucucuggugaccuuggguacauuacuucaccuauuuggauuucaguuucuuugcaugucacugccugauccauaauagaaguacuuuuccaaccuauccccuaagucaaaugucuucucuuugagaacaaggugucccaaccuuaggagucugacaucauucagaaaguggagagagccugucauuauucucucucaugcaucuuuauuuccucuccucuccagcuccuacauugugcuguaaacacaggccucugccuugaacacauguuugccagaugcucccucuuacucauuucuuuucucuuguuuacugccagguuuucucaagugcguggucaccagccauggccuccauuuccuuagucucuacccuguauccucugcccgcuggguccuacugcucaaccucucccuggcugcuaaauccaauagucuuuucucuguccuuaccugcagggccucaugggacuauuuggcaauacugaccacaggauugucucauaacucguuuuugcuuuggcuuccaugacacucuggcaagcuuaguucuuccuccuuuucuggcuuccauaccagcuguuaaaugugaguguuuugguacuuggccuucucuucucucuguauguuccccugggcucugcuauaaacuucagugcaucugguucucaguuuuuuauacuuguuauuugucuuuugacgaaaagcagaucuuuggaguuugacucaagccugcuagguccaccugagcagcagaacagcucuggcuggguaacccuugaauuuucauguguuucuugauguguuucaaagaagagcugggauguugauccuucuuaucgcugcacccauuuaucucagggcauguugagugacucagcucucuugcaguguaaacccaagaggagcucaugggucauuccugggauucagcugcuucuacaguccgugucacucauuagaggcaagcuguguuuugccuagacuuuugcuuguacuuuggcuugggaaacccucuguggcauccuguggggguaggucuaaucuuuucgacuguguggaaggucaauucaaaagugagacguaacuucuuagaucacguaccauauuuuccucuuguguguacagcugcucuggggcucagcuacaguuaccucauguugaauugccugcuuuugaguugcuguauucugguguagguguaaucuguuuauuugaacuuuacugauauuacgaagagcuuuggggauuuuuuuuuaaagaauugagauggguuauucugaaccauccauauuuuaaugcccgauucuuguuagaauuauuaacaguaguucuuggaagagaguuuuucuuuggaggauaaagcuuuuuuuuuuuuuugaggcagagucuugcucuguugcccaggcuggagugcaauggcgugaucuuggcucacugcaaccuccaugucccaggaucaagugauucuugugccucagucucccgaguagcugggauuacaggugcccaccaccaugccuggcuaauuuuuuguauuuuuaguagagacagaguuucgcuguguuggccaggcuggucucaaacuccuagccucaagugauccaccugccuuggccucccaaaaugcugggauuacaggcaugagccacugugcucggccgugccuuuugaucuaugaacucaucacaguacaauuuacuucacgucuuuggugaucacuuuguaaauucuacauuuuuauuacaugaucucaaaaucccaaugguauuacauguguuaugccccuaccacugaagaaucuuuaaaaaauaagcuauuuaaggccaggcgcgguggcucacgccuguaaucccagcacuuugggaggcugagguggguggaucacgaggucaggagaucgagaccauccuggcuaacacggugaaaucccgucucuacuaaaaauacaaaaaaauuagccaggugugguggugggugccuguagucccagcuacucgggaggcugaggcaggagaauagcaugaacccgggagguggagcuugcauugagccgagaucaugccacugcacuccagccugggugacggagcaagacuccguccccaaaaagaaaaaaaaaaaagcuauguaaaacaaugacagccacgacgacagcagcaccagcagcauucagucgauuguguauuucauuugggcaauucaauuggcagguguaguuuugcguuuuguagucucuguuuucugacuuaaaacuuuguuuaagugaaacccagacaaaauaaagaauggaaaaacagagacacagagguaggaaacauuuuuuuaacauuggaaaaaaaagucccuucagacuccuuggcaaauaagaggagucuggggaaaaaaaaaucugcaaacaguuuccuaguugucugaguggaaaauccugguuuuucacauuucauaucuuggaaaugucugaauaguuuuuguuuaaagggaaauuccuuuuggcugagaaagagcuugcaggauucaaacugauagggugauguuuuuagaaaaccuggaggaaauaggauuugugaugaaaaugcuuucucaguggccaauuguguuaaaccgaaauuuaaauccaagguuaccaaucauagaguuuuaaagguucagccauuaacuccuuccuuccccucgcauccugucuguuugcauccuggggaaaccucucacauagcugguccuuccuccaauucgaggaacuuaacaagcugcuugucuaagcaugugccuguucuaggcaggggauaaacauucuugaccuguggcuuuccaaguagaguaggaaggaagaugcgucauuaaauuauaagucauuaaaugccugauacauguuuugcaugagagcuguguuugaaguauuucuguagcaaagcggauggaaugacaaaucugaagggggugaagaguuggggaacacuucauggaggagcaagugauauuugcaaugggugcugaaguauacauaggaguucaccaggcagugggaacagcagcuacagaauaggaacguggaaaaagucaugacugauccugggaaucccaagucauuuuauguaguuugagaguagggugcucuauggggagucuugggagauaccacaagaucaugagagguuugugugcuuggcaaaugacuuggacauucuuuuguaagcgggaaggugggaggcuuuuaacaagagagaccagacaggagcagaaauguauuuuagaaaggauggacuggacggcagaauugauagugacaaguugaucuucuggcuggcuauuucauccauggaguagaauaagaugccaugagggccugaacccaacagggaggaguagaugaauucaagagaggauaggggagguuagacuggagaugugauuacagggcaugagggcuaugggagauuucuuguuuucuggcuuggaaggcugaguugacgguguugccguugaccuugaaugggaguauuuggagggaggaugaguuuggcagggaagauaaugaguucacuuucaggcacaguaauucugguguacuugcagaacauucacaggagcgacacguaaagggcauuuggagacuugggucuggaguucuggagaaaggucuggacuggagauguagauuuggguguuaggauccuggugagggauuagugaagccaauaauccauauaagauaguccagaaagguuagagugagagggaggaguuugagagaagggcugaguguggagcccugggggcaccagaaggauuggccagggagaagacccuacagauagaacccagaaagaaucaucaaaaaaaaaaaaaaaaaaacuggagaaaagccaggaaaauuccaucauaggcuccaaaauaggggagagucgcuacagaguggucaguacaaauaaggguugagugugcuauucagcugaccgccgaguccccugaggacuuacuagcauguuagcucagggcggugucugugucucuguagccacaggucuucucuguagcagaccugugugcaugggauguggcauucugcugggaaggagaggccugguuuccaggcgagagcacgaacugcagaaggccaggaacucagaguaaauggacaaaguguagaacacagcgcugccucuuuugauuuuuuuggaacaagauuaauaucaguccucaaaauuggcauuggagaccaucacugguucauuggugcuuguguaguuuuaugaggguucuuucuuucucucuuucuuuucuuuuuucuuucuuuuccuucccucccucccucccuuccuuccuuuuuuuccuuccuuccuuccuucugucucucuuucucuuccuuucuugcuauguugcccaggcugaucuugaacuccugagcucaagccauccugcccccuccaccucucaaagugcugggauugcaggcgugagccacugagccuggccucugaggguccuuucaucauucuucucuccagauaaguccaucuaucucuggauguccuucccaucggcuggauggaguuugugcaugugucuguuuugugacugugucauuugcaguucuuaguuuuggggcuuugcaaaaggauagccuuuguacucauuaaccuguucaagaguguugggauucaccacaugacuccaaggugugagucuuuuccucucuuuauucuucugacucuuccacuaaggaaguaucagguggauccacugaaugccgaaaaugaguuugaucacagaggcaucaacaauauucaagugguagaaacauagaaacaagcccuaauugguuccauuuuuguaugacauaauaauaaggacaggugaggacaaauggcuuuguaauaagaauaugagccugcagaaggaacauuaaguaaauaauuguagcuucaaagaaaaugagcagcugcuggcaaugcccagguuucaggacccgcaaaggcacucuggccagacacaucccugcuccccucuugugccucccacgugccguggcuggauucuggguucugcccuugcucucuguuucacugaaucucuguuccugucauggcccucaggccugucagggacaugaggaacaggugugggaggaggaagcccuucagcugggccugaggucgggcaugugaguacugaggacagaggugggugcagaggaaggagaauucugccucagacugcacagggaggaaagggccacccuucacagcccagagcagagcaggcucuuugaaggagacacagaguuuaggauucacuccacaguuuagcuguguggugaauuaaauggguuucugaggccugacugggaaacagaugacuuuuuaucacauuaugucaguaagaaaaugucuugugaguuugaaccacccguguuacaaacuuuuaaaaaagguagagaaaggugugguggcuuaugucuauagucccagcuacuugcaggaggccggggugggaggaucgccugagcccaggagguugaggcugcagugagccaugauugugccacugugcgccacucugggcaacagagccagauccugucucuccaaaaacagaaagcauuuuagagcaguuuuauguucacagcaaaauugagcagaaauacaaaaagcucccguguaucucuugucuccccaacacacaaaaccugucccaccaucagcauccugcuauuacagacuuuuggcauauggagucauaagcuggggucaccuguggcagcuuuugauuuaaacuuaauuuuuagagauuagucacagauaagccucccuuuguaguccagcaagaagccagauuggccacaaaagccuugaacaccgaagacuguauccuguuuuuuguuuuuuguuuuuuuuugcuacugaaaacuuauucaaacgacuaggcacagaccuauagauuucaguaccauuaaaaagucaaacuguggugcggcauuucccucccucuuuccaguuacagaugacuuaggcaguagauguuauccuuuggaaagagaugggaucuagugaggaaacaguauauauuuuuuguaaccaaagaaccugacuccgaucuuuguaguuuugacuuuuuacuuccuaccccugaaugguauucauuucugaggcacugccaggaauuguuuuucugguuccacucuggguuugcaagcuuucucuccaggcucuccugcagcccaagacccauguuggagccgcugggagagcuggggcagugggcugaggaggccaaggcccaaaccagcuccaggcgaacagcugcagcacagcugugauguuaccugcauggugcaguggggucgcccuugggcucgaggcaucauguucuaaggcagucuucacagacacguuuucuugugugcuaagagaggggcagaaacguagcugccaaaaaaccauuugguuucucagcuguguuuacaagcugaggaacaugaggcacgucgaaauccaguguuuccuuuugacugaaauacagacuucuaggaggacacugaaaugagggugggauggcuggguagauggagcaugaggaaguuucagcuucuuauucccacccucccaguuucggugugggauucugacuguccucuugucugcagauugcucaaccacuggaaaaggcaguugguaggaggagcagggauuuugcggucagcacaacuucauagcccuuaucaccacuggcaaaugauuucuuuaguauccccgagcccugcugucauggcagucauggaaaaugaugauaucugcauggugcuuugugucaaaguaauggaugagccuaaucauaguggguggaauccaucucaggggugcagucgcuccagccucugcugccaacuugcccuccuucccagucccauggagcuggggcacuccccggcauaccuguugggaagcccugauaagugugcuugucuguuuucucgucuaacaaaauggaaacaccgugaaagcagagacuuucuuuuauucacugcuguuuaucuccagcuaacagaacagugcugugcgcaugguagguguccaguaaaauguuuggugaaugaauggaugaacaaaugaaugagucuaggcuuacaaucugguucuggcucucccuacugugagcaccuuucugagacuguuucacaaggccaugguggaggaagauaaaugacauaaguaaagugucacuaugucugguuuguggccgcuagaugggggauauucgguuccuuucuucuauuuuuuuuucuccaauaguuucugagaggccuaggaagaaaauuuuugcugcauucugaacucauggauaaaaugaguaaauagaauaagaccucugaauuguggccuaauugugaaaggcauuuagggaaaaagaccugaaauauuucuucaguucuuaccugaauccucuuagguucaacgccugguauugauuugcaugacugaauuaacacuucaaauuuucaggcaccugcuucugaggaacugaaauguuuuugucaguuuugaggggguggguuggcagcagguguuagcacucuuuaaguuacaagagggaagacaagaaggggacggcuuguuccaugucccugucauuuccugaaacaccaucuaucacuggacacugaggucacuuacauuauuuuuuccuaaugaaaauagucuuucuggggcugauugugaccuguuuaggggucuguuaacagcaggaaggugaguaggggacagcaggauggcacugagcaguccugguagggcuacugccugcagugucagggacaagcugaagcgcucuccauccacgaggccuggggcuuccuggcagagcaccuuuggaaugcuguccauacacugcagcaaaggcauuuaagccacguucuuccuccgaccccuggccugaacugcgucuagccuuggcuguucccaagcaguugauguacauauuguugagcgagagaaccucucugaguccugcuuucuugggaaucagguucuaaguugcucuccugugccuuccauuuaucuggaccaacuagcauuuuaucaaacagagguuauauggagauucuggcgugugaaugggcccccuucccccuuuccauaaugucuuauuauugcuuuggcaauugcaguaggucuuugaagagggagcugacugaaaacugugcccaaaucucaaugucucuuggaaguuaaguuacacauuuuuauuuuaaguaaaagcaaaagaaaacaaacaaaacccccagcuccccgcaaaacucauugcugauaauggaguucaaugagaaaggaagaaaauguuagcuauugaggcugacaagcuuuaaugagcugccugauggcucuucucuacugggcuacguuacuguagaagaguuugcaauuugggagacuuugagaccuuugaucuuucaugaaacgcagacuccuuucauggagaaguuuguucuuugguauuugccaaccgaaagaaaaauauccugguagguagauuuuuuauucccccauagcuuuuuugaggaacuauuacucgacccaaguuugcuuuuagaaaaaccaaacaaaaagcugcaggagcaacaaaauaagaagaauaaaaguaugaagaugacaagcuuaucugucacuuggcuugagcauuugguaauuuaaacauguaagggccuauuuaucucaugaaccaagcaguccugagcuaggcccuccagggcuaguguagugcuugaucagggccaacggggcccuucccgugaggcuguuugucaccuuuguccucaugacuacaagaugacugcuucacuuccagcguaacaucagccucacugguggaagaaagugacggggcaaagcagaaaggguaguaccuauauuaggacaagccagggcuuucucugaggccuccagcagauuucccguuagguuucacuggccaucccuagcugcaaaagaggccaggaaggugugaguguguuagcuuaauacuugccacccugaauaaaauuggugucugauaguaaggaagacggguaggauggauauugaguggucaagcagcaguguccaccacaucccaaaauaacauuuucccaaauuuguagaauccaaggucuggucgggaccugugagauggcugagaaugacgccugcaucucacagauaagggagcuacuuuauuuccuucuacuucuguucagccaaaaaccucaguggcacuuuuuggcacuucuggguguggcugcucauccccugauccccaaacugugccuggaaugugagugggccgagaaguuccuucacuggagagcagaguggcagggagcgggcagugugcggaugggaaucaaaaggcccgauugugcuuucucaggaaaagcagccggccaacaauaaugacugggccgccccugagugcagaaccuggaauccagccuucuggaaugaaaaagccaugcaagacucagucccugccccugaggagugaaggccuaguagggcggacagaacaaccacaggggagagguaaagcagagagguaugcgaacaaugaagaaaggccauagcaaacggaguggccaggccgggaagguggcuuggaggaguugacuuugaccagggauuuauaaaggucuguuauuuggcggcucacaaugguguguaaaaauacuaagugagagucagcagcuuugccugguuggagcaauuuaacaacaccugccugaagccugcuguguuuucuuuagaagaacagccugagucaacagugcuuauggauuccuugauggaugcagagggaguauuaaguuagccagauuuauuggaacaugucuaaaagaccacuagcucuguaccagcguuuccucugaaguuucagucucuguccucucuucccuuccccacugccugguagcucugauguugcauuucugcccuugcuucucuuguuuaagauuccuucuucgagggcccagccagccuccucaguccuggggcugugugguagauaguccucuggaaggcauucaccaccuugucauagggccgugugguugguggagggggcagaaauaaggagacuaguguuucagaggcucuuauggcacacaugggaacagguagacuguauuuuggcauugagaguaucuggguguauuagucugcucaggcugcuauaauaaaaugcuacagaugggugacuuaaacaacagguauuuauuucuuacaguucuggagacugggaaguccaggaucaaggugcuggcuaauucuguuccugguuagggcucucuuccuggcuugcagauggccaucuucucacuauguccuccugugguagagacagcaucuucuuucuuccuuuuugcuauguccucuuccaaugaagaugcuaaucccaucaugagggcaccauccuuucagcccauuuaacccucaggcccagucuccagauacugucacauuggagguuagggcuucagcauaugaauuugcagguguauuaguccguucucaugcugcugauaaagacauacccaggacuggguaauuuauaaaggaaagagguuuaauugacucacaguuccacguggcuggggaggccucacaaucuugguggaaggugaaaggcacaucuuacaugguggcaagcaagagagagcuugugcaagggaacuucucuuuauaaaaccaucagaucuugugagacuuauucacuaucacgagaacgauacaggaaagacccacccccaugauucaaugacuucccacugcgucccucccaugacacaugggaacugcgggagcuaaauucaagaugagauuuggguggggacacagccaaaucacaucagcagggaacacaauucaaccccauagcacuggggguucacuagaguuucauaagguucccaaggacucauggcggugaccagagcaguguguuuucuacugaaagaaaccugugggaguugaaaaccuacagacugaagguucuuaagcugaguuuauggccucaagagggucugggaacuucuggaaaugcucuuuagggcauuguaugugcagugcauaugugugucuuucaucacauuuucaaaagguuugcugaccuaacagugguaaaagcuaaugucccagagacuguaccucuaaaguagaagcugagaaggaacaggucugugcacacugguguccaccaccagcauaccccccaccucauugugcagccccaucccccuggagcauuccagagaagcucugcucccucuugcugcugggcacuaauuagacccugacugcuggcaggugagcuuacugcccaagaacuaaagagagagagcucuucccccaaaagcugcccugugccucuguacucgaaaccuaacccuuuguugacuucuuuuacuuuuuauuuuuggagcaaacucuauuuuuggagaauacaugaaacgaguggcugucuuacaucauaaaccagaaaaaccacugugcuuauuaaaggcauuucggaguauucucaagauucggacucaaagcagacaauaguagaagcuggcuuuucugccucuaaauggagggcucuggcccccacauucauucaucccuccuugagcuaaaccacugccugccuggcuaacugaucucaagagcaaggcugggacucauggguauauauuuuuggucugugacuuuuuuccuaguuaauuucuguggggucuggacuguuuucuagccccauacuuauuauuuuuucuuguucucuacuuccugguucucccacaugacuaauccuucucuacacccauguugaauuuuauuugaccucauuugauauguuuucucuaagucacuucaguccuuuuuaaaacuugguaaacaugaauccauuuuaaaagcacaggcccucauagaaucuggguuuauccucaggcuaggucacugcuaccccugaccaguccccaaagaaugcuggaggccuuugccaugcuccaccuuccuauucuccacccaggcucccuuuuccuccucuccuuucucuccuucucuuucccuuuuugucuccuuugcucuccucuuucuuucauucacgcaggccuuccccuccuccucugggcuuuaacucugccgguuuuccuagagcuuugcucaguccugacaggugugaggaccugaacucagggcuugggaucuuaucucagguucuccugcuuuauugcaaggacucgggguccucagcagaucuuggcauucuggagggugucacauuauuggugugcaucaucguuaagggucuuuggaggggauuucugucuggcauuuggaaauugcagaauugacuuucuaaauguauggaguagcuggcgacaaaggggggucacauuguggaggaacaggggccagugcaucaguaaagagcaggagaggcaaagagaggagcuggucacucuuagaaauuaaugaggaauuuuauugauggccaguggaaaauuguuuccuaguuugccuuucccaacuccucccucucaguugaaauccugaggaccuucagccuauagcucuagcagcuuuggagccuguauggagaaaucccaugucauguauuuuaggagccugggccacugguuggggaagucugaaaguaggccugauuuuuacaggugucugcaaugcuugggguaagcccugggcaccagcaagucuucucuuccccuuucucugguuguguuugucuaggccugggguugccccccaccaguuuggaaccuuuuuaacugagccuguggucacuugcauaacucagccugggugaccacucuccugagcugccccaggccaggcgaacccacuggaacaaugaagcuccugcucugcccauccccacggucuagagcaaagagucucagucuuggcugcacaucacacuuaccugggagcuuaaacaacuuugaugccugggucccagcccaagagauucugauuuaauugguucugggaugaggccugggcaucaggcauuuuaaaagcucucccagugcuuccaaagugaaaccgaggugagaacuacuggcuuggaguaugacuacucaaagcaugguccauggucuggcaacauucaucuccugggaguuugucacaaauucagaaucucaggcccuacucuagacuuucugaauuauaaucugaagauccccagaugauccaugugcauguaaaauuugagaacugcuggcuagaauauucugcugccuccugugaggcugauuggacucacccaucauccgcaugcaccagguacugaugccagaucaagcuagauggagcccaagaaacugauguggccuccccuggaucccuucuuggggaucuguucuacaucugagucaggcucccugcugucuccauuucugacugaucccuuuuauaccuguccacucagaagucccagcaugucucaaggccagagauugaaagagccaggcaguguucuuuguuguuguuguuguuguuguuguuguuguuguuguuuuugagacggagucucgaucuguugcccaggcuggagugcaguggcacgaucucggcucacugcaagcuccgccucucggguucacgccauucuccugccucagccucccgaguagcugggacuacaggcgcccaccaccacgcccggcuaauuuuuuuguauuuuuaguagaggugggguuucaccauguuagccaggauggucucgaucuccugaccucgugauccgcccgccucagccucccaaagugcugggauuaaggugugagccaccgcgcccggccggcagcauucuuauauuaaacuaaggacugguaggaccaguugcagccugugcuuuuugaugucuuggccugaugacccgcccuugcugugcuuuauuuggucagccuggcagagccugccauccugacccuggaggguaggaacaggaaaaucaggcuaaaaggaaaaguuucaugaaagaaaauggguacaauaugcuagagcugugaucaauuagaacagagaugacaggcacaaagcacucguauucuucccucacuguguguccugaacaugcuuguuuuucaacacagaucuuuccccuacugagcucagacuuggugcuaguuccucugucagcagggcacaccaggcagauauggucaauuacuuaagaugcaacuauuuugaaauuucuuuuucccagaguagcaucauuuacugcucucguugugagucuugaguuuugucccacagcuuccaaguucucagaucacaucucugagaugccaucagaccuucgccucaucccaccaugcauggggccacucucuaggcccucacaggcaguuggugaaaugaguguguguuucuccuugagguuuucauccacggcucucuuccauagauguuuccugagccgcacucugugcccagugcugcagugggcuaggaguuggaagaacacaaacuuuguggggacucagcugccugccucagcugcgucacuacugcccuagucaggauagccccccuuccucucauucacccagggggaaugacagcacacugagucacucagcuucuugaccccugugucacugccugaccagugucuuacguucuuuucccacucaccauuauuugaaaacgauaugacaugacuuccuaaccuuuacaucguaccgggccugccauugccaacuuccagaaccaccugccaucuugguugauuugagcucaggagucaggcacaggaaggagugaagcuggucagagacaucauagggaggaggagggacggaggggauaggaaaguucaggaccugcuuaaaggaagcagcugccacuuagcuccaacagacccuuaccauauaggaauuuggacccaguguuuucagcuguucugacuucaaaagauguuagaaauacagauuuuauauguguguaaaaucucuugcuuuauauauagacagauaaucucuagagagauauauagagaguuaucucuguauagagaguauaucucuguaaagucguccagaagucaggauaguugcauuuuugggcuccuugugcuccauggucucugauuuguuuuuauuuaucuuggucucucugcuucauuuguaaggugaaaugauaauaccuauugauuucacaaagcugauaugaugacuaagauugugaggaaucucuucagaaaaggcuaauuguaaggcaucaaguuugaauuguaaggcacuuuuggaaacugcuucuaccuuccuccccuccccuccccuccccuccuuuuccuuuccuuuccuuuuuuccuuucuuuucuuucuuagucucacuuucuugcccaggcuggagugcaguggcaugaucucgguucacugcaaccuccaccucccagguucaagcaguucucaugccucagccuccccaguaacuggaacuacaggugugcgccaccacacucagcuaauauuucuguuuuuaguagaaucaggguuucaucauauugaccaggcuggccucgaacuccugacuucaagugauccgcccaccucagccucccaaagugcugggcguacaggcaugagccaccacgcccagcccuacauuucuuuuuaaacaaaacaagauuugugguuacauaugguuaucuaucugucuagauagauaaucuaucugucauuuauugccuucaaaaugaaauuaauuuucaagguuuuuuggaaauggcuacuaaugauguaguuagaugcccaguggguuauaccaagauucuuuccugagucacuauuugucauuccuuuuucccaacccuuguaaguauuaacuguccccacagucuuauuuuauaaucguuguguuguugcauaaccauuucacuugugugcuuugggucucuuagaggacagacguggagaugcugcuuaccgguagcuucugccaccucggcacuuugguuuuggacugucuggacuagaaaaucuaggcaggguuuauugcuaaucccacuuucuuccuuuugcuggauuuugagaagcccugcaaccccauuuccaugcagacuuccacugugguugggagucagaauaacgggggaggaaccugggaaggauggugggaggugcaggggcaggggccguguuuaaguguggaagcucagggggugucugucuuuagaccugaauuuccccuucugcagccucauuucuaaaggaauaaagggaauuuucucuuuccaccucccaacccauuccuuggccuuugcuucauuugucgaugguugauguuguguguggguguguacgugcaagaagauggcaggcugccgucugcguagccuauauagcuuaugauguuccacaggcuccacccacuggccucucccacugucucugggcggggcucaugggaggcagaagcauucuccccuaucccuuugguugcacauuugaauuacuuggggagauuuuuaaaaaauacuaaugccugagccccacucaaaacugacuaaauuaaaaugucuggagguggggcauaagauuuuuuaaaauagucuccagauuggauuuguguuuauauauacugaggucugcaacuuacucuguaaugcauaaaaaauaaaguggggugauggaugaauaugucaauggguagguuugugauaagcaggaacaaugaaauauuaaugguguuauuuaggcaguaggcauaugguauucauuauaaaauucuuucaacuuugcucugauuugcauauuuuaaauuagaaugcugggaaaaaaacaaacauaaccacuucuccagaugauuguaauaugcagccagguuugaggaucacuggacgaaaggauaaauuaacgaguggccacugcauugaggugcuuagggcaggaaauuuggggccgaugccacccaaggcuugaguguggagguaaguggagagagacuacauuaguucucuggguaaaggguguuaaauaagcagauuuuggcacaugccugguggcuggguggccauauauuuaggaaagggaccccaaggagguccaacugagaaaguagguaagagcagacuccuggcugauaaaauauccauauugaacccaauacuuggcuaaucagaguucugagggccauugggccacauuauuagcaaaaagaaagagauguuuuugaaagaugcugauucccuaauuggagaugaugucuguggaacaucugguucuuacuuaugggaucagacucuuggagcagagaaacauugagggucaucuggcucggccucccacucagugucuuucccaguggccugagcugaauuguauuggauuuaugcagcuggguggaaugauucuaaggucagccuuuuaagggcaaaacuacuuugaauuccagagaaugaauauaguuuaaaaccguuuuccuaaaagaagaauaaaagcuguuucaugcaaagcuugauugucucucucuuuccugcuguuuaauuaauuuauuuacuucuuuuuuaauuuuuaaauuuaguuucgggcucuaacugaaucuuuccugcuauuuuacaauuggauguugaggugcuggaagacgcagagagcaucuaggagaaguaugccgugugcuacuuguguuuuacuucccaugcagucauggguccugguccuccccgaagugugcagaaugaagucccuuucuaaagcuuuuaagaaguacagaagcaaaggcucuucugucuugccugugaggcuggggaacaaaggacaaaggcccuuuaaaaaagagagaaggggcgagaguccugcagaugugagguugcagugugugucagcccgccugggagcugcagccaacugauugcagaggcccaaauaugggacucauuuguggguucugcaagaagaaauagccugcugguuaugaguaacccuaaguccccuucugagagccucuugggcucacagcaaauucaaucuguucuccuggacuuuuggagcuuugauauggauuaaacuccuccugaguucuguacaacugauggccuuguugaguuugaucuauagcuuuuaaugucagagaaauauuaauuuccaugcccuuucaucuuuuaaaguaacuaauauuuuuauaaugcuuuacgguuuauaaaagauauucauauaccuuaucuuucuugauucaugcaacuuucuaaaaggucugaguauuucaaggcuugaugcugaaaugucauuucuucucauucuguaacugucucuugggcaacacuccaguuggcaucucuaucaugaugggcccauaauuuauaucuuuagccuggaucugucucuaagaccugauuauccaguugccagcuugucucuccacuggacuaucucaaagguuccucaccuuucacaggcucuaccccaaaccuguucccuaucuccagcaaauggugcagucaaacauucacuggggcaggccaggcaccuaggagccguucuugaugucauucucuccuaacuuguaucccaucugucacucaguccuguggcucuucccucuugaauagcuugacuccauucacuucuuuccaucuccuuggucaccucauuagaacugagcuaucccugucuuuugccaggacuauugcaguagccuauuaacaacuuuucucauaucuguucucccuucucucucuuucgugucauccccaaguuuaagagaaaucuuuucaaagauuucuucccugacaucugaucucuucccugacaaucugcgcuccauccaugaguccccuuccccuuuuuaagaucuuuaaauacauuucuuccugccauggggccuuuguacaugccgguugguccugguuggaacacucuuuucacccuuuucccuuugccuggugcuuagccuucagauugugcucaagccuuaaggaaacucuuccugcuuuuagagaucuguauuccuuuauuucagagggguuauaauauuucauguuuuugauucauuauuuugauuguuucaccuuuucucucccauuauuguaaguuccaauagagcaagggucucuuugcuuuucaucaccguuguaccucaguacccagcucucaggaauauuuguucaaugaaugaaaccaaugggguagguaggacaaguauuuuuauucauuuucuuuuuacacaaggagguugauuuuuuuuuuuuaaagagcagaugcuuggcauuauuuuauuucuaacuuuauaauauggauauuucugccucugauagguucccugugccaucauuucucggucuuggcucguuccagauucacuucagcagagacaaugaugagcaguuauugguuuggaaauacuccccagaacaugcaaugccagcucauaaaauguuuucagguuguuggaaaucuugugaaaacgugcauaguuaacuauuggagaauuuaacugugaauaugaaugggggagccauucaucagaagcccugucugaauaauugauuaaacaaugccaggagguguguaagagaaggauuugaagacugaguuguaaaacuauggcugacuaguagggucccucuuggcagucucacuuuuuugccucguggcauuaggcauuagugucucagauccaucauaauaagucucugggcuuacuaacugugaucuugugucggaugggcccugugcugcuaccuucuugacuuuaggauaucucuuguuaccuuuuugcuacuugcucccaccaaggagcacagcagacuccaacucacucuaggugagcuuuccucuagcucccgagggucaugugccucuccauuguguucaaagagaauaggcgccggugggccgcugucugggaaacucuguguuccuuggugcgguacugaaccuauuuaguuaaacuugaucaacuuuagcacacccucaccaggaguguguggauucuccuugggacccaagucuuccguacaaggcaaacaaguuggaauggggacuucuaugauuaaggucaucguuaguugaagaauuucaaaccauuuuaguuuuucaugauaugcuauuucuuuuuuuuuuuuuuucauuauuauuacacuuuaaguuuuaggguacaugugcacaaugugcagguuaguuacauauacaugugccgugcuggugcgcugcacccacuagauaugcuauuucuucaauuucucauguggauuuggggugugugugucuguguucucucauguguaaauauuuucauagaggcccugaagcuucuuuccuauauagggauuuggggacauucccccaaacaagaggacuuuguuaccaggguguccauucuggggccuugcugguaugaaaaugcucccuggguugauccacaguguauuuauucaugaauguuacaggugccuuagaguuuaguucccuuaggugacuguggaauuuaaaauaagaaaucaaccuuuauccuagguuuuucuuuuucuuuucucucucucucucucucucucucucucucucucuauauauauauauauauauauauauuuuuuuuuuuuuuuuuuuuuuuuuuuuuguagagacggggaucucacuguguugcucagacuggucucaaacuccuggccucaaacuauccucccacuucagccucccaaguagcugggauuacagaugugagccaccaaaccuggcuuccuuuuauuuaucaagaaaaaaauacuguucuuauuguucauuacaaaaagaguauuaccucauuaaagaaacuaaaaaacaagcaaaaaagacaucucucuguuuuguuuuguuuuguuuuguuugagauggagucuugcucugucgcccaggcuggaaugcaguggcaugaucuuggcucgcugcaaccucugccuccugaguucaagcaauucuccugccucagccucccaaguagcugggauuauaggugugcacccuacucccggcuaauuuuuguauuuuuaguagagacgggguuucaccauguuggccaggcuggucucgaacuccugacauugugauccgcccgccucagcuuccuaaagugcugggauuacaggccucccaaaguguugggauuacaggcaugagccacugcgcccagccaagacaucugucaaaagcucauuaugcacucccgaaacugcuguuaauuucucuuguguuagaguucagauuuuuuuuaugaauacuucuuuuacauagcuauuaauaaaacauauucauauaacuauugugccaugcccuuuuguauuuaauaauggacauuuuccuauuuuaauacuuagccauuauuuuuuuuuuuuuaaggaagugaacaaaugaaagaauggcuacuccauagacagagcagccuaucuaucacuuuuuaauggccguguauuguucauugaguguauguuuuguagguucuuaagugacauccaauuauuaggauuuuagguuauuucccauuuuucccucuuuuaaauaaguuggcuuaauguuuaauuaauaguuuuagaaaaauggaaagagcaagaauauacauuagaaaacagacccuggccuuuuuuuuuuuuguaccauccagagaaguuaaugauuaagguaagaacuuaugauaagguuauuuacaauggggaaagagauccaggggauucggguugcagagaguaaggaccgguguuuugugugcacucacacaucacagccuagccgcaaaaagaucaaguucugcggugucugcaguguugccuuaguguccuucauacaaugucuccccccauccaaaauuuuuuuuuuuuuuuugagacggagucucgcucugaugcccaggcuggagugcaauggcgcgaucucggcucacugcaagcuccgccucccagguucacgccauucuccugccucacccucccgaguagcugggacuacaggcgcccgccaccacacccggcuaauuuuuuguauuuuuaguagagaugggguuucaccguguuagccaggauggucuccaucuccugaacucgugauccgcccuucuuggccucccaaagugcugggauuacaggcgugagccaccacgccuggccccaguuuuuuuuuuaaacauaauucugacucuggaaauaaguaggcaccuuuaaacucuguguagacuugauuuuguuuuuucuugaaguuuguguguaucucuuaauaugugugcuaacuuaauuuagggucuagguucaugcugauguuggaagcaugccauucuccaagcuuuuuaaaaauauggauauucuuaaguaucucacacugaggcacccagcuauaaaguaaccguaguguagguaggugcacacugcauaaacacuucuucuguaagcuggagaaauagcuggaggagaaaucuguucuuagaacaaggcacaugcuguugguuccagacauucuuuuuaguggaggauacaaaaguguguuuaacgguugcuggccccacgccugcuguccagcccuauggaaugugcucugucugggccacacugccagucaucaaggcaguuacugugaggaaggaagaagccagcucuucaguuccuugaccugagcuuuucuggccaaaagaaggaaucuguuuugaagauuagguuucccaccuggauccugcccaccccacccacccccuucugugaacuguccggcuuaucgaagaagacccauuuuuccuucuuacaguugcuguuucuucauugcaagugauucacccugaacguaaaguuaggaaacuuaguuuauaaggaacuuuauuugguggagaaaugucaccccauucucucguuaaaagauacgaugucuggauugauuccaauaucugugguuuuuggcacaugccaucuuucugaaauugcuucucuguguuuuauguaagaggaagaaagaaaaagaaaguucuaaaacaaaauggucagcuuauucuuuggaauucuauuugggcaguuuaagugaggauaguacuauacauccugucuuuucuuauaucaauaauaauaauaacuccugugacuuauuacauuuaacucucauaaucaacccuuuguauucaauacuguuuugggcaccauuuuacagaugaggagacugcggcuugaagagguuaagaaacuugcucuuuagaugguauuccaguguaggcagccugacuccagagcuggaugaucuucuaacccccccauaacagugcuuucaagucaucuggaagaacuuauuaugcaaauuaaaauacccugggcaucuggaaaacauuuguuucuuagguugugccuauuucauaauuucuuuucuuuuuuauuuugaaaaaguucaaaccugagaaagguuguaaaaauaauacagucaagacauauaucauuugacuaaauccaucaguugcuaauauuuuaccauauuaacuuauuuuucugucuuucugcguauguguauguuguguguguguguguguguguguguguguguguuugaugacccuugaaaguuaguugagacauuaugacauuucaucucuaaauacuuuagcugguaucuuugaaaaaaaaaaauucugcuaaacaaccucaaugaaaaucauaggccggacgcgguggcucacgccuguaaucccagcacuuugggaggcugaggcagguggaucaugaggucaggagauugagaccaucccgguuaacauggugaaaucccgucucuacuaaaaaauacaaaaaaaaaauuagccgggugugauggcgggcgccuguagucccagcuacuugggaggcugaggcaggagaauggcaugaacccgggaggcgaagcuugcagugagccgaguucgugccauugcacuccagccugggcgacggcaugagacucugucucaaaaaaaaaaaaaaaaaaaaaaaagaagaucauaaugcucaaaaaaauuuuacauuaauacacugcuauuaucuaaggcauucauguucaaauugcccuaguuguccccaaaauguccuuuauagccaccucuuuuucugauccaauuuaucaaaaaggaaacuuagcuuuuaugauuuguaaucuugauaucaucaugcacauucucuucucagacugggaacaguuuucuuuggcuuaacuaggagaccagggaucuugcuggaguuccagauuugagcucucugcccuuccugacuaagcagccccacaguguccucacuugacacaugcuguuuuauggggcgccacgucuucuucguuccuucucucuccucugauccacuuuuuuccuugacccuauucuucuccuucguuucuuucuuccucauuuucuuuuugccccuucucacuuucuuccuucuuuucuccaacccccuaggacacacacaagacuuguucuuaugugcuguaauuggaaguuguaaaucaaugggguugaaggugggagccaccaaauuggauucauuuaugaguugggauagagaguugguggcgggccugagcugaugguauacuggggacugauccagcuguaccccccauuggaggagguucagcuggcuugaaacagugugaggcugagaggauacaagaguggccagcuccacuauucacaguagcaaagacuuggaaccaacccaaauguccaucaaugauagacuggauuaagaaaauguggcacauauacaccauggaauacuaugcagccuuaaagaaggauggguucauguccuuugcagggacaugcaugaagcuagaaaccaucauucucaguaaaauaucacaaggacagaaaaccacacgcugcauguucucacucguaagugggaguugaacguugagaacacauggacaaagggaggggaacaucacauacuggggccuguuggggagucuggggcugggggauggauagcguugggagaaauaccuaauguaaaugacaacuuaaugggugcagcaaacccacauggcacauguauaccuauguaacaaaccugcacguugugcacauguacccuaggacuuaaaguauaauuaaaaaaaaaaaaaagaguagcuagcuccaguccagggcaacaucagcuguggaggacaaggaagggauggggugugccaaaaugggguagaaacgacgcuguguuguauuggaaagaaaauagacuuuaaagucagaaagaaaggugaaaauagcaagcuuuuacugacuggcugugugaucuugggaagguuauuuaacucccuaagucuugugugcuucaaccacaaaugggaagaguauaaccuaccuugcagcauuguguugaggauuagggauaaugcguauuaaagcagagauccuggcacacgguggugcucagucaacaguggcuguuagguauuuacauggugucccaggaaguggauggggcaucacagugaggggaggugaugguuggaaguucaugcagguggccaacaugaggcugagcugccagugguuagaaggaucuuaggaaugcagugcagggcaggcuuccuguuccugggagggaaacuugugagucaguuuccagcgaucgggagcaggggccacaggaacacuccaguucagagacauggggcuuggugucugggagagaaucgaagagccagaaccaaacugucugaucagguucaaaucaauagcaagggcacuugcggcugagucauccggaguaucucuuguuuuggguuagcauuagggagaagcuaggguugggggagugacugugggaggagggcugggacucaagcuaagccuaguguuuguucuccuuuuacauccgcuaguaguguggugaccaugauaacauuccagaggcucuuuucuuccugaguccuuggcccaaaguuagguaaauugucucuagguagauaaugaugucccgauaaugagcucagaguccaaacugcuaggcugauggagauucacucaccuuuugccuuggucugcucaggccaccuuaacaaaguaccauagacuggguggcuuaaacagcagacguuuauuucuuacagcucuggagacugaaagucugagaucagugugccagcauaguugagcucuggugagcgcccgcuuccugacuugcagacagcugccuucuuucuguguccucacagggcaaagaggagugggaaggagaggaagggagaaagagagaagacugagagagagagaagaaggggagagagagcaagcuuucugggcuguucuuauaagggcacuaaucccaucaugggaaccccaccucaugacgucauguaaaccucccagaggccccaucuccaaauacuaucacauuggggguuagggauucaauauaugaauuuuagggggacacacuuucaguucauaacacccuccuuccaugcccucauucccagacacuugagaauccauguguaaugagaguguuaccuugaggaguaugcggcuccugcguauuauauggaggcagagacaaggauucagaagcacaguucuagcagcuugucaguaagccacugcaggggagcuuugaugaacucucauauggcauagguccuuccuuucuaccuacgauuuuucuuuuuaaaauuuccuuauuauuuuuauuugagaggcaugaacaugaggcaaaauauguuauuuccuguucuuuguaaaaucuccaaauugagcugucuguagucaaaagugagguaaucuucuucuuuuauccaaaagauuaacuuauucugagcuuuccuucuaucugagucguggcuaggaucaacauacacuucuuaaauauuccaauuccauaucaaggauagugcuccuccuucucccugagccacuggagggagcaccaauguauuaacaguuuucuuuguugacugaauuugcuuuuuuuaaccugcuuucugaaagugcaucacauuaccauccaaacuuauuggacauaauuuuuuaaaguauguaagcaaguaacauauaaucuauuuuacaaauuaugcaguaagacauagugggauauaauuuaagaagaugcaacuagcccuuauuuuuccacucucuggaggaauuucauaacuuuucacauguuugcacuuccugucucugaucuguaucuucuuuggcuccucugucuugaugccccucccaacuucuguucaccuaaguccuugaugccaucagugaacaucagauuccuucuuuggaagaccagugguucucagagugugcuuuauggaccagcaaagcauacgagaacuugguagaaagacauauucuugggccccacugcagaccuacugaauuagaaacucuagggugagaugcacccauuguguuuuaauaaacucuccaggugauugugauacacccucagguuuaagcauuccugcccuagaggaggaggcuagauucaguagguguuucucccaguugcccauuuugacauaaauaauagcacuuuguuuugcuccuccucaggcauagaaucccauaguuuuaaguggagugggauuuugaguggacguuacccuggucaacucucuuuaccguagaagagagagcuuugcagauaguugcaguguuuggcuggagaaccuagggcuuucuauguccuugcuuauaacaugggcugugucacuuccuugaaacuuuaaucagugcuuccugagaccaggguucuuuguaaaauaacuuaaggaaguauuccagaagaaccaauagcauuggucuacucaccuguguguucuauuaacauuuuaauauuaacaauauucugauauuucagauguagauugcaaagccucacaaucaaggggcuuuugucauugauucgauuuaauuauccuaagggaaaaaauggaaugcuuaaacuagcaaaaguucacguuucugucuuuuuggccauguuuuccucaacgaguguaaauauauuugugcgcauguguguugauacugcguguuggaaagacagaaggagacagacuaaauuucuguuuauagaaaaaucguaaguaaucugaggaagcaguaauuacuggaguuggcaacaguuugagcacuauccugucccuugaucuaacucuggcuuuagagauaguugaauuuagaauguuaccuuaugggcaguuucuuuaucuauuuuguuuccccgguuggacaaucucuguaguagaacuagaguuuggucacuacuuguauuagucuguucuuacgcugcugauaaagacauaccugagucuggguaauuuauaaagaaaaagagguuucauggacucacaauuccacgugguuggcggaaggcaaaaggcacgucuuacgugguggcagacgagauaauugagagccaagcaaaagagguuuccccuuauaaaaccaucagaucucaugagauguauucacuaccaugagaacaguaugggugaaaccgccuccaucauucaauuaucuccuuccaggucccucccacaacaugugggaauuaugggagcucaauucaaggugagauuugggugggaacaaagccaaaccauaucacuacuggauuaugacucucuauaauuugaaaagaaugguagaauuuaaagaauuugaaagcaguccguuuguuuucaauauuggauuguucaauauugauuaccuugcauaucaugcuuguucccuccccaucuuugugggagugcaggaggcacaaagaaagccuuuaacugaaugaucugguuuuucuagauggcuuaacauuuuuguauuugaugggucaauagccuugggugcuuuagucuagaugcugagugcucaaaaggcuaaacacggaggaaaacauuccccugucgaaacacaugauugauuugguagugacaaguguuuugggagccagagacaugcuaguggguuaagcaaggguuuguuuguuuguuuguuuguuuugcuuuguuuuguuuguuuugagaggaagucucgcucguguccccuaggcuggagugcgaugacaugaucuuggcucauugcaaccuccaucuccuggguucaagugauucuccugccucagccucccaaguagcugggauugcaggugccugccaccacgccuggcuaauuuuuguauuuuuaguagagacaggguuucaccauguuggccaggcuggucuacgaacuccugaccucaggugauccgcccgccacgaccucccaaagugcugggauuacaggcgugagccaccgcgccuggccgcaaguguuucuuuaacauggccaucuuaaaagggauaaaggaucuucuaggaauuuauuucagcugaaaacagauugugauacauucuuacuuugguguugucaucauuuguucauuucuauuuuuucuuucuuucuucaacagauaugucaaauacuauccuaacauugaacaaaauaaguuguuuaaaaaaaaacaccaaaauaaaaaaggcaauaacuauuuuuaaacuuauaaaaacaaaucaaguuuggcuugacauaauuaucccuggacauaauuaucccugcuucggcaauuuagggaagaggauuucaagauuucaaaagauccugggggaaaauuagguaagcuccauggccagagacucuaauauaaauacaguucgugaaggaggaaguuagaaaaacauuuaaauuuaauccaguaaaaaugaacaauaaaaacaaagaugggagggguggaucaugauaccagagagugacuagagacauuuugcucagaauuuaaaauaauguauccagaagcuagaaagauugauguuuaccuuaggauaaauacaaaauggcgugaauuagaaaucaguuuaaggacuaacaaagucaaguacgaggugccugaaaacuagaaagaagugaauaccguacugguuuuugaaaagggaaaagcuugacauuaauaccuggaaaacugguggagcugguuauuaaagagauccuuugugaauaggaagaaagcagugcugacuaagugggaacagggacuugcuaagagguccugaagagcagguaaauucuggcuuagagccuccggagagggggaucuuuaaaugagcucuguuugcucagccuuuuuaucagcauaucugaggaugacauagaccauaacccuuaucuagacuuuccaggcguugcaggcuugggauccagaaggaacgugaaggaggggggcugguugagugagaugaagaaggagggagacaucuucaugaagauccaagggccccaaagcugagagggacugcugggaugucagaugucagaucaguauccaaaaucaccuugcuguuuaggaaagcuggauaugcagaccagugaaugcagagagaaagcaaagagguuugugugugcugggggaugagugcgaggauggaagggagugggaauucauuuauugauauauacauacagagcacugcacccacuuugugccagguacuguguucugggugcuguuguagcagugaaucaaguagacaaacguucggcccccauggaacucauguguagugcaggagaucggaagcaaacauacauguaauuucuuagggggcgauucauguuauggagaacaauaaaccacgaugggguaagagaaugcugguggggggugggaggcucugacuggcuuacacagggugguggggaguccugccugauguugugauauuugagucugggggcagugaaggugcaaucagcccagauggcuggcaaaagugguuccccaggguguaugcuggagcugggagaggcaagugugccuguagcagagaucccucagggaaggggaaggaggauggugcgggaagaagcucaaggugagaaggcagagaaagggggccuagaaacccuuuguucauccugaugagauucaggauuugaguagaggagggacaagaucugggaauacacacucaggauccuucuugaugacagccuuccaaugcuuuaagggaacaguuccaaagucagagccauggccaucuagugaaagguaccaagagacagcuuuuaguucaguguauggcagcuuuagaauucaagucgcccaagcaauggucugugcugcuucaugaguuuagugucccuggauuugcgcuuaaaaaccaccaggguccauuucaacgugaacauucagugagucuucccccuuguucuacaaguguuuccugacauugguccugacuucgguggggucgcagauggggaagagcagagcaggcgcguggaggugcaggggaugcuaggagaggaaguggaggcuggguucauggagacacaggggagcagugugaguuccuagaagaacuuccuagaaguucccaugguucagaaaagugagggggccugccacggagagacugagcauugggcaugaagagggcaugggucaugagaucauggaggaaaggccugggguaggcuagagaucuuucaagaagcagcaaaggaugaauggaagaauugccaagggcagagcuuagagcggagugaccaaggugaccaucagagucuugugaggugugccccccgggugggaaaaggaaagcuuuuguuuccuagggaccacagguaccugagagaaagauagaggacugucuggcauagaaauggggaggggaggacaagagaugccacaggggagggacccccaaaaugacaggaagaguugaggccuagagguuggauccacagaagacgcauucugucuguauccugugauggcaaaggugggauaaagggccucugccugagaggcugaaguaggagaaagccugagauucuuccagguuuggguugccuggguguggggagcaacaacugacucaaggagagaaagccugacucagccugugcuuugacugugcagggggagggcccccaugauguuccuuccccaauuucaauucagagacauacguacuuuccuccaaacugccacuuaauuauaugcuggcuugacugcaaggacacugagcaaauucauuuacauugagaaaauugaggacaaaugaaaaauuuuaauguucucaugucccccaccccccaccccccaguuuauaauuuggaggaaggaaguaaauuuaaugcagaauauaaacauuuaacaauguaggcuucuuccuaaaauaauagauugguuuuuuaagcccacauuucuuucugagugaaagaaauaauucuugggaggccaagguggcuggaucgccugaggucaggaguuugagaccagccuggccaacauagugaaaccccgucucugcuaaaauuagccgggugugguggcacacaccucuaaucucagcuacucgggaggcugagguaggagaaucacuugaaccugggagguggagguugcagugagcugagaucgugccauugcacuccagccugggcaacaagagugaaacucugucucaaaaaaaaaaaaaaaaaaaaagaaauaauuuaguuuuaaguuuaaaauaauugguaaauaagauuauguuuauuuguuaauuuaaaugaaauaaaacacgugcuucuguaguaguuguacuauggcaaaacuguucaaaauaugcacaguuaauuaauugaauuucagaugguuccccuguggaugucuuuccagguaugugcuuuagagccagagguaauugauccaauguugucuuuuauuagauacuuccaggcuaauaucccacugacccuaacuguuauauauuccugauucucucucuaagccuuggaaaggcuuuggacaaaaucacuaauauucucuuuugacggaauuugaguuuucacaauuacuucuuucuuuuauuuucucucuccccaccccccugugugugugugcauguguguauguauaaacacacacauauguauuuauucugcauuuacuuauagucacuguauuuuaagcuugcauucuuauggaaagucuauguuacgaacuuagcacuuacuccucagaggcaguguuagauaauggaaaauucaugagcuauguaaccagacagauggugguuuaaauucuagcuccagcacaugcaaaccacauguucuuggcaaguuacuuaaccucucugagccuugguuuacugcccuauaaaaugggucuaauuauuacuuaucuaauggguugguuaugauaauucacuauauaaugagaauuauauauuuuuuacuagauguuaaaagcaccuaguaaagugccuccauuaguggaagcuacugcugcuucuguuuuugcuagaggaguacaauggagacaugaagccaugagaauucuaaaaacuagggaaugggaacauggaaaguagaccucugaaaaauaaagggaagagagugaaagugaaaaguuacugagguaaauaaguauuuuaucacucaacuuucuguuguacuggugaaccaguaauuacauuaccuuacauuuucuaaauauugcacguacuuuccucgccggauggcaaaggaugcaguuuacuucggauaauuuaauucgguuauuauacuuugauucucaucaugcuuucuuuuacccugguuuguagaauguuugagaaaucauugauugggcucccugucuucacagaguugaaugucuuuucaacauauggucaugucuucucucccaaaacguuuuugggaaugguguuuaagguuuugcuacauaacaaaucaccauacaacuuaguggcuuaaaaccaccaucauuuauuuagccugcaauucugugaaccagcaauuuggacugggcucagauggacuuuucuucugcugguuucagcuggguucaccuaugagucugugcucaggugcuggucagccagcucugcuucuagggaauggguggcgaucagcuggggugauagagaaagggaaugguggggaauauggaccuugggggucacucauuacccagagacuaguccugucuuguucagauggcagcugaagguuccaggagggagacuggaagugccaaagacucuuggggcccaguuucagaacuuggacaguuauacuuuacuucauuguguuggccaaagcaacucgaaaugccauugcagaaucaaagagcagagaaauagacaucaccucuucaugggaggaccugccaagcauugaggccauuuucacaauccuccuuagguggggacucuacaguccucauuaacaagucaauucuggucucuuggagucaauagguuccuucucagacaugagacagacauacacacauacuguaguaacuucugcuuuaauguuagucucuuuaaaaaugacucggcauuuugaagacugaaaagaauuacuuaaguuuuuacaucccuuguguugcagacagaucucaagugugugaaguguuggcgccagaggauugauccugacugcacuggaccuuccuuggauuuaauccugaccagauccacucaccugugucuaagcaguggucaggcagaaugaggaaguguuagcuggugaccucacuagaggcucuucagguggcccuggaucaagagcagcuuauuuguugucuuugaugcagaaagugagacaugggagaaagggccugcccuuaacucacuggauuucuuaaaacauuuaaacauugcauuguaccaaaugccaagcagauaagugaguuccucaaauacagcuuuuuaaaacucuuaucacucaucagauaucucaagcuguuuggcuuguuugaagcagccaaggauuucuuuucuuucuuucuuucuuuuuuuuugaacaggcagggucuccacuauguugcccagucuggucucaaacuccugagcucaagcgauccuccugcccuggccucccagaguguugggauuauaggugugaaccacugugccuggccaaagguuuauuuucugaucauuuugagggaaaauaaauuccaauauuucucccaagacaguagacuuaggaucucagugguuugucuccaagucgcaaacuuaagggguucuuuuuuuacaugaauuuuaccugaguucuaacuuguguugggccaucaaguuuguuacgcauagccuugggcuugugugccuuggguagugugaacuguucaaauugacuucuggccuguaaacucuacucucuucccacugaggacugaccccagggaauugcaugagucagggagcugccuguuucccuuggugaccauggaaauuaggaacagugaugaccuggauuuaggggaaaacuagaaagugacugauucaguugaacagcuccugggacuucagugggccaggccuaggacggaacacgccagacacaauguuccugccuucugggaggagguccuagauuguagccauuauucccuugggaccaaacagucuuccacccugugauacagcaaaaauuaguaggaaugcaucugaaguguuuuugcuuauugaugaauuaauaccuuagcagaggaaagagauaaaugucauugcauuuaccacucuucuuguacagccagucuucuuucuuacaggugcguucuuugaagaaaacuugugaagccuguaaauugaguggaaggaguaggaauuauuuggguuauuaauauauucuucacuuucuaaaaaugaagaaaaaauauccaucuucucaaguuuaagaguucuuuacuaguugaggggcugggccuaguuguugaguuuggaguuacuguauuuuuuucugaugcgaaguagucugggcccaguggagauucuagggugaaggaggacuugggguuguauaauuaggcaccccuguggacagucaggaugcuguacagacgguggggaaaggaaugagguugugauguuaauggauuucucaaguguuuauuugccuucuguuaugucuaggcauuguagauuccuguagucacaucuuugaagagagagaaauagguuuaaaaaaaaugcagaaaguaagugguaaauguguuaagagaaggaaaugugugaguccuugagugcacuuugggugccuagugacaugauuuccugggugaguggaaaaaggcuagauuguggaaguagcaguuuuccagguggagaagggagggaaguggaauuccaggcuguaggaaccuguguucaagauggggaggagugaugagcgcuguguucagggaacuccacgucaucauuacaucugacuagaccagagugggaacccaguggaguggagaggccgaagaagaaaagacaaaacauuuuaugaguuuuaauguacacugggggguggggggcauuggauuaaauccacacacacugcuuuucuaaaaggccucuguuugacaaaaggaaaugcuguucagcucuaaaaguagcucuucacuacuggguuaauugaauuugccuacuuuccuguaagugacaaaucccuuuuucuagaaaaaggugaacagauucaccuagcucugugcggaauguuguuucaccugucugaauggucuaacucuuuuagguggggccuuaugcuguaugcuagcaaucgcaaauguuugcccaacucaaagaauucagaaccuggauugugaaauucaaguuaaaguaaaauaacuaucauuguuaaauugugcuguuucaauauggcuuaccugggcugcuggcuucucgagaaauauucggcauggcuguccgugugaaggauugccaggaccugaaagauggaagguagagagugcaauggcaguuugaaagcagcucaggugggcuuaggagcuuuugugaauaagagagagcucagauuugauuuagaagaaauugacuucaaauuaauucuauuacuggaaacuugcacuggggaggaaacccggguauuacuguccacugcuaacacugcgaaacgauuuucuucuggcaagagugguaguuggaauuuaaaccagacacugaccugagaugcucucuaaaguaaauugacuaaacacuuauuugaaaaugcucuauaaugaaaauguucaauuagauugaaauuguauucuacuccuuauagcuuauucgucucacucgguuugugcuuuuuaauuuuauuuccacuuguaagugggaaacaacuguuuauaaauaauuagaaggccuuugggucuucucugauucaaagucuuacauuccugaggcaaacugaugguucugucuugccaccaaauaccuggugccuaguaacacaaguggcagcaaaaucugagaccugaaauuaagugccuuagcuaguguuuuaaacaucaaaguaugagugauuucaagugauugaaagguacccacugagagaaauuuuacuugcagcaaggaagacuaggacuugaauguguccagugacuguccccauacauccugggguaaguuauuuaaccccuuuaugccuuagguuguaauuuuuugaauuuuugcaugaaugaaacaucagaccuuggcgaugaccuugagcaguaggauauaaauaacucccgcaugcuuaguguuccaguaauggaacacgaggcauauuaaucuuuccgagcuucaguuucugccuuuauaaaaaggagaggauggugcucagaucugccucuuugagguggguuuuaguuuuauugguaauauuucaguucuuuuucaaaaauuugaggccaagauugcagauuuacauuugaaaagucgaggugguggauuucaggggugccuguuaaauuauuuucugaguuauguuuguuucagauuaucuuccaauuagaacaauaauugaaucacaaauuagaagugaaaaugccaagugcccucacacauauuucuagacuccaugaguauuucugaaccggacguguaaguuuggcguguggggauuaaggggagaggagugagguggccgugcugaagaacuaaucauaagacugccaucuucgcccucccccauccuguggugcuuaccaaaccaggaugcgaccagcuucaauccaccagggcuuugcugcuugcuccuuagagaaacugucugugaacacgugcuuuuucuauaccuguuggauggauucuuacuguacucauugaagauggaaaugggcaaggauuucaggggguuucuaaugaugaaguaguagcguaucuguaaccacuuauaaaaaggucagccuggugagaauuaggggucaagagagugauugguuuaucauggucauucauuauuuacuuuuaaauguagguuaacguggugggagaauggugucucuaccaguggcucuguccagggaacuuuagaguuuuauguuaaauaagaacccagacucuggcaguuacaggaccugguuucuugggucuggguucucagucacugggagucuugagugacuaauuacacuugugcuuaggcaacguuuguagucuucuuucuauuccuuuguagguugggcaguuguuccgacuucugugggacugagagauaucccaggauguggaacuuuacaaccagaaaagucugaggcaacuggggcagcuggucuuccuacuuucuagccuccaugccuuccucuucuccucuuaccuccucucucauggccagacaauaccaugagcauuccaaacucuuuaggcugcuguuacagauaaacuuuacaugugguggaccuggggaguuuggcaacacaaaguuauucauuuuaaaaaauaggagugcuccuaggguaguuuggacgcaagcauaagcugccuuuauagagcuuaaaugugugcugccugcagugcuccugaugauuucuuugugguucuuuccuuuuugcuaaaaguuuucugaaaauagaaagccguggccauuauaguuagaacagggagcaaacaggaaccucugagaggaucccuagcccccugcccccugccuggguccaccccuacuucuggguagcuaucugcugucaccaccugcaagagcaagaguauuuguaagcuguggauuaugucccuaggauuacuagucuuucuuuuucaggaaaaauaauacacaauucaagccaaauguaaacaagcacuaagauccuacacuuuuguucucggugaucauuaaaugcugugggucauuucacaauuucaguugucauuuuaguuaucccucaugcguagacaggacagguacaaccuguaucucaaggucaaagggcaggacucuacuuauguuuguggaacuucagaauaccagacagaaacccaugcagagagguagccucucaagauuuugaucuugucuccuccgugaagaaugacaugaagaauuucucuuucccugugauucaucaggagagugcuguuuauucuuccagguuuacagcucacacaccccugcugcuuuucccuccuggagagguuacaggaccuugugaucuuacugggcugugugaaaaacccaugaugaugccuuucccuucugcagaucuuuguuugaccgucuguuuuaagugccccuuuuucucuugguuaucuagcugccagcuguuuacaaacuaguuugcaucaagcgguugccuagaaaccaucaugaaaacaggauuaggcaaagcauuuuuucuauauuacagcugcuuucugaugaaggcuuggcauuagaaagagcucagugucuaccccuucccagccuuaaaacacaaugcaagugaaacaaggacuuuccaacagagaugaaaugauuucucuagagucacauucugagaccgucaucacccacccaacucuccccuccucugcaaacccgcauaccuuucccuuucaggagagucguguguuggggaugguugacgcuuuuuaaagaacauuuaacauacaccaacagcaggucucagauacuguuauuuauccaucuauuccucaggccucagcuagacuggagugggugcagagaaguuagaaggcucuggcaguaauuuggucauaaggaaggaauguguuauguggaguagcaguuaaucaacuaagcgguaagcagguuuucagugaaacaccaccgggagcuaaucccacuuaacauaaacuacagugacuuagagggaacaaacugucuaacccugagcucucuuguuucccaggaaauaaaucaggaugaagucaagagacaucaaggaguuuacauuaaaaggucuuacuaagugauugaaauauucuuaaacuggcugggcacagcggcucaugccuuucaucccaauacuuugggaggccgaggcaggcagaucacuugaggucaggaguucgagaccagccuggccaacauggugaaacccugucucuacgaaaaauacaaaaauuauccaggcgugguggcaggcgccuguaauccagcuacguuagaggcugaggcaggagaaucgcuggaacccgggaggcggagguuguagugagccaagaucacgccacugcacuccagccuaguugacaagagugagagagagagaccccgucuaaaaaaaacaaaaacaaaaacaauuauucuuaaacuccuccuggaguaggauagauagguaaauaagugauuauaucuggauuuggggucaaaggagaaagaggaaucaggaaaaacuuaagaguuaguaagucagcaaauacuuacugagcacuuccuucuaggugugguagaguuggggugggguagguaggguggcugucaaacacugagcaagacagacagucccuguauauucuagugcaaaggcgggaaagcaggggccagaucauaaaaacuggaacagauaaaucaguaagcuaauuucacagacuggcaaaugcagugaagaugacaaaaugggaccuguggcuaccguaggggucauggacacuguuucucuaaggugacauuugaguugaaaggcugagagccugagggcugggcggggauauccucucagccauggggaaguugggaaggaggcugaguauguggaagagaugguuaauagaaaucaaacacaaggagaaccuucaaagucagaugauaaaucagguccauacuaggaagaucuuuuccaaguuucccagaaaaguaaaucaaaccucaccaggccucuagaugguuuuaauuaccuuuuuguagggcugcugaacaggguauuagucauauacuugacaauaaggacuuguggauuuuucucagagauauuaauggaugggaguaaauuugcauuugaaauuuuauuuuuaaauuacgaaaauaacauauuaccaaaguuagagaaauaagaaaagaaaaacucuuauguucccacuauccuaccagcccuauugucuauuuuguauauuucuugaagacuaggucucacucugucacccagguuauagugcaguggcgugauccugacucacuagagccuccaccuccugggcuuaagcgauccucccaccucagccuccuaaguagcugggacugcagcugugcaccaccacgcccagcuaauuaaaacauuuuuuuugguagagacagagucucccuauguugcccagacuggucucgucucgaacuccuggguucaagcaguccuucugccucaccucccagagugcagggguuacaggcaugagccaccaugucuggccuguuuuguguguuucuuacagucuuuuucauguauaugauuuuagauaguuaauacauugcccuuugaaugcaugacagacauuucgccaauaauuccuugagcuuauauaccauacuuauacauuucaauaaguacaaucaauucuuguuauuugcagugguuauggucucuuaagucacugugaacacugaacuagcaaauacuaacccuuugcugcuaagggaaauagaggauuagguucuugcgggugucugauuacauuuuuaucacuaaucaguauauaaccuuguuuuaugugugcuucuguuuaaagacaccauacuuaauguaucaauauauuguugguuuauuaacauugagcuacagccaagagugcuaucacccauaccugaacaaagcuuaucgaacacguggauuuuuuucugugaggcauaucacagccgucuuguacuuaggacacuagauagcacuucagcacugugcuugggagguguuuuagacagcaacgucaccaacaaaaagcacaaagauaugaaaaacauggcacuaaauagaccaugaaaaggaaccugcguaauagccugagagcuacagcaagaaggcagagugugcccuuuuucagccuuagcugggcacgugcaugucagugacucaaauuuuuugccacucuaugcggauucucaaaugaccaugaaagugccacaaguauugauuuuugagguuacaaauacauuuuaucaauuagacacaauucagaaauauggaaucugugaauagugaggaucaguguauuauucuucagacuguaccauggcuguaccaugaaacuagggaucuugaaacuagggaaagccuccccaggccuuugaauuacuggaguggagaaaugaaaagguucccuuucuccuguaauauugcaauuaaaugagaauaugugaguccuuuauaaaguguguuuugagaucuagcuuacaccuuacaacgacacaguuucugauauguccuuuuguuuguuuguuuguuuuacucugaaacuaaaucauaaauggcucaccuucggaugcauacacagacacugcuacucugguguuuguggagccuucguaauaccuccucacuccccaccccaaacaaaccaaauccugaaaaaaagcacuacuacggaguagcucagaagcaugggguagaggagaaacagcccuuugugucucaguagggaacaguggugauaauaucaccuuacauuuaugagaggcguuagcauuugugagcuucuuugaugugguccaguuuccccagaaaaagacaaguguggacugaugguaaucauaccugaccuuaccugaaaugacuaucagacguuuugcccucuggagaaauccagggugugagucuugauccuuucuuugaccagugccuguuuggugagaauagcuaucccauuggaaaacacaguaccccucauaugacccacaaauccaugacaaaaccacccacauuuucaccaucgaagaucaagaagcauaugguguauuggaaagaguguggcuuuugcagucagaggaacugauuuugauuuccuaguucuaccccuuccucagcugugcaacuuuggguaaguuguaaagccucucugagcuugcauuuucucauuggucuaauggggauaauuaugaccccacucauaugucuguugugaagauuaaauaaaauaauauacuuagccacuucccuuauuauacuucugacaguaccuccguugacaaggagcuuaucaauagauccuuagagaaaaucagugagucaucuugacagugaccuuuguuucccagcaacucggccuggaguugaucacucucaauaacaccauuaucaaauaaccagugcggauuggguuuugcauccaugagugucuaagcaaaugucacuauuuaauuuuauucuuccaaaacauguuauuuuucccuggugugagaaacacaaauguuccaaaguaaacauucaugaaauaucccuuagauuuuuuuucuaaucuugauugggguguugacaagcuuuacgucuguguuagcuguugaauaaagucauagaagagacuuggugaauauaacauacccaggucaaaggggugugggaagaggcuagugcaacacugguguccauuugauccaugggaaaagcgaaauauaaggaaguaacuugcacagaaggaucuugaaacuagggaaauccuccccaagccuuugaauuacuggagaaacaaaaccuagauucccucucuccugauaauuuugcaauuaaaaugagaauacgugaguccuuuauaaaguguguuuugagaucuggcuuacaccuuacaacgacacaguuucugacauguucuuuuuuaaacgucugugggaaguuagcaagugaaucccaacugcuggauugcccaucacggguccguaucagccucacuguggcagagauaauggggucagcaguuugaaugccgaacuccagguccaaguggcuauuuccguuugcacuuugauagcuggcauuugccuaagagaaaaugauauuucuuugggcugacuuggccuuugagauugccaugagacgagugaucucuguacccugauguuagguguagacuuauuucucaacuaggaagagggacaacuucauguaaacauguuuggaacuuuguuccauucuugugugaauguccuuuauauuucugaugacuccuaugguguaaguugguaacagacagccauccuuaagccugggauagucacaaaacugaugauccugcugguuuucaucaucaucacugaaacucauuugaauggccaguuguucauuauguugugcaggucacagaacaaggacaacaaaaugcaucugauauaccuucuuggagcuugcagucuauaacagauaacuggauaggaauggucaauucguuuucaugaggcuauucuucaguuacgugcuaauacucaugcuguggauucaguaggaaaauugaaacuagagaagucuuauggugagcccagcacgcuuuugaauagccaagaugauccucuuaaaugcuaauauuuaccuuggccaagguaaaucaauauccuguuuccuucuguuaacuugcaguggcuuucugcaaguaaguaaacagucuaauagugagaaauuuaguagggacauggaacugagacaccaaaauuccaauacauuuguuuuauuccaacuuuguagaguuggagaguuggaggagauggagaagcuauggguaaguuuugguuccuaccauaaugucccccuggcuacuagcaagaugaagcuuaggcacuaguugagaaaaacaguuuaaucgugaauugaguuucagcaugauguaauaccagcuucaguaaugaacuagugagcauguuuuagguaguccuaguaggcuuugagcugcaagacagcaucuaugcaucuccagaauuuagcacaauugacugacacauuaugaauuuugaauauaucuuagcugaauugaagccaaggugguagacacaagagcagagaggccuggagacagggaaucaugggaaagcacugucuugugagguccucgauauuagauccaggugaggaauuguugaggucagguauggaaguaccuuguucauccagggagccagaaacagagcaggaggacuuggugggguagcugcagaguggcagagcccgaggcuccaggcuagugagggagccaacucaaaugaaggucgggccggaggaggccuggcacaguuauaaaccuccuguaaagacagggcaggggaaggaaguggauguggagguggauauucuagacgugacaccagccaagccaggcugugacuggucuucaguuaagaaaugugucuuauauaaaugugucuacuuugagcauuucaaaaauucuucuuccucccuccccucaguuuuccuguaaaaguuucuuuaaaaaacucaacuuggucuuggcuagaccaucaggaauaaagagauuuaucuaaacuuaggccagggcagaacaacuaaccugugaucugggagcccagguaugaagucacaggcgccaucuuagucugacuuccuuuucuaaaggagugagccaaggggggcaaauggcgggaucaagacacagguguggagaggcucaggggagccccggagggcacaggccaggacuacacccccaguuugaggcugacugaaagugucacagguucuccagcucuccuguuucucuucaggauucauuuuuccuccucaagaaugucuucagauaguagacccagagaagcgaggguguaggugagggaguggacagagauguagccaguuaguggguauauuaguuuucucuugcuacggguguugagcggguguggcugccauaacaaaauaccacagcugggugcagaaauguaugucucgugauucuggagguugggaagucugagaucagggugccagcaugguugguuucuggugagggcucucuuccuggcuuguaaacagccaccuucuugcuguguccuuaguggguagaguggagggaagagagagagcgagagagagagagagcgcuagggcuucaacauuuggauuucggugggacucaguucagucuauggauugaacuauauauauauauauaacuauauauauauaacuauauauauaacuauauauauauaacuauauauauaacuauauauauauaacuauauauauaacuauauauauaacuauauauauaacuauauauauaacuauauauauaacuauauagauaacuauauauauaacuauauagauaacuauauagauaacuauauauagauaacuauauagauaacuauauauaacuauauauaacuauauagauaacuauauagauaacuaaacuauauagauaacuauaaaaaacuauauauaaaacuauauauauauaacuauauauaaaaauguauggacagccuuauagcuuauauauauagcuuauauauauagcacuacaccuaacaaauuaccauaaacauaguggcuuaaaacaaccacauuuauuaucucacauuuuccaugggucaggagucugggcauggcuuagcuggguccuguccucaguggcucaccaaccugcaguuaggugucagcuggagcugcagucucauuugaggcucaagguccucuuucaggagcauaugguuguagacagaauucaggguuguuuuuuuuuuuuuuucugcauuuguacaucuucuagugguuugccucuuccaggccagcaggaggaaaauuuuucucauuucuagaccuucuuuuaaagggaucaccuuauuagaucagacccgcucaggauaaucuccguuuugaugaacucagagucaacugaauugagaccuucaagacaccugcaaaauugccuucaccauuguaacccagcacucacaggacugccaucugucauaaucacauguugcacaggccacacucaagggaaggggguuauaccgagcauguuacagcagggagcaggagucuugggagucaucuuagaauuucagccuauuacagugggcaggagggaguguguggccagugccuguuuauucuuugcauaaaagcagagggauuuaacagacuauaauuugggggagggugcauuuggagagcaggaucaaaaauauuauuuuaaguauuuguggcugguggcucaagucaugagagaacagaaacggccacuaaauacaaucuaaagauaaaagcuuaauuguagcggcucaagguggaaauuuggauuuaugaaagaaaaaguguuucgauagggcaauuuguuaggagucauuucagagcccacccucaugaggaggcgggugaauaaagaggagcuccuuuccagcauuugagguucuaauacaaaaccugcguguucaccuguagguaaccauacuuguuggugaaaggcccaguucuucuuaguccagauugcugucuacauggagggcaaaauuagagagcagauuucugccuauguaacauuuaaagugucagaggaaaaaggaucugugauuugggguauuauugcccugcagaaaagucugucuuuuaggccugugccuaccaauggguuaguuuguuuauuuguuaacaugcauaaaauauagaauaucuaucuuuugggcagaaaauauugucucuagucaguuguccucccugguuuuuguucccugaggacuauuuaaaccaggucucacgcaauucaguuaaacagaggcuguuuugaaaaagcaaaugcuuuuuuccucccauuguaaauuagaggucuucauuguuagaaauauagauaagaagaauuaaaaaaccguauuaacacuacacaggagugcaucaacauuuugcuauaaggcuguccauacauuuuuauauucuagcacuuauagauaauuucuacuuucaauuaaaaguuauaaauuuggcugggcgugguggcucacgccuguaaucccagcacuuugggaagccaaggcgggcagauuaccugaggucagaagcuggagaccagccuggccaacauggugaaacccccagucucuacuaaaaauacaaaaauuagcugggcgugguggcacaugcccguaagcccagcuacuugggaggcugaggcaggagaaucgcuugagcccgagagacagagguugcagugagucgagaucaugccacugcacuccagccuggucuacagagcaagacucugucucaaaaaaaauaaaaaauaaaaaauaaaauaaaaguuauaaauucuaaaacuauaaauuugauuauucauuuaugaaauagauaaaaagacauugauauauaaaguauguaacaacauauauaaauauauaaagacaauuauaaauuagggaauucaguuuucacaauauauuuuucauuuagauauaugacguggacauuucuguauauuaacagauaguuuucuacaguagcaguuuguuuucauagccacuuagauauaccuuaauuuauuuaaauacucauaugugggcuauuuuaaauuucacagauugauggaucacaauucagggauaucuaccuuugaucaguaagcuguucuuucugauugugaucuuguugccuucacucaaauggucuaauguucauugauucagugcuugcugcuugcaaaggcaaaacuugugcuuuagguuuacuuuuuccguggucgguucccaaggcuacaugcagaguuuuuaaauaccucuuuugugagccagaagaccuaauaaacaaaccacuuuguugagacugggaauauuagcauuggcacaauuucuuaauuuuacugugcguuugcagacaucaugaggcagagaggugguccagcugcaccuucguuccacacacggacucuguguacagcuuugugaauugcuauuuuucuuucccuuucccuucuaaaugggcucccgguggcaaaaaucuguuuaaacaaagguaagcaaaagaucaguuuaaagcccaaacuucaaaaguuaagagguuuaaccuauuagacacccagacuuugcaaaugugaagaguauucagaucaauggggaaaggggcauuuggauauuggugggucuuuagacagugaagagaauacaauuucaugccagagacagucacgaagagaaguuuuugacacagugcugcauuuugcaugaaugcugaaaacagacccauggaaagaaccuaaaucaacguuauggaucccucuuaguugaaucuacauuuugaaagcuccuuuuuuggcuuuuggaaauacauggcggcauuuuugguuguugucauaaugggaaagggggauguuaccagcacugagugcccaggggcccuggaauguacaggaaaauccucauuaaugaagaaucaucucaucgacaauaucaacauggccugguugaacaucucuaaccacuucagaaauuguuaguuucuuaugaggaauagggcagaaaacaugaaacuauggcccugaauuuuuuucuaggcuuccuagaaauggucuagugccauuucccucccccauuucucauggagguucugcauaacugaggcuagaagauacugguagaugaaaggagguuugguugaggagaaaguaguacaguaguuuuaagucugauacugcucuccaucuaugcuuggccuccacaaguugagucauuuuuucugauaaagccugucugguuguuugucucagagaccagcuguugaaagggcagagaucacccaguacugcccagcuguuagcucagccauccucaagggaagccauucuuugccaauagaaucucagaaaaggccagagaaggggaguugcagggaacauugacucaggcuuaagauuuauuuucaggcuguuuuacucuuuuaggugugaguggaagcagaagcuaccuacgucauaguuggucucagaauaccagagccgcagggggccugggagacugccuggucccaccucuuauuuuauuuccuaacaaaagagacccagagggguucagugacuuguccaaggucacagaaccaaguagugacagggcuaggucuaaaacccaagcguuuugguuccaaacaaggcauucuuucugcuaugccagcaacuaccccuuugacuucuuacuucuuaaugaagcugugcugacuuucuuucuagaauaucucccccacccccgaggcauugcaucauuauugcauucaaaccuuguguacuuucugaugccauuggcuuuauagguaacagaaaauaaucuuuugugacuagaaggcaaauguguccuauucaugauccaauaagcagcuauccaccauuguucaaucaugaacaaacauucagaagcauugcucuaccucgucuuuugggagaaaaauacucaaacuguuugggaauaacuuuuaacauauggugauugcauguguuuuccagcaggacugcagaauaucucuguuugcuuguucuuauaauaaccugcugagaucacuagauucuauuuauggucuuucuuagaaagagaauauuauggccucguguuuuauuuuguuuuguuuuguuuuuccuucuuagaaauucuucaacucuaccaaguugaagaauugaagcuccauuguuuucaauaaagaaucugaagcuaagguacacugaaccacuaccacuaucccaaaagaagcagaguuugauguuucccuauucauuuagaaugguuccuuucuguuccaaaagggaugacaggacuguggcucaaugacaggggagauccgccugagggcagaaggauuuagagggauacuuuaaggagaaccuggaccccacuuccagagaaagauuugagaaccugaaaauauucgucugguuuucagcagugccaccaaaguaggaacuugauagugcaguucagcuuuaaacaguuccuucauaaaaguuugaaugagaaguuugccuaaaaauuauaauugcugguuaagaugaaaggacacuaaagaagcuuauggaugugagcacaguguggcuggugaacuguggagaaauugcagggaaugagagagaugguuugagacuggagauaugggccuaguuuucaaaaaggggaaaggaagaucaaucaaucaauuaugaauugaugaacugaaaaugagcccccugguaagcaaaugggaaaacuagaaucgaccgaguucacuaaagaaaaaugauguuuuaugaccuucaucauuuuuuaugguauuaagagacugauaagucagagaaauacuuaauaauuuugucccaguuuuagcgaggcauguaauacaaacaacaauaaaacagcuaacauuuauuaagcucuuauuaugccaaaguaauucuucuaaaugaauagagaaacaucaaacucugcuucuuuaggguagugguguaguguaccuuaacuucagguucuucauuuaaaauacuggagcuugccuuucugaucucucuuguuucuagaaaugugauuggaaugaauaaccuggcuggggcuagcaaugugggauaacagaaagccaaccggggcccuuuacuccccacugcuccaagauagucuguccugagcaggccucaaagcucuuggauucugguagcacuuagagauagaagaggguucauugccucagcugguugagguuuaugagaggaaggaacaugcaggagcggacagccaauggcuacugcgcucccaauaacugcgguugcuaacuggcuggccacgauggagauaagaacucuguggaugucugggaagucacuuccguguucauagccugcacaugguuuucuuagccaguuuucauuuaccauagcaccaucuuguaucuggauuagacuuguaucgaugaauucauuuuuaucuucacuacaguuuugaaaggcagauuggauuucucauuuucuagugguguggagagaacaagugauuugacccaagguugcugcuaggaucuacagagcugauguagacuauaugccuucugucccaugaguccggugcauaacacaaggguuucaaaggcuaagauccccugguaugucucaacacaugucauuccagagagguggggcauacaugugaggucucacagagcaggagccaaaguggcuagaagccagaaccuuccuggucucccauuugcugaccugcgggauucccuuagcucuuaucuugggguggagggguaccuccuggcagagucaugccugagcauuuaaacaacacaaacaguacuuuguaccucucaagcacuuucccuuuuccccaguguggcccucuagggaugagauuaucucaguaaugcuuaagacauauuuggcucauaaauaaagcauagguuucuaggaagcaugcaugccguucauuuuuucccacaaacuucaucgcccguuaguguuucauaccugauguuuuuggcauuagaucuugacuuggaggcagaauuguuccauugcaacaugcacguucuguucagagaauucugugggggucgucuguggaacacuuuucagucacccauuuggugaucuuuaugucuggucaccguuucucuuguuagagagucuguaguguagauuucaguucucaacucuuugauuucaugugccauuuuggaccucaguuuucucaaauuagagugaccaggucaggccagaugauauccaguguuuccucaagcuucacuagucugugauuuggagccugcuguaauccaaaauuuuucuggaaugaauggcagaguaccagauuguauucuuuuaggguaggaugcaagaguguaggaauaguaaauaccuuagcuugugccuucacugaaagauaugagggaauguccuggguguccccuggugagguaaagacugaaauggagauggagaguguauacugugggagagggaauggggaugccuucuguuuaagagaguggaagauaccagagaggagaagcuuaugacugcagagagggcaagagaccucauuacagcagucugaccaaaaaacccuccaaauuuccuuauauaaugagcauguaaaaggguugaaaacugcaaauugaaggauaagggacagaaggagggauaucaacaacaccaauuaggaagaguaucuagagaauuuaacuggguaguaagaaauuuaaaucuacuuuaacucucacuguggggaauuuggacauaggcugaguuauguaggaggcucuuaagugugggaggguuaaaagcaaacauuuuuuggccuuggcuugugggauagaucaggcaaaaagccccgcugggccuccagcacucccauccaagauugcggggguagagucuagacucggggauagaaguggagaaaagggagagggaagaauuggugguccugauggcagcugcuuucagcaucccagucucuguggcuuccccacuauggaugacaagaacagaaucacagguucuguacugccucagccuugaacgguugacuugaucauggcuuugauggucuuucacuuguuggugagauucagcugucuguuguggcagaaggaaggggcaagaggacucggggaugguuugaguuucuugaagcauaucagaggacuucucuaccugauacggguauuucuggaacagcucugucugcucuaaaaggauccugaggauuuccuucauugacaugaggagauugcccuucucucaggcccaaguuacaauucaaaaagcauuuuuggggaacaauuagaaaucugagcuccaaguccucuguguuagugauugagaggcagcagggacuaugccgaacgugccugggaagggguccugcccuacuccaggcugccccacugucucuacccucgggauaauucuccgucuugugaggaucagauacagucauggugugcaaguguuuugucauauguaaauacuaugcauugaauauggaaggugcuauuauuauuaaauuuucuucgcauuauuuuuauuccuguugguacuuguuggauacucuugggccauggaaggacaggcccuacuaggcuagaggcuaauuuggguucagaaagaaugaagaagugcauuuuggggguauuugcagcuauauguguaaauaagccaagaaguaggcagauugaauuuuuaugugcuagcuaauucugaaucuugcagcucuccuuuguuaucaggagccacuugugggguguuucucccuucaucucauuaacugauuuauuuguauugugggcagaugcucuuaaaaugaaacaguggauuuuuuuuccacaucaaauucuaauaacugcuauaggccauucaggauuggcaugcauuugggaaaguggaucauuacuuguuuuaaugaugaaaaauuauguaguuuaaaaggaauuaguauggugcaugacccuugaagcaaauaucauauguaaaaauucauuuuuacuuaauauauacauuaggaauuaguuuuuaaaaauaaaccauuucuggccaggggcaguggcucacaccuguaaucccagcacuuugggaagccgaggcggguggaucacaagaucaggaguucgagaccagccugaccaacauggugaaaccccgucucuacuaaaaauacaaaaauuagcugggcgugguggcgggaaccuguaaucccagcuacucaggagacugaggcaagagaaucgcuugaacccaggagguggagguugcagugagccgagaucgcaccacuguaccccagccugggcgacagagugagacucugucucaaaaaacaaacaaacaaacaaaaaacccauuucugaaagcaguuugagguucagagcaaaaucgaacagaagguagaaagauuucccauauguccucugccccacacauucauagccuccgccacugucaacaucuaccaucauauugguagacaugaugguagauacauugacacauuguuaucacucaaaguccauaguucacauuaggguucacucuugugucguacauucuauagauuuggacaaauguauaaagacgugucuccaccauuauaguauccgugucagaguuccacugcccuaaaaaucaucugugguccaccuauuuauuccuccuucucccagggugacuccuuuuacaaaauauugaauauacccuaccaauggauuuauaauagguuuccuuuaaauaucaucucucaaugccuuuauugcuuaaucuauuucacauacuucauuuacaaaaaaaaaagguucaucuggauacuaccaagcaagguguacauauauuuauuuauuuaauuuuuuuuuuuuuuugguaauaagccucuuuaaaacacagcuuuuguuacugcuagugaaauuucaguaaagcaaauaucacuucagaacaaaacacccuccccaaaauaacccccaccacaaaucuccaaaacucugguguaauaaagaguucgaagcucagcccccauuuuuuaaaaauuaaagaaauauguaaugggccuacauuuuuguacuagaaaagaauuggguauccuugaaauuucacuguaauggaguuugacuugugagccauuuuuuuuucuugggacuuugacaaggucaccuuuuuccucaugguuggcaucuggcccuuuucuguguguugugugcaggguacuugugugagagccacucaggucuaaggugcacugguuuugaaggcaggucccuucucucccugcaaggggaggagggaggguggccuaggggaugccaggagcccagggcagcuccucccugccugagcaauacagucaaacuauguuuugcuggaaggaggccuugguuucuaaugugaauuugagcuguguccucugaaucauuuauggagaggaucagcuugcucuugccacacucccuucuucuauggcuccagucuuugggaggcauucugugcucuagguaaggcuccuagccacgauuuuuaaguacagaggcuucuucuccugccugccggagaacuaucuuuucagccagagacuggcugcaaagcuucccuguuucccagagggcagggcugggaauugaaugcuuggggagcucagaaggagccccggcaggccuugggccucuuguugccagcccagguucugcuuucugaauccuauuaccugccguggccaccugcuucacugcccaugggcuggcauuacaggggcaaaucuaaacaaacccgggaggcagaaagaggguguucucuguccuccuuuucccaaguugaaaaaccuucguagcuccauuuuauguugccugcaacauuuuagaaaaugauaggguaguagagcugaauagguuguuagcaaugacuuauaaauaucccuguguuauuacuacuuucucugcuggcaggguuuagcccgggauccauggaaucccccugccgucugcagacagacuucaggggcgggucagccuccugaaaugcugggcuguguuuguguguuuguggcugugagcauuucucaggcaggacugucauuagauucccaaaaggagcauuagguugucaggcaggagcauucauuagauucccaaaagggucuaagaauuuaaaaaaggugaaaaaaggugacaaacuacugaucagguuuaaagccuacccucauccccaguacacauagcacucacacacucacaugcacacacgcacacacacagagguuuacagguaaggaaacugagucuagaagaggcagacugaccaccacugaagugcaaggcugggacuagagaacuccugucccuaacuggucuggugcagcacucuucuguuagccugugcacaaaagaggccuguugggcugacuaugggauggcacaacugcuuuagaacacgcucugcaaguucucuggaugauggggcacaggacauacauucuggcuaacucauuuugcaccuugggauaacucugucuuuauaagacugaccuuuauucaucuuucugcccaugcucccacuguauuuguugagugggcgaaccuuaguggagaguacuguacggaagacaggucgguagcuuuaugcagccaguuauuugaacuaaagaauuaugaauccuuccuuuuccucccacuuuguuccccuuuccucacccucgugaccucugaucuuagggcaguuguuagcagcaggaaguggcccagaucauaaaccacuccuuccuugcaagcuacuuuggcaguucauuagugaccugaaaacucaaagcguaaaugcuucagagccgagguaauuuuuuauaaaauaaguaauucuuauaaggauaaaaauuucuccuaauuuaucugauuuguaaauuuggauauacauuuuaaauguuugaaggcacuuauuuauaacuguugggagaucuagcccuaauuuggauuuaucuucuauuucguuaggauguuauagaaugauaauagaugcaaaugagauaguuguugaaugcagcaacuaucuacgaucuaugaucucugaucugggcuagguccagagagagggguggguaaacgguuuacaucugggccauagaguuuggaaggccuagugauaagauauuuaaguaacuuggcaaugaaaggaacaucaaagaaaaggaaaaaugugucaaauuaagagauacuuaaagggcuuuacuuguuuagggaaaugagagaucaauucaagguguaucugucuagggaugacuuucuaaaagaaguacauuuguucugucuuagguaguuuccuguuugguaaagaugaaaaugaaagcauauucuaggaagaacaaugcgagaagcuggugugcaaguagaaaaugccaacauuuuauuguuuuaauuauguuaguuuuuuaaaagagcuuuuuaaaagauugcuaugcagugaaguguuagguguauuacgugcauuauuuaguuuaauucucaugacacaaggccggaacuauuguuaacuucacuuugccggcauuauuguuaaccucauaaaccaagguuuggaguauggacauaucuuccucaggcuugcacagccaggauucaaauuuagggcugacugacuccaaagcuacauugccacaaugccauacugugaccauuaggauugcaaugaagguguuguguuuauaagaauaaagggagacaaaacuuuaugggauaguugcaggauguuuaauucagaaucuuaagauaauggggagauaaaacuugacacaaauuuuuaagggaaguugccauguguauucucugaacugggugaagaacauuuauguugugaggcagggguucaauccuauuaggagguuucuuccaacugagagauucugugauguugcuugaauccuuuggcagaaacaugcauuaaggccgaauaaguaucuccauccuuauugcugauguaucacagcaagugauaccaggagccucuccuucuaacaaacucuuggcauguuucuacagguuuagugcaggagaccauguguucauagcggaugaccgucugugagccuaucuuuaucuagcuuuagaggcugacacaaaugagggagcaugcuguagaaagugccugugauuuggaacuggcugaacaugggcuagaauaucaguuucaccuuucaucagcugugcaucucagggcaaaauagcuaauuauccugagccccaguuuucugaucuguaaauggggacauguuuucauuuucugaaaaucgaguaugucaaguacuuaguccaucacacaagucuagcaccuaauccugacaacaucauuauccaugaucaucaccaucaugguuuuacacuuguuagaaccucuccauacaguuguauugugaggcuuaaauaucucuuuccuaggagaaacaauaaggaaaaaaaauucagucaauuugacaugaguacccuagcucaaggucucucaguaggggacagagaucuuggacaauggacuaaaagccaauuuacaggauugucgugaguauugagugagaaaaagguuaugaaauuauuuuguaaacucauaaaguuugauucaaauauuagaaugcuaaaauguuauuaugccauugccuuugaaggaauuaaacuaaaaucccauaacccuuggguucacaugagcaguacuucgcuaaagcguuugcaguauccagaaaggcuuccuccucgaggcucacuuugcuccuuucucugguuuuuggccuucaggaccauaaggccccuuuccaacuggcuggcauuaaagaugggcccacucuggcccgauccuggcaccagcaaugggauguugaccugucugcugagucuuggagcccaccacugccaaggacacccagcuggagcuaauuugcugggcugagucauagcaucugguuggaaccgguuucuuuuccaucacaaggaucucccugaaccuacugagagcucaccaccuugcuaaauucuuggguguggguggguguuuaggcacaguuagacuucugaggaggauccuuuuccagaggggagguuaugauaauaaacuugauaacaacugugaaugcuucaaaacugucuaucguuagugcugaaugguuuguaacaugagaauuacugcauaauccaaaguagggggaguucagggaaaguuagcagaguuagagaacguuuauuauugguuauccaggggauguucaugaaaacauucauuagugcugcucagaagaaagaaaacagagugucagcagagugcgccaaccugggcaacuuccauaggaaagccuggccaaucaaagagagcguugccucgggauagaaugggauuccagagcuuuaguggccagcacagcagaucgggacuugaccuuguaguucagggaacaaaacuguggcuuggaaaugcagggacuguggguuuaccucuugcauuugcguguuacauucuguuauuuauuucucuuuuuguuaacuuaguuuugucuucaaaggaucucugucaaacaguuguagaauagucaccaucaggcaaccaggaaauuuguccuuggggagcuacuuaagcaaucagaugcugacuuagauuguuguauaaucaggaagucugguucuaaucuuagccuugccacuguucugcuccuugcugcccagaguguggucuguggagucacagcguuaccugggagcugaugaaaaaugcagaaucucgggccugcuuagaccugugagucagaagcgacggcuuaggagccccagguaauuuaucugcacauaaaacuuugagcacugaccuaagugguaaacucuggcagggcaugggcauuuucuaguuucuuauuuauuauuuuguauccccagcgucugucugaaguuuaacacacaguagcugcaaaauccuugaaucuuccucuuaccuugggcauauuugaacuuguaggaacuuuguaagcuucuagggacuuaacuguaaaguggcguagggagaggacuguugaguggaaauggagccagugauugagaaacugaggugagcauagaaggacugguggugugaguuuuuuguuguuguuguuguuguuguuuauuuuuuguagagauggggucuugccauguugcccaggcuggccuugaacuccuaggcucaagccauuugccuaccucugccucccaaaguguggggauuacaggugugagccacugcgcccggccuaggugguaguuuuaauauagacgucuuuaacuuccuaagucaaagucucugaggguggaucaucaaauuuguauguuuuuauuuauuuaugccuuuaaaccacauucugaaaacaaaacuuuuguguuuuuuaaaguucucuuuauguuaaggaauuuuuuuuacaauguuacauacaauaaaaaugugaggguuccucaagaggaaauggauaaauacaauggaauagaauucagauguuuaaaucaaugaaacagggcuacguguauaaacaugaauaaaucuaaaaaaauguuuuugauaaaagaaaauugcagaggaaauaugagauaugguaccauuuacuuaacguuuuaaagaauccuauguguaauggauacaugcauauguaguaaaaggauaaagaccuggaugggaaagauaaacaccaagucuggcuaaugguuaacuuugagagggaugaagggaauggaugggagcuuuaacaguccuucauguuuuauuucuugagaaaaagaaagaaaaagcaacaaaagaaagauuacagcagcaaccauguaaaaauaagauuuuuaaauuuuguauucaaauuuuuuuaaauuguauuuauuuauuuuuaagacagagucucacucuguuacccaggcuggagugcaguagugugaucucggcucacugcaaccucugccuucuagguucaagugauucuccugccucagccuccugaguagcucggacuauaggugugcaccaccacccccagcuaaguuuuguauuuuuaguagagauggaguuucaccauguuggccaggccagccucgaacuccugaccucaagcgauccaccuuccucggccucccagaguucugggauuacagacaugagccaccaagcaagccuggccaguuuuuuuuuuuuuuuuuuuuuugagacggagucucgcucagucacccagacugaaguacaguggagugauccuggcucacugcaagcuccgccuccuggguucaccccauucugcugccucagccuccugaguagcugggacuacaggugcccaccaccaugccuggcuaauuuuuuguauuuuuagcagagauagaguuucaccauguuagccaggauggucucgaucuccugaccucaugauccgcccaucucagccucccaaagugcugggauuacaggcgugaaccaccgugcuuggccuuuucuuuaaagacagguucucacuccaucaccugggcuggagugcaaugguacaaucaugguucacuauagucuugaccuacugggcucaaggaauccuccuuccucacccuccugaguagcuaggacuacaggcgugcaccaccaugccuggcuaauuuuuguauuuuuuguagagacugugucucacuauguugcccaggcugguuuagaauuccugggcucaacugauccucuugccucagccucccaaaguacugagauuacaggcaugagccaccuugcccagcccaguuucuuuuuuuuuuuuuuuaaaaggaaugacuacauaauuguucaugauauguauaaucuuucugaaugcuuacaauauuucauuaugaaaugacuaacccaaacuucccugguaauugugaugcaggcaguuggcauguggccuuaaauacuccuaaggaccuuccaguuugaaauguauuuguacucagagagcucucucccugacccugucucuuguucucauagacaaucaugccuauaggacaugcccaaguccuguagcuucccugcauucuguccugaugaaaugccaugucccguguuugugaugucagugaauuucaccguucuaacucuuuagggacugagccugcagaagcuuccucucugcuguucgcuuuucuucuuuauuaaaggaagcauccuguucuacaacuacccugaucuuagagcgccagcucuagggacaucucccaucuucccuucugguguucauuuucauaacgccuucauugacacuucaguuugguggugggacuuagguguccaagugaaucccaagaauuguauugcuuaccccaagccucauuauuugccaucguucucuuauugcugugucugcuuucuuaacuuccuuucuauacuagaagugucccuaaaguuuaaucaguaaggaugacacccauuggucugugauucagagaauguuaagaaggcagaaaucucuaauagcuagugccaaagugggcuuuaaaauuucauuuuauuggccgggcacaguggcucacgccuguaaucccagcacuuugggaggccaagacgggcggaucacgaggucaggagauugagaccauccuggcuaacauggugaaacccugucucuacuacaaauacaaaacaaaaauuagccagacgugguggcgggugccuguagucccagcuacucaggaggcugagacaggagaauggcgggaaccugggaggcggagcuugcaguggagaucgcgccauugcacuccagccugggcgacagagcaagacuccgucucaaaaaaaaaauuauuuuaauuaauuaauuaauuuauuuauuuauuuugagauggagucuugcacuguugcccgggcuggagugcaguggcucgaucuuggcucacugcaagcucugccuccuagguucaagcgauucuccugccucagccucccgaguagcugggauuacaggugccugccaccacacccagcuaauuuuuuuuuuuuuguauauuuaguaaagacaggguuucacuauguuggccaggcuggucucaaacuccugaccuugugauccgcccaccuuggccucccaaaguccugggauuacaagcaugagccaccgugccuggcccuauuuuauauuauuauuauuauuucuaauauagucaauagcagugauucuaaaccaggggugacuuuuucaccuacagacauuugggcagugucuggaaauauuuuugguuucacaacugggggagugcuaccggcaucuaguggguggaggccgggaaugcugcuaaauauccuacaaugcacaaaacaaugccccaccccugcccuucacaacgaauuauccaguccaaaauguuauuagugccagguugagaaacccugcucugaagauccucauaccaugaauauagaccuaucaaggagggagaguggauggggcugcagcuccuuuagagugguacagugucacaggggauaugggaaucccggggaauuuauaugggcuaguccuauauuauguccaaagcauggugggggcuggaaaguucaugguauuagagaugaaggaugggagcauauuaaggaaaaaccagagaggaacaaagucuagcccauggggagacuagagagaagccaccucuaauguuuuugagcauggcaccuuaguguaaacugcaccuuugugcuauagaaacagaggauugcuuauuuaaacauauuaucagugcaaaaugugguaggucaugauagcaaggacccccagugaaucaugccccccgcacuguccacacucgucugcauugugacucugccauuccucucaucaagcaguggagucuguuuucccgccccaugggugugagcuggucuugucccuugccuugaccaaaagaauguggaggguguaaugaugcgugaugucuggggccacucagcuuugguuuuucucccucauggaagauuucugccaucaugggaggaagcccggccugaucuuuccuuuugagaaagaggcccaaguguccaggggucccagcccagcacacucccagccagccuucccacuaaugugcugugucagggaacacagaugaaaucagcucacccacccagcccaacccacggaggagggagaaguaauauauuaauauuaugguuaccuucagccacuaaacauuggggugguuugcuacacagcacgagcuaacuggacauuguguguguagaagggacuucauaucgagcaguggaugagguauuugguaugugcguaggguaucugucacauuaugguuaagagaaacugaguucuuccuccuuuguuucuuguagcacuucucagaacuucuggaugaguuuucccagaacgucuugggucagcuccugaaugauccuuuccucucagagaagagugugucaauggagguggaaccuuccccgacguccccggcgccucucauccaggcugagcacagcuacucccugugcgaggagccucgggcccagucgcccuucacccacauuaccaccagugacagcuucaaugacgguaaacucagaggaggaggaagaccuggaccuuagcgccuuugguucugagcucuugaggguguggaguguguauuauauuaaagagggugucagcacccuuauuagugagauaccuacaguguguacggccuugugcuugggcuguggggaaaagcaaagaggcccaggacccauuucucuacacugcccagguucccuuggaacuugcuauaacugaaggauggucauuacucucuuucacccuauggcuucagcagcagagcagccuuuugcaaaucaggccggccuaucuggcuggucauuccuaccaguacaguaagucucuuguuucaaggggucaugccauuuuuuuuuuuuuuucugagaaagaacuauuccucuauagaagcuucuugggcauccucucaacccaauuccaucauguucuauugaccccaugucccccaccccagaucuuaguggacauuccuagacuuucuuguugauuacccuuucaugcccaucaucaaugccaugagugugguauuuguugaaggucuaguuuuucuggccuuagagauguuaagauguuuugaccauuacucuacagcccuuaauugguaaaagcuguaucuuguuccaaacucuccaaggcauauauaucuuuuaaguguaauuuucuuuucuuuucuuuucuucuuuucuuuuucucucucccuuccuccuuccuuuccccucccucccuugcuucccuucccuucccuuccuucccuccuucccucccuuccuucucucuuuucuuucuucuuuuucucucucccuuccucuuucccucccucucgcucccucccugccucccuuccccucccacccuuccuuccuuccuuccuccuuuccuuuccuuuccguucuguuccguuccguucccucccuuccuuccuucuuucuuuauuuucuuuccuuccucccuuuccuuccuuccucacucccuucuuuccuucuuucuuuuuuagacagggucuugcucugucauccaggcuacaguucagugguaugaucucagcucacuguagccuugaccuccugggcucucauguagucauucagccucagccucccaaguugcugggacuacaggcaugugccacuacaccuggcuaauuuuuuuauuuuuauuuuuuuguagaaaugggggucucacuauguugcccaggcugguuuugaacuccugggcugaaguggucuuuccuccacagcguccccaagugcuaggauuauaggcaugagccaccaugcccagguuuaaauuuaauuuucuauguuuuguuuuccuagagggauagccagcuauuuuaguacuuuaaauuuuaaaaacucuauuuccuauucccaguccagcauaugccuucuucuuuacaggaggaugacauggugaggaauacucacuaacuugaccuucuugguguugguguucaccucuuguucuuauaccacuguacauauggcagcaucuuuugaagguggcugcaccuaucaacccaucauguagggauuuguccuaaugcugucccuccccuugcccgcuacccaccgacaggcccuggugugugauguuccccucccugugucuauguguucucauuguucaacucccacuuaggagugagaacaugcggguccuguucuguuccuguguuaguuugcugaggaugaugguuuccagcgucauccaugccccugcaaaggacaugcacucauucuuuuuuauggcuguauaguauuccaugguguauauguguuacauuuucuuuauccagucuaucauuggugggcauuuggguugguuccaagucuuuucuauuguaaauagugcugcaauaaacauacgcgugcaugugucuuuauagcagcaugauuuauaauccuuuggguauauacccaguaaugggauugcugggucaaaugguauuucugguucuagauccuuaaggaaucgccacacugucuuccacaaugguugaacuaauuuacacucccaccaacaguguaaaaguguuccuguuucuccgcauccucgccagcaucuguuguuuccagacuuuuuaaugaucaccauucuaaauggcaugagaugcccuuuaauugugaggccaaagcauucaccauucaguucccccagcuggggcuuuguucuauuuauagcucuuaggcugugacaggccgugcugguaauuugcugagaacagguacagugggucagauauauuuuacaaaggguuucugauccacaguucagcuuuuuugaaguaccagugucuuaucugaguaaaagucacuuuccuaggccagcaaaagcaagacaacaaacacgggauacuacucauuuaagaugugugaaaucagagugaggcaguguggaugaguggauggggaacuuguucagcaaagcuuugucuggaucuauuuuucugaguuguguggaugggcagauguuugggaacagaauuauuuuauucaugugaaccccaguuugcaucccccuuaagguggcgaucuguagggugggggaaucaauccacaaguauuccuuccaaacccaagugcucuguuagagcagauaaccacccugauggagaaggaugguuauuuuuaggcaacacauaaauauguagcauguauagacagcuauauacauuacauuuuauauucuuuaucugcugcauggugauaauagcuuaagcaaaacuaggaguccuuguguucagugauagauggggaauuaauauuucauuauaccugggaaagccagugauucagcucucacuguccaauuguacuuagauuaaauacaguucuucugcaauugcuucuaagccuggaaaaagagugaugacacacaguuaaguggaaacucccuccuaauuuauuagaguuuuucuccuuuuuucucccucugccuccugcuuccccucucuccuucuccuucccacuagaacucuucucuuucccucuuccuccuuugcccuuuuccuccuaacuuucccuuccucccuccauccuccaccugaaccccaggacaacugaaaagggcacacacagauguucuuauccuaucauucuaucacagacuucagaugaacuguggaccccuaaaacuguauacaaaaaugugggcuaucuacauuuguuaauuuuuugagaguuauuauaucauuucuuagauucucaaaagaguuugugaccaaaaaaaguuaaaaauaacuguucuaagauuccacaggaaucaucugucucagggggacuuuguagacuucugaaacacuagagcuaaggaacuucauguggcccagccaccacaggagccaacccuagaaauguaggugcagccuucaaaacccccagaaagacauccugcauccagcucagccauuucucccugugauuaaggcugugaaccagaugcuaagcaagguuuucuguucuacaaaaaaggcaacaacaacaagaaaacaccaaaaaaaaaggaagaaggaagaagaaaaaaaacaugucaugagguuaagagagaaacgcagaagcaucccagcaaaauauuuaugauacuuuuaugcuuugagaaacaaaagcuuguauuugaaugaccaagucuuguaccucaccacauggagguugucuuuaugaguuacuauauuucagucauguuccuuuguguaauucaguugggaugcuagguaugcauuugcauuguccuuuaauuuugguguucuuccuaaagaagaaacuagugcuggaugagggcuguucagagagaaccagacauggccccuauccucuaagaugauacaagaacagagcuaaagauuauauagacuaucaacagaccuuagcauaaaauaggcuaauacagaaguggucuaauacuaccuuugcaucacaaauguagucaaggguggaacaaaggaccgugacuauggcugucccaggucuacacagggugggccaggaacauggauaagaaucaucuuccuccugaugaauuuaguagggcuuucaguggcaagggauggcuggguaggcugguucacuacagauaccuuaaauuuauggagcuguguucucaggugggaaugaacacaguagucugugagguaaaggugagcggauauugcuggagcaaagucacaugggguaagugggacaggcuggagaagggcaaggacuaggguuuuaucucugccugaugggaagcagggacugagaaacauaggaucacauuuuuuggagcuuagaugaaacacagaagaucuuauggcugccaugcgagaacagggaaggugugcacugauauaguuauccagggagaaguggaaagguauauaacaugauggcaaagaaaaaauggguuuugaaaugauuugaugaaaccugcagcaggaaaagcacaggaucgaauaugcugaggaaggggcagagaugagucagagaugacuuagguuuuugcuuugcaguguugaagagaucuugauguugacaugguccauagaagugagacuugaaaaucacagaaaugaggugcauaacggugucuucaucacauauagcgugagcugaugacaagaacaucacucugaaucaucguagaguagccagacucagggguagaagagaaaaguauguguaucuacugagucacuggguccucugucaugcacggccaaagagagaaccugacagugauuggggaggacaggcagaggaacaguugaccucuuccaucugaagcuuggguuuguaauacacgcuauuuugcuauuccuccgcuuuuuugguguuaccuuuuacuuuuuuccaaacagauaaaaacaauagugauguuuccccuuuuuauuuuuugaaaaaaguaaaauaaugacuucucugcguagccauugcagugcuagauuaguauaagaaagcaauguucacauuaauccagcgauuacaguuacuuuggauauucauacaugagagucauaacuucuccauugaagaaaaaaggauguaguaaauauuuucuguuucuacuacuaucaccaccucuucaugccauucaauacugaaaguuauuucaggguuaagauacucaggaacgggccagggggagauaggccuguaacuuccauuggagcauguagugggcuguaguuuaauaugauucugacacauuuaacugaauucuugccccuuuccccagcuuccagagccuagccauuauauuuuuccuuuaagagauuuuuacauaaaaaaauuguucaagauuugccaacuccuuugaaaauucucaaagggcaaacaaaugaaaugcuaaaggauuuagaugaggcauauuuauuuaauuuauaaaauuuucuuuucacuuuagauauguuacauaaauaguaaauggauguacgguccgcccucccugugcuuggguuuugcauccuaugaauacuguauuuucaauccacguuuauuugaaaaaaaucugcuugugaguggacccgcaugguucaaaacccguguuguucaaggaccaacugcguauguguuuuucucauguaagugguaguacgucaucugauuucccuuuuuaagaauaaaugcccauucucucuauguucacauguauauauauauauuguguguguguguguguguguguauauauauauguguguauauauauauguguguauauauauauauauacguauauauauauauauauauacauauauauauauauauauauauauauauauacauauauauauauaguaaaccagaaaguaucugauacaggucccaaucaauuuaggaguuuauuuugccaagguuaaagacauacccagaacaaauaaacacagaaucacagaaaaaaucuguggucugugccuuucuccaaagaugacuuugaggacuugaguauuuaaaggaaaaguggcugaauggaaaagagggaggguacgguaauccauauguugcaagagagaaaaggagcagguaggggaauaguccauuacacauucaucuugugcucaguaaaucaacacuuuucauaagauaagauguauguugagcugggugcucaugacugugaucccagcacuuuggguggcugaggcaggaggauuacuggagcccaggaguuugagaccagccugggcagcaacacagugagaccucaucucuaucaaaaaaaaaaaaaaaauagcugggugaggugacgcacgccuguagucccaacuucuugggaggcugaggcggcaggaucgcuugggccugggaggucaaggcugcagugacagagcaagaaaagaaaaagguggacauagagugucuaccuguggagaucuuuaaccuuucauauauaacugugcuuaggaauaaaaggaaaggcaguuucuuggaugacucagcuuucagcuugauuuuucccuuuggcauaguggauuggggucaugaauuuuuauuuuccuuucauaauauaucaagauaaugccaacucccaauuuaggguuuuuuuuucuuucuuagcaaucaguauccauucaaugcgcuuagcuacguggcaccuauggaaaugauggaagaucugcauuuugauguugcuauuaccuuggcuuugaguucaugucuuuuucagucucuuugaugauuugccuaucuugaugauuugauaacuuggcaucuagccccauugcucauggcugcaccauuuugucuuuggauguaaaggacuugcuucucaccacgaucaguggcuuguuuuuauuuucuugcugacaguuaaguggugaagcugaggaaaugugccagucgaguuugaccuuugacaggaagcuguuuaaaucagcugauauggggguuguucuucuuacucuccaaacuguggacugcuaaacuuuaccagggauguuuuucgucugaaaugacauuuaaaagacuuauaaacacaaugcggaaagaacauuuuuauuuuuuccacucgguaucucagcuucaaguuuuagaaauuagaggguguggagugucuacugacucuuauguuugugguuuagccaauaacuaagacauccaaggauaauuccaguucuaagccaggguggcccuacugaucuuuuugccaauaaaguaaaacuacaaaaguaaggacauggagaaacauugugauacauauucugcuccuucuccucuacucuguccuuccuuaacccucacuucauagauuacauuugucauuuuguuuucugugauuugauauuuauuuccauugaguaagagaguacaagccaaccuccaguaguucagaaugaaagcuguuuucuuucauuucagcuaccacuggaaugcuguucucaccaaacuacuuacuggcugacuuucuucauaugaagucauuucguauuuugugauguaacuaguaggucugaucagccaaucuacaaacauuuauugauaugauccauaguugaugguuuagagaauuauuuuggaaaugaauguagucauuucauuguaauagauucuaauguaauggguuuaauuuauuuuucauacauucggcuauauuguaucagcuagcucuguugcggcauaacaaaccacccccaaacucagucacucagucauuuauuaucguaaucuaccugucuguuucugugugggggucagcagagugguucugcuaguuucagcuagauucacuggcaucucuaaggucagcuaauaguuggcuggucuugacuaagcuccucuggaggugacuguucuauguggcugucauccuucuccugagaucacuagauuauccuagcucauucuucucaugcugauggcaaaacuacagcaacauuaguuccauccugcaagcacauuccaaaacuccgcuuguauuaaaaagcucacauaccaaugguacaucaagccacaggaccaagcuguggguggggaucagcccaaggugggaggucacugcaaaauucuaaggcaaaagacauggauggagggaggaggaagaccuggagccaggaaugcaacuuauuuacauaauaagggucucauugacucuuacugagucaagggcuucuaaacacccccaugggcaauuacaaccucuacccaauaauuaccauccuaagccaugaaguggagcaggccaugucccuguguguucauccaaagacaauagugucccaagguuggaaaucuagaaguaccauaaaauuuaaagaaaaagucauucauguucugaacgauuauccagagaugcuuacuauuuggcauauuucuuuugaugcuuuucuaucacuuucuucuuuaauaguuauagauuuuuaucuagaguuuuugucuuaauauuucauuauaagucuuuucuuuguaauuaaaaaggcuguauacauguaauauuaaugucugcauaaauauuccauuguauggaugcaccauaauugacuuaaccuuucucuugcuuuuuaauguuuugguuauuuucaguguuuugucaucauaaacaaugcccuagugagcauuauuuaugcauaaucuuuauccacauagaaaguuuucuuguuaaugggaagauuacuggccagagugcagagaucuggguucugccacuaauuugccaugugaccuaggcccaggugucauuuuccucaucuagaaaugauaggcugggugugguggcucacaccuguaaucccagcacuuugggaggcugaggcgggugggucaccugaggucaggaguuugagaccagccuagccaacauggugaaaccccgucucuacuaaaaauacaaaacuuagccagguuugguggcacacgccuguaaucucagcuacuugggaggcugaggcaggagaaucgcuugaacccaggagguggagguugcagugagccgagaucacaccacugcacuccagccugggugauagaacaagacugucucaaaaaaaaaaaaaaaagauaucuuugagcucaauggccuuaaaucucuuuauaacucuaaagcaucuuucaggaucaaggacuaaauugcuguauuggaauggaagcaugaaagcagcgccuguuguuugcccucaaaaaagcucaggggaggagaggccgcuuccuugggcuucucucuuggaaauguacaguuguccuugagagagaagguuuccuuuuauaguucaaguaccaucacuugcccugugguuuccauucccugaggcagcacugaugauauuuguauguuuguaaagagggcuauaggacacugggcauuaagaauauuaaauggucuugacuuguuuuacgaaugugcacacuuugagaauggccucacuagauuggaauaacugauucuaucuaucacccaucuucauuuuguuuuuuguauucacuuuuuuuuuuaacuuuugccucuucuuuuguuugccuugugaauuaaguuucaucacaguugccuucacugcacagucaagggaucuggccuuaucucacaauuuccugguaauugugugcgaccuuuuucucagggaugcuuccuuaccguccauuucagccuguacugaggcuauauuucauccuaccgucuuucuuccagccuuugccagggauaaauauuacucagugugggcaggcuuuaaguguugacuucaaaaagcaaaagcauggcuguucacgguggcucacaccuguaaucccagcacuuugggaggccgaucaccugaggucaggaguucaagaccagccuggucaacaugacaaaaccccgucucuacuaaaaauauaaaaauuagcugggcgucguggcguguaccuguaauuccagcuacucaggaggcugaggcaggagaaucgcuugaauccgggaggcggaguuugcagcgagccgagauggugccacugcacuccagccugggugacagagcaagaaugucucaaaacaaaacaaaaagcaaaagcaucaccaugucauugccgaauggaaaaaaugggaucuaugcggucucugucucuccagcccuucccuaacuguccuaagcggguguucuuugcagcggacauugucuucuagcuccuaagcuccuuuggggagagucaacggaaucuuuuggcucgugguccaguugcuccaucucugggcugagcuggggcacggucugaguccaguacagaguggucucccuccucuggccgccaucagagagcccuuuguucccccgcccuccccuuccaccaggauguggcgcacaccccaugaaggauggaaauccccgucacaccauagcacucagcagccccacucuaaaagcaaaacaucuuccaccaccugcccauccugucuuuauuucaccuugggaaauaaauugaggcugggauaauucaucaauuauaaacuggauuuaagggggaaaucauuccucaaauaugaaccuaacauuuuugugcuuuaaagaagucacuuaugaaacauaauuuuaauaaucguagauuuuaguucuuaguuucugugucuacccuucccuucuucuuagcgguucuaaaugauuguaccuuuucauaagaaaacuggagucacauucuugaauguaaaauaaauuuauaaugugaacgacuuugcucuccugacagucaugggucacuaaguaugugaaaugugguguauguguguaagcauuuugagaaagcaaaggagcgugucuuugcuuuauuuuagccucauuuuaguaaaacugguaucagcuaaggaacguugccuuuggcuugcuuugucuuguucuguggcuguuuccaacccucuggucguuuccuuuccuucccuccucccggcuuuuccaggcagugcugagcgcuagcuccaaaguaacuuguuaagaaauacaaauucuuauucuuuuagacucugagaagaaugugcauuaaguggcagaggcacucugucuguuccgucuugucucucgguuguuagcuaucuccaggccuggugauaaucaggaaagacaagacccagacucaccaagaugcagcuguuuucucaggaagaguauuuuguccauuucagcaaagggcagaugguuauuacaaaccaaagucucccaaagggcuaagcagagucucugaaagucuaaguuagguuuaaggcuaggugggaucacagugaaaacagaagaggacaaaaacaaacaaaaaaauggagugagaagaaaaaauaucaaaaaaccaaauaacuuuccuuuggagagaaggagagagagaccuacucaccauguucucucaucuucucccguugguuaccaaccauuugcuugcuucucucucucucucugucgcucucgcugucacucgcucucgcucucgcucucacucucacucucacucuugcuuucucucgcucccccucccccucccuucccuuucucucucuuucuuucuugacagggucucacucuguugcccaggcucuggaguacaaugaugugaucacagcucacugaagccucgacuuccugguuuaagcaauccuccugccucagccucccaaguagcugggaccacagaugcucaccacugcaccuagcuaguuaaaaauuuuuuuuuguagagacagagucuugcauuguagcccagguugguguugaacucaugggcucaagcaauucucuugccuuggcaucccaaagugcugggauuacuugcgugagccacugugcccggcugcuucuuucuuucauguuuuuaaaugugcuuauuuaucuauuuuugaauagauaauacauuuacaugauuugacaaccaaaaagaguagcucauuacauauucaaaauccucccuccuauucuauuccccaucaacccagguuucuuccugccuuucucaggaagccaaguuucuuucuuuucuauggauuccuuccagaguuucuuuaggcauacucacaugcaagcgaauacaaguauagauucuuucuuugcuguucauaucuaucaaucuuuucccucacauauuucauuuucuuuuauucuacuuucaaucauccuucacugagcuuuuuuggggagaaagacuaguggucgcuuguuuugcuuaugccugaugcccugaacaaguucacaugugugcuugucuuuuuuccugcagaugagguggaaagugagaaaugguaccugucuacagacuucccuucaacauccaucaagacagagccaguuacagacgaaccacccccaggacucguuccgucugucacucugaccaucacagccaucuccaccccguuggaaaaggaggaaccuccucuggaaaugaacacugggguaugcucaauuuucgucuguuuaaacagguuggauuaaaagauacagauagauccucauucuccaauaagguguuuaaucuuuuuggaguuaguggcuguguacauuuaaggacaugcaacuucauauguguguauauacauauguauacauuuaauaaggguauguugauuuggugccaacuuccuuuaaagccauuguucggaaaaaauuaguagcuaagcugauuucauucucuuuuugauuacuguuacaaaauaaaaaacacagaaaauaucuaugguaaaaaaaauuucucuauggcacugauuuuuaagcaguggaaagggagugauugaaguggugauguaauccauggcuuacagugcauggcuacugggaaugugagcuccuguguaauauuuuacuuuccuagugagaugcugaguuguccuuacucaagucaggaaugucccacguauugauucauauaauaauaugaauaauauuaacaauauuaauaacauuauaauaauaguaauaguaauaauaacaccuauuauuguguuacccguggaaagcauaagaaaucaggauuuuuuccuuacuagauuccaugccuaccgcaaguagaauuuaauucuacucuaccuucuuucuggauauuuccagugucuggccauggaccagcauuguauuuguacaucuucuugcaaguguuggaagccugucuuagcuucccuuaaguucaaagcuucagguuauaaacaacaacuucauuaacauuccuuaagucagauuucuugugagcaagauagaaugucuaucugcagccgggcacgguggcucaugccuauaaucccagcacuuugggaggcggaagcugcagugagccgagaucgaggcacugcacuccagcuugggcaacagagcaagacucugucucaagaaauaaaaaaaaagaaagaaagaaaaaaagauguagugucuaccuguucagaauaugguaacacagaaucaguagacucauuaaagugucacugcuuacucccuugucaguccaucuguguagaugaugaaggguuguagacagaggccucugcaagugugcuaggauuccuuucucaguagcuaccugagucucuuuauuaggcugggcucucuggucuauauuagucuccuugcuccacagaauuuuaguuacuuuauuuauuacuuuuuuuuuugaaacagaagucucauucugucacccaagcuggagugcaguggcaugaugucagcccacugcaaccuccgccucccggguucagugauucuugugccucagccucccagguagcugggauuacaggcaccagccaccacgccuggcuaauuuuuguauuuuuaguagagaugggguuuuaccauguuggccacgcuggucucgaacuccugaccucaagugacccgcccaccucagcgucccaaaguguugggauuacaggcgugagccacaugcccggccuaguugaauuauuguaaaguauguaacuagcaaagcucagaggcauggccuugcuccuguguaugggccagauaacuuuucuccuuucccuaccaggauuuucgugauuagauaccaucagucauuaggaagccuuaauaauaacaucauuaauauuaauuauuaauaauuauauuaauuguauuauaacauuauuaauuauuaauauuaauaaaguuauauauaagagaaaggauguggcuuggugcacagucccuaccccagggcaagcugguggaggccuuugacucuuuaaaauuuaguucccauuuuccauggugauugacucgauuuaagugcauuguggcuauauguaauuuacaggcugcuuuacguugcaggcagggaaaacucccaggcuggugugaggcugaacugggauaagagacccccuggccccuccuuauucugcuaaggucaccaccucuuagaaggucucuuauuuucuuucagugaucaaaugcacaguuacgcucuacaacuaaauucuguagucuugggaauccucaccaguaucaacuauaaguugcuuuuuaaagcccccaaaguggagugaggauagggggaguggaagcaguguuugguucuuacuuuacccaaacuauguauaaagaauaaaguuagcagaaugaugccacaaaaaaaaaaguaccagaauauuuuguaauaaaaugccuuuauaguacuauaaaaacauagaaaagaauauugauauaguuuugggcuugagcauuuggcuuucaacuuuagaguucugaguguuuuucuuuuucuuuuuuuuucuuuuuucuuuuuuuuuuuuuuugagauagggucucacucuguuaccuaggcuggagugcaaugguaugaucacagcucgcugcagccucaaauuccuggguucaagugauucuccugccucagccucccaaguagcugggacugcaggugcacgccaucacaacuggcuaauuuuuguauuuuuuuggggagacguugucucacuauguuacccaggguggucucaaggaaguucugaagguccugucagcuguaaugccaaguuuggcaaugagaaaaagguuaagaacuaaaaugacucccugucagggaaguugccuacacucagcuauucuccaggauaggcagggcugucccgagaggaagacacaggugacaaauagcucuccugcaugugucuucaaggcugugauugguuuuuaaaaauuguguuugaaauucuuccuccagguugauuccucgugccagaccauuauuccuaaaauuaagcuggagccucaugaaguggaucaguuucuaaacuucucuccuaaagaaggucugucugcccucccugugucccuuuggguuauggauauggucucugggucuacagagagggaauauggcgagagagcugggaugaguuuguaccacagauguuguagcuggcuuuaugaaauagcucuguucuuaaaaaauaaaaauuuugcuuccaaauaaaaauuuugcaagcuaacuauuauuuucccauauaugcacgugauuaaauuucagcuaaguguuaccauacuuuuacuucuaaccagggugauauuuuucaaaacuuuuauggacugcuacuacaaacacuaucgaacaagagaacugcagcccuuauucauccaggcgugaacccuacguagccccacaaaucaacaaccaucuacaaaagcaccuugcuuauuucaaacaacucuaguuucaacucuuugugaaguaaauucacaauuaauuauguggccaauucauuguuuguaaacauugacuuugaaugacaacuauugcaaggagcccccucucuauuuggucauguucaugguucacaauugugcaucuuuuugggcuucuugacauccauccauuuagaauuaacacauccuugaggugaucauacuuuuuuuuuuuuuuuuuugagacagagucucacucuguuaccaggcuggagugcaauggcaccaucucggcucacugcaaccucugccucccagguucaagcgauucuugugccucagccuccugagaagcugcaauuacaggcgugcaccaccacacccagcuaauuuugguauuuuuaguagagacgagguuuugccacauuggucaggcuggucuugaacucucagccuuaggcaauccgccugcuucggccuccugaaguccugggauuacaggcauaagccaccacgccuggccaagguuguuauauuucuauauuuaucuuucucuaugucaguuucuuucugaguuucucccucuuuguucuccuaugaagcccauaguuaggaauccuggaugcagaccccugagccucaugaggucuaaugaagcucucucugccuugcguaugcagauucuccggcauacauccugcucuucucacuucugugccuucacucaugccaucacuucccuuuucauucauacuuuuuauuuauuuauuuuuugugugugaaacagggucuuacucuguugcucaggcuggaguguaguagugccaucauggcucauggcaaccucaaccucauggguucaagcgauucucccaccucagccucccaaguagcggggacugcagacaugcaccaccacgcccagcuaaauuuuguauuuuuuguagagauaggguuucaccauguugcccaggcuggucugaaacuccugagcucaagugauccucccaucuuggccucccaaaguguuaggauuaaaggcaugugccaccucacccggucccauucauacuuucaguacaaauuucaaaguacaguucacuacuguggucaacaaauaagaaauuggcuuauacaguugucaccgaaaagguauauuugcuacgguauauaaaugugaggauguuuacauaugagcacuucucaugaaaauaucgucugucuucauuccauuagaaacuaacucaggauuugguuuguaacaauguaaucagggcuggcccuuuauuugccuuuauuaucaauaaagaaaggauuaaauuuuaaaaguuaauaauacuuagugaaauaauacuuaguaaauaauacuuauuuacuuaguaaaaguuaauacuuagaauccauauugagacacuaugucuuugcacugagugacagacaguagugccuuucagcuuuauguacugcuucaaaguaauugcuuucguuuguauaacaccaguuauuacuaucaaaugcaucuuacucuuuuaauuuaugcugugaugugguucagaagugucaucaccauaacaaugaaucccauaguggcuucugaauccaggguuauuggaggagaaauguuucaagaaugaaguuaaggacagcccuuccucauuauccuggauaaacugagauaaggaaauucaauauccuugacugcaucaguuucuaggcacaguagcuuguuguccccagaccuugcaguaacccaaaagcagcauuucaaaugauauuuagaaaucugauccugaggugccucuggccagcucuguagcucuuaauagauaggaaagacaagauuuuacuugcuucacuugcuucaaauucucuuucugucuuuuguggggugcccucugcuuggacgggagaacgguauuagaauaauuuggccccuaccaagugaaagggacaggguggcucuagguacuccuggcuaguucuugggaauguaacagcacaaagccccuauuagguucgucugcuucccguuuuuuuguuuguuuguuuuuuuguuuuuaaaccaugaagugccauaauauucauggcauucgagaaaccuugauuaacacgcuuaggacuccucacucuuagccaagcaccugcauauuuucccuuccugggcugccugcaccuguggcaguagugggaauagcgcgauuaggauuauuuuagcauauucuuuagcuuuaagagugcccacagagacuaaaaagcccagggaccucuuuggcaagacuggcagagaaaaagggaaagaggaaacaucuagagaaaagcuguauguggcagaaagagaaagaaagggugggagagagacagggaaucgcaaugagagagagaagaaaaaaagcaugccagggccggggggaccaggguuggcugacggggcauugccuguuguggccucggcuauucagguauuccugcaggagagagaugcugauugcugcucauccucucugagggcaguguauuagucuguuuucaugcugcugauaaaguacccaagacugggcaauuuaugcagaaaaagagguuuaauggccucacaguuccacguggauaaggaggacucacaaucaugguggaaagcgaaaggcacauuuuacaaggcgucaggcaauagagaaaaugagaaccaagcaaaagggguuucaucagaucucaugaggcuuauuuacuaccacaaaaacaguaugggggaaacugcccccaugauucaaugaucucccgcugggucccucccaccacaugugggaauuaugggagcuacaauucaagaugagauuuggguggggacacagccaaaccauaucaggcagcuauggguaaggucaucuuuuuugggucaguuguugugucucaggagagcccuucccauccauaguaugcuggguggucuccauuggaagaagggacaaggaggugaugugcugaggcuucccguggccuucagcaguuaguucucuggccgagcagaaccagcugugugggccaugcccaccacggggcugcuguacaggggaauccauuguccugggggcuccaggagugaagcguuuaccugcaguuaucucccuuggcucaguagcaguggcugguacaacagaaaugugcacuguucagaaagaacagugagacccaagagugcuuucauucacguggaagccugguuggauuccuccuucagaagcccaucucugcugcccuggagaugccugauggacgcugaccaaggcuccauaggcccuggcagagaggguguugugccuccuugaggaaagacgcgggagacuuuagaggagaaaguccccccacugcacucucacuuauuuuuccugugcucacucccguaucugaagauggauuucauguuuucugaaugaagaaugccuggcgucuugccugcgggcaugaccacgcacauugcuccagaaacaaaccggcuuuuuucaaagcagccacuccggcuuuuugagauggauucucgcucugucacccaggcuggagggcaguggugugaucuuggcucacugcaaccccuaacuccuggguucaagcaauucuccugccucagccucccaaguagcugggacuauaggugugugccaccacaccuggcuaauuuuuuuuguauuuuagcaugaucucggcucacugcaaucucugccuccuggguucaagcgauucuccugccucagccuccugaguagcagcugggauuauaggcacgugccaccacgccaggcuaauuuuguauuuuuaguagagaugggguuucgccauguuggucaggcuggucacaaacuccugaccucaggugaucugcccaccucagccucccaaagugcugggauuacagccaugagccaccuugccuggccccuggucgcacguuuauugguuucuuguauucacuuccaguguuucuuucugccaguauaagcaaaugugggucuauauccucuuucucuccuuuuucauacaaaaggaggacucccauauccacgcucugcaccuuggagaucuguccaggucagcucauggaggccccucacacuuuaguuugcuaugccacaaaucaguuguguccugcuuuguggcucugggauggaugagaugugcuuccuuuuuugcagccccaguggaccaccugcauuugccgcccaccccuccgagcagucacggcagugacucagagggcagccugagucccaacccacgccugcaccccuucagccugccucagacccacagccccuccagagcugcaccccgggcccccuccgcccucuccagcuccccucuccucacggcuccucauguaaguaugcagcgggcauuccuggaccaaagggaacccucuccauucauuccccuggggcuguauccagagcaggaccacucaaggcuguuugguuuuuacuuuugucaagaaguuucugcuuaauggcgaaagcagagugaugucaacccuaaagaacacuuucuaggaacugcccgcacaucucaccuuuuacuaccacaauucucuuccuuuucacaugcacacuuccaguuuuuauucauauguuuauuuuacagagcuauagacaugaggaauaaaaauuugggguuuuucuccucaaaguucuaucauaaauauuugcauuaauuuaaugguccuugugaccuaugucauaggaaauaccuuuuauauuuuaaagaagcaauuuuuggugaacuuaaaaauuacucugagauuaauuucuuugaugccuaaaggucaaaaacaguuuaagccuuuucugugugucauaugacucuuaacccagaaacucagaucagacaucaagaccccucguucaucccucccauacaugaggacaccauaauaaagaagaauagaucguuaacuccuuauuguucuaggagugaauugauuucuaugaaauuuuaaaaauuauaaucagcuauuuugaauucacaaucucacaacuagaaaauuuaaaugaaaugagauguuuuaaaauucuguaaguaccauccguccauuaauuaacauaacuuugaaaauuuguauugauucugucccugaaaguucuagaucugcaaccacauucuuaaauuucaucguuacugaggacaagggaauucacccuuccacucuuucuucaccuuuucaccuugaaccugacuucacuccuuggauuacuagaauagcuuguauccuauauaccuguguguacuacuaugaucuguccauucuacauguuuauggaggaacucuuccccaugucggaugcuugcccaacaacuauguuguauuucccuguuacuuguugguaccaagcccugacaccuuuacucauuaucagguauccaacccuccgcugcuucaagaacuccuuacccacacuaggcaguggcuucuucagugacuuuucaaaauacugccuuuugcuuagaaugcacuccucucucuuauguaaaucauccccuuucuuucaggaggcccaauucaaaucucaucuccugcccuaaacguuuccugaucacacaacucauaguaguguucucuuacuucaaauuuuuaguacaccuuuagcuaauguauuaguccauuuucaugcugcugauaaagacauacccgagauugggcaauuuacaagagaaagagguuuaauuggacuuacaguuccacguggcuagggaaaccucacaaucaugguggaaggcgaggaggagcaagucaugucuuacauggauggcagcaggcaaagagagagcuugugcagugcaacuccuguuuuuuaaaaccaucagaucuugugagauucauucacucucacaaaagcagcaugggaaagacucaccccauaauucagucaucucccacugggucccucccacaacacgugggaauuaugggagcuauaaaaugagauuuggguggggacacagagccaaaccauaucagcuaagauuacaguuuagcauuuaauuacucuuauccuuucauggguaucaguucagucucacagucuugaucacaagcugcuugagagguaggguuuguuuugaguccuccauggcauuuaguauggagcuaaaaugcaauagggacucuguuugauuaauuauaaacaugccauucuacuguggguuccaugagaugugcuacuguucuugucuucauuguugauggacauucugagacugcugaagccagaggcuucuguggaaagagucugcagaugugucccugggugcucugcacucuuagcuaaaaguggaggagagaauugacuccuguuguguagagagcaccuuauaaaacugcauuuucagaaggagaacaacaaaauucuugcacaaagcagggcugcaaaugaauccuucaucacuccaaggccaggaaaucucuagggaugugggaaaugacuucucugcuuuuucuuuucauguuuuagcgaguagggugcuucccgggaaauaauggguggaggcuucuuuauucuuucccuugaauuauaaucccuagguuauaacacucacaugggggugucuuccccaucuucccaugcccuucaaaauacccaucugucacccaaagcagauggggcauccuugucucagagccuucuguaagacauuguaacagauucucaucaucccauugggaggugauucuucaguggucccaguucuuuuucuuugacccuuuucugcuccuuggucugcacagaaacugcagggaucaggcccucugguccugacagaggaggagaagaggacccugaucgcugagggcuaucccauccccaccaaauugccccugucaaaaucagaggagaaggcccugaagaaaauucggaggaagaucaagaauaaggugagcucuucaaaucuaggcacuucuagagcagagacgagcagaaucgagucagcaucccuuucccugccuucccaacggccagcacuaccccaucccaugguggagaccaaggcccagcccuucccuucccuaagcccugggaggagcacccucaccacgugccccucucuuccuccagcccaucccaucccucuugaggccagcagacucccagaucaguaucuaccucuuuggugcccacgaugauacauuuacgggugggaggaagcuauuagaauuuccaucuaguuuuuuuuuuuuuuuuuuaacucagccuuuuaaauuuuggguguaugauauauacaauaguuuccucuaguagacauauauauguacucuauguaucuauauaaaauacagcauauauauauauuauauauauauaagauacaaauacauugcaagugcuugguuaauuuuuuuuuuucuugguaggguuuugugaucacaaaacuucugcaguuugcuggucuauauuuggacucaguagucuccuaccccugggccccucagugcugagcaggccugaugaaaaccagggggauggcugaggcacaggccuaccaggagggagggggcaaagagggaaggaagacaagagcuuagugucacucuauccaugugcggaaccagcagcaaguugauguaugaccaagccagcugucuuauuuuauauauguacuucagccagcagagguccaggaguuaaacucauuuaucugagaccacacugaugguuugugagccacauguucuggccuggcucuucacucaguguccauuguuuucuuuucuuuucuuucuuucuuuuuuuuuuuuuucauacagagucucacucugucacccaggcuggaguguaguggcaugaucucggcucacugcaaccucugccucccagguucaagugauucuccuaccucagccucccaagcaucuggaaccacagacgugugccaccaugcccggcuaauuuuuuuguuuuuuguuuuuuguuuugagauggagucucucucugucaccuaggcuggagugcaguggcacaaugucagcucacugcaaccucugccucccggacucaagcgauucucuugccucagccucccaauuagcugggauuacaagcaugcaccaccgcgcccagcuaauuuuuguauuuuuaguagacgggguuuuaccauguugcccaggcuggucuugaacuccugaccucaggugaucuacccgccuuggccucccaaagugcugggauuacaggcuagagccacugcgccugccauuuuuuuguauuuuuaauggagacaggguuucaccauguuggccaggcuggucucgaacuccugaccucaagugauccgcccaccucagccucccaaaguguugggauuacagguguaagccacugcuccuggccacucaguguccauuuuacugguggccugguuuguaggaaaguaggugugaguuuggcagcuagaaacccgggaggacagacuagucaaugaaccagcagcuuaaacaaauggcaagcagcuugcagaaguaagcagggcuuuggugacuucuacgcuaaccaccucccaucuuaacugguuuacuuacagagcuggaaauuaaucauucuccucccacuccucucucucagauuucugcucaggaaaguaggagaaagaagaaagaauacauggacagccuggagaaaaaguaagccugcuggcaaacuguugcguucaucgggcaguaugcacagggaaauaugggugugcggagaaucggggagaagcaguucaauuccucuuucuggccaccuuggaaacccggugguuuaucagcugugguuugccugccaccuagugguuauuuggaggagacgucuauaauaaagcaagaaagaagugaaaguaccuuaguagguguuugaaucauaccacugccagccaaggaccccggaguccucacagacuucuuuucaaacacauacaaauauuaacauuccugcacauuccuggaacuucuagcaggagaagcccuguuuuagcugaaaggagcagugcuacuuaaucagcccccauuggccacacuccuucaugcucuagagagggcacauagggaaagaaagaugucagguuggcagccuuuauuuuccagccacuacaauucauguuuuuuuuuuuuugcaaaaacacuugaaggcaaucuuuguucuuuugaaaagucuguaauaucaggcgggcuguuagaaaaagaugaauuaaauacaguuuugucuuagcccuggaaguuaguucuuuagcuaacaaaccaagauauuuuuaagaugggcaugaggccccagacccagaaaugaacuucauguggaucuggggaaaggaguggcuggugguuccuggcuguuucucaaagcuacuauugaaaguuuagugcuucuaucaccugacuuaaguacugguaaugcagcauuaaguauaguuggcucuccauaucuggggguucagcguccucagauucaaccaaccaugggucuaaaauauucagaaaaaaacuucaauaggcugggugugauggcucacucuuauaauccccgugcuuugggaggccaaggugagaggauugcuugagcucaggaguucaagaccagccugggcaacauagccagacccccuaaaaaauaaaaaaaaauuagccaggcaugguggugcacaucuguggucccagcuacucaggaggcugagaggggagaaucacuugagcccaggaaguugaggcugcagugagcugugauugugccacugcacuauagccuugaugauagagugagacucugucucaaaaaaccaaagccaaaaccaaacaacucaauaaaaaaaaacuacaacaauaaaaaauaauacaacuauaaauacaagauaacacauauuuacauaguauuuacauuguguuugguauuauaaauaaccuagagaugauuaacauauacuggaggauauguaaagguuauauacaaauacuacaccauuuuuuaaucagggacucgagcaucuggagauuuugguaucuguggggaguucuggaacuaauccccccugaauaccgugggaagacuguagucccaugcugucccaccauuuucuaugggcauccagggucaagauguuccuaugaaagucucuuuacugucucuuuugggcaugcgugccccagcaccaggauuccuaguccugggcucucguccugcccuuugcuuaagucucuucacuucuuaucaguccugguaagaguguagcugggaguauccagauuacuguaguauagagggagaaguaugaugggcauugagaacacuagggaggaggugagaggaaagagguuguaacacccuaaaagagggucauauuuuguacugucacuauucaucuuucauuauucaggcacucaucacucagcucccucuuuuuuuuuuuuuuuuuuggagacagagucucgcucuguggcccaggcuggagugcuguggcaugaucuuggcucacugcaaccucugccucccagguucaagugacucuucugucucagccucccaaguagcucggauuacaggcacacaccaccaugcucagcuaauuuuugcauuuuuaguagagaugggguuucaccauguuggccaggcuauucuugagcuccugaccucaagugaucugccugccucagccucccaaauuacugggauuauagacaugagccacuacgcccggccccagcuccuucuauuuuucuuuuuuuuuuuuuuuuuugagacagaucuugcucugucacaaggcuggggugcaguggcgaucuuggcucacugcaacaucugacuccuggguucaagcgauucuccugccucagccucccgaguagcugggauuacaggcacgugccaccacgcccagcuaauuuuuguauuuuuaguagagacaggguuucaccaugucggccaggauggucucuaucuccugaccuugugauccgccugcuucggccucccaaagugcugggauuacaggcgugagccaccgugcccggccuauuuuuuuuuuuuucuuaagucucuucauccuucuuucaauacuuucccacacuuccaugggguggcagauccccccaacccuccuuuuccucauccccaccuaccuccacccuagcuccuagcuuaguguuugcucuauggauaauaauuuucuucuuucucccuccuuuguagaguggagucuuguucaacugagaacuuggagcuucggaagaagguagagguucuagagaacacuaauagguaagugucacuggacugagagcugauugcgcuaccaauggaagauggggaaggaagaggauagaauccagaaccagggauggcagaaaaguggaggaggucacagugaaagugcaguugugcugagaugcucagcauggccaaacuccacccacccacuccugcuacacacacacgcaugcacacgugcuacucuugcacauauacaaacacauaugcacacaugcucucauguucacauccacaauacacauauguacacacucucauaugcacauacauguacacauacaugcauauucuuuacuuuuccuaaaugauacaggauugaagaagaagcugaucaugacaaggacuaugacuaggggguuaaaaaagaggcuuggaggagaauaagaucaacaagccugauucuccugaaaaugacaucaaaauuuagaggugaccaaggaggcacuggccacuucauuauaaucuaauuuuaguagcaaaugauacuuauuaguuuaaaaaaagagaaaaucauugguauuuuuuuuuucuuuuuuuugagacggagucuugcucugucgcccaggcuggaaugcaguggcaugauaucggcucacugcaagcucugccucccggguucaagugauucuccugccucagccuccugagcagcugggacuacaggcacgcgccaccacguccggcuaauuuuuguauuuuuuuuuuuuuuaguagagaugggguuucaccauguuggccaggauggucucaaucuccugaccucaugauccgcccccaccuuggccucccaaaaugcuggaauuacaggucugagccacugcuccggcugcaaaucauuguuuuuuaaauuaguuuuuuaaaauuagcuaguuuauuaauugcauuucaaacccauuuuacaaaaauuguaacgguaccaaguugauaaauuccucuagcacuugcugugcccagugcuauuuuaagcacuuuacagcuaugaacucauuuagcccuaugagaugccauuauuaucauccucacuauauagaggagguaacugaaacucggaaagucuaggugauuuguccaaggucacacaguaaccgcuaaagcugcauuugaacccaggcagucuggcucuggagccuggaugugggaggaguauauggagguuuaugccuggcucauaugcaagagaaaggggugaaagugcaggguuaagaaacuggcuuuuggggaguuucauccagaauguauguguucaugugcacacaugauacauaccugugcugugacaauuauuucuuagagacuccugucacccugaguguuagagauccaacaaauuaagcagagaaaaauggacuuacuggguaaacaaaaauuuaaucagauuaagggucaguguuaaugcccaguaacaauugugcaaauauuaagggaucaguuuaaaucucuuugcauguuauuugauaauaacaaaugaauuuaauucccguuuccugaugcuucaugguuuguugcucaaaaagccagcuaauauagacauaagcuaaaacuaccgccagugggaucccccugaaauuuucucugcauuucugggaaugugugcucagauagcagucaggggcaguucaccccaagugcucuguaagacagacugcccaaagggaggaagugccaccaacuuaguguggcauuaccuugaucucaugaggcaagggagcugguuucacugcuugccuuuggccguuagucugcuggggcuuccucuguuuuuaucuccacuuccucucccuggggggauugccugaggcggcucuguuucucuggauccugcuccccgagccagcauauguaugcauguuuuuagcauccugagccgauaggcguucccggcacccauccuggcacuugcuuccgcagcagccccauguucaugggugggugggacaaauccuggccaagaauuggcgaaaaggggaagagcaaagaccuccuuggaguuuguguucagguuucguccucuacaggcuccgugucaggccuucccugggccacaugggggcagcagaggcacagcagggaugugcuggggcgaaguccgggugugugagggagaaggaccgaccccacuaccuugccugggaagucucuccucuccucugcagguggacugugcugcguguuccuuccuuccuuccuuccuuccuuccuuccuuccuuccuuccuuccuuccuuccuuccuuccuuccuuccuucucuuuccuuuuucuuccuuuucuuucuuucucuuucuuuuucuuucuuucuuuuuucuuccuuucuuccuucccuuccuuccuuuccccuucuccuuccuuucucccuccuuccuuccuuccuuccuuccuuccuuuccuucuuuccuuuguuccucccucccucccucccuccuuccacauuuuuauuuuuguuugcuuguuugaaucagauauccaaauaagguccauguguucaaacuguuugauauguccauuacauaucuuuuugucuguaaguucucuugcaugucuuugcuguuauuuaguaaaggccgagucaguuguccuguagagucuuccuggucuuaguuuaccuguaauguccuugugguguccguuagcacaguccuucguccacuacagacucuacuuuguuugguuuugguuuuugguaagaauucuucauagguuccacuacaugccuccaucagaaggaacauaaaaauugguuauucgguucuccacaauguauacuuauuggcuagagagaucaauacauuagggguuugaaaguagccuuauagaauucuaucauuucuccuccaguuauuagcagaauauuuuucuaaagcaagacucuucaucguuaaugaacauggguacacaaguaaccaugagaugcugauuucauugucuuuggguauauaccagcagagggauugcuggguuauaugcuaguucuauuuuuaauauuuugaggaaccucuacacuguuuuucauaaugguuuuacuaauuuacauucccacuaacaguguggaaggguucccuuuucuccacaccauugccaacacuuuucgcgccuugucuuuuuuauaaugauaguacuaacagaugugaagugauaucauguaggguuuugauuuacguuucucugaugacuagugucagugagcaccuauucauauaccaguugaccauuuuuauguuuucuuuagagacaugucuauucagauucuuugcccauuuuuuaaaauugguuguuuuugauauugaguuguaugaguuccucauauguuuuuaauauuaaccccucaugaugguuuauaugguuugcaaacauuuucucccaauccgugggcugccuuuucauuuuguuaauuuuuguuguuguugugcagaagcuuuuuaguuugauauaguuuuacuuguuuaucauacguuucgacuuaaggaagaugcauacauaauaugugcuccuuguaaaaauaauuuaggaaaaaaaaagaauccuuucacucagagguaucuuuauguuuuggaauaucuuauguguauguauuuauauuguacauacuucuuuguuaagaacuauuuccacauaacaaaacacuggacauauucucauacauuucuacaggaucuuugacucaccauuaaaaauaaucuaccuugaucaggcgcaguggcucaugacuguaauccuagcacuuugggaggccgaggcaggugggucaccuguuggucagagaucaccugaccaacauggugaaaccccaucucuacuaaaaauacacaaauuaucugggcguaguggcagacaccuguaaucccagcuacucgagaggcugaggcaggagaaucgcuugaaccuaggaggcagaggcugcagugagccgagauugugccauugcacuccagccugggcgacagagcgagacucugucucaaauaauaauaauaauaaucuacuucaugcuauugggaucugagccuucccugacagucugcuguuacugaaugugaccagggcuagcuuagccaccuguuaaagcagggaaaguuuuuuguuuauguguuuuguugucagcauuauuaaggcauaauugacaaaauugcauauuuuuacaguauacaauguaacgauuugauguaugcauauauuaugaaaugauuaucacaaucaggcugauuaacacauccaucacuccacauaauuaccuuuuuuuucuuuuucuuuuuggugccaaugcuuagcacacuucuaguauauaauauggcauuuuuaauuacagucaccaugcuguacaguagauccucagaauguauuuaccuuauaacugaaaguuuguauucuuugaccaguucucccacuuccagugcccagugaccaccuuucuauucucuuguuucugugaguuugacuuaaauuuuucuuuagauguaagugauaccauacaguauuugucuuugucuggcuuauuuuacuuacaaagcagaacaaguuugucgauguuccucuuccccuuggccuccuucccuguacucugugccuucccuugagucucaggagcgcaguggcucugugugucuucuucucccauuucuucucccucuucaagacucaccucuccucguggauaacgcuuuuaugguaguaauggcuggcaauggauucaucugugaucuucccacagauaauuguagcggggaccuccuaagaucauaauauuuaagaccuggcgcgguggcucacaccuguaaucccaguauuuugggaggccguggcuggugaaucaccugagguugggaguucgagaccagccugaucaacauggagaaaccccauaucuacuaaaaauacaaaauuagcugggcgugguggcgugugccuguaaucccagcuacucaggaggcugaggcgggagaaucacuugaaccugggagacggagguuacggugagccgagaucacgccauugcacucuaaccugggcaacaagaggaaaacuccaucucaaaacaaacaaacaaaaccaguagcuuuuaauguauuuuggcuugagagggaaauagauaaaagcagggcugcuucgcucaaauggggaauagaccuagaguuccucuaacugcucuucccccuuucucuuuguuuucugccgagggcgucuguggcgcucagagaauaccacaguaaccaaaaugacugauguaagcauuggcaaugcccugcccuagagccagccauggggagcuggugauugggguacugggcaagggaagacguugggacccuuuacucacaucaccccaugcaggugaccaguguuugggcagugugcagggcugggcuggggaaugcacaccuguguguguguuccuguugaugcuucucauauuaucauucuucagaggcagcuggauggaaguagaacaacuuugauaagugaagaggauccugggucaccagaaaugggggguggagaggccuugggggccauuguuucauaugcauggcauggcagggaaggugaguggcuguuucaucauugaccaaaugaaagaaaaugauaccucuuuacuuuuuuccaccccuauacaauaccccacaggggacuuucgcaucuacccagaugaaaauuugugcucagauuaugagucaauccugaguaugguuuucuuucuuuuuuuuuuuguacuggacucagcagcagccaccuagccuauuauugauuucuagaugaaaagaucuuuuaucugagcuauggagaguggaagaggacagggccgggagaguagaugaggaagucuuuuucaucuuucuucaguuuuucucugggagacucugggaacagagcugaaguggugcgaaagcaccuucacacuuccuuugcugaggugauccgcuaauugcaugcuaucaggaaauguguaagaugggagugagaugguuucccagggggcccuucuuccugugcuccaucaagaaauacauuuucacuugcuggugucugagcagugccuguguggcugcuagagaauccuucuggcuuuucuaagugaaugcaccucucuaagcugcaagcuuucuggauggccccacccuggucucaucccugagaaaucuugucauuuuuucccacugguauaguuuucuucugcaugagugaugcacauacacugcccggcccauuaguuguaggcguuuguggcucaguuugcuccauuuauuucuuauuuuguucucaggcaucuuuagggcugugagcuacagcuuuucuccuugagcauggauuuguagaaucauaggagcuuagacuugagauacaccuuagauaucauuguauugaacugcuaaucaccuuauuuuacagaaggagaaacugaggccuggugggguuaaagucaucuuaacauuuagagguagaauggggacgagaacuuggucacuuaacuuuugaacugguccuuacuuugguuucucuugcugcuauaccucuugcuccuucaaggaccuugccccagcaagagccaacuuuagacuuggacacaagggcccuugauuuggacucaguguuuuagagggcccugugcuggcucuccuucagccaugucccccuccaugggauguguaguuggcaggaccaaggggaugcauccaucuggagcucucacccuagcccucuagaacuuacuccaguaccuaggauccuggaauucccuguccaaaggucuuagcucauuuccagggccuauguggacuucuaccccaaaucuguucuccgaagggcaaaccuggugaccagugggcaccccugaagccaaugggguagacagagacagcucuuugugagggcugcauauggaguuugaaccaggccuggugugugcacgacauccuucacaauaugucaggucuggauucaauuuagccuuauuuauagaagauaugagauuccugggucaaagacaaaggauucuauugcucaguagacagagugagcagcagcauauauguaucaguucuccuugcccccaggugccaggacagauccggguggaugcugugcucucaguggggauugugucacagcuaaggaagccugagcuuggagaauccacugcuuuuauagcaagcaaucaguaaaccugcuucuugcccagggagagacauuaccucaucuguccagguuaccagcuucauaacaaccuugagagguggcccaucauaaaagagcagugagagccuuuccaucuuggcauccacagcagaauguguaggaacacaagaagacccaagagacugucucucuccaacgguguggagcaggcugaggccuggaguaauucugcuuauacuaccacauuuuggcaagcagcccugggaaguccaagaauucuguucaaaccuggccauagagggagccggaaggagcagguguugggcugcuugacuuguagaaaccuuaagauguguggcauguggacuucauuuguacacuuuccucagaccucacagaauuaagggacaugcuugccugacauuuaucucuauuguuaucagaaauaaaauuccuuaaucuuuuucuuugaucuuccucuuagcuauagucuuucuaacucuacuuuucuuguucuugacaaucucuauaugauuccuauuaaaggucuuuccagccaagucuacuggguuuugacuggauucuggcucuccuggucuguuuguuuagcccacacagcugugucuguuugcacuaauuuuguguauuuguucccuacacacuauuaugguuuucuguguguggguucaucucuucucucuuagacugacaauaacuggcugaacccacccccagcugcacacaaagaagcuauuugaggacugauaaaugacccaaguuacucuacuguacacuuuuaccuugguuuuaauucacuuuucauuucugcauuaucucuaacuucugguugugugaagagugugaacuuucuuuccacauggaaauauuucaaacuucaaaggauuauuggguacuaaacuaaguuccccagagggauuuaaaaggcauuuuaguguaauuuaguguaaaguucaaaauuccacagccucaguuuuuguuccuuggccaguguuuguuccugggccaguagguaauauagcauuucagaaaugcccucugguuccuacaaaauaaagaagccucuuguaauguagcaauuaacacaggaagaaaaaggagaaaauuuauacgcuuuuuuuuuucauuuaggccagagccccaugaacaaccuucaaaacuuaaguaaaaggccauaaacauauagguauuuacucaagguuuaggaguuugagcugauaugguugucuuuuguguaugacacacuuuaguauuuaaaugucuuugagauuguucaugauuuuccuuaaauauccuuaugaaauguguagaacuuauaauuauuaacauuguaucccgccaccucccugcccuccaucccaggauuuugagguagagguuucagcuguuggacacccccuucucaccucagaaccucccaggcacuaacucuagaugugacucggguggggugggaagggauucaggggggauuuugccucagaaggacauggaugcucaucucuuccaucaugaggucaccugaucaucaccugaguuuuguuuuuuugagauggagucuugcucugucacccaggcuggagugcaguggcgugaucucggcccacugcaaccucugccuuccggguucaagcgauucuuguuccucagacuccuagguagcugggauuacaggcacacaccaccaccccuggcuaauuuuuauauuuuaguagagacaggguuuugccauguuggccaggcuggucucgaacuccugaccucaagugauccgcucaccucagccucccaaaguagugggauuauaggcaugagcuaccgugccugaccaaguuguuuuuuuuuuuuuuuaauugugugcauuagauaaguaacacucaggcuuuuuugauuguacaauuauuuuacauuuuauguaguguaaauggcacaccagacuaccacaugaacauguacauauacaucauacaccucacuaauaugaaugcuucacaaaucgauaguucuuuacagcauacaaugcccucugauauuguguauucuauuugacuccauuucauuaaaaacauauaucagucacaacccaauugauuucacaaacccacaaaugguucaugauuuggaauuuggaaaugacugcucuaggugcuuccauaaggcugugaaaaaguuccuucaucucugaaggaggcugauuuacccagggaauaguuuacacacauacauaugggcacacacacacauaugugcacccgcacacaccacuccccagagaguuccauuucuaagauguguuguaagauuugauggaaguauguguggcugggugugguggcucacaccuguaaucccagcacuuugggaggccgaggugggcggaucaccugaggucaggaguucaagaccagccugaccaacauggugaaaccccaucucuacuaaaaauacaaaaaaaauuagccgggcgugguggcauaugccuguaaucccagcuacucaggaggcugacacaggagaauugcuugaaccugggaggcggagguugcagugagccuggaucacgccacugcacuccagccugggcaacaagagugaaacuccgucucaaaaaaaaaaaagaaaguaugucuacagagagggccuaaguugaagcucccaacacagcaaauaauugggaaccaccacuuuuuuuuuuccugcuccugguuucugacuccagugggaaauuagguuccugaauguucaaaguccaacauucaauaacuguaugacuguucucauucuuucuuuuguaaauaaggaaacacacacaaaaagcaaaauuaaaccaaagacaaagaaaacaugagacuguugaugcauuucccaguuauuguaagauugugucucccacucuuggauucuuuugaauguuuugcccaauuuccuuugauaugccucccaagauacagggugaugguuuauuuugggcaaggcugacagcugcuuuccacugcucuuuugcaaggaacugcaugaggauagccacugaguuuauuuuuacaucucaccacaggacaaaauccacauuuucaaucaaguguuggacacuccaauuuaacaaauugugaaaaaucuguuggcccagauaaacguaugcuaagaguauuccuuucucuaaauuaagauuuuguucccggaagcccaagaauucauuaaggccauaauuagccaugaucacugaugauuuaaaauacaauaauaaagaggaaguuuauacugagcuucauaggcaccauuggaucuguccugcgguugacuuuuuauagcuguaguuuaaaaauaacuuuuccauuucaucugcuggcugucuuuucuccacccagcccuucaugcaaguagggugggggcugucauccaagcucccauugcugcaggcagugacaucugucucagugacaucagagaaagugccacaucaucucaaaccaacauaucaguuacgaggucacaggcuuucccauaaaaaggacuggccucaucugucaucagugaaaagagacagcaagcacucuucaaagauguauuugcuucagcaaacgcagaguuacccugggagggggcauuuucucauuauuccaugagcugauguggucaagggaauucaucugaguagcugccuaaacucagaacuuaacuugauuaaaggcacauagcagucauccucugauugaaacucaggugucuuugccuuuagagccaauccuccugauauauauaugcaucagcuuagcaauucuaaagccaucucaucagcuuuuuugguguuucacagagagacagguuuuauauuuuccauuuuucuaaauaaagcccaggcuugacuuccugaaccuuaacuaggcaagaaguacccuugauucuuuuaucuauuaucugcauuuuaucuuugauguauccagagaaaauaccacacaauauuuauuugcccugaugguuuuugugucauuguuacugaaauuuuguuaguaugcaucuccuugccgucagaauggguuuuauuguggcucuuccgucuauggcuuagucucuuuuaauaguaauauuuucauauuuaaugguggacauaucucaguugggcuggugucaacauaauauuaauguuacuggaguuaagaaaaaucuacuuaacuaagacaugcuuuauuauuaauuuuaguagguuauugauuaggguaccaugcuguaccauguuggaauguacacaagcuauggggucagauagguuuugguuuacaucuuagguccucuacuuauuagcuacgugacuuugagaugcuugcuuaguauuuuagcguauguaguucuuggaacucaaguaguaggcacucaguacucugucauuguucauuuucucuuuuuaugaugaaaaggaguguuucuguuguauggaugugugugaauuucccaaacucuauuggaucauagaagucuguuuggauucuggggaugacugagcgaaaugccucaguguugcugauugauggggccuugcacauguugucauuuccaccaucaguuccguuuacuuucuccagcaccaguaggagaagcaauggcaaacagcauauuauuagucacuguugcgcuuuccaccaacauuucgaacuaaaaauguguauuuuaaaacacauguuugcucaucuuaaagaguuagauuauaaacuguuagaaaucagggacuauuaaacaaccauuuucauuugcaguggauucagaauauagucaucuugaguugggaaaggauguguccgugaaugccaagcaaagugcugugcagucaggaaacaccagcccucucugcucucuccagcccuucuugaaggguccuucuucccaacuuguagcacuuuacaccugugacuggggaaugggggauuccaauuugagccuaagauauucuuucagugggcuucagguguagcuggccugcugaaagucuguuuucaggaggcacuggggagccuccuaggagacuguucauccuaggggaagggguacagggcccagagauaucaaccagaaauuggaagggaggacugauuccuuguguggauuuuuuuuuuaaagcuauucaugcucuaaggacuaggcaagggguaggggaugggcagggaggaaguacgggcuggcugcuggucaauagggauuguugguaaaaaauggaaguggucauuccccuuucaaaacagcuuaagacuuuggagcaaaaguaacaugcuuugguaccaucuggaaagguacuaacugaagccuggauggagaaaccuuacccccucaugcccagagcauagcuaaacuucagcaccuugcggccaccagcuuacaggcagcaggagcgcccaguggaaaacugaggugcccaggaaaaguggcagcugucacuuacagaaguagcucuugagcaggccaggggaacaggagaccgcuuuucauagcuuagcaggaaggagagacccauuccuaccauagagagugguuggcaauaagaggaaaggguuugagccauguggucuuuucugugggcuuaccuggaaauuugcccaaggacuugaagaaauaucagcagggagaacccagcaagggcuuuggggcuggcauuacaggugauagagagucaaauauaugcuucggccagugaaaucucgcugugagaaugaaugcacacucaggaaguggcagugcagaaggaaaaggcagcugugcuguuggguaggaagggaauuuucuggggaaguccugggagaacagagaaaaaguuucaugaggaaggaaaggugcugcaucauagaaccauuuaguugcaaacuuucuuuaaguagaauuuagaguaauuaugcuguugaguauuucucagcauuaaguaaacauacaaaaugcuuuuaaagaaaauggugcugggugcaaguggcucaugccuguaauuccagcacuuugggaggcagaggugagaggaucguuugagcucagaaguuccagacgagcugggcaacaaagugagagaugcugucucuacaaaaaauaaagaaaagaaacuuagcugggcaugaugacucacaccuguauucccucccagcuacucaggaggcugaggcaggaggauugcucgaguucaggagguugaggcugcagugagcuguggucacaccacugcacuccagccugugcgacagagcaagacuuuaucuccaggaaaaaaaagaaaaauaaaaauuguaccugaauacauuuaaauacaaaccaggucuaaacuacauucaaucauacuucuauauaaacagaaacaaaaauguacgauuaaguacaaaaaaagaucuucacauuaaauagaacuuaaauuagugauauuaacuaacagaaugaaugauucuguguugcuuaaauuaaaaucacuauaccuggggaaaaugucauguagauagaaacgcauagaaauuuuuuuuuuuucuuugagacggaaucucgcacuguugccugggcuggagugcaauggugcaaucccagcuuacuacaaccucugccuccuggguucaagcgauucuccugccucagccucccgaguaacugggauuacagacgcccgccaccgugcccagcuaauuuuuuguauuuuuaguagagaugaggguuuuacuauguuggccaggcuggucucgaacuccugaccucgugaucuggccaccuuggccucccaaaguguugggauuacaggcgugagccaccgcgccuggcccagaaaggaguuuugaguccagaaagcaucuacucugugugcugagggcugcuccaauucacccaccacuccuauccauuuaaacugcugaaagcaaaaucauucuuguggccaaccuguccuuaauuugcucaaauugggagaacuuguuucauugguacuagcugggggugaagauguaagcccaggaaaaaucugcuuguccuucuagcaccugaaugcuauucggggguagacuguggugagaagcaaguuaucugcgaaagcccacagcauucugugaacaaaugauuugaugauguuuuccagugaacuuauguggcugucuaacauuguuacaucacagcacacauuuuccgagaauccuugagacccaagagaaagcaucugcucauaaaaucuuuccacuuugccauaugcacuggguuugggggugggggaugaggaugaggaggagcuucaacucuuuacaccacucacagggaacucuucccgggugcucuaacucaggaggguguguugucagauccuuuucuaugccuugcaguguucagaauuugcaaagaauuuuaccaucugcucugugugcugaugucacacagagcagaguauauaagacuguucuuaucccucaaacuuugccuuuuaaggagaggcacaguugucccauuuuagggauaaaacgucuccuuuuuuuuuuucugcucuugcucucuugucuuuuuccuggagaaaggcuagaaucuguuucaaaggaugguuuuaaagacccuugacucugggcuugaggguccaguugagcaggcaucuuuguucuuucauauguuggcuucguuuccugacucuggaggugcugugagcguuuaagaaccacaggcuugagcugcagguggcuguuugccucucugccuuaaacagagccguucuuguuuuuccucuccuuucucucucucucuucuaaccugccugugaaugccuguuacucuguguuggcauuuccagucacagcccccaccucuggccuuucucucucucuucuaaccugccugugaaugccuguuacucucuguuggcauuuccagucacagcccccaccucuggccacuccuucuguuguucucugcuggucauuuuuuauuuuuccuucucuuugccuuugucccuuuuuuauguuuuugucaauguuucucaucucuugcuuaaaugaguucuucuuuuaaucgacauuuucuuagucuguucagguugcuauaacaaaauguaauaaacgaggucacuuacaaacaacagaaauugaucucuuacaguucuggaggcugggaaguccaagauaaaaguguugggagauuccguguugggcgagggccugcuuucugguucacaaaaagcagcuucuugcuguguccucucauaguggaagggaagcacucuagucuuuucagcuccuuauaagggcacgaaucccaucaaugagggcuccauuuaugacuuaaucaucucccaaaggugcugcauccuaauaccgucacauagaggacuggguuuuagcauaggaauuuaggagagacacaaccauucugacuuuagccaccauccaaucagaguguuccuuuuccuuuguucucaaucgcugagaaacaagccacagccugucagggguaauguggaggcaguuaccucuaacucagggcagugcaagaacaggacuuucaagugugaaggcugauucugagccccagugagcucugugacaauggugcuagaagguacugguguucguaucuucuuccagaggaaacugucccuuggggcucuguugaaaugcaggcacaaaggcacggcggccuucuugggucacauggagagaucaaaaagcaucucuucucugucagacuccccucacggcuguuguuaucauuggcaggacucuccuucagcaacuccagaagcuucagacuuuggugaugggcaagguuucucgaaccugcaaguuagcuggcacgcagacuggcaccugccucauggugagcuucccagcaggguagcacagugaccgccccuggccuggccccugucuccccucucccuccacuugccaaggccaagugcugugcuguaggagaaaccacauggaggaacuccacucugaggcuguuccucggugaggcacucuggugaugugacuggugggugcaguccacuggccugaagaggagagucugugucccuggguauaaagcugugcuguccagaggcugaaguccacagccccucguguucucucuccccucuuucucucccacagguuguggugcugugcuuugccguugcauucggcagcuucuuucaaggcuacgggcccuauccuucugccaccaagauggcucugcccagccagcauucccugcaggagcccuacacagccuccguggguaagacagcauguggcaaguugggcagggucuuguuuuauuucccuagagcuggguuucucagucuuccaaaaggaaucuucugugaaaguccaauguuuaaaaagugguaaaaguggagcuucucccuuugaagaggcaaguggggguuccccuggggccccucauccacuggacugcggcaucacugggaauucuccagagcuugacagagcacaguuugcaaacugcuguucuagacuguguucccugauccauucugacaucuaauuuuugaguucugauaagggagagggaagcagaugagggaaagagucugucgcuuucugugacguuuuaagagaacugcuguguuucugccuccacugaguggaauuguaugaguaauguaaugcaauguauauaguaagggcuuguaaagugaaauuaaauaaacagcaaggucagggccgggcgugguggcucacgccuguaaccccagcacuuugggaggccgaggcgggcagaucacgaggucaggagauugagacuauccuggcuaacacugugaaaccccaucgccacuaaaaaauacaaaaaaauuagccgggcgugguggcagguaccuguagucccagcuacuggggaggcugaggcaggagaauauugugaaccugggaggcggaguuugcagugagccgagaucgcaccacugcacuccagccuagacgacagagcgagacuccaucaaaaaaaaaaaaaaaaagaaucagcaaggugaggaguucaagaccagccuggccaauaugcugaaaccccgucucuacuaaaaauacaaaaauuagcugggcaugguggugcaugcaccuauagucccagcuacuugggaggcugaggcaggagaguggcgugaaccugggaggcggagguugcagugagccgagaucgugccacugcaccccagccugggcggcagagcaagacuccaucucaaacaaacaaacaaaaagaaucagccugccuuccaaaaccuuaugcccaagaucuagagaauauggggacuccggugucagauaagaagcguaugguguucucaccuagaaauaaagggauggugaguaaggaauacacacacaaauucacaccuacaccuauaggaaugagcaugggguuaggcaguacaguaguccccccuuaucugagguuuuguauucuaagcuuucaguuaccuguagccaaugaacauaccugcaguuaccuuaaaauagcugaauacacuauaguaagaaacacuaccugcagccaauaaaaauaccugcaguuaucugaaaauagcugaguacaccaccauaagaaauuuugagagagagaggccacauucauguaacuuuuauuagaagauaugguuagaauuguucuauuuuauuauuauuguuaauuucuuacugggccuaauuucuaaaucaaacuuuaucauaaguacauauguauaggaaaaggcauaugaacccuacaugcuauaugcccauauauaaacccuguaugguuuuucccauacauauauaccuuauaccauauauauaggguucaguucuaucuucgguuucagccguccacugggggucuugaaauguauuccccauggauaagggaggacuacuguacuggauuugggauagggaaaauuuugccaucuugaaacgucuguggucuucaccaggcaggugugucucugccagguaugacagaagugcuagcauuccaauuaaauaauuucaguggccuguugagaauuuuuccccccaaggaacuaucucucuaaauuuaauuggaagcauaguuucuaugucauggaaaauugcuacagagccaucuagcugugugacuguccuacaaaacaaaggagauugucucuauccuuugauuuauggcuuuggcuuugugucuccucuucccuuucuaaaugagaugcccuguaccucaucccccugccagaccuacucacugggaaugcugcuucuuuuagcugggucuggacaucuccaaguauuccacucccauucuccaugaaucauuuucccuagaugguuaugggugguaaggggggaguuuuauauuuucaaagcagugggggugguaguuugccuuguguuuauuugcuuuucuauuguucuuccagcacuguauaauugguauaauuuuucaaugcacaaacuccgaagcucuaaagucuuuauagaaagccaaauucuguuggcacccaugguucugggcaacgagaacacacacauugucaucugccaccagcccugagcaccuggagugagggaauguguuggaccccuguggucuuuugcuaacaccuuauuauucugcucuguccucagugagauccagaaaccugcugaucuacgaggaacauucucccccagaggagucauccagcccgggcucggcuggggagcuggggggcugggauagagguuccucccugcucagggugucagggcuggaguccaggccggauguggaucuuccccauuucauuaucucgaaugagaccagccuggagaagucagugcuuuuggagcugcagcagcaccugugagucauagagacacagagccaacuccucuagugcacugaugguggguuaugagucagcaaccugagaugugagguugagacucuccauaggccugguucagucccucagcucucucaggaccuauuuccaggaccugggacugcagagagucuguugcuggccaacaguugcccugagcagagaugaggaaaaaaaccagcgugagcuccccuaugucugcugcaucagcggggagcuggcgugguggcacaaagaagugcuugaaucccuucccccacugucuccauccucccuuccaagccacacgagugaaugcacagcccagguaaccacaguguguuugcugugcaaauccaacuuuaagacauguuucauggcuucaacuagggaguagauauauauugugcuauaugucaauauauguuuaugauuuauauguaaauacacauguguuaauuaaaacuauacauauuauaguuuuauacuuauagauguauguugagggguaccauuuaagaggcacugugcacacauuuccauauugagaacaaccucuauuuggcuccaauucuacaugaguuguuucucaguuucugggaaaaaucccuuuguaaacauaaaggcuuaugcgacugcaagguauuguuguuguaauaggggaggucccugggccugcaugcaugcuccugguuacgugugacaugguuggugauuuagcugaacucugcuccuaugccucccagaaaugaggccguuccgauguaaaugggaaagauuuuguuucagauucuucagcuuucauccccuaauucugcaggggaagguuuauaaugaaguacuuuuauguguguacauuauacauacauauuuaacauuuacuagcacuuacuauuuuaagcacuuuacagaugugaggcagguugacuaucccuuaucugaaaugccugggaccagaaguguuauagauuucagauuuuggaauauuugcauuauacuuaacaguuaagcaucccuaauccaaaaaugcaaaaugcuucagugagcauuuccuuugagcgucaugucaaugcucggaaauuucuagauuuuggagcauuuuagauuuuagauuuucggaugagggcuacugaaacaguaucauacaaauccuuuuaaguaucccaugugguaaggcaucauuauuauucccgucauagagagacuugccaauguagccaccgcugggaucucuagaagacccagugccuucuuacuuggcucuggacacaguuucucuucucucagcuaagcuguucaaggcccacuucaaaucccauuuguucugugaugucuccuagauaacaaagccuccuagcccuccucugaaugccuagaaauuuuccagguuguuacacaauuuaauaauguauuuauuuucuguuauggauuuauuauuauuucaaauuagcucauuguuaaaaaucuuuaucuggauuauuagcucuucuaggccaaggaucagcucuuaucauuuuauuuucuccuucccugaguuuagcauagggcuaaacauccuaaguaaauagaauaauuuaaugcaucucauagcagaucaauaucaagccaccaugauuauccuuaguaggguugggaugccuuggguguagauaaagguaggaauguggacuaguggagaggcugguagcaggggacuuuggaaacagagaauugcuacuaggagagaaaaggacaagaaacaugcccaggccgucucaccaaguugcaaccccugaaugauugcaucacgcuacaaagcaugagaauuguagcuaacagcuggugacuaauacuucguuuuccuuuuaaugccuucacagggucagcgccaaacuggaggggaaugaaacacuaaaaguuguagaacucgacagaagagugaacaccacuuucuaaagaggcugccugcacccccucccuuucccuuaacucuacuuuuacauccccaaaccaccuuugucaucagcuuuuccucuuugccacuggaucuucauggagacaugggcaagcauuaguggcuucagauuggagaccagccugggacuucccugcagugagagagcaucucccccugguccaugccccuccugugcagaagggagccugcaucccucccuuccuuucucuuacugccauaggaaauuauuuuagggguuggaggugggacaagcaggcuuguuuccaccaauagugccaaaaagauauugccuaaugugcaccugugagguguaaccccccgcuuuggagacgagauggcucuuguucagucaagaccccagacucuggccacaaaaaugccauaaugccuguugguauuuggcaaagcacugacccguguccuccguugcucgcacuggggucucuggugugaacacccccgacagcagcccuccgcccacucugcccccugggagcccucgcuggaucgucucgucuccugcagcagcacuggcaggcgagggcucucguucauauucucaggccgcaagugcaaugccugaggggaucaggcuuuucuacuccaggcaaaccugccccaucuugucgcuuuuaggaccucccacaaccugguuccccacacauccauaguucugccuccccagcuucuccuccccaguuguaaauaguauuuauuagcuugccgaggcuuccugcuagcaaccacacugaagagaucgaugccuccuuucaagcuagccaaguuuucugcgagccuucagagcuaggagggcacccuaggcucugggaucccgugucuuuccagacaauguuuuguuuccuuuccuuuguuuuuucuuuuaacuggaauaauuaccauugaaaaagaaguuccuuugagcauguaugugucugccucuaggaugagcucagagcgagagaugacacaaugccucacucaggccccgggcucccuggccacaagcuuuuucuauccuguuuucaugacagagaaggggaagcccuguucugacaacagacauuucagacaaccuugcuggcuuuccacaccugccuggcccccuccucccuccacacuuccacuuuguccuccucguccccuaccucaacaaagcagggugggguaggugacauuuguguauccacauucuuaccuuugguagucagguuuggcuacuuugcagcucgcccaaagagauacaaccuaauccccaaccuacuuuuaguuuuuuuguuuuuuuuuuaugguuaaaaguaacuuuuguaguuuaaaaaaaucuuuccucuuucauauaaauaagaaguggaaauugccuuuuuauuguguaauguagaaaacccucaaguguuuuuuccgagcuugggaaagauuuuguguaggaaaugugcauagaguuuguauuuuauuuuuauuagcagcugaaaugccuuugguuuuggcuucucucucucccucucucucucugucucuccuucucucucuccccccaccacccacccccacacacgucaucugcauuguuauuggagccuguacuuagagggauuaagcccacacccuggcuuccauuccauaucagguacaggauuugauguuauuaacauuugucgucauaccucauaagucggucccugccuugucugucuaggcccauuuggggcucccugugagugauuccccucucucugcuaugcuggagacgguuccagccuggaaagcggccaaguucaucuucucacugugaguggaagcuggaucgggcccccguaguccuggcagcccuguugucuggaggguucuuguugucccucccauuagccagggcggagacugucugagcugugcaggaggaggguugcuaguagguucugcuucugcuucucucugcuccacugucugcagcccagauccuguugggccuggcuggugucugguaaccaugggccuccacugacccaucccucucuuuuaaacugucaggucauuaucaggcauaggcagccuauagggcccaaagaaggcaaaaagauaagauuuacucaaguagcauuugggcaaugaggaaggaaagguuucaaauuuaggggcagaagugagagaaugagccaacccauguaccugcugcaacugaaccagacuggguuuucaaggcucccagacguagaguaggaaacgugcucuucuaaaugaggagggagaagauaaaggaaacuucuagccccuguccuuagugcuuugaggauuuuauuuucucccuuacuacgcuugcuugacgucacucucucucgaccuccaaacagcaggacucuuucucugggaaaccauccuuccaaaacggaaucuauguagacaaugggacguuaggcagagagcucagauggcccuuuuaagggggcuccaagaaccaacaucacugcucuuuuagauaaaccucugcccuccacuccuugcuugaguggguuaaaggaacuaacaguugucccuuuaggaggacaaaauggggucaagaggacacagaagaguuguauagcaccagauugguuccaaauaguuaauggaugugugcacauuuucuguucagggauuaagaccagaauaucaguggauuuguuuuccccaccaaguggccucuuagacuagucauuaacuuaugauuagcucuaaagauuucaaauaguggcagacagugucuucugaauguaaguuuugagaaauacgagucugucagagcggccauaagccauaaagagucaaucucuuaauuauauuuuucaucauguaaacaaguuucccauuucccuuucuuagauugcaccagugaaggagauguuuugcaaagauucagagaacuaauuuuucacuggauaagaccugaguaacccagaccccccaccgugguucuuuucacagcccucgacuuugcacuuaaaaagggauauuguaaaugaaaggcugcagugccaguuuuaagaaagaauuucugugaagugugaggacucuggagucuagcucacauaaagagaguguuauauaaaaauccgacagcugaacuagguugcucuuuuuuggcagggaguggggaugagauuugacaccaauaugggcaaaauuagauaaccuuuugguuaauauaaaugauuuugauuuggaggccuaauuuguagauugugaaagcagcuuuuaguuuaacuuauucacagaccccuuauaauuaccauguuuuuuuuuuucuuccuaaaucucuugguucagcuugugaaucuuacgugcccguaaaguugggauguugaauuggcucuucuuuguucuggcagugagucaaguguccagcauuuuuucauaaguguuuuuuaaaauuguucuccagcauuuuauggcuccucccucccauguccucagacccagcaaaagcguagaggcagaauuagaggccucuccaggccagcuccucugcccacaugucauacaaggugugaauuugagcacaguccagaaauggagacaucccacccccaguugaauaauggcccauucaugccaaccuugccaacacggagagggcagagaugcacuagaagaccuucauccuccccuuccucugccccaagucacuacaguugguucuauugaagccagucuuuaagaaaccuggguuaaagacaccagcacuucugcuugcugggcuggcuggaccugugaagccaugggcagguagugcccucuugagagucauuuuauuuggccaccuucaggugagacuauccauagacacaugcuaggauaggccccgcugggagggcaguuacaggagagaguaggugguggugacgugagggcugugaaggauccagagacaagacuuagauguuucguucauucacucacucauucaguuacuccuaagacuuuucaguuucauaaggaagaguguugccugaggcccuagggaauauuggggaauagaagggauugaggaaacauuaauaauaguuauucaaaagacccaaaugcuuauacuucucucucccuucuucucucucugacacacacacacacacacacacacacacacacacacacgugcacauuccucccuuacaugcucauuugugccuuaaaugugccuuauagguaaauccaggaugacugaggaaucccucgucacugggagauuuuguauauauucuuuuauuauuagauugaguuggguguggggaaaaauuuuuuucugaaggcucaaaagugguuuccuaaaagugagccacuaucagauuugcacaucaggagaaaagaaauaggguuacguccauuaggaaaaucccaguuugcaggagugcaaucacaucaaaaaaacaaccagccaggauuaaagguauuauaaauccucauagcggaacauuucucagggcaaaggaaccuggcucauuugaagauuaauguuccaugccuuuguggucaaagggucagcacuuaacacaggaaaaaacuagguguuguuuuguuuuguuauuuuggacaacauaaaauucaggaauguuuuauuuagccuugguuucuagaaggaagggaaauaauauuucuugagcauuuacuaggguguugcgugcugugcuaaguaaauuuuaagucuuucaguuuuauagauacggaaaacaagggugacucuuuaccacaggaugaauaaagaacuaaguaauaugggaaaugcagcaauuucuggacuagcugagccgauuccuuccugugagcacacuguaagcuuucaaguucucugggcaggaauuacagcaccuguccccugcaauggcccugcugugugaugcucaucgcuucccuucgugcuggagcagucccccagguguccaucuccuaucuuuuuguuccaaucuucugugaguuccagcuagcaggcuuuacaucuggggaaaggaaaaccagggguuuuagcucuguucucugcucccauccuucgcucaccagcugagugagaacaugaacuuuuugcaccauguacccauggcuuacacuacuuagaaaaucaccuuuucagauaaaacaguuuaugaguucauagagaacaccagcacucuuugacaaaacugugagugacccuuuuuaaacaaugcugagcaggcccugagcuauaaucaacggugagcuuuaaugucuaugcugacaguuagguuuugcucucuuuuguaacagguuacguagaccagcaguguuuaaaucuaaauacguugugagucuguuaucuguccuaucgcguuuuuuaaaugacuuuuuauucuuuaucauagcuaaguaaauaccaaaaaaaaaaaaaagcuuuguaggacacuuguacuuaguuugggaaaaaaaaauaaauugaaauuguuaugcuuuuguauuuccauuucuugcaaauaaauauuuuuucuuaaauaguaagau

SEQ ID NO: 14588 - RNA, 1301 nt, Homo sapiens
gagaacagauaugagaaaaguuguuaauaggcuacugcaauaguccuggcaaaagacagggauagcucaguucuaaugaggugaccaaggagauggaaagaagugaauggagucaagcuauucaagagggaagagccacaggacugagugacagaugggauacaaguuaggagagaaugacaucaagaacggcuccuaggugccuggccugccccagugaauguuugacugcaccauuugcuggagauagggaacagguuugggguagagccugugaaaggugaggaaccuuugagauaguccaguggagagacaagcuggcaacuggauaaucaggucuuagagacagauccaggcuaaagauauaaauuaugggcccaucaugauagagaugccaacuggaguguugcccaagagacaguuacagaaugagaagaaaugacauuucagcaucaagccuugaaauacucagaccuuuuagaaaguugcaugaaucaagaaagauaagguauaugaauaucuuuuauaaaccguaaagcauuauaaaaauauuaguuacuuuaaaagaugaaagggcauggaaauuaauauuucucugacauuaaaagcuauagaucaaacucaacaaggccaucaguuguacagaacucaggaggaguuuaauccauaucaaagcuccaaaaguccaggagaacagauugaauuugcugugagcccaagaggcucucagaaggggacuuaggguuacucauaaccagcaggcuauuucuucuugcagaacccacaaaugagucccauauuugggccucugcaaucaguuggcugcagcucccaggcgggcugacacacacugcaaccucacaucugcaggacucucgccccuucucucuuuuuuaaagggccuuuguccuuuguuccccagccucacaggcaagacagaagagccuuugcuucuguacuucuuaaaagcuuuagaaagggacuucauucugcacacuucggggaggaccaggacccaugacugcaugggaaguaaaacacaaguagcacacggcauacuucuccuagaugcucucugcgucuuccagcaccucaacauccaauuguaaaauagcaggaaagauucaguuagagcccgaaacuaaauuuaaaaauuaaaaaagaaguaaauaaauuaauuaaacagcaggaaagagagagacaaucaagcuuugcaugaaacagcuuuuauucuucuuuuaggaaaacgguuuuaaacuauauucauucucuggaauucaaaguaguuuugcccuuaaaag

SEQ ID NO: 14589 - RNA, 1301 nt, Homo sapiens
cuuuuaagggcaaaacuacuuugaauuccagagaaugaauauaguuuaaaaccguuuuccuaaaagaagaauaaaagcuguuucaugcaaagcuugauugucucucucuuuccugcuguuuaauuaauuuauuuacuucuuuuuuaauuuuuaaauuuaguuucgggcucuaacugaaucuuuccugcuauuuuacaauuggauguugaggugcuggaagacgcagagagcaucuaggagaaguaugccgugugcuacuuguguuuuacuucccaugcagucauggguccugguccuccccgaagugugcagaaugaagucccuuucuaaagcuuuuaagaaguacagaagcaaaggcucuucugucuugccugugaggcuggggaacaaaggacaaaggcccuuuaaaaaagagagaaggggcgagaguccugcagaugugagguugcagugugugucagcccgccugggagcugcagccaacugauugcagaggcccaaauaugggacucauuuguggguucugcaagaagaaauagccugcugguuaugaguaacccuaaguccccuucugagagccucuugggcucacagcaaauucaaucuguucuccuggacuuuuggagcuuugauauggauuaaacuccuccugaguucuguacaacugauggccuuguugaguuugaucuauagcuuuuaaugucagagaaauauuaauuuccaugcccuuucaucuuuuaaaguaacuaauauuuuuauaaugcuuuacgguuuauaaaagauauucauauaccuuaucuuucuugauucaugcaacuuucuaaaaggucugaguauuucaaggcuugaugcugaaaugucauuucuucucauucuguaacugucucuugggcaacacuccaguuggcaucucuaucaugaugggcccauaauuuauaucuuuagccuggaucugucucuaagaccugauuauccaguugccagcuugucucuccacuggacuaucucaaagguuccucaccuuucacaggcucuaccccaaaccuguucccuaucuccagcaaauggugcagucaaacauucacuggggcaggccaggcaccuaggagccguucuugaugucauucucuccuaacuuguaucccaucugucacucaguccuguggcucuucccucuugaauagcuugacuccauucacuucuuuccaucuccuuggucaccucauuagaacugagcuaucccugucuuuugccaggacuauugcaguagccuauuaacaacuuuucucauaucuguucuc

SEQ ID NO: 14590 - RNA, 1058 nt, Homo sapiens
gcucgccuucgcgcccggcccggccucgccccggucuucgccuccgccucggccgcagagcuugcccccuccccacccgcagacaauguccgaguccaagaacggccccgaguaugcuucguuuuucgccgucauggcagccucggccgccauggucuucagcgccccgcgcgcugccuauggcacggucaagaccggugccggcaucgcggccaugucugucaugcggccggagcugaucaugaaguccaucaucccgguggucacggcuggcaucaucgccaucuauggccugguggugacaguccucaucgccagcuccccgaaugacgacaucagccucuacaggagcugccuccagcuagcgccggccugagcgugggccugagcggccuggcagccggcuuugccauagacaucuugggggacgccggugugcgagccacggcccagcagccccgacuauucaugggcaugauccugauccucaucuuccccgaggugcucggccuguacggucucgucguugcccucauccucuccacagaguagccccucuccgagcccaccagccaccgaauaugauguaaaaaccaccccuccucauuccagaacgaagagccugacacacacgcacgggaccgcggcccccaguaguugaucuuguacaugcgcagcgcagcguccuagugccgguugucuguugcccuggccuugcccccaccccaccccccacgccgccccgugccauggacaucuggguccacucaucgccccuccaggcccccggugccccacccccuagagugcucuguguauucggaugacuuagaguugucauuucucuucacuggauguuuauuuauaaagaucuggccuguucccgcgucugcggagaggcccuggucucccagcugucuauaaccuuagcuagaguguggccuugugggcuccuguugcugagaccuccuggauggagcugcccucgccaccgggcccuuggcccugcacggagcucuguccaauaaaguucucggauuuggggggaaaaaaaagaa

SEQ ID NO: 14591 - RNA, 1058 nt, Homo sapiens
uucuuuuuuuuccccccaaauccgagaacuuuauuggacagagcuccgugcagggccaagggcccgguggcgagggcagcuccauccaggaggucucagcaacaggagcccacaaggccacacucuagcuaagguuauagacagcugggagaccagggccucuccgcagacgcgggaacaggccagaucuuuauaaauaaacauccagugaagagaaaugacaacucuaagucauccgaauacacagagcacucuaggggguggggcaccgggggccuggaggggcgaugaguggacccagauguccauggcacggggcggcgugggggguggggugggggcaaggccagggcaacagacaaccggcacuaggacgcugcgcugcgcauguacaagaucaacuacugggggccgcggucccgugcgugugugucaggcucuucguucuggaaugaggaggggugguuuuuacaucauauucgguggcuggugggcucggagaggggcuacucuguggagaggaugagggcaacgacgagaccguacaggccgagcaccucggggaagaugaggaucaggaucaugcccaugaauagucggggcugcugggccguggcucgcacaccggcgucccccaagaugucuauggcaaagccggcugccaggccgcucaggcccacgcucaggccggcgcuagcuggaggcagcuccuguagaggcugaugucgucauucggggagcuggcgaugaggacugucaccaccaggccauagauggcgaugaugccagccgugaccaccgggaugauggacuucaugaucagcuccggccgcaugacagacauggccgcgaugccggcaccggucuugaccgugccauaggcagcgcgcggggcgcugaagaccauggcggccgaggcugccaugacggcgaaaaacgaagcauacucggggccguucuuggacucggacauugucugcggguggggagggggcaagcucugcggccgaggcggaggcgaagaccggggcgaggccgggccgggcgcgaaggcgagc

SEQ ID NO: 14592 - RNA, 1231 nt, Homo sapiens
cuuugguacgucaucgucacuucauuuucgccuuacccuaucccacgaaaccacaccuagcgcccacgugaggggugacguaugcugggaguuguaguuagagaacaaaaguccacaucaccgcgccaaaggcuuuacccucgaaacugcaccgaugcuccggacguugaacgggcgcgcgcacgcuucugcguacgcgcuugccugcgcaauagucuccgcgccugcgccguaguccccgcgccugcgcaaaagcgggcaugcgccgucgcggagcacagcgcgcugggcaaauuggccggaucuucgagacucgcccucugaacgucagcucugguggguuuuuaccggaagcagccggaccuuuuccgguguugcgaauuuccaggaggagcuuugcuccagcggccguuagauggcgccugccgcggucaauuucugcuuccgguugaagcguugaggccauuuccgcaggccgggcgugguggcgcacgccuguaauaccaguacuuugggaggccgaggcgggcggaucaucuuaggucggggguuugaaaccagccugaccaacacagagaaacccugucucuacuaaaaauacagaauuagccgggcgugguggcgcaugccuguaaucccagcuacuccggaggcugaggcaggagaauugcuugaacccuggagucggagguuguagugagccgagaucgcgccauugcucucuagccugggcaacaggagcgaaacuccaucucaaaaaaaaaaagaaacaugugccguguccuuugaauuggugcgucagcgauaaacaugggacagcggggaaguaauaguacauugauuaggaauuaauuuuaaaaauuagcaguucauuuuuugguucuguuccuaauuguauaacgaacaaaucacuucggagucccaguaaacuuacccuuauaguaucacaggggcuucccauugucccuaagauaaagcucagacgacauaaauugauccucgcuuguaccuuaaucuucaucucucacuuuucgcuuaucacccucugcuccagguaucuccacuuucauugucucuuccccaccacacaccuuaccugauauucccucugccugaaacuuaaccauuuguauuaauaugccucuuuacccuuugggcuucagcuuacuccagaagucuagguuagacgcuucuccaggcccuugaagucaauacggcaaggugaaaauua

SEQ ID NO: 14593 - RNA, 770 nt, Homo sapiens
uuuaaaauaaaaaccauagauuucccacccucuuuaaucccuuccuuuuaaaaauguucucuucucugcucuacguccucccacuucccgguucaaguuucacuggugucccgacccgucccccugcccucugcccccccccccccccccgccccugccccguuugcauuguuugugugcggcaucuucaguauaaaaggccagcgcccacggucccaggagcgccucccuccuucucucccuccucccucgggccauucucucccucccucccucccucccuccccuccaguguuuauauguaaggguacugguugaccuuggcggggcucaguggguauccaguguagacgguggaggcuggcgaggcgcugauguaggucuggugggcaaauugggcuggauacugacucggguggauggugggcgagggcaggacccgggggcccaugcucacggggaccugguggacgaugcuggcuggguaggcagugugcugcacgguguggcgcgcagagccuugcgaggccaccaggugggccacggugccgguggagcccagggccgccggcgcaguguagguguagagguggggcuggguggggaggugggcagcggcagcggcugcagccagaugcgggugcacagugccguggcuggggcuguugugcgggaaggaguacggagccugggccauggugggagugauguaggccugcugccuucgguggcucccagugcgguccguggugaugugcugcugagccugg

SEQ ID NO: 14594 - RNA, 770 nt, Homo sapiens
ccaggcucagcagcacaucaccacggaccgcacugggagccaccgaaggcagcaggccuacaucacucccaccauggcccaggcuccguacuccuucccgcacaacagccccagccacggcacugugcacccgcaucuggcugcagccgcugccgcugcccaccuccccacccagccccaccucuacaccuacacugcgccggcggcccugggcuccaccggcaccguggcccaccugguggccucgcaaggcucugcgcgccacaccgugcagcacacugccuacccagccagcaucguccaccagguccccgugagcaugggcccccggguccugcccucgcccaccauccacccgagucaguauccagcccaauuugcccaccagaccuacaucagcgccucgccagccuccaccgucuacacuggauacccacugagccccgccaaggucaaccaguacccuuacauauaaacacuggaggggagggagggagggagggagggagagaauggcccgagggaggagggagagaaggagggaggcgcuccugggaccgugggcgcuggccuuuuauacugaagaugccgcacacaaacaaugcaaacggggcaggggcgggggggggggggggggcagagggcagggggacgggucgggacaccagugaaacuugaaccgggaagugggaggacguagagcagagaagagaacauuuuuaaaaggaagggauuaaagagggugggaaaucuaugguuuuuauuuuaaa

SEQ ID NO: 14595 - RNA, 70656 nt, Homo sapiens
auuguuuccaguuguggaguuuuaaaguguuauuuuucaaguuguaaugagaacuagaagguauuuaaaauuggcuuuaaaaaccuauuuugggccgggugcgguggcuuacaccuguaaucccagcacuuggggaggcugaggcgggcaaaucacuugaggccaggaguuggagaccagccuggacaacguggcaaaacccugucucuaccaaaaauacaaaaauuagccaggcaugguggcgcaggccuguaauccccgccacuaggguggcugaggcagaauugcuugaaucuggaaggcggagagggcagugagcugagauugugccauugcacuccagccuggacagcagagcaagacucugccucaaaaaaaaaaaaaaaaaaaaaagaaagaaagaaagaaagaaagaaagaaaagaaaaagaaauaaaaccuauuuugaaugauugggaaugcaaaggugguagcuacacaccucccuuuuuaauagcugcagucagcaggaaucaaauaauuacaccauuuuuuuuuauuuuuccuucacuuuuuuuguucuuuuuuuuuuucaagacagggucuugcucuaucacccaggcuggagugcaguggugcaaucauggcucacugcaaccucagucuccuaggcucaagcaauccuccuggaguagcugggacuacaggugugugccaucaugcccagcuaauuuuuuuuuuuaacugauuuuuuguagagauaggcucucguuaugaugcccuggcuggucuugaacucuuggccucaaaugauccucccucuucagccuaccacaaugcuggggucacaggugugagccaccauccccagccacaguuuccuuagacauaugaagagcuggguggcaauguccagaaucucaauucagaaugcagaucagggggacucuuugagucuggcaaccccaacccgcccggaaaaacaaacagccuuguaggacaacagccuuuuaggacuugaaccuucucaggcccgccucucaaaacaauaugacuugaaaauguuuaguuuuucuuguauugucucacuugccaaaccuccgaaagcaauuugagaguaauuucaaccacaucuuuuagcaggccuugugaaaaauaaauuuaacagguuaauugugugccguuuugauuugucuuggcaucucaauaaguaaaagguuaaaaucauggccacaaaaaguaaauaaagcuugauuauuccaguugaaaauucauccauggguacucuagugccuggcuuucguguugaccucauugccauaugaccaccaucaauagcucuuuauauuuaauuaauuuccuaaaaaaaccacacucacacauuuguaauguuuguaaucuuuuuauuccaugauaauugauguagccuagcguaauuguaguuuuugugugugugugaaguaucugacauucugugcuuuaguacguuuuauuucaucacuuaaugugucccccccacccgcccacuggcugugacaguguuuuugcgaaugaaacaguucagugagaccugggaauuuccuguggcauuuauguggucucaugcucaucucuauuugccagauaccauccguguaagaaccaugcucaacagauacauuuuggagaaccagaugucucauuuugucauucaccaaugagucuugaaaggcugaauucaagaagacaacuuuuuaagaucuuucucucucagucuacaaaagaaaaaacgggcuuauuacugucaccgcugccuuuaauuauguacagucacaauacaauuaucucccuauuuggguguuaucuccccugccagaucaccaaugccucaaauugggagagcacggcuucuguuuauuguucauccuuugaaaugacuuaaaaggaagcugaguacacaguugacccccuagccaaggggauugauaguggucucgggcuggggagaggacucugugauucuucccaaaaggucacucccuauccagaaugauaaguccucaguuuuuagaauguaguuguuagguaaagggauuaauccagagaaagagauuuuaaggcugcaucauugauuuuauuguuuuggauaagaacguggaauuggcuuuucuguaaauugaguacauuauauaaggcacagguuaaagugauccuuccacgugaauucuuucaugguuauuugauuauuuucagaauaucuugacauuugaaaggcauacagacaaaagccaaucauguaaauaauugcauuucuaaaacagucaucagucuucuuuuacuucaccauuuuuaaccauuuggauucaaagcuggauuuuaucucaacuaaauagaacagcuaauauccaauuuaaugugcaacuguaaccagucagacccagaaauuuugaauagcauuuguaacuuuuaaucacaaaauuaauggcauuaaacucuaacagaauagauuccauuuguuaauuuuuucuaaucaaacuucagauauuuauccaugccucaggugagaaaugucucaccagacacccaguuaaaugaaaaguaaaucauaccuuuuuuuuuuuuuuugagacagagccuugcucugucacccaggcuggagugcaguggcgcgaucucacuggagcuugcucacugcaagcucugccucccggguucacgccauucuccugccucagccucccgaguagcuggaacuacaggcacacaccaccaugcccagcuaauuuuuuuguauuuuuaguagagaugggguuucaccauguuagccaggauggucuugaucuccugaccucgugauccacccaccucggccucccaaagugcugggauuacaggugugagccacugcacucggccaguaaaucauaccuuuuuaaaauagcauuucacauuaauuauacuuacuuaguuaacacugagguuaucuauuauugcauaagauaccguugauuuuaguugcauaucauaugcagguaacugcuugcuugcuugcuuuuuuuuuuuuuuuuugagauggaguuuugcgcuugucacccaggcuggagugcaaugguuugaucucggcuugcugcaaccuccaccuccuggguucaagcgaucgccugucucagccuuccgaguagcugagaugacagugcaugccaucacacccggcuaauuuuuguauuuuuaguagagacaggguuucaucauauuggucaggcuggucucgaacuccugaccucaggugauccacccaucucggccucccaaagugcugcugggauuacaggugcgagccaccgcucccagccacaaguaauugcuuucuuuguucuuaccuaaaagauaagccaaaguaaaauagaauauauuuacuacuuaacaccuaugaaacuagauuguucuaauguauaaaggaaauuaaccaauauguuuuauauauuauacaaauguacaaauauuuucccgagaaucuggcaauguuucuaaaaagcagcucauucuuuguuguuguuuucugauuauaaaagcuagugagucaguaccacuucugaaauggcagucacuacauuaggauccugcagcagugauucagcaccagauuagugacacucugcaguguuacuaguugucacaaaggguagaucaaaaaguauaaaauuaauuaaaaacuauguauguguacaguucuucuaaaggucaguuuuucaaaucauauccccagccaugaauauuuuuauauccuuuuaccugaugaucucauuccuuaaaauuauaaguaauuaauuuuuuaaaagcuauauguguauaugugauuauccaacuguuucuaaagauuaaauauuaaaaacaaccaaaaucagcaaaugagcagugacaaaguuuauaagauggaauauuaauaauugguggacuugauuauaaguagaaagaccaaaacuaugcaaggguaacuauaggcuaucaagugacaaaaagaaugcaaaauuauaugauacuaugauuacaacuauguauuuaaggaguuaaaugaaaauuuauuguguuagaguuagaguguggaguuuuuuuguuuuguuuuuuuuuuuuaagaaggagucucgcucuguugcccaggcuggagugcaguggcgcaaucucggcucacugcaaccucugccccccaacaagguucaagcgauucuucugccucagccuccugaguagcugggauuacaggauccugccacuacacccagcuaauuuuuguauagcagcagagacggguuucgccauuuuggccaggcuggucuagaacuccugaccucaggccgucuaccugccucggccucccaaacugcuaggauuauaggugugagccacuguacccagccagaauguggauuuuuuaaauuuuguuuucuucauguuguuacgaaguugucuaauacauuucuaacaucuuuuuguuauaucagcacuuuauggaggacuagaaggcaucaguccauauccccaaaauauggugucuuguuguacuguggugccucuuaacaaaugauuguauucauuuguggccuucuaaaagagugacugcuuuucugagagucuuuuaccuacucccagaaaguuauuuacucugugggacaguucauucuguugcaucuuaucugaguacuuaaagccccaaggaagaagaugauauuugccaguacauaaacugacauuuuggcaccuaaucuuugacuuuaagaagaaccagaggacccuugaugguuccagugagcccugggucuucugugcuuucguggcgaaggccucuuucagaggacacaccacggcagccccugcuccucaagucucagaaggccugaacccaugguagcuggaaauaauagcuugacauuccucccucauuuuaaacugugauuuuuuuuuuaaacacucuucuugaccuuuucuuugaaggaggaacaaaacagggaaaacauugcucuucaguacacuagugaauuauuuugacaauggcagucucccgaaacaggcuaccaugucaucccuacgcuuuucucuugugugucuuugauugggugucauugccaguccuuacagaaauuggcuucuggcccccaauagucacugucuaucggcaggaccuaucacauaauugcuaucuugaaagcaccaucugggcagcucaguguuuaaaaaaaaaaaaaaaaaaggcagaccuccuuauugacuugaaagagcuuacagucugcuuguaaacagaagacaugaaaugacugaagaauguucucaaagcucaacaugaacaagucacauuacagacauuugaacugaacugaaugcugaaggaccuugaacaaaugagcaucugggucagauuagcuaggcagauggcacugggugcccaaauggagugagcaugcauggaagaaaaagugaaggcccaggcacucauuuagaggggaggaguuugguaauauaaugaggauaaagaaugcuuguagauuucugguuagugaguaguagaauaaaaauugugacuaagcaccauggguggauggauggauggauggauggauggauggauggauggauggauggauguggccaggaggcugaaggcagugcucuauccaggagagccaggucagcgcaugcauagcuagggcauaagcuaagaaaauggggaagacacagcaaauuccugauacuuuacauaaaaggaguuuguuggguuuuauuuuaaaaguguugaaugugagauaaaaaagaagaaggguugggaucccuaauguagaugaauagcuuuguuucagguccgcccuucugggcacagcgggucacaccuguaaucccagcacuuugggagaccaaggcaggaggauugcuugagcccaggaguucaauaccagccugggcaacauaguaagaccuccaucucuguaaaaaauucaaaaaucaaccuggcauaguggcaugcaacugcaguccccgcuacucaggaggcugaggugggaggaccaccuaagcgcaggaggucuaggcugcagggagccaugauuguaccacugcauuccagccugggugacagagcaagacccugucuaaaaaaaaaaaaaaaaagagagagaaagaagaaggguaaccaaggaaagagcuggaaggaauuuuaagccuuuggaaacuguuguuauggugguguuagagacacucuguauuaaggucagaggaaggagucugagcgcuuguugguauguuguaaauagcugauaucuguaggaugucuaugcaaaugauuaagguaaaaaaauagggagcaguuaguagcagagauuagguuuuuugaucauuucugcuuuggcugaauuaauauacagaaggaaaaacuaguugaaagucaaaggggcaccuaaguuaaugguggagagugagaaaagagacagcagagaaauuuagggcuacaguacagcucagagccacucacuaccaaaagaagagaccagcggagguggcccucguuguccccugaaagggauguugcgccauagcaggaaggguggaagccaugugggaggaauaaaaaucaaggguuugcaggagaaaaauccucaagcuacuuuuuuuuuuugagacagucucacuguguugccccggcuggagugcaauggcuugaucucggcucacuguaaacucugccucccagguucaagcgauucuccugccucagccucccuaguagcugggauuacaggcacccaccaccaugcccggcuaauuuuauauuuuuaguagagaugggguuuugccguguuggucaggcuggucucgaacuccugaccucaggugauccaccugccuuggccucccaaaguugcugggauuacaggcuugagccacuauacccaaccccucaagcuacuuauuguaguugagaaagaagggugcggaugacaggaaaaauaaguagaugaaugcaaagugagauuaacaugagauauuugguugguugguugguugguuugcuugcuuguuuguuugacuucaggagaaaccuggaucagauugggcaugaggggaggacgcugaagcgagaugaccaagugugagaggagggucgucagggacucgguaccaagcgugggggcagaguccuccuugaagaauggccccuuggcccaggccucugggguuugaucccuggucacccuguauguggacacuggcuuggcagaagucgaggacaagaauauuucugagagcuggugaaggaagacucgugggccggcauuaugggugggcuucgggaaagcaggagauagaauugaggaaguuccuggcuaguuccuucuccuugcucagucugucuccagcuucaaaggucagcacuguggagagugcuaaagucucaagguuaaauuuuaccccagagucuaauugaauuuaacuuuuacauuuuguuuguuuguuucuaaugucucaaaagccuguuuuacccaaagcuauuuacaguugccguuggguugggaucccuaacguagaugaauagcuuuguuucaggucugcccugccuggagccccuccuucccaccaguuaccuuuaugguuacauaugguuuggcauagaauaccaguaaaauaccaguagacacagcugaggugcucuuuuuuguuucugaaggauuuucaguauagugucauauccgaacgucaggacaguggaggaagcccacgaggccuccagcucaucaguggcagagccagcauucagggccccugugacucuccagcugcauugcacugcugccccugagcuguaaacccgcuuccuaguuaggaagaaagcugaauuaggugaucuccaguccagccuuccaaguaaggcuucugugaauccauggcuguaagcauuugaaugaaugucguauaaagaaggugaaggucaguggagaccagaacugggaggagaagcuucaugguggaggggacuugaagugcacucugaaaggccagugggcaugagaagggcaggaugcagggagaguuccugggcugagggaagugugagcaggaauuagugucgaaggucauggacagaaaggagcuggccugaaacccagucagaggccaugguggccagugggaagguggggucugaugauggagagcccugauagucagagacaggacuuggauagugucaggaaugucugaacagcagggcaacaugaagaaaguggcauuuuaggccaggcacgauggcucaugccuguaaucccagcacuuugggaggccgaggcaggcaaaucacuugaggucaggaguucgagaccagccuggccagcaugugaaaccccaucuuuacuaaaaauacaaagauuagcugggugugguggcgugcaccuguaaucccagcuacuuugaaggcugagguaggaguaacgcuugaacccaggagguggagguugcagugagccgagaucacgccacugugcuccagccugggugacagagcgagacuccgucucaaaaaaaaaaaaaaaaaaaagugguguuuuaggaaacuucgccuggcagucguacacaggagagacagcuagggacaggcuuguacaccccugguauauggcccgagugguaaacucaaccugaaugugauugauucccaaggaaauuucuuacaggauuucuuuggcaagugguuuauaagcaacgauagaaagaccacaggguacccaugugaccucacugaggaaaaaggcaugccaaaugaaucccauuuauuuucuucauaacauucucagagaguucuggcagggaaauaacagacaaauccuuaccuuuauacagugcuuuccugcuaaaaguacauucuaaauuucaacuaggcacuugacaagugugugaaauucugugagcaagauggagaaacauagauuggagaguggugccgcuggcuggauguuagcuaaggacuauacucaaagagcauggauuaaagagggcgaggucccuuguagaugcugcaaaaaucuaugugagugaauugaaugaagacauaaaaggcuuuuuagcacguuuguggguaacacccuuuggaagaauaaagaagaucucaguagaggucagaagccaagcuaaacauauaacaguuggugagaauaauguagucuuagcaaguguauuuuaauaaucaauuaaugugaaaaaccugaaauaauauuaaaagacucugggaggagggaaaggcuuugggggagauaguuauguaaggaugaaugguuaguaucagguggcugucaaaaggguuaaugcaaucuuaggagaguaagaaaagcauaguauuuagagcaagcuuguccagccugcaggcugcaugcagcccaggacagcuuugaauguggcucaacacaaauuccuaaacuuccuuaaaacauaugagauuuuuuugugugugugauuuuuuuuuaacuaaucagcuaucauuaguguuaguguauuuuaugugugaugcaagacaauucuuacucugauuagcacaagggagauaauggccccauuguguuauguuacauuugggacauuuuuauguucauuguauugugggugggcuguuauacuuuugaugugaaggguaguagaaggaucuggggauauguuucagcauggagaagaaaggagaagaccccaagguucaugaccacugucuucaaguauguaaaagguugccauguugaagacaccacagauggguagacuuauccugcacuucuccagugggcauacuuagggcauucuaagcuaggcagauguuagacuucaugagcagcucaccaguggagagcaaaacagguuugguguacagcugucagggauucuguagaagagacgcuuauauugggugucggauuguucuccaggguuucuaguguguuaaguauuauccaguggugugcuggagccaguucauaccagcuugcaggagcugguuguuaaauaaugaggauuuuuaagggcuaguaguuaaaauguuguuugcuugaaaugggccauggaagcaguauuuauaccaaggaaauuggcaauagaucaaccccaccccaccccaccccuacccagugucagcaugccagcauaccaccaguauuauccauaauaaaaaggugucuuuuagaggccgggagucucuggaauguggaagagcagacgggugugggaacauccacgugcguguucuuuggaguuuucagauucuguuuccuuguuaauggugcguagcuccccuuuugugcucauaccacuuccuaucuccugccaagaucuggggccugugaguuucucugucucuggaucugccaggaaaacgcagauaucuucuguugcuuggaauaauucuuuccuuguuacguaucuagacuggcuagcccucugugagaggugccucccaccucauucucagcacuagccucaaggacugugaauaucagaugaauucaaccagugaaauaggauuuggaaacaccugggcuguugagaacaagugauuguaggaguaagguccaacccacaaauauaacaaagccccgcaggccauauggcaauaacagcccaaccgauggggccuuuggguugaccucagaucagccucuguccccaugcugccugggcagagagcaaacaaugacuuuauuucugucacuuuuaucucccuuauuucuuuguaaaaaggauuuaaauaaagucugagucaugcuguaaccaggaaaagcaaauguccugugguauacaugauaggcgaauucagcuguggucaugcaaauuguauuugaguuugguugaggcucuaauuaaaaacaacaacaacaacaacaaaaaauugguuguuuuuacuuuucuuaguugccuacuguguucuauuugaaacccuauaggcuuugccauuuuccccaagggugccuacuuccuacucuuuccuuuagugguuucccaagagacagacaauaacacccuugaccaguugggcuacaaccagauaugagcuucucaaacuaugggaggccauuccaguaaaguguguauugccagccagugaacuguuuguuuuugauaaaagguuuucuuggcaaaacaacccgcccaaaggugauuuuugaaccauggaacaauuccgaauuucaaaauucaaauuauaaauaagagagcugaaguauagguguugcauuuaacaugcaguuauauauugggaagcuauaaauaggucuguuuuugaagagacuaaacccaaguaaagauuagcuauaugccuguaugaugguggcauauguagagggaucagggagaacugaauaaaggaaaucaagaaauaacccuaauuuucuaauagggugucaggaagaaaagagcagaaaagagagagaaugcagcucuagccagccagaaguucgugggcuggagacacacccuuuaaaggaagggucugucuuccuuuaaagggcauaggcauaggccaaggcauaggccaaggacagggaauaaagagaaaacugaaugccuacugcagagacuauaggauagcaacagcagaggugacagugacgaccauauuaaccagaguccagaccugggacacuaauagcccaagcaggaaucucucucuauccgugcacaagcugcagcugcagccgggggucugugcugggucuucuggcuggagaucugaccccgcggcucagggccagggaaccuaccaaaaagauggacucaaaaaaggcugcuccuacuugaagggugcagaaagaaucggauguuauuaaauuaugccuguugaaucuucagcugcaugaaauggcauaucugugaaugcuuuuagaguagaaaauuugguuugaauggccuaauugugaugcguggcagggaaaggguuaagacgagagacagucccaggaaagaaguagggcagugagggaaauguggacacaagcggcauagaaaagcaagugaguucauuaagguagugcuccucagugaaaaaaucccucccggcccccuugcagcagagacagggcccuauuguuuuuggucagccaaugccaauaccacaugccgucggccucagcgagaaauauguccaucagucaguguuuagccuuccccaacuaggguucccagggagaaauaagcccuccugcuuuaagacauccauuguagugaaucgacuccucuccuggccacugagagugguauauaggaagguuacagucacacagaucauuuucugugcucuguaguucagauagaaaacccugguugagaaagacuaguagugcagugacccagaacuggccuuccaauauaaaauuagcaggcacuucagcaaccugggguuuugccugaaggagauggcagaaagcaguuguaauaaaagggcacucagaauuaggauguacaaaacaagaucuuauccccaccuucacagcaccucccaacucugccguaccuaccagaacucugacugucuccucuuccuaccuagguuguauauugucaaagacucuucucuguccaaauuucugguauuugguuuauaaaauagguuaaacuagugugggcauuaaauuaguuucuauggagaaaauuuugcuuucgcuuuccuacuucucaugaagucacuuucccugaaaauaauucaguggaauugaaaacucuuggcucaucuucauuucauaacauggccauuuguguagcauacauacauugaaugauuugagugagugaaugaguuaauuaaacauacaaugaaguuugucaaauaugucaacacucuguuugccuuuuccccguucauuuuuuuuuuuuuuuugagaccaaguuucacuguugucaccuaggcuggagugcaauggcacgaucucugcucacugcaaccuccgccuccuggguucaagugauucuccugccucagccuccugaguagcugggauuacaggcacacaccacuccacucagcuaauuuuucuauuuuuaguagagacgggguuucaccauguugcucaggcuggucuagaacuccugaccucaggugauccccuauugauucuuaaggugaucaaguaggaauggcugcuaccaucuuauggcugagggaacuuaggcucauaacauuuaagugacucaaccaggaacacaaaguagauagugacaaggucauguggagaacccaggucuccugaucccugugcagaccucuuaaagggcaucuggaaggaugguggccagucacauggugugacacaaaauaagucaaucaguuguguuuucgugagcacuuauuguguaacacuguguucagugauagcuguccaagaaaggaaggugccauguuucuguuuuuguuuuuguuuuaaucaagaagcuuauagcuuaauuggagagauuaaacugcuacaccuagaaacaagugccuggcaugacucuuacaguuuaauggaaggugugugaagggaaagaagagccuucuggaaggcaucaaaaaguuccucaggaagaacugaaacugaacauugugcagagauagcacuggguaaauccagaggccaaugagaguaaaggucuacccaggcaggggaugauggccaagaaucauuuggguggaggcagaaugugccaguccugucucugucuagagaugugcagcugaaggugaagucugauaagcucagcguagauaaggccuggggauuugggaccaauacagugaaaaaucgaauggacgaggucugaaggaacauuugggucaacacaagccacccuaacagcauaaucacuaccuaggaugguagaugaaugcugucuaacagacgacucugacugacguaguaccucccacggagggucagcgugcaagguggacacagugcaguccaaggcucuugacuacagcagaagccugggugagcugucgggggacugcuaauagaaguggacguagaacuggcaagccaggcaugggggcucaugccuguaaucccagcauuuugggaggccaaggcuggaggaucauuugaggucaggaguucgagaccagccuggccaauguggugaaaccccgucucuauuaaaaauacaaaaguuagccaggcgugauggugcaagccuguaaccccagcuacucgagaggcugaggcaggagaaucacuugaauccgggagguggagguugcagugagccgagauugugccauugcacuccagccugggugacagagcaagacuccaucucaggaaaaaaaaaaaauggagguagaacugaacucugaggauguuuaggauuugaauaagagaaggagagagcaucgcagaugaagaaagcaacaugcacagaagugucgaguaaggagaguauugcggugugcacaaaugacagggaagggucagaccuaaaagaagaggauguuaugaacugaacacagaaaaacaugaugggguaagggagggcagcuguggggccuugggagcaauuagaauuuggauuccgugugauaggcaaguugguucuugaggaaagcugugggaugaugaaagugagucaggcagcaggcuguaaauuggauuggacggagggaaagauuagaggcagagaaacuagccaagagacuguuucaguuaucgggcccaggccaagggaguaguggcauugagaauaaagaagaaaaagugacugugagguaaaucccaaaaagaaggcagaaacucaagaaauaaagguaaacgugauaagcaaagaugacucuugagcauccuaauuuuggagaugaaaaaaucaugguucugcuggaauaaguggggugagcuggagaggagccccguuuuguggggguggagggacaugaugacuucacuuugaggcauccaauuagagauacuuaagucaaugagaauaugguacuagaacccagggagagauuggggcugggaaugcaucugccuggugguagaugccuggcagugaaugaguucaccauggagguggaccaggguacagagugagggagugggagaaggaagaggagagagaagaaugaugggagaaaugagcagagaccagcaaaacacauuagcaacccuaaggggacuuggaaagcgaguugaggucaacagggucaguuaucaaagagaggcaaggcugaggaugagaaccaagggaaggccccugagucccaaaagcagcuugguggugaugugugagugcagccuuuccagcuucccuggcacgagucuccucauccaugguuaaaugaucauccaauuaucauauaggccuccugacuugccuccccacccugagccuucuugacccuaauucauucuccaguugcccauuacaagagugugcccuuccuuuaaaaucauaaccacaaucaaucauuauguuuccaaaauacaaauguaaucauacaucuucaccuggacuuguggguugcuuaggaaaugaaagagggguguguagaccccuccacuugugcguccaucagugcagggcagggagcagggacaagcauugccaccuuaaaggaagaaggagagaaagggccaaggagaaaagaaagaggaagugagcauguucagaagcaagagccaagaagacccugccacgucggauaagcggaaagacuccagaggaagacagaguugcugugcagguucccacacgccuucugucuacagccaccugcagaacugcaggcagcagccuccuugcccggcgggagccucuugcacagggccuccccauucacucucuacuggcuccacugcaacuuacgucuuugucccaaagggaagacugacauuuguuuguuuaucauaacuagcuucgcuugcucugaauuuauuugugugccugcucaacccuuuucugaacuauuuucugguuuguauuugucaugacuguggucccuuaacugacugugauccuugucaucaacucugcaccuuaugggcacugagaauucaguaacuggcucaucaauacucagcuccaggcuggggacccuaauuccuagggacacuuucuuauccaagcgaauuccccccacagucagagcagcccuucaugugaauuagcuauuuucuauugcucuuugucgccugugaauauguaauugcaugggaucgggaggaaggcagugauagaauccuagauuguguguuggcaagggcuuuagaaaucacccuauucaaccucccacucgcaggaaucccuucaacagcuuuuauuuaacuuauuaauagcuuuucucuugauuuaaacuguucccaaaaauaaauauuggguaggugauccaaggaguaguuugagaguugauauuaccaggaauaucguaaugaacaggccucuucuuaagcacucagaauuuggcuggacucgugagcguccauguugcgcuuuguccuucccaucugaguuuuguuaucuugcuacugacugcaaccccgccauggagacagcacucagaguuuucacaggggcuuggugaagccucaagcccauaacagaccaccauaaggacuccaugcucccuaaaugcauuaaacaguuccaaagauguguuuuuugcuuugggguuuuuuggggguuuuuuguuuguuuguuuuugagauagggccuugcucugucguccaggguggagugcaguggcgugaucaugacucacuuuggcuugaaccucucagacucaagcaguacuccugccucacccuccagaguagcugcgacuauaggugugcaccaccacaccuggcuaauguuuugauuuuuuuuuguagacaaagucucgcuguguugcccaggcuggucucaaauuccugggcccaagcgauccuuuugccucagcuucccaaaaugcugggauuacaggcaugagccacugugccuaaccucaaauauguguuuuuaaugauguuuaagagccucacuuguauagcagcagcuuuuauguguaucucaugcuguuaaaccuauaggaacaggggccuggcagccccugugucauugaggcucuguuuugcugcuuuaucauucaauaagcugggcugcacauacacaaaccugucucuguaguaaagaaacaguuuuggcugggcacaguggcucacgccuauaauccuagcacuuugggaggccgaggcaggcagaucacuugaggucaggaguuugagaccagccuggcaaagauggugaaaccucgucucuacuaaaaauacaaaaauuagccgggcgugguggcaggcaccuuuaaccccagcuacucaggaggcugaggcaggagaaucgcuugaaccugggagguggagguugcagugagccgagaucaugccacugcacuccagccugggcgacagagcgagacuccaucucaaaaaaaaaacaacaacagucucgaggaggccagaggagcauguuuuguuccccccaccuuuggaaagaaaaaaacauuguacaaguggaaaaucuucacuaaugcaacauaaaacuuggcgauuuucaucacaccaggucagguaaucccaggcugugcuucuugaggcaguggaagcugauuuccuuugcucacuuaucaccugugccucucaauggcaugucuguaacaggaggcagaggccuccuucccgagguccaugggucagaguuuuaccauacgagauggcggugugggaggugugauuugucccauaagaucucuaaaucccaccacccauucuguaacaguugauaguccucagcacugcauuuuccaguuacucauguuuacagacaaaugucucuuugucuguaguugcucucugaagaaaucaaagagcagcuguuguccugccucagcaccauggcauaggagguccagaguuagcaucgaggaugacagugacgcuguuucugcucugguaucacuugccccuugcuccuacugcccuagcccuugugucacuuccuuguucuccugaacaguuuuuuuuuuuuuuuuuuuuuuugagacagagucuugcucugucacccaggcuggaguagcaguggcgugaucucggcucacugcaaccucagccucccaggugcaagccauucuugugccucagccuccugaguagcugggauuacaggcccccaccaccacacccaucuaauuuuuguauuuuuaguagaggugggguuuuaccauguuggccaggucucaaacuccugaccucaaaugauccacccaccccggccucccaaagugcugggauuacaggcgugagccaccgugccggcccugaacagucuucuuuguguuuuccugccucuguaccuucguuaaugauguuuucuuaccugcagugcccucucccuucucucaacucugaagucggugguaccuaacgauucuauuuaaauucugccuccuugaauucucuccuguucuucccagccuggaguggaguccgcugaggucuacuagaguucaaguuccaugagaacagagacugucuuuuuuuguucacucucuaauuagugcccagcacauaauggaugcucaauacauguuuauugaaugagagagauugcucccucuaaacguagcuggcaucugacauucaugauuucugucuguauuccuuuuuccauacguguacacgagaugauaagcuucuugagaacagcaaccaugacuugguaucacccucuagcagagucuugaacaugcugggagcucaauaaauaucagugauugaacuuacuacauaaucacucaauaauccaaucauguccccgagcucaggggaagggggaggcagacagaaugccuuccuccugcugucuuauacaaagccacucgugagcagcgucuuaugcaaacacaaggccccauucucccccagcccagcacuugcccaccuaggaaggauauucucaagaacaugaggcuguugacaucacauuccuuuuccaaaaaugugcaaaggacuacagaauuguucaagaagcagugauccagugcuuggcuaguuaauuccugaguaagccacucugaaaacugauuauaauccuguuucaaauggagaauugggagaaggccaauaaaggguauauuauuguaucuuguaggagggaagaauccggcagauauucacugaguuauggcgccagagccuuccucucuaauguuauuguaaauaauuguuagaguagaaagccagaucagcaaagugagacuccagcauugcaguuccucuccacggaggucuuauauaacgaagaccuccauaaacaaacauugcagaaacauaacaucggaucucuccucuuaaaguucacacuguguaauguaaaguggaauaaucauuuuacauuccuuguaaguucuaagaagucccuucuggggcagcuguuugcuaaaccuuuuuuguuuguuuguuuguuuaauaaaagaaaacaaauuguguaccucuccacagugcccccgcuauagagcuaaaagcagugauuucauguaaguguuucauuugucccccuccagcucgccucucuccuaggagucacgaacucaagugccuccagggccagguagguggucagugagcugguaaugacuaaggucugcaucuggugacacacacgugcagagggcagccuuauccagccccaggucauugugaccacgaacugacaaguggcccagaguugccagagcuuuugauuuucagcaggaaauccaaacuuuuaggaauaucaccugaguucuaaauguuaauagcuaguugaaaaaauuuaauaucuaugcaggccaaagagugucugucucugugccggguucauccuguggaauagcagcuugcaaacuucaugccauccguucagucuugccugcauuugggugcuuggaaguccuccucaggcuguguuuuccuugugccuccuaccuuuuuagaaagugcuucauugguucccaucagggcagggcaggggcuggauggaggaccuagugauguguuggguaucagggggugcugaccuaaggcuuguuggaaacacaaauccagagcuucucugcgugcucccuccccucuuagagacgcccaaucaguaucugucacugcauaacgaaguaccucaaaauuccguggcugacacaauaaacauuaucucaccguugcugugcuccaggaauuugggagcaacaugacaggacgauucccacuccaguucugucaugagguggcggugagcucuuagcccaggcugcagucacccaagggcgugacuggggcuggaggguguucuucccaggugggucacccuuguggcuggcaagccagagcuggcuguuggccagaggccuggguuccauccacguggaucucuccacagggccauugaggguccucuuccagaguaagugauucaaggcagagcaaaagcagaagccacaugccuuuuacagccuagucucagaagccacacauugucauuucugcgcugucuuauugguuacacagguuugcccugcucagugugagaggagaccacaccaggguguugacuuccaggagaacuggguccucaggggccaucuuaagggcuggcugucacagcugugaucacaacccucagucggucccuuaugaacaaaugguccaacccugagaauaguuuaaaaaaaaaaaaaacccgaagggaauaaaauauaugucauagugauuugcaccuaauauucagcccacuuacuauuguguuccccagaucagccucagaaauuaaauauccuuuuuuuuuuuuuuuuuuuugagauggagucuugcucugucgcccaggcuggagugcaguggcacaaucuuggcucacugcaaccucugccuccuggguucaagcgauucucuugccucagcuuccuaaguagcugagauuacagguucaugcuaccacacccagcuaauuuuuguauuuuuaguagagauggaguuucaccauguuggccaggcuggucuugaucuccugaccucaggugaucugccugccuuggcaucccaaagugcuaggauuacaggcgugagccaccaugccuggccuaaauauccuauuuuuauaucccaucuuagaacugucuucccugaauguaucuaaagucacuuuuuaaaaauauuuuuuaaaauccuacccauaccaccucuucaagcgauagacugagguguaccaaacagaagaacccuugcuuuucaagggaacccuuucgcuugcugcuuaccccugucugcuuccagggguauuccuaggucucucaguugcucgagcaacuaaaccuaaccaacuucucuacuaaaccuaacguuuuguaaagauuugaaaggaaaaucacucugaacaaagaguagucccugcuuugguauaccaguagcaccugugaagacagguggccccagaaguuuucugggacccucugaauugguaggagaggggcaccaguuaaucagaggcacagacagggaggagcaggguugcuccuguuccugcagcaguauccauuucugggacccacuuuccaaaccacccccccgaauucuaacagcaggagacacacacacacacauacccucaggcucuacaucaccucugccuccuucaagaccacccuuaauauucauuuuaaccagauuuugccugaauaaaaacgugaaggggaagaaaaggugccccaguguguuuuccccuaggaaaaucccuacugguaacuagucuuauuugcucaauaaacaaaaucuuaggcugggaacugaaggucagcacaagcagcaucugcgggugugcaccggggcucuggggcccuguaacauuugcgcguguaccugggggaaggggugcugcaucggcccgccccccgcagccacccgccgcagcaguggucaccgagucaggguguggggagguggaaaugaaaugcauaauucauaggccgcugugguguccagucugugggaggggugguaauuacagaacugagaaaugaggcugcagcgggcaagucaccucuagguuagaggcugcuaugauagauggccugcauuguucucuuucugaccuuuuucugaacuuccccuuagaagaacagaggaaauauggugcugccuuuucccauauuguuuuugaauaauaccuucagacgccagcuuuuagaguuucuguucuuccguuugggguuuugcuucccccuccacccgcccaaugccuugcuucuuuccauagaaaaaucgaaucacuaaugacuuuauccuaguauuaaugguaaauacagacuacacaaauauuuguccacacugaacacaauacauacggggaaaggaaaaaaaaaacccgcagcacccucucccuccuucugcuccgcccuccacugccaagcaagacaaucccaagagccguccuccguccuccguaaugaugcagacggggcugaugagaaggguggggggcguugcucgguaggaagugauggaaccuaagcucuggcuugcagaauagaaucguuuuaaccggacgugaaggugcaagcaggaaugaugcucacucccauguaagcuauugaugcuaucccggggggauaaaguaacaaggcuggggacugugugccguauucccuucaucagccuuuccacuguguaacccgaaagccgcaacgucguuucccuccacgcuucucucugccgcuagugauuuccuggucugaacugugacucccuagugauggccuguaacuuuggguucugugaucaucugaagucuaucaaccucuauauagucagggaaacccagaagagggaagagggaagauuucuguuugauuuucacacaagcaagacuuacuaaagaguuaggcagaauuguucacuuagccuucaauucaaaauugaaucucagguugaaacuuugggguaugugggguuguuuuguuuuuugaaaaauguaccccuuuugaggccaaaugaaaaggaacuagacaguucugugucagagccuuucagacuggggguggaauuugguuagcuccauuuagcggguuaauguugauugaacuccugcugugugcaucaccacccugagcuguguggcagcugagcacuucccugggaagcaaauauagguucugucuccucaaggaacuuuugaucucuugggggaauccaggacaagccuaaauacaaccauacaaagaccuacuuacacagcugacacuacagagacaggccugccaggcaggcccucgcugauuuccagugaugccacaaaacuuuucuuccuuggcaaaaaagaaacuaagcuguucauaccaaugaucacugucauucuuucaaacaucucacagguuuuuuuauggguuuaauugcuuauggguuuuuuuuaauugaauuuucaaaaucucccuagcugccuccucccuaucuccacuuauucucucuucuucuucagguagguaaauaguaucuccuuuaucaccugcuuuucacccacuauuccucagcauauauauagauaucuagauagauagauauagauagaugauagauagauacaaacucccuaugucaagcuucuccuauuaaaaaguggagcuuuauagguuucuauucacauuucaccauugaaauccuuauuaucagagaagaacuaaaagagccacuuauuuccuuaaaaguaaauaaacaguaagaaaucccaguuuucacuucuucuucacacaaucagcuacucaguucagcaaacaucuguguauuggguauuuacuguucuuagcacagugcuuggcgguaggaaagaagauaaugaaaccacagcuucuuccagcucaugagugugaacaaugacacccaaugucugcagacaccgacccucucaccccaguagacaaggcuguacgcugggugcugugagguguacagagaucagucaugcacaggccauggccucgggaugcuuccagucuaggagcugauuauagaugauucuuauuuaaaaaaaaaaaaaaaaacuaucagugcaaggaugagugaaagagcugaauuggcaguagagacauaguuagcguuguaggaauagagcacaggagggagccucagucagcagggagugcuagagcagguaagguuugaguagaaagcuucaaaggcuuuccaugagagccaggccagacaugcuuuccacagggccacugacagaggugcggaggggaagccugggugugcucagggagagucugggaccaccaagagucucaggugcugccucaccgccccucacucuuucuucucugacuucccucaagagucccucccucccuuccuccugccuuccuuucuucccuucuccacccaaagccccagcugaugugugacagcucccugauuccauaagcugguuagcucaguuggcuggaguaguguuuggggcucacgagaacaaaaugagcauucucaucucuuuugcugaauguugcuccguuccaaaggcacuguaggagagucccuguucuuggacuacaaagaggccccauuguuaggauaagaaaacugguuaaugagaagauggagcagugguauccucaucugaaaacuuucuuuucuuucuuuccuuuuuuuuuuuuuuuuuuuuaagacaaggucuuacucugucacccaggcuggagugcaguggcgugaucacagcucacugcagccucgacuucccaggcuuaugccauccucuuaccucagccuccugaguagcugggacuacagguguguacaaccacuccuggcuaauuuuuuaaaaaauuuuuuguagggacggagucuuacuauguugcccaggcuacucuugaacuccuggccucaagugauccucccgccuuggcuucccaaagugcuggcagugcaugggugagccaccgcaccagccuuaagggaaccguuuguucccuuacccagugggucgcgucccucugucuccauggaaguugaagguucagguggcuuuccgagccugugucuguugcacuucagcgcccccuagugggagguguaaagagccagcuuaguauuuccucugugacccaaacacaagaaggcaaacuuugguuugguuugguuugguuuguucuuuuucagcuccuuuaagaaaaguugaguguuggaagguuuccccugaguaagcugcccuuggcuggagaccuggaguuuaugcccauuuuguuuggcaagaucuucuuguuccuaacuccugcuggaauaaccaaccagucaccgugagagcucgcucuuguccggaccacagcagguccuaaccaggagugcugugagcagacgggccauggccacauuuacucuguggaugcucccugcucuaaaauuggguaaaaaacauacccucagugaguccuguuuugcugguuugauggcgugcacgucuccagagagcaaggccagccucauccaccuggcuccccucaccgcacucacaccugccugcuuagagucaggccgcauccuguacuuacaggaucagagccuacuccaucggccaggaguaguggcuuuauuuggaaaguugcuuagguaggguauuaguggguuucggcccugcuuucucaguaguuuuccaccuaacacacagugcagugggggagaccuccucagacgauaccuguuuuauuggaauaucccuuaggcugcaauggaaauucacucucuaacuuguguuugacauuuuuacugaguggguuccuuuucauagcucaaguuucuggcuucuguucucuuaauugguaugucuccggcuggugacacugaauguaucucccuuucaaagaaggagcaaguuucugucuuuuaucccagacugucagccauaaagacugacugugacuuagcuccacaagccacaugaucagauggugcuguaaggaaagaaaauaccccaaagaugagccuugucuauggcacagucacucaucugagaguuggggauucggggcuucuccaguggaggcacugggaaccuuggaaaggaaagcaucguguuucuucugccuguuguugguucauucauucauccagcaaacacuuauugaggccucaccaugaaccagucgaagcuaaauguugaagcaaugagaaguuuugcauuuaaaucaguaaaguugcacauaagugauguuacuuucuuaguaugcauccaucuagaguagagggugaaccuugaauuaauguguuaguguggaagagaccagccuuuuccccagccucacaucucaugaucacuauaaguggguaacaucaccaggcugaauaaagugaagacgccacaucugcaguugauccacaggaauugaaauuccaaaucccuugccagugcagagaaaagaagaguggucccagaaagcugaaaagugacagcaggugacagugggacuuggguuaggccuucccagaaucagcaggcuucccaacacagcucuaaaugcccaguuucaacccucggcuucagucaacagacuaacaaugaaucggaagaaaaacagucaacaaaaggauccaugaugaggaccaucauaaaagaauggcugaggccuggcuccuuucucagccacuguguugggauucccagccucuggccuuugcgcucaccugggcaggagccucaucugagcacaguggcagagcacagcgaggcaugggggcugccacaccgaugugcacccauacccaggcuugagugugcaggcugcaugucaccucccacacauggugacuucagagccccuuugaggaggagggacagcggaugggaggaaauaccacagggcuuuugugauguugacagugcucuguuucuucaccuggcugguagugacacuggucuuuguuuuccaauaaguuguuaagguauacguuuuuguuguauacuucuuuguauauauauucucuuucauaauuaaaaaaaaagauaaaaacauuuaaaaagagccuggagcaguauacauaugaaaagauuacauagauaggcaccugcagagacacaugguuccauuucucuggcugauaggugcuucugcaaacauuuguugagcacauucuuugacaaaagucaccaagcauaaagcguggccuggugacacuguagucugguagagugcugggaggucagaacaggcuuucuccagcaacgcagagcuucaugguauagcaccagagaccagauugggggauauugggccacccaggccagggauggguaaagcaggcacagcacgugucaggaguauaaggaucucaggaauuacagggcagcgugaguaucuuugaaauacuuaucauggaguccaaacugguucuucuaggaaccuuccucauugacauuacaauucauaguuuucuuuuuuucuucuuuccuucccuucuugcuuuucuuauuucaccaagucaagucaauaucguuuagguggauccaugucccuggcuguacuuucuucacuuuauucuacaugcacaagcacauaaccacaaauuuagaggccaguaugcucuggacaucugagaacugguuuccaguuugcaccaacaucaccagaagccuuuggagauuauauucauuucaguugcagaugcaaccuucuccucuggcauguaaacaagugaguuagauuuuggugcuacgcuuagcagaguuggagcaggacuaagaacgaaggaucagugugaaaauguguguguguguguguguguguguguguauuuaguacauauucagagccaagauguucacugccaauaugaauagaaaaaaccgccaaucugauucuaacauuauacagggaauggccaguugaaucaaggaagccugcauccuuuaagagacuguccaagugugccaugagaaugaugucaacaucuagacccaacugcaauuauaucaaccuccauauggauaugaugguucauucugaagucuucagcacuuguauuggugauagcugaagauacucaguuaugacagaaucaucagugagggucugaaaugauccuccuuagcacacaguuuuauggacaucaguagcggccccuuagguagaaaaucucugcaacagugguucuacguguauuacaucaagcugcaaccacccagaaguuugggugucgugucuguccccccagcucuccuuuuggaguuggaacccuguucccuugcagcagcucuccaccuuaauuucuucagcuuauaaccaggcaaaaguacccugcugcagagugcacagagaucuugggguccacgguguuuggcuuggccauuccaaggauggcuccguggaagccagcgcaaugggugggccccuugucaaccucccccauguuuugcuccuagagcuucaucucugggucccuuuuuccuuuugcuugucugccuaucacccuaaucaaagacaaaacuauuucucuuugaucuccuguuugccuaggaagcugugugucuuuuuaagaauccaaucacagguugaccugggauuagcucaccucaauggccaucuacaucuccacuuggaccuucuggaucccccuaggcaugguguggauucauccuguggggaggcugccccuguuuucccagcaggcuugccuguggucacagggcguguugucucuccaugcagcugccccgaggugcuuuccagcccuugccuuucuggcugucuucugugcagcucucucuuaccucuggcuccaauuccucugaaauagccuccuccuccucccugcucuucagauuucugccacuguuucuuggguccugugcugcuucacuguaaucccucgccucccacucccggucaccagcucaaacagcggcucagagcucaagacagcaaugcaagucuccuuauuuuugcaguggaaacauaagauuuaacaacccaucugaaauacaguuuuacauuuugauugcuucugccccagccauacugagguuacuuucaaucuacauauauuugugggaacggacuuuuucucugcaguucgaguacaccuuauaauaccagugauuauaaaauaccauggacuaauagagugucuugcuuccaaggaguuuaaacuguuuuauaauucugccaaccauaauuuaucuucauaagcugccguagagacaagagaaaaagugagauuaauaaucacauuuuauagauggugaaauaaaaacucagagaaauugaguaacauuuuuccagaaaugcacagcuccgccugugcgcuccgauuagcgcugcagauuuauuacccaaguucggaguggcagugaacccugcccuuguuuugucagugaacuauguaaaugagcaagacauugacucuggucucagacuugaccaaaguguuuggggugagcaagggacuauacccugaacccugcgucccagcccuuguugccgccgaugccauaagcagacacaguaauacagguugacucugcccaccgggguccucagacccacgggaccacccucccaaaccuguuccccgggcugugcucccugggcaucacucugaccucuagccuggcacacuguuaggacuccaagcagcccaagcgcauggcugucuuuucagucuucauugccuaguguacugcauguacccagcauucaugugagaugaaauaaaaggaacacuagguuacgguaguauuucuccacacaaggaagaagcaagaggauuguggauagggaguuuuauuccuuuuuuuuuuuuuuuuugagacugagucuugcuugcucugucacccaggcuggaguguaguggcgcaaucucagcucacugcaaccuccaccuuccagguucaagugauucuccugccucagccucccaaguagcugggauuacaggugcgugccaccauguccggcuaauuuuuguauuuuuaguagagacgggguuuugccauguugaccaggcuggucucgaacuccugaccucaggugauccaccuaccucggccucccaaaguacugggauuacaggcgugagccacugcacccggccagggaguuuuuauuucuaaagcuaggugguagguacuucacuguugguuauauuaaucuuuucagcuuuuuguguaaauaaaugaaacaguuguuuaguguauaugcuuuaauguauuucaacagaguguuccauaucagaaagaaaguggcuuuaaaaaaugaggaagcugggugcaguggcucauacccauaaucccaacacuuugggaggcugaagcggaaggauugcuugagcucaagagcucaagaagagccugggcaacauggugaaacccuguuucuaugugccuguggucccagcuacucaggaggcugaggagggaggguugcuugagcccaggagguggaaggugcggucaaccaagauugugccacugcacuccagccuggacaacagagcgagacccugucucaaaaagaaaaaaaaaauaaggaagagggaugaucuguuuauuucauugcuuucacauggacuuagacguguuauagauaagugguuuaguauuguucagcugacuacucuaugccaggccucugcaaggugccccccuaugaugcucuguuuaaccuagucuucauaccuguacccagaaguagguacacaaccaguaccugacagggcugggauucaacccggugaacacugggaucccaagugcgggccacgcccucuugacuucugcagccucuacaccuccacuggaggccauuccccugcagggucauaugaucuggacaugaucugggaaugcuucucagugugugcagucaagagagcgaguggagcuaaaucaucaaagcuuccauauugaugguguccaaaaugacaguuguuuuuccucuuucuuuagaaagauagaauuuucagugucuuccuaugagaauguuggaaagaaauuaucccccucuuucuuaggugcagauuuugucugacacuucauguguguuuaaaguauuuuugaugucccaaaauaguaaugaggcgauucuuuaagaugguuccaugggguggagcuguagcagugaaggugaggaagagcaaaugagagaucaguuaugacagaaccuggaaaugcucacucacaguauucaggaaccagcagcccuaccugccugaaaccgaaccgagaacaggaacagccccuguggaagcaaccgacaugugaugaucaacccaaaaaaccauguaaacucugaaacagaaaggccaagcugucugccucucacauaggagguacugacaagguggcauugccagcuccagggaaaacuggcaacugcugagggugugcacuugacauagacucauuccuucuacaaauguguauggagcaccuacaugcccaggcugcgugcuaggcgcuggagauacagcagugacauggggguugggggacuugcgcugcucugugugugguagccaccccugccuggccacuuacuaaggcucagcucagacuccuccugggaagcccauccugcuuucucucuccuccuccaauuucccccaucuuuguguacuauguacacacuucacacauuguaugucagaugucgcuaugcugcuaccuuggcuagacggugaacuccuggaagagcugcagggucugguuuacuuuuugaucuuuagcacccagcacaguaccuggcacagaggaaacacuuaguaaauggugguugaauauucuaauaagugagugaggacagcuugaaacaaauucuggcucagaaugacugucagaaugagcuucccugaagauuaagcaugcuuuagcaaccauccaacaugcuucaggugggcuggaugaaaagaaacauuuuagacuugacuuugaacuucuaggaccucagagccuuauagacuagcagagcagggggacaaggccucugcaagaucagaucccagcaaaauggucugaaguccccaaagauuccugggggccaaauggggaacuaccucccuuaccugaggguuuaugggcuggguguugagcagcuguuuacgaagcagcuucugugugccaggcugaggaucaaggacaagugagaugcagacccugcccuccaggagguauaguagaggcagauaugcaaacguauuugugugucaaaaaugacaauuauuggcugggcgugguggcucacgccuguaauccagcacuuugggaggccgaggcgggcggaucacgaggucaggagaucgagaccauccuagcuaacauggugaaaccgcgucuuuacuaaaaauacgaaaaauuagccgggcaugguggugggcgccuguagucccaacuacucaggaggcugaggcaggagaauggcgugaacccgggagguggagcuggcagugagccaagaucgcgccacugcacuccagccugggcaacagagugagacucugucucaaaaaaaaaaaaaaaaaaagacaauuauuuacucucuuucuccagaacaagaauguuuaguggcuugcuuugggaauguuggaaaggaaugaguccucuuucuuaggugcagauuuugucugacacuucauauauauguuuaaaguauuucugaugucccaaaauagcgaugaggaaauucuuuaagaugguucuguggggccagugggugcucaguuaguauuuauuggaccaaucuggucugaguaugucauugaucuuuguaugcuugucaccugguagagccagcacagagacagugggcagugucuguuugaauaaggaagaauggaagcgggcagggaggggagcaggcuguaucugaaacaugucucaugagugcagagaaaaggcugcacccuuaggggugggagagggauccagaguggauuggaaaagguuaaaaccaaaggcaagagagcagcagguggcuguagugaggcccagauggaagagcaugugauuucgcaugcugcagugggacugcgcaggauaaagucuucaacauaagagcuaagguggaggcucuagagggcguaaugacaauggccauaaaauaagagguuugggcuaaaucccugaggucccaaguccuaacccugcaugagccaggugccacuucuagcccuccuguuccuccucccugucauuuuugcuguaauucuuuuguuggccaccugcaaguagguguccuuggcacuccugcugucugcccugcuguggugagugugagccggguugcucgugccccucucugagccucagcuucugcuccuccuugggcuaaauccugcccccucaugcccaaaccuugauugcugcauaaugauucagcccuucuacucucuuuuaucugcacugccuuagagcuuugucuuaauccauauuuuaacacuuucuuauauuuaauaaagguuuauuugaucaacaaaugcuuaaugaguggcuaccgaaugccugcgcugcccucauagacuuggucagggaagacagacagugagcagguuaagaaagugcugugaaguggcauuuauggcacccuauaugaagacuaacuggugucaagggaggccugucuguagcgugacagcugagcuaagauuugagggaugagaaggaggcagccaugugacagccagcagggagagcauuuaaggcagaagcaacagcaucccacgaagacucuggcuccaaaggagcuccagguacucuugcaaauggaaaggaaaccaacgggccugcaacguauuaagcuaggagagugguuggcagugaugguggagaggugggcagggucccaaucguggaggccccauggccauggaggggucuagauuucauuccaaguccaguggggagccccugaaggcuuacggcaaggggguggggugccaucuguucccuguggcugccauggaggaagugggcacaaggaagggagagacaaguggaaaggcugcaguggaagcuccaggugacgcaggggugaccagcgccacugcugcggcaggggggauggagaaucaggggcugacuugagacuuuggagcuggccauguuaguggauagaugguggggaugaagaaaucaaacaucuuuccuggauuucugccuaagcagcuggaggguggugguucccuuucauaaaaugaggaggacaguggaaggaauauguuuagagagggggaucagagaauaguucccuucuagacguguggaauuggagaugacuaugagacauuccagaggcaauaccaggcuuccagaaugcaaaucuagagccagaaggagaauuccaagauggagacaaaccugggaauacaaauggaauuuaaaccuauggagcgaguaagaugacugucaguuuccuagggcugcugaaauagguaccacaaaauaucuggcuuaaaacaaaagacauccaaaaucaaggugucaacagggccaugcucccucugaaggcuccagggguagagccuuccuugucucuuccugccucggguggcuccagguguuccuuggcuuguggcagcaucacuccaaucucuuccucccuuuucacaugaccaucuugcugcugugucaguaucuauguccagauuucccucugauauggaugcaagucacauuggauuagggcccaccuacuccagugugaccucaucuuagcuaauuauaucugcagcaacuccauuccuaaauaaagucacaugccaaggugccaggaauuaggaguucaacauaacuuuuagggggacacaauucaacccauaacaauuaucuagggcuggguggaaggagagaagacggugggcuuaggacuuggccaacacacagcaguuggauagaagagggcgagccuacaaaggaaaugggcaagccacaagcagagaggcgggacagauauggggagcaagcgaugucaugaaaaccaagaauaaguguuucagggcaggaaggaaugaucacccgcgugaaaaaaauguggcucccaggucacagagcuaagaaguugaucaacagaugugacagcguggagaucacugcugaucucaacaagugcagcgcgucagugacgcagaguguccaacuccaauuagaggaagcugagcaaaugcugugaggugaagaggugggaaccacagggggagaugacucucuccagagagugggccuugaaggggagcugagaacuagggcagcagcugcugggagacgaagggauuaggaaagguuuguguuuggggcuuuuguuuuguuuuuuguguucuguuuuguucuuguguucugcuuuguuuucuaacgugggagccgcuagagcauguggugugcugugucggcucgauuuuuaugucugugucuuucugugacacacguuuuguauucgacucgaguuguccugugugcuuugauguggcuuucgcagcaucagaggccuucgcagacaguacugucucccagccaccuagccagaugccugggcauuuguucuuuacggucgcagcaggaacauucugcggcacguaucaugguaccgugaauggcugccauuucauuuucuugguggacuacaagcaauuuucccaggccccguucaugucacgucagucgucaaaaucuaugucugguguuuccugcuaaagaacaucacuaaagugccuuuguguggccauuuuaguuguugcagucugccuuguucaucacuggggaauggaaacuggaaaacgagguuuccguggguuaggaacagccuuccgggccaugagaaccacguaacuaaccugauaggaagggcaggcccauagucaaguucagagaaguccccuggggccagaccggccuuccuaagacuuacuugagugucaaacauccaaaccuacagacuggagcgucagacuuccaaacgucaggcugcaagagggcaggggccagccaagaggccaggugacaagaaucgggggacagaggugagaaugugcuugauccuugagccagcaguccaggccaaaacucuccucccaugaagaggccuagauccacgugagaggaggcaggaggccaccccugacucuagaacagggagggcagagagaaaagcagguucugacaccauaauacuuuuuuugguaguguucuuuucagauauucccuucuuuucuggccagguaugguggcuccugccuguaaucccagcacuuugggaggcugaggcagguggaucacuugagaucaggagcuugagaccagccuggccaacauggugaaaacccgccucugcuaaaaauacaaaaauuagccagaccuggugguaggugccuguaaucccagcuaccuggaaggcugaggcacgagaaucgcuugaacccaggagguggagguugcagugagccaagaucaugccacugcacuccaggcugggcaacagagcaagacucugucucaaaaaaaaaaaaaaaaaaaaaccugaaacagauagucccuucuuuuuucuaagggaugugauguuuuaaauaaacugaaacgaucucuaaaggcacugcuagaggcaaccuggcaguaaucuuaucaguuacacacaaugaugagugaaccugggggcccugguauguggccaacacugacacagguggccuaggcagguggugggcucguggucacauggaagacaagggugcagcagggacaugucuuggagccaccacaggcauccccagcucaucagugccagugaguaagaguggccccugacaauacaugcgcaguccaauguggggaccaaaggagacaaaggccaaagggggugaagugccaagcagaacacuggcagcugaagacgcccagcagcaggcgauggggacaacggaagguucauuaaauagcaacaaggcaacucacuccagcccccagcggucacuccuucugcugcccagaccggcaagugugacugguacucuagaagcacguaguagccaguacccagucucuaguugugaggaaaggaauaaacuaaaauuuuuuuuuuuuuuugagacagggucuugcucuguuaccaggcuggagugcaauggugcaaaucauggcucauggcacccucaaacuccugggcucaagcaguccucccacuucagccuccugaguagcugggaccacaggugcgcaccuccaugccuggcuuuuuuuuuuuuucuuuuugcgacggacucuuacucugucacccaggcuggaguacaauggcacgaucccggcucacugcagccucugccuccuggguucaagcgauucucaugccucagccuccugaauagcugggauuacagaccugcgccaccacgccuggcuaauuuuuguauuuuuaguagagacaggguuucaccauguugaccaggcuggucuuggacuccugaccucaagugauccucccaccuuggcuucccaaagugcugggauuacaggccugaaccacugcgccuaaccccuuuuuuuuuuuuuaagaaacagggucucacucuguugcccaggcuggucugaaacuccugggcucaagugauccucccaucucacccucccaaagugcugggauuccaggcaugagccaccacaccuggccaaacuccauuuuacuugugaaaaaucagaacuugguaauaagacauuuuuggguuuuguuuguuuucuucuuuucaauacuauuauauaaagaaaaaagauuagcaaugagaacaaauuuaaagggggaagaggagguacuuuuucaguagagaaaaauucagcuagaagauccaagaccaguggggguguuucugaucgcccucuuccuccccacucucaugcuaggugugugaaagguaaccaagagaaaggucuccccagcucccuucacucccacuccaggcugcagaaaggguaggaaaguagccucuucuaccaucucuuagugaaguggaaaauuuauagagaaaacaaaaaucaggcuaaugcauuucauuaucagcagaaugccuugagcuacuuucuuucuuuuuuuuuuuuuuuuuuuuuuuugagacagggucuauuucugucguccaggcuggaguagaguggugcaaucucagcucacugcaaccuccaccucccggguccaagcaauccucccgccucagccucccagguagcugggacuauaggcacacaccaccgcacccugcuaauuuggguuuguuuguuuguuuguuuguuuuugguagagacaggguuuugccauguugcccaggcugcucuugaacuccuggguucaagcaguccaccugccucagcuucccaaagugcugggauaacaggcaugagccaccgugccuggccuugagacauauuuuuuuaaaaaaacauaagcuguguucauaucucaaacuuugagccugguuuuguccaaaacauaccccuaccuaaucaugacagauucuuagaaaagaagauguaccuggguggucucuuuaguguugauuaccaacucccugugaaauguucucuugggguuuaggugauuuccuugaagggacagaacuccugcauucaggaacagguuguucauggaguuuacgcuggaauccugguugauaccagacucuguauucaugaaugggguucuauaauuguaauauuagguaacuucuaagaagauuagcuuuuuagaagcuaauaaaaaauagcaauguuuccuuaagaaagugugauguaaauucuuaagaaaggauaauuggcauaaacagauauuggacuuaaucccguuauuuugggaaggggacagcuuguuuuacaucuuccugaagauagaauaccucgaguuaggugugguugugcauuccuauagacccagcuacucaggaggcugaggcagaaggauuguuugaguucagaaguucaagacuauagcgagcuaugaucaugccugugaauagccacugcacuccagccuaggcaacauagugaguucccaucucuagauagacagaagaaaauagaagaccugcguuucagaacuccuuuguaaaaaccaggcauucucugaagauuaguuucccagacuuucagcuacaaaagauaacuucagaauaucucuaaaaugguuguuagcucaucugauuggcgugugaagguaaugaagucaguagacgugguucucuguagguguguucuaaacacacagacuuauccuucaucucagccaaccuuccaagugggcccuccacuaauggaggggaccaagccaaagaauggaaggauuguuguagcacagcgccucuccugagagccacaggcccuucagaggaggagucaguaauggcaccccagguuugaaagauaguauucauauagaaacagcuuccugcauuuccaacuugcuaaugguuucuuccauucuuccuuuucagggccccugagaucauccuugguuuaccauuuugugaggcaauugacauguggucccugggcuguguuauugcagaauuguuccuggguuggccguuauauccaggagcuucggaguaugaucagguggguccagaugacacagauauucacaagaccucauucuucaucuggaaaauagccuggauuagcauuucauugauuacaugacaaaugggcgggacuguggaaugucacguugucucccaaaccuugcuucccuuaaccuugcuauuuuuucuuuauuccuuucucuuuucccuuuuucuuuuuucucuuuuuuguuaacuucuuucccuacaaaaauugucauuuucauuuuucucaaagccagcagagccauuaguauaccauauguauagugacaggaaaagcccugaccucauucuuaucuuuucuugcagauucgguauauuucacaaacacaggguuugccugcugaauauuuauuaagcgccgggacaaagacaacuagguuuuucaaccgugacacggacucaccauauccuuuguggagacugaagguaggaagagcgucuccuccacuccucacaguggcccagcgcuuagggaagagggccguagacccauuaguggggagcuuuugauucagucagcaaaaugagggcacugggggugcuguuguuaauacaugguauggcugaaucugaaugcucagaagccccucuuucccuuggccuaucgccgccugugagaguccaaccuuaugauugcugaacucccaggauuuaauccgauaagccuugaugacugucugauuugugcuagggagagaaacgaaccccacucugcccuugagagcuggcaguccagagggagacaggaccaugugccacaagcucccgcccacuguaguaagggcccuguuccuggucaagaaugggugugggugccaagaggaaggagcauuuaauucugccugcagcagaggggcaaggaggagcauuugaacugggcccuaaagaaugaagagggagcgugguggcucacgccuguaaucccagcacuucgggaggcugaggcggguggaucacuugaggucaugaauucgagaccagccuggccaacauggugaaaccccgucucuacuaaaaguauaaaaauuagcugggcgugguggcaugcuccuguaaucccaccuacucaggaagcugaggcacgugaaucacuugcaccugggaggcggagguugcagugagcugagauugugccacugcacuccagccugggcgacagagugagacugugucucaaaaaaagaaaaggaagaaugaagcggguuugcccaguauagaagugugggguggcggcuggggugauggggguuagggagagggguuccaggcaaaggaggcugccuggugagcccaugggaauauccuaaggcccagggaggugucugguucacacaaguaaccauaaaccugaaacuccgggggcaggggcuucacuuuaacagaaacauaguuugcuuucacuuugaucugugccuagcaauuaaaaucaaaguauuuuccugguaaaaagaaaauaauaaagucuuaaauauguuucauuuuagguauuucuuuuuuugcagcaggguggguggguguuuguuuuguuguuguuuuggauuuguuuuuuuaauggaaucugcagccaaauccuaauaugguuuaaagauaauauauauccaguagucacaaaagacugagaaaagagauuugggaacugagcaagcacucaggcuauugaugggaggccuggcauuuggcaacugugagggugagugucaaggucagguccaguaaaaagaguccuccgguggaggagggugaggcuggaguuugcuguuguguuuuauugaagagccucagucccacauguccagcuguucccaggacuuaagccgcuccaggugugcuguccuugagugagauuuugaagacgaauuaccucuggauuaccucauggaugaguacagaaauccauaguaauuggaaacagcaguaucuccagccauuuggggaauguaggucugugucucagccaccaauagaggggcagcccagccacaaacucuggggccagcugccaccuauuggccaugugaccauggcaagugccuggagcuuucucuuccuguuuccccaucuggaaaauggggauaguaacugugcuaccuaaugugguugucaaaacuauuaaaugaauaaaugugcuuuagaacaaugucuggcacguagcaagagcuaugugcauaaggguuuauuaaauaaaauuggaaaaugcaugggaaagcccuuugcuuuuccacaauggaaucuugccuuauuccuuagacucagagaaggcuguaagcugaucgaggauguggcauaccuugaucagccugugguauggagcaagacugcuccauaccugacccggagccagccccugacacgugugcauaggaaggaggagggauggguugguguggaugaagagagaagggaauugcaggugugcaggucauugaagaaucaaaaucucuuccgaaaugugggaaagagacccucugugagacacaggaguuccaaggcuugagucccagugaugaggagcuaagucacgcuaccaauuggcuuuugccucucuugacagacaccagaugaccaugaagcagagacagggauuaagucaaaagaagcaagaaaguacauuuucaacuguuuagaugauauggcccagguaagcuucaugggugaguaugcaacguaagcccuuuaaaaccaagggcagcaagacuucugcaauaguaauagaagauaauggguugaaauccacauuauucaacugcagugguugaccuugaccuuaaauaguuacagccagucuuaguaagaauaccauuuggugugugaaacauuuuuaaaacuucauaccagcuccuuuaaaaucguuccaguuggccaggcaugguggcucaugccuguaauccuagcacuuugggaggccaaggcgaguggaugaccuuaggucaggaguucaagaccagccuggccaacauggcgaaaccccgucucuacuaaaaauacaaaaauuagcugggcaugauggugagcaccuguaaucucagcuacucgggaggcugaggcaggagaaucacuugaacccaggaggcagugagccgagaucacaccacugcacuccagccuggacaacaagaucaaaacuccaucucaaaaaaaacaaaaaaacaaucauuccaguguauugguucccaguuguaauauaguacuggccuaucugccugauguuaucaugagaagaauuccagcccauuaguacccauggguuuaaugcccauaauuuaguguguauguuuccuggggcagccguuagaaggugccaugaacuggauggcuuaggacaacagacuuucauucccccacaguucuggaggccagaaauuggaaguugggcuucagcaggcccauguucacuguaaaggccauaggggaagagcauccgugucugucucccagcuucuggcagcucuggcaauccucagcguucuuugacuuguagcugcaucccucuaaucucugcuuccuucuucacauggcuuuuguccugugucuccucugugccucuguguccacaucucccuugccuugucacugggcccacccuaaucgaguaugaccucaucuuaacucaauuugauuacaucugcaaagacccuauuuccaaauaaggucacauucacaccaacuggggacugggacuuuaauauaucuuuuagagggauacaauucaaucugcuacacagucucagcucacuggcagggaccgcaggcucucaccuuugugccccagagaaaauucuagaacuucagcuauuuuuagugugaaaauuagucugaaaccagggcaacccaaagugaguuuucucuuuaaagcaaugagaaacaaagcuauacaccaguaaacacuuagcaccccucuuacuguagaugacuauaaccaaaaaucaugauucugaguaaagugugcuugucaguugauuagcagcuuagauugucugagaaaacugaaauugguuuccagaccauguccuggaaaauacagaaaucaccacaaaacaagccuuuuaaagucgauccuaguauagacucacccuuggaagaaaaauccuguguucagauauccugccugucuuggccagaggugacuccauugaacacagggacuaaaauaauucuggcccuaacuggggaacccaugagaaggaugauaugcuguagguggaggacgggcacacucaggcccuuccacuucccucuaaagguuaaauacaugcauacauacauacauacauacauacauacauacauacauagacuuuuuuguaucuuauuuguacugcuuggccgugacucuuuuuuaaaaauuguggcaaacacacacauagcauaaaauuuaucaucuuagccuuuguuaaggguacaguucaauaguauuaacacucccauuguuaugcaaccagucuccagaacucuuuucaucuugugguuauuuuuaaugaggagugaugaaagcugcauuucaacuuaacugaugaaagcaggagcaguuuacauccugucauucagauauauuugcaggucccagcagcagcccucuccccuuccuggggcacagccccucucugccuuuccugcagagagaaaagccacauccugugggcaaugacaacauguggguggugccucccauaggggcagaguuccugggaacugagaaagggggcuugagagaucaggaggaaguuacagggcaaaaaauaaggggagccaggagaggggaggcacgcuggggucuuccuugguaaccuguccuuacuugcguccaggugaacaugacgacagauuuggaagggagcgacauguugguagaaaaggcugaccggcgggaguucauugaccuguugaagaagaugcugaccauugaugcugacaagagaaucacuccaaucgaaacccugaaccaucccuuugucaccaugacacacuuacucgauuuuccccacagcacacaguagguguccugccugaugcuucguaccagggaucggcaaacuuuaaaggcccagacacuaaauauuuuagguuuugcggccauaaggucuugguaacaacuacucagcugucacuguagcugaaagcagccacagaugcaauacauaaacagaugagugaggcugcauucuaaugaaacauuuaugaaagugggcagggcugggcguggugucucaugccuguaauccuagcacuuugggaggcccaggcagguggaucaccugaggucaggaguucgagaccagccuggccaauauggugaaacccugucucuacuaaaaauacaaaaaucagcugggugugguggggcgcaccuguaaucccagcuauuugggaggcugaagcaggagaauugcuugaaccugggaagcagagguugcagugagccgagaucgcgccauugcacuccagccugggcgacagagcgagacuccaucucaaaaaaaaaaaaaggaaagaaaaaaagaaagaaagugggcaguggcuggacugggucccuggccugcaguuggcuucacacugaaaaggagggaagaggagagcacagagcuggaugaaccugacucuggguaucugugcaggaagagaggugcccgaaacgguagucucuguagcgcaaaacuagucucagggccaaagauugcucccagaaccuucccagaguggacccagucuaguuuggguuuggauuuguucauucauuucuucagcgugcugugugccgggguacaguggugagcagagcagacggcccugcccacuggagcuugcaguccguaagagagagaaugguauaaaacaagugaugcccaaaucaccaggcugcuaugaggacaaguaucaggugugaugagagcauacccacaggggagccucauuuuggggcaaaccaggaagacucccaggaaguggccugugaaggaugaggaagaggaugggcaugagcaggcagggcauugccuguauggacaggacacucccccaugggcaggaccaugcacccaucccagaaggcaguaggugagacagugaggcauccagucagccagggcaggccguacauguuaagguuuuuaaucuugauccaaaaagcaaugggaacucauuaaaugauucuucagcaagggaauagcugguuagaucuguguugagcaaagaucugucugcugccacacaagucaaaugagucuggaaaaaaauguccauucgguuuaacaacucacaaguugucaguaacgcaguggcagccauucaguggagugguaaaagcagaaaccaguuuaccagguugaaagaccaagugagaggugaagaaauagcaaccuuucaugaagugaggcuaugcaagagaagaaauagaggggugacuggggaggggucaaggggauuguuuuuaagacaggguucagagcacagggaugggccagugucauuggaaggauagauggacgaggggcauguggaugucagcguaugugcuggucucauggagaaaaguugagggaguccugucagacagcuucugcuucucagaaguaggcaaugagguuaucuguugagaacgagguggagggugguuuaagaaggguagaaaguuuagguagcuggagcagaagguggcagagcaaacugaccagagaaauacgguggaauuguugagcccugagguucgacaugaaucguuuauaguguaacucaucuccccaggugaaggcauagagaagacagaugagucuucugaucuagguuuguccagguggaauuuuugccaggcugguaagagaagaagacagauugacaaggaagcugaugaggcuagccagagaguaacuguaauccagaaugaugucuauuggagacuuugcccaaagggaaaggaagugaagaugggaggggauccaaguaaacgugguguucuggucaaugcagagaaggguuaucauagucauaguggaaugagccagauggaggaagaauguggcugggaaaacaggaugcuuaaacuuguaguuucuggagguggagcaauuucagguuugacgguccagggaaugaguggcuguacuggguugagaacaagagucacuggacaugagaaguaagcgggaagccaggguauuuaaaaagggaccugugacuucugaagccuuccuagcgaggcagggaauggcuuggagaggaagguccagccaguggcaaaggccucagugaacgaaggggagaggaaacgaagucauggccgguugcaguggcucacaccuguaaucccagcacuuugggaagccaaggagggcggaucagcugaggucaggagcucagaccagccuggccagcaugguaaaaccccaucucuacuaaaaauacaaaaauuagccaagcgugguggccgcacuucuguaaucccagcuacuugggaggcugaagcacaagaaucgcuugaacccaggaggcggagguugcagugagcugagauagugccacugcacuccagccugggcgacagagcgagacuccgucaaaaaaaaaaaaaaauaggaagccguugguggaugggaagguaauggagggucucacuucagccucucaacccugagguacuugggauguaaaagaauaaauaaucacauccuacgucugcagggaaaaggggugugcucaagagagcagcagauucuauaaggaucaggaggggaagggaauccugugagaagagccuggagaugugagaauugugcguaucauggcgggcccugcugucuccagagucagagggggcugggucucaaggcuggacccgccccuuucuggccuacaggaagugaguggguggcaccaccauggauaguggggccuccauuucauuucugugccuuacuaucagugaagcaagucaaauggcauugcaacaaacagauagugccucuuuaauguaaaaccaugcuugaaacaacugaacuccgguacaaaggaaucuggacccaucccuccccuacucuuguuaugggauuuguccuuuuuuucuuuuuuuuuuuuuuuuuuuuugaaguagagucucacucuguugcacagguuggagugcagcaguacgaucuuugcucacugcgucacugcagcuuccaccucccagguucaagcgauucuccugccucagccucccgaguagcuggaacugcaggcacacgcaccacacccgacuaauuuuuguauuuuuaauagagacaggguuuccccauguuggccaggcuggucucgagcuccugaccucaggugaucugcccgccucggccucccaaagugcugggauuacaggcgugagccaccgugccuggccuggauuuguccuguuucugagugccauaggggucagccacagagcuguccaucuguaccacaagaagaagaaaagcagacuuggcaauuuacuggauagggcucccaugauuucagucuuuugauaucacggguaaaaugggaugacugagaaacagcuacggauaggagacugaggauaggggugcccucuacagagguccucuuagccgucugcaccaaaacagucagauagucacccccauaaagccuggggcuuuaaugaccucagaguccuuccaccucuggguucuguaaggaagaaucaguagaguguuucacggcuuggucacauggagaccgugagcaucagcaaccaauucagaacuucaucugggacccaagaggggcacugacaagucagaacucagaaauuagccuaagaaggaaaggugggucucugaacacaccuaggcuugccugaaaguaggccugaucccuaaaguucucuagaacuugcugggaaaaccuugaagaacuccagggcaaggauaaaucuccaggcccaugcagcuguagcgccccugcccugggagcugagccacagcuacuggauuacuaggugaaacagaccccacuccuuucuccauaccaggauuccagugcacaauuuuuaaaaaaccaaucuucuuauaaaccuaaagugaaaggacuugcccuuuccuaaaacccaaaacuugaaauauuucaguuggaaaauucugaagggguauggaaauuuuguguugaauugucacgaaaccaaaugcuuuaagcccauuccaaaaagaauauaaaaugcauugguuuuaugcugcagccuccacgcacaagaccuugguacuuaguaggagcugaaaacacacuggcauuaacagcauuauuaggaguauuuuuaccuacuggauaccgcagaauauguuuucuuuucucuucagcaucaucaguccguaaaugguuaugucgugugcaugacgcagccaguguaaguggucagaaucuuagaaagaaguaggacucucuaagucgcgucucagucagucauuugaaacuuggaaugcauuuuucacaggauguuugggaauagcccacagacaccugcuuagccccaaagauagcauacccacagaguacugaaguaguacacguuuguaauccuaaaauaguagaaaacuuuuauuuuacucauucaguuauuacauuuuuuauaauuaaaauagacauuuugaguugaaaauuaaaugaguuuuuuuucuuuuucuuuuaauuuuuuuuuuuuuuuuuuuccugagacagggucucacccugucacccagacuggaauauagaggccuaaucaugacucacuguagccucgaccucacaggcucaagugauucuccgaccucagccuccuaaguagcugggaccaugcgcacgugccaccacagccagcuaauuuuuauauuuuuuuuguagagaauaggaucucccuauguuguccaagcuggucuugagcucuuggacuccacccaccuugaccucccaaagugcugggauuaaggcgugagccaccccacccagacuaaaagggauuuuauuaucuugaauauuagcauuugaggaaaaguaaguuuaacuacaagaaaugaaugagaagcgcuguauaaauucugaaggacacuuuuuggucgauuuucaagaauuuggguggcugaagccacuuguggcuuuccuuuucccugaugcugguuucagcaccacuuuuauacuuuacuuuuguaguugggguuuuguuuugauacacagaugcaaugggggaagaaaaggagaaaauuucuauuucauguagcuggacaagacuuagacaagaaaaugaaggcugaaguuggugaaagaggacguauguguauacacgaagguagccagugauuaccuauccuuggcaaacucccuaccucccuaagcuucagccuuacucgugaaguagggacgagaaucaugucuccgucuuauggauguugccggaccgagugagagguugcagaguauuauuauuaggacacuaauaaauguuaaccacuauuauuaauuauuaguauuauuacuguuuccauuaccuaccugcacaaccccugugggagaaaguguggcaauagggucaccauacuggguuggagaguuccuuggccguccccuagguggugcuggugacccaggguagcugaagcaggugacuacaaggguugucuuugggaaagguggaggcggguuauaagugacuaguuaauguucccauucagagagcuuauacauugguuugugggccagaaaccaggcugagaguugagaaugagcagugaugcugcagguggaccugaugugagaaugcagugugagcagucaguuuuguugugauauauagaaccuauauggagaaaggguaguagggcacuggagaaaauucaucugaauaaccgugccuguugcaaaugcacaggcuuugcacaagcaauccaagaaacuuagaccuaaaguuuaguuucccugcuuguccuguuuacugaauuaacccuucucuccuuuccuuuguuuucuccccuucaucccacguuacccucuuccccuccccuuaugucucaauaugccucugccuuuugcaugaacagcgucaaaucauguuuccagaacauggagaucugcaagcgucgggugaauauguaugacacggugaaccagagcaaaaccccuuucaucacgcacguggcccccagcacguccaccaaccugaccaugaccuuuaacaaccagcugaccacuguccacaaccagguaagugggaaacagaagggaaggagaggcggggcugcacagugugagccucaggacuuguauuuuccaucauaccuagucaggaggcaaaauuccugcugucauguucaacaacuaaacaaaguauuugcauccaagguuauuuccuuugagggacccaggcacauuuuguguugacuucuggccccauugacaggucccagaaaggacuggugagggccauucuuucugagaugguuccccuuacugcuuuccucuguccugaugugggaauagggggaagggggugcuaugauccuuuuaugccugauaugugccugguaaagaauucuagaacuggccaggcacaguggcucaugccuauaaccccagcacuuugggaguucagggugggaggaucacuuaaagccaggaaguucaagaguagccugggcaacacagugagacgccaucucuacagaaaauacaaaaaauuagcuggguaugguggugcaugccuauagucucagcuacucaggaggcagaggugagagaagugcuugagcccaggacuucagggcuacagugaacuaugauuaugucauugcacuccagccuaggggacagagugagaccccgucucaaaaaacaaagaaaaagaucauggaaacauggauuuaaucuaaaaaaaauaaagauucuagaacugggaaggacucagggaaucacccaguucaggcccuuccccucguccccacauggcuggaucuaccugaucuccuuuugggacagauaaacccuguccuuucuccgagucauggagaaaaucaguucaucagccugucaccagaaucccagcagcuggaacuaaaugggaucaggaagcuaagguuuucuucccacagauuuccaggaaauuggcagaaggagcagcuaacauacugcuugaaacuuggaugacacccaggcaauauuuauugaaugaauaaucuccaagucugagcugagacugccucuagugucuaagaaacuguaacuccuacucccaucuuucaauccuccuaguuccccuaaagaagggcccccagauuuuuguucuuaauaucaaucuggaaugaaaagacuucuguguggauguguguguaccugaaaugugaauaccuuauguccauucuuuuugaaaggucccuccugucacugaagagucacugcccccugcuuuucagccgcuccccuucccacccuuuuccccuaggccauccuuguggcacauuggccugcucaggccuagcuuuucuucccagccugccaucucccuuugcccaaauucuaggagacaccaccugguaucugcugcccucugggggccguuugcauucuugaagcucuccuuagggugaaagagcuguugggaguccgaaaacuaaccuugcccagcccuaaggcuaaagcauccauagccagaccugugagcuucuugacaaaaaucagcaugguuuuguucauuaccuccuugaagacauuuguuucucccaccagcccucaugaggcaccuggucuuaacucccuaaccccaaacuaccuguccccaucuaacaucugccccaucagguaucaaaggcaucugugaaacaggaggaaggagcaccccuccaaugcaggcgucaugucaaguggagucuccccagcaggcuguccuucccauggaugucuuucugccaggcuggagaacuguggucccugaccagacgcgggguggggggccaccgccaucuugcuggugauaugacagccagcauauccacuccaaagggugucgcaaagacucugcaaaacuaaaaggguugcucaucaaaaggcaguugucaaauaagaacacccgucuucuccacggcacugagaccauccagaucuggcuugggacuggggugaaguaggaguagcugguaacuuagugugaugcuugggccagagucguggguaagggaaaaugacaucccacaaaagcaaaggguccaagaacaggauuucuguucucuugcauuggauucuacuacucccuacuuuugaauacaucaggaaaaaaaaauuacucaggacacaccuagccuuaagcacuaaggcaugcuuucccuccacugauacuguuguuauuaaauaacaucauuacuaauagcuaacacuuauuaugugccaggcuuuacuaagcguaccauaacucuuaauccucccagcaacguugugagauagguuuuauuauuaucauuuccauuuuagaggaggaaacugaggcaccgagugauuaauucucuuacccaaggcccuugcucguucaugagaggugggcuuaggcuuugcagccagcaaucuggcuucagagucuggacucuuaaaauauacauacacagcagcauaaguaagucuuaaguaagucuuauggagguccccaaaugccuuuccuaggugaugucugcucuuuaaauccaacaagacuucuucuguucauugcugguucuaguagcuagcuuucuacaugagcuccuuggagcuguuugcccauuuagauauuuagaagcaauacaauauaugcauaguuuuauguuagaaguugaaggacauuaaacuacuuaaagaaucucuugcuaccuuuaacauauauccaguagacuaaccaaagaaccauuucccaaaugaucaugaaucuacaaucuuuuaggucucaaggaagcugggucaauaauucauaacccguuaagucucaaggcagcugacuuccucuacuuucuaaaacuuucagguuacccaguugguaacauguugaauaauaagucuucucucagcuauuccuuguuuaucauguggaucagcaacuucucuaacauuuccguggaauucuauuauuuggaccuagccuucuaccaagaauuugaauuugaguuuauagaccaagcucaaaccccuuccuucuggaaccauuugaacgucuacuacaacugcuuccaggaaucacuucuuccauuuuuggaaaaccugugucaucaauaaacuugcuuuuucacuaggcacaguggugcacaccuguaauccuagcuauuuggaaggcugaagugggaggaccacuugagucaggaguucaaguccagccugggcaacauagcaagaccccagucucugauuuuuuuuaacuuguuuuuucuuguuauuacuaucugucagcugcaagagcucuucccaguucucugugugcuccucucuggcaagugauaggcuagcuaccuuucugagagcuaaaggaggauauacagaaguagaaaacuuuuuguugcccucacaugggcuucuucaacugguccuuaagcaggguucgaaacuaggggaaaaccuuaugcaugucugauggucacacuggagacuggguccauaucaggacacaagugccauuuguccuugagucuacagagcuggaagauucagccucucaaggagcucauggucuccauggugagacaggcuguaagcaaaaauaguuuaaucaaaaugcagaauagcauguacuaggggccagguagacaaacagauuauguguuacagaaucgagaggaaggagagaccacugcaggcuggaggaaaacaccacuaagacacagccccucccucccaggagacuuuaggcuggaaagaccaacuguacuguaaggcagauuguaacaggagcugggcuagaaggcuauauuguacugugugauagcaaaggaaggagcaauucauuuccauuaauggugucugaaaggguuucacaauggggcaugugggacccaggcuaggccuuaaagcccaaaggcuuggagagaaugcuaugggucagagagcuuguaugaagggaaaggccugugcucacaguaugcuuggaaaacaaugaguaaacuaaucuuggugucagaagaguggagagcagagggagauaagucuagaagguaagguuggccaaaccagggaaaacagggcacuagaccaggcgcauaccauguucaucaagcuguaauugggauuuuggagcaggggugcugacaugcacaaaggugucuuguggaaagaaugaucuacccucugugcucaagaaggcuggaagggaaguagagaccagaacauuucuagucagggccuuauaggucccaggcaccaggaagucacaacugaaaagagucaguggauuccagggacaucaggaaggaagcagcagcaggagcaguggcuggcaagaaaguggaaccaccgagcagaaguuugggaaccuagaggauacaggugccaggacccccagcagggacacccacaggggcuaagggcuggggggagucuagauaugagcagaccauggggaauguggaggguugagggggaagaagccuccggaagagaucgcgauauggagaaaacaggaaauacaagucaugucaucugacaaaacacagacacugaugcccacauauguacacacgugucccaagcagacuaugcgacgcugcaaaagcacacccacuuuaaaauauguggcuuaaaaucagacaucugugccacucaauuucgugauuauuuucaaacaaaucaauuugcuuugcaaugaaauuuagcacaaaaucuaaguauagaaaacauauguaaaauaagacuuuguccuuuuuaucaaaugugacauccauacacacccuacuugaaauucuauuuguguccaagauaucuucgugguuucuuccuauguauucccugguccuuguaacuucuagaggcaaaaccucuuguagacagugcugaaugugaaaccacugguaaccaccuaucuugcuaaaggaucaguaugaaggcuaagauaggggaaacuggagaauuccaaaguuggaauuuauuuuccuuauacagccucauuuuucaugcaaguucagucucaagugaugucuuuuucugaaaaagaaaggcaagaggacauaaugucaauggcuuguguuugucaaagccaccuccauuucaguuaucuggacacaccagcaucuuuucuaucugccaggcuuugucacugcauaccaacaugaaugcaugggaugcagacacaaagccccaggcucaacaugucccucucccucucugcauacaucuccuguacuucucuaagcuuugcagccaucuaaggacaucuguaaacaguacugcccauaguccugagccccuccucggcccugcucuccgccuguugcaugugcuccugugccaagcucuggguacugagaccauaguccuuuagggccugcaagagccucccccuggauuuguccucccacauguggacugcacccaccaggcccgaggggagugugagcagagcuuggacgugcaggcuggcagguccaggcacccagagcucaucauguugugggauggaauggggcuugggcagagagaaggagggcaagguccagcucucucccugucaccaugugucagcacagaacccaaggaaucccauaguccucaacucacgccuggucuucccgguuauugggaagguguauuugucaaaaugaaaaggcagaacauuuuauuaaacaguuuucuagccuaauuuuuagccuuuucagcauuuagacaugguagcaggcauccguguguccucuugucugggccucacaaaugccaggagcaagucugaaugugaacaccaaggugacugucucccauguuuucagggaccugcuuuucccugcgacuuucaaucguguuuccacuccucucugcuuuugccuuucugcucuuaguuuuuguuuguuuguucuucuuugaguucauuuauuugauuuagauucgugucucccaacaugccaccucccucauuuuuuauuuuuguuuauuuuuguuuaauccccaucacuccuuuaggcucccuccucuaccagugccacuauuuccuuagccaaucccgaagucuccauacuaaacuacccaucuacacucuaccagcccucagcggcauccauggcugcaguggcccagcggagcaugccccugcagacaggaacagcccagauuugugcccggccugacccguuccagcaagcucucaucguguguccccccggcuuccaagguaagauugagcagccacagccucucaccugcuucuuacagaacggccucuggggcuccggcaccugcaguuuucugucacgcucauuuucauggagaaaggcccuccucauuucuuccagugagagcgcugguaucacugaacuagagggcuccucuccuacuguggccaaccuagaaacaauagggcuuaugccucagcaccaagucaauccuuugugacucucacaccugccagggacugugucccuggccagcugucuguaaauaaguacauaguuugugcuuucauuguuaugcugaugucagcucuugcuuuuccucgcaugaaauauccucuguguggguuaucuguagaaaacugccaaucucugacagccgacauagucccagcucccaugaagaauauccaucagucugaaaaguacuucccugggaccccuccucaaaacaauucuuuggccaugaccccagcacuccucuccuguagacucuaagaagcuagacuguguacuuuguuacaauuuacccagaaagcuuaagaauuuauuuuugcaagccucaugguguaaacugugugguuacagucaaugcaauuccaaauggguucauacaucuccccaacaccccucauuuugacauacacagguacaucuugauggucagaagcccuuguuuuccuguuguaaucugcgagcauaucuguccuacuuuuggccuuacagccuccuuaaucugaccuucuagccuuugaagacauucaagauuucaggaggaguuuuguuuuuuaauuuguuagaagccaaaggggagacuuccaaggaccaggcaauaccugguuguugucagugaccagugcaaagggaagcagaaaguugacauaacugcccaggaagguucuuuucauccagcuguucacagcgucucagcuaacccuucucucccucacacugucuggaacaggcuugcaggccucucccucuaagcacgcuggcuacucggugcgaauggaaaaugcaguucccaucgucacucaagccccaggagcucagccucuucagauccaaccaggucugcuugcccagguaauucuuucuccuuuauuauuacugguauuaccauuaccuguguuaauguuguucacaaaagauauauaucuccacucccucucucccuaguaaugaguuaggugcuucuagucauuggaauguaucuguaauauucuaaaugguccccaagugaauuaccuuccuaaguaucugcuuacaauuccaagaagaaauuuagauacagggagagucuggggaaauuauuauuauuauaucuuugaaaugcaaauuaaucugggauaccuagguuuuaauccuaacugcuaguaacuugucuaugaccuaaggcaagucaguuaauaucucuuugccucaaauuucuuucuuguaaaauagaaaugaguuuuuagagccaaaaggagccuuggugauuauccucucauuuuauaguugaaaaaccaggcucaugguuacuguaagcuggaaccuucuaucucuguauccauguaggugcucugaugguagaaugagauggcagagaugaaaaaugguugaaaauuuguaaaguguuauguaaacguaagguaacaguagugaugcaaugauaacaguaacaauccuuaaugacacucgaacccugauaacaaauacaucaucauuauaccagggcacuuuacaguuguuaauugauuuaauccccacaaugccacaguauuugucuccauuugacaaauagggaaacugaagcagaauaacuugcucaucagagucacacaacaauuagguaacagaaccaggacacacacccaguaagucugaugccagcaucuguauuucaaccaccaagcuauacuacuucuguauaaucauuucuacuauugaguagcuugaccuaaauguuauuaguuuagaagcagcuuuauuuuuaaauaagguagguucacaaaggcuuuucccaaagacacuauuuguccugucuuguuaaauggaaguuguuuuuguuguuguuuaauuuuuaauuuaaaaaauuaaaaauuuaauuuuuauguaaucaaauugcguagguuuguucugugcucuucuauuccauuggcuucucuaauauccuguugucuuaaccauuguaacuuuagucugucuugguaucuaguagggaagcccuguucccagagaguucuucaaauuuuccuugucuguucuugucccuucauguuuuuaagugaauuuuaacaucacucuuucauaagaauuuuaguuacagaaaccaaaaaucugcuuuauauuuacuggauauacauugaauuuauauuuacuucaggaacaacugacaucuuuaaacguguaagucauuuuuauccaugaacaugguauaacacucuguaaugggugugguggugcacaccuguagucccaggccuguagucucagcuacucaggaggcugagaugagaggaucacuugagcccaggaguucaaggccagccugggcaacauagugagaccccaucucuacaaaaaaaaauuaaaaauuagcugggcaugguggcacaugccugcagucccagauacacaggaggcugaggcaaaaggaucacuugagcccaggaguuugaagcugcagugagcuaugaucacaucauugcacuccagggugggcaacaggguacgacccugucuguaaagaaaaaaaaaaauuaauagaaacacuuuaucauguuuaaguuuuguaaugaauauugaauuauaucaaauguucuuucuguaucuauuaagacacucauaugcuuuuuguuccuuaaucuacuaaugggacaaguuauauuaauauauuuuguaauauuaaacuacccuuuuauuuaugauauaaacuccauuugcucaugugcuugauaugauaugcuuuuuaauauuggauucaguuuguaaguacuauaguuaguauuuuuauaucuauguucauaggugaaaaauggcauauaauuucccuuuuuauaaaauccuuaucugauuugaguacaagguuacaccaggcucauaaaauaucuucuucuuguuguuacccacacgaguggguuuggucacuugacagguaccaacccaaugaccacagacaaggauuuagcaaggggauuguauuacuuguaacaaguaaggagaacacuggagauaguucccaaagcagugucucugagcaaagggcugggucagguuuuauaagcauaggguaaugaggcaugaucugauuggaucuugcaacgaauugauaucagaggcaugaucugacuggauccugccaugcagugaugccacagcucgaucugauuggauccuggauccugccaugugguauccauuucuaaauuccauucacucgccucaauccaggcacuuagguucugccuguuguuacauaccugguucaucugggcaugcucagguuaugugaccuuuaaccuguggauccauggcaaaugaaaaacaacucacaacuuuguuacauaaaaguugaaccagacugcugugguuacauuauuaucuauucuguuuuccggaacaguuuguuuaagaucgauaugaaguauucuucaucucugugcuuagguccagaaugacacugugcaguugaccacuaacaccagugacugguagcacacaaaguuuugucuuauugaaaguuuguaaacagagaacuuuuuguauuuaaaacaggccuucucuucguuccucucucuccaauggguccuuguagcuuccuuuuauuugcauaguucaguagcggggaguucagaaaaggccaagauagaucagagaaagaacuacagcucaguccaggggcaaaaaagcuucuucauacuuuaucugaguggcaaaaauccacaccagucucccagugcuccgccuuugugagcccaaaucuacagaacucacgugugcuuuuaaaggauaauuacagaucuuuuuuauguuugcacacuuaacccuaguaagccaggagccaucucugaaagaaauaauaauuagcauuucuuauuagccaaaauagggauucuucguuguucaguuugguggaaccaguagacucagcagucagaauuuguuucaguccuuuaaucguagcaggggagaacuuuaccuuuugcuuccuugaaagagagucccuagaguguuguaaaucuccaaguagauuuaaccuaaagcuguaauuaggaaagugaacaaaaaauacguguguaaggauuuuaauugcuacuguguuuauaacugagauuguuggaagaaacuugaauguucgucaguaagggauugguuaaauaaguugaugcacacguaaaauggaacaccauguagccauuaaaagaacaugguagaccuuugugucuugacaugcagagauuucuaagauauauuaagugaaaaaaauccugcccuauccaguaucguguugugucuuuuugucaguugcuuuuuauuuuucucucugcuugucacuuaauccaugccaauauguuagccuguugagaugggcucucuccuagauauuuuuaaacauucccuucaaaggacaaaaauaaguuaauuuauaaaacucuuaugguggcuauaaaaaagcacaauuaagcauuuaaacugaaggcuucguuuuucuacaguuaaauuucuaggcaccaggcagaggcauuccaaauccuauuauuugacauaaauguauucaaaaaguugacauuguucuuuuucucuaaauacugaaaaucuuuuaaaggauuuuacuuaugaacacuuagagauggagucuuugaauccacuccucauguuaauuucauuuucuuugcccuuuuccuccccaccucccagcagcaucacauaaaacuuucagggaaacaggccucuguggggcacccagaggaugugugcauggcagguggaaaugguaaucauucugcuuauguuagugauaugggagugaucuuuguggaucaccuugcaacaaaagcuuuuuugguacugccuaaaaggagcugucaacuccauccucccaagccccaugccacagcuagcaucuuggccaccaacagaaauugugaaugaguagguaauaguggagagaugggaagcacaguucuugauugagacaguauugaauuuaucugacuugucaaaugucaggaucuaaaaucuccuuugacuagcaggguuagagaaaucacuguagacuccacccuuccaugaaguguuuuguguucuucuagccaaucaaaucauaucaccugaaccucuuuauuuuuuacuuauuuacuuuauuucuugggcucauauuugaccaacugagccuuuaaauguuucccugaaaacaaacuguuggcuugaacccuuuaaacuguucgaaauacaaaauuuuaauguuucucacucaaaaguuccucugauaacauuuucagcaaccagucuuuccaaccauuguccugcugucugccugucucuugacuggcaccugauauucuuagagaauaaggaagacuuguucaugccaccuuuaugcaguuaccaccaaugccugauccugaauaggggccauuauuuuuguguauuaucaacacaaggagagguguauauuggcugaaagcaugggcacuggaauuagguugcccacauucagauggcugccucaccacuuacuggcuauauggcuuuggggaaguuauuuuugaaauuuaaauuuaauuccuuuucaaaguaauacauguacauaauuuuuaaaaguuaauuaauaccauaaacuuauaggaaaauuauaguccucugcucuaucccauccuuaaugucuccuccccauaacaauauauauaguuacauuauauauguauauauguauauauauacacauauauauuaucccuguuauauauauauuuuauauauauaauauauauuaucccuaaaaguuuuuauuuauacacacacacacacacacacacacacacacacacguauuuuuuugagacauagccuugcucugccaccaggcuggagugcaguggugcaaucucagcucacuguaaccuccgccuccuggguucaagcaauucucgugccucagccucccgaguagcugggauuacaggcaugugccaccacgccccggcuaauuuuuuuuuguauuuuuaguagagacuagguuucaauguguuggccaggcuggucucaaacuccuggcaucaagugauccacccgccuuggccucccaaagugcugggauuacaggugugagccacugugcccuggccauaacgauaauuuuuaacuuaacuguuuaaucuguucuuuaacucuguguuucuaaauaauaugcuuagacugcuuuuuauggauuuuuuuuuccauuuuagguauuauccauugacuuccuauuauggaagaugaagauuuagcuuucuaacccacugccauccccauaacacacacaauuucucuccuguuccuccuuucacucacucuuuucuccuauuccucccacauaauuuugauucaacuacuuuguaauauuuacauaauuaucaauauuauauaauauuauucuuaguugagccuuauaauauacugugauuauguuuucuuucuaacacaucuuuuuguuuuuccuggaguuaaugauugccucauuuuucccauuggguuaguuuucuguauaucucauuauacagccccaaacccuuccagagcuauaaaagguuuguauguuugauguguugauguguuugagcacacugaucucaguauguuguuuuuucuuucucugaaagcgacuuucuccucauccacaguggacucacauuucaugacuacaugccuucuuuugggucuuuuuucuuacauuguccugaacacccuauuugcccuuuuaaucuggauuuuuuuuuuccuuugauaauuucuuccccuccauuuucucuguuucuccuuugcagaauucuuauuaauugaguguugguacuucuaaauugaucuuccgauuuucuuaucuuuuuuuccccucuauuuccuauauauccucugucugcacuacuuucuaagagauuucuuaaacuuuuuugaaaccuccuuuugaaugguuaauuucuguuguuguaguucucauuuccaagaguuuguucucugcucccuccauaccaaaaaagagcauguucucugaauauagauauugauucuuuauaugaucuuguuucauggauauauuuuuuaacucuguaaaggcauuaauuauagauuuuagaaaauuuucuucugauucccacacuguuuuuguuuccucuuucuuuuguuugcuuauuuuauucucuuucagguuagaggcuuccuuuacugucuggugaucauuagcuauucauuccuauuuaagacuaaagcacuaaaaaacuaauuggaaaccuggaggguaggggagagacuauugaaugugggcuucucuauagacugaaaagaggcaaguccagcauuuucacugacagauccccugauccuuaaaugucauaucuguaguuauuuucucuuggacuagucauuuccccuagagagaauugucuagccuccugcuuuggggcggggaguggagggugguauaagcauguacaccaaggaucugggaacuaaggggaaaugaagaccugaucuuagauuccuucagucuguuaauucacuuaguaauuguccaucaguuuuucagcuucuaaaauuuuauucauggugauugccucucuccuacucucuuugcccuuaugaaucuguauuuuuuauuccuuuacuaucauuuuaguugaguguaaagaaggcaauaaauguauauguuuaauuuaccauauuucagggcaaguuauuaauauuauuaaccucucugugucucaauuuauuaaucuuagaaauggaagaaaauaacagucccuaccucacagaacugguauuaagaagucagaaaaaagaaguagucagaaacucauuuaugacuuaacucuguguuuggcacacaauauccauuaagaaauguucacuucauucuuguuaguaguaauaaauuauaaaaaugucugaugaagcguugucacaaaugagccaagcauaucaaucagugaaauaagucaaaaauagucuuucuacccuaucucuuugagguaaaauguuaauauccauuucagggaaauagaagaaaaaugauaaccuuagcuugauaucaagauuuauuuuuuaaaugacauuaguuaaaacuaaugcuuuucaugagcucugaaaugaguuccaauuggcuaagucaguagaaaccuuacugcaaacgaaauuguuauuuauuuaauauuuggaauuugcaacuguuuuaaucaauuaaauuauguuuccgcuuucugugaguuaaguaaaccugaaauacaauuaacuguaguuaauagcguugguagaguugcuucuuucauuuuaucaacagauauuaagcacucaugguaugcgcauggucccugagcuucugccuauaucaaaagcaaacaaacaguaucaaaaacaucuaagagauugcacugggccucaggugcaacaugaaaauaacggaacaggugaacugguccacucagcucucaaaugugauucucucauuuuuauaagcgucaauguuuuuuaggcccugacucaaaucuguaauccauuuccagaauugcguauuuguaccuauaaaacacccacacugagcacaugcacaguuugugaagcacugcauucgauaaauuacccaauguuagucacauccacucugauagaaagagagauggcuaagauaucaaaccuuuaaauauuugaucuguccaaaagguauuuuaccuuagugacuaugcuuuaaguguccaacuuuaggcagugguauucagucugaaucaucuaaugaccaaagacaagcagaauagugaucauggauuaaaagagcuuaaaacacaacauacacacacacacacacacacacacacaccagugaaucuaucaaggaagaaucacaaacguucauuuuagauuucuuagaaaaauuagguucaagcagugacuuccgccucucucucauuuuugcuuugagaaaucaaaguaauucucaauuaagcuauagucacagcuaagaauuuuacuucauacuugcuugcucucagauguagguuccagauauuuggugaucuuagaauuguguaaacuuagauucagaagauaacacaagcuggaaccuagauucuaauugauaaaucaaagguaaaauguuaaauaaaggauacuaggcagaaagcuucuugagggccagcggucacccucaucuagcucaacucaacuacccuaauccccuguacauaguugugggacagaacaaguaaauaaauaaacuuucagaaacuucaagcauugcucauuagagcaaauuuauaaagaaaucauucuucaacaugaaugaaucccuuccauacagcugugucccuguacuuaauuaucuucuacuuaguucauauauguucuuuuuuuuuuuuuuuuuuuuuuuuuugagacggagucucgcucugucgcccaggcuggagugcaguggcgccaucucggcucacuucuucaagcuccaccucccagguucaugccauucuccugccuuagccucccaaguagcugggacuacaggugcccgcuaccacgcccagcuaauuuuuuguauuuuuaguagagaugggguuucacuguguuagccaggauggucuggaucuccugaccucgugauccgcucuccucagccucccaaagugcuaggauuacaggcgugagccacugcacccggccuguauguucauuguuuaucuccccuuacuuuaguuuuugaggccagagaccaggcccucacucucacacccaugagaaugucuagcacaaccccaggcacagaauaaguguggguucaugcaaaucaauuaugugauuagcaaacauggucauugcacauguccuguguucuacagcaggcuuggccaagugggacccagcagauccugcuucccccagcauggcagcaacugacuggaguggccacccacacaucagugcagcaugccaccgugauucccgagaccauggcaggcacccagcagcuggcggacuggagguaagcaggaaaccccucuagggugagugggugugucugggaugggaggcacguccacugccaacacagggcugccaggcuggccuguacuucaauuccccgguuuguagagagcuuuuuaaagcuucuaaaaauauuguguggacuaugagugcaggguaacaagaagcaauuuuuaaauaauauaccaggauacaagaaaaucaguuucauuaauuuaugcuugguugucauuuccacccagaauucaguuaugucauuuacucaucaguguaauucaccagacuugguucuggaugauguuugguaguuucucagaauuaaauucuacguucagaaaacaaaggucugucaccagugaaagaaugcagaagaggguccccaaagcccuaagcaauucuagaaaguguucugaagauguuugagacggggguacucuggagucuaucugaccucccacgggauggcuugacagaaugggguuuauuuggaaggguaaaugcuggcauguuugcugagugugccucuucaguuaauagucauaucuuacagaucagagucuacuucccacacaccccagaggcguccaccugacugccugccagcacagcauacccccugcaucuguuuccagaacucuacccugcccaacucaugauuuccucacagaugcgcuccucuguuauuuuuauggcuagauacccuuguaccuucccccgaacaccaccacaauggccccuucaccagugcagagccagauggcaacccuccaaguuguccccaacuccucauggcccuauugggcuaucucucauucugcacgaauaucaggacaggucacuccccucaacccccugacagccuccauaucacacagggaaccucccacaguucuuauucugaccuacaaggcuauugugaauuaagaucucuccgagaaaagaagaaagguggugauauaagcccccagucagaccccuacugcagcuuccuccauuccuccaguucauuuucugcccaguacagaguaccugggcccuuccccacagucccacucacuucccuucuggcaacgcccucaugccaccacuccagccugggcaacagagugagacuccaucucaaaccauguagagcugaguucaauccuggcucugcaugaccuggggcaaguuaaccuuuaugcaccucaguuucuucuucaauaaaguggggauaguaaugccugcuucacaggauuguugggagguuuaaaguaagauaaaauacaaagcacuuggccuauauuuaacaugcaccaucgcagugcccgguacaugacaggcauuaaauaaaccugucaucuucccuccccacuaucacaucggcccaugcucagcaagauugccuuuccuccuccagcuccuuaggagcagccgaguggaaagcugucugaccaacuggguuuuuuuuuuucccucgccccuuuuucuccuaaaagaccacacacaugacauauuccuuuuuuucccuuuugucuuucagcauuuauagcucaucuaauuucagaaauacacauacacuuacuaauuccuacauauuuucuuauuccuccucccuccuuccuuucguuuugacaucucuuaccuagugaccacaggagacaucuaaagccagcauacucucuuccuggucucucuccauuucaugugugagccaaagaacaucuauuauuguggcuaacaaacagaaguaccagugcuaggccugacucaaaagagaaagagugccaccugucuacaggagaaagagcuacaacaaaauaaagaagccauaauaucaguuucuuggucggaugcaguggcucacgucuguaaucccagcacuuugggaagccaaggcaggcagaucaccugaggucaggaguuugagaccagccuggucagcauggcgaaaccccgccucuacuaaaaauacaaaaauuagcugggcguggcagugcacgccuguaaucccagcuacucgggaggcugaggcaggagaaucgcuugaacccaggaggcagagguugcagugagccgagaucgcaccacugcacuccagccugggcaacagacugagacuccaucucaaaaaaaaaaaaaaaaaaaaagaagccauaauaugaguuucuaaaguccauguaaaugcccaaaaggcgcuaucaaaaucccuacaaaaguguucaucuacuucuuuuuuccuguucauccuuuuccccauguugcaacaauagguucuuauaauuuucuaaaauucaaaugaauuauccuuuagcuuugaauuuuauuauguguuaaaugagcucuuaugggccaaucucugagucagucaccaccuuuaacauuucugugggaaaacaaggcuuuaagcuucauacaacccaaauuauaagaauugugaaacauaacccguuuuuaggaugagggcugccaguauuucuaucaugacuguuauuaauuuugauuuaauaccaacuuuauacuugucuagucaaccuucaguuaaucuaauuauucauucagcaagcguguaauuaauugaucagcugcuauaugccugagcauuguuccagccacugagggaauucaaaagaacauuaacacuuccuaacaccagaagcauauggcucccaggcuucaaaguuuguuuuucacguaaaguauaauuucuucuuuaauaaaaugguauugcuaagauauccugccuacgucacagaguggaauaaaauaacccauugaagacacuguguaaauuccgcuuuuucuucauuuaaaaauuuuuuuuauaaaauuaaggugaaacuuuuuuuuuuuuuuugagacagugucucgcucugucacccaggcuggagugcaguggcacaaucucggcucaugcaaccucugccucccaggcuuaagugauccugccaccucagccucccgaguagcugggcccauaggugcaccccaccaugcccagcuaauuuuuuguauuucugguagaaaggggguuuugccauguugcccaggcuggucucaaacucuugagcucaagccgucugcccuccucggucucccagagugcugggauuacaggugugagccaccauaccuggccuguaaauucuaaaauagaauauuguucaggauaaacaccuaggugcucagggacuuuaaaaguuggagggaauauuuaucuccagucccuagaacuuaaaaacuuggagccgguguacuuggcauucuucccacuugaaaguccucuuucucacucacagccaguuauguuucaccuacuccuuaugaguagaagaaacccacccguugagcacacauggccaggcucaucccuucagcagcugcacagcuagugagauaaccaacugcagucagcguuuaauuggggaggaagcuugaucuuauagaggagcucuacuuuuagaacaccucuaaggcaccuuguugucccgguugccuuucagaaauacgcaugcucacggaagccauuauaaucccaucaugcagcagccugcacuauugaccggucaugugacccuuccagcagcacagcccuuaaaugug

SEQ ID NO: 14596 - RNA, 1107 nt, Homo sapiens
auuggcaaaggcuggcaggggagugugcaugggggcagaaguaaaguccuagguccuucuggcucucugcaccugcauuugcaccuggacaaaguggauccaguagcccaagggcaggccgcugaggagguuuuuuguuuuuuuuugagacagagucucgcuuugucgcccaggcuggagugcaguggcgcgaucucggcucaccgcaagcuccgccucccggguucacgccauucuccugccucagccucccgaguagcugcgacuacaggcuggggccacuacgcccggcuaauuuuuuguauuuuuaguagagacgagguuucaccauguuagccaggauggucucaaucuccugaccuugugauccacccaccucggccucccaaagugcuggcauuacaggcaugagccaccgcacccggccugaagaguuuugauguaggccuuagaagcaaagcuugcagacgggcauacccgcagggcaaaaggaagccaaaggcaucuaggcagagcagaugauguccagugugcucugugggucgagucacaggaacaucacucauggggggagauaauccccacagagggaaggguaagucugcacugcugcccgaggcuugaugccaggacugggacagugugugaccccugggaccagacuucagagcuguugcaaucaugacucuagcacauuacuuguuuccuuggcuguaaccuccacucugacagaagggacccuggcuuuuucccauggacccccacccccggccuaccuaguucaguaccugauauucaguaaauauuugaggaaagaaaaaauaacaaacaucacccaucaucccaccacccagguggagcccauauuaaucccugaggacuugcacuggacuugaguggggcuagaagcccugcuugcagauugcaucuagccuaagguaaagcaauuauuuggagguuguaggcaggcugauggcucuguaaggaaccccaucucucacgcacuggccaucacucccguggucgggggaucuccacagaugugguagaaagaaagacggcuucuguuuuuauuauggcuuuaucaacuguccugagaguugucag

SEQ ID NO: 14597 - RNA, 9301 nt, Homo sapiens
ggcuuuuuccuuuguagcauguaauacaauuguauguaauuauguaauauuagucccucccacaagacugaaacuuacaugagguagggaguauuucucuugcuaaccacguguauuaccagggccccaauaucuuguacagagcagguauucaauacuuccuuuuaaaagauacuuacucuacaaauucaucuuaauagauuucucaaaggaguaggugaagacacacacaaaguuugugagcuuggugguggagacaguggcugaaaggcccaagaugaaagaaguuuagggcugggugagucaguaagcaagaagggagaaaugaggacacuauaggaugcucacuuaaugagguuuccccuccauucccccagcaucccaucccaccccaaacaaaucaucaaacaauaacuuagguauuuauuucauuagagaaucagguaaaccucacauuacacggccaaggccaagauaauuuugcacaguuagaauguguucaagaaaccagccacaauguaaccggauuagauuucaccaaggagaugacuguguuccuccaaauaaacuucauuuaggaagaugacauuccuccaauagguggaaagacaauaaaugcacuuucuucucuccgccacugaggaagaaagucucccucuugagggaccaacacuauuuccuuuuugcugcucuuuucccuucuccuuucuuugguuucuccuuuccacgaagcuucuuuagucguuuuugcucauccauaaaauccugaugcucaucucugaaugaagaaggaaaaaauaauuaaccaguuauuuuuacgaguagaaaaguacacuaaucuagcacgcacugcucucuuaggucauucugguuaucgaucuuugacuuuuacaaguuagccacaugcucagcuuggugaacaaaaaguauagggagucccuaacacagagaugcgguguauuccaaaaguucacuuguaaguccguuuccccucacagaaacacugccacaagcugcagggaaauucccaggccagccuacauaaaccuacauaacaaugacacaauacuaaugauuaccccaaauuucccugcaacacuaagacuaaacagagaggagacaaagugggaaucugcuucaauagcuacacagagacccugacugcccuaggaacuagcaucuacucagaauggggugaggucuggaggaagcucagccuggccaacauggugaaaccuuaguggcagcagguaacucacacaaaaaggcugcuggggaaaggcucaggcagaaggaagccaaaucaaaagacagauacuaaaggaaucaaagcagccaggacuacguaaguauguggauggcacagaaguugaugauugcuuauauuauaaaaaaaaguccacaucuuaagcccagauaccuaaagauugguaugguguuuaaacauguaagcucuggauuccaugugaaccuggguucaaaucacggcuccaccauuuacuagaucugucaccuuggauaaguggccuuaccucccugcaccuuaguuuccuaaccuguaaaguauggauaauaacaguguaugaaucaaauguaagagaggggugugcugagcuuaaguuuuaacucucuaggcuauccaugaacaucauggacaguauacaacucuuugggauuaguggugaguguccccaaauaauucucaacagugcagcugguauaauucuucuaaaauauaugucagaucaugcuacuccuguucauagcccugcaaauaguuccccauuucaaccagagcaaaugccauuguccuuacuauggcuucacagccccuugcaauccgucuccagucccacacccucccgguaccugcacgccuccuggaaaggaacacucccaccucaaggccuuugcugugcucuugccccucugccuugcaaacucuuccccaaguccuacuuggcucacucaccaccuucaagccucugcuuaaaccucaacuccucaacgaggcugacccugacuguccuguuucauccuguaaucuagccucuccccaccuacugcaggccccgucagcacucuggauccugcucagccggcucuacuauuuuuuuccacagcauguucaacuuuguaacagauccuauaauuuacuuauuuuuuuucccccucuucugucccuccuucauucucaucaaccguuggacagaaagaaagcuuucuggcgacucugucucuguugaugauacaagcuagguaccugguuaacugaaugaaucaauuguuucugagaacuggugcuucccucccucuuuugcagaucucugaauaauauuuucuuuauuggagacugucuaguuucauccugccugaugccacaggaggccuagcauuagagguaucauuuaccauaccuagugacuacgugaaaauaaucuuguuuuucuauggauaacuauuuuucccuguccccaaagauaguuaagucuuuauuuuucaaacaaacagacagcagcagcaaaaagaucaauuaaaauaacugaaugugauuuuuucauggguuauaaucuucuccucaggauaucugccucccaauauuuuauuuuggguuauaauaaaauuaguuuuuauuuucugagcccagacuaauggcaagagagguagucccaaagcaauuccaaacauucaaaacaugucauagauuguaaccucuaauguuaaccaagcacaucuauuauguucacugcuguuccccuagugccaucuuaagugccugcacguggaagguacguaagaaauauccacuggauagugaauguaccaaucuuuagugaucugcaaugaauguugugcuguacuauuaauucuauuguauuagaauaaaugguucccaauaauuuuaguauuguugcccaaagacaacuccaauuacaacuuguuaaauuuuuaaaaagaugguagguauuuuaacuuuauacaauuauguacuauuugaauucuuuuguaaugggcauguauuaguuugguaauuaaaaaaauaauuuuuuuuuuuuuuuuugagaccgaaucucgcucuguugcuggagugcaguggcacgaucucggcucacuguaaccucuuccuccugaguucaagcgauucuccugccucagccucccaaguagcugggauuacaggcaugugcuaccacacccagcuaauuuuuguauuuuuaguagagacgggguuucaccauguuggccaggcuggucuugaauuccugaccucaaguggucugcccgccuuggccucucaaagcgcugggauuacagcugugagcuaucauaccuggccaaaaaaauaauuuaaugagaaagaucacacagguauuugauuuuuuuuuuuuuuugagauagagucuugcuuugucacccaggcuggaguacaguggcaugaucuugacucacugcaaccuccaucuccuggguucaagcaauucucuugccucagccucccaaguagcuggaauuacaggcgugugccaccacgcccagcuaauuuuuguauuuuuaguagagacgggguuucaccauguuggccaggcuggucucaaacuccugaccucagaugaucugucugccucggccucccaaagcacugggauuauaggccugagccauugugccuggccugaucuuuuuuuuuuuuucagagaugcacacaguucuaagcaccuacucccuagacauacacacacauacaaacacaugguguuaagaaccugugugauuuacguauuauccuuaaaggcaaacuacagcuuaucuagaccaaauuaauaugucaaaaaggguacaaaauaaaaaugccagaagacaguaggaagaaaugucaacaaaaaugccaccagaagagaaagaaggcucccacauaccaguuaagcagcagaucaggugucggucagggacucuguucaucugauaacaagagcccacugcccuggcaaccuugguguuucugaggcuuucuuccucaguacuuggaccaguuuuucucugcauuguuuuuuuuuuuuuuuucucgagauggagucucacucuguugccaggcuggagugcaguggcgcgaucucggcucacugcaaccuccgccucccagauucaagcaauucuccugccuuagccucccgaguagcugggacuacaggcgugcaccaccaugcccagcuaauuuuuguauuuuuaguagagacagaguuucaccaaguuggccaggauggucuugauuucuugaccucgugaucugccugccucggccucccaaagugcugggauuacaagcgugagccacugcgccuggccucuuggcauccuuuuuagagugcucuuagauuaacaaaugauuaaacaccucucuacagcucaguaucuauucaacauuagucauguuguagacauaauuaaaauauaucuuccaacaagcaugaauuuccuuuuuuuuuuuggucucuccauuauggguauuuugaaagaagacuuucuccugccaacuguaccuuuugaacuaccugggcucuauuauaagaacaaaacuacaaggauagaaaggcuaauuuuuuuccuuuucugaucuacugaaaaaaagucucucauaggucccucuuuguguuugucaucaccuguagaguccaagaaaucggagcgucugcaugaguucagcguaaguguggugauuuggauaccaaucauaagucuccuucuucuuggccaagggcaguucacuaaacaguuucaccacuuucauagacuuggaauuaguaggccuggugacuucaccaaauagccgggcacugagacgagacaugcggaaggcauauucugaaagggaggacauuucuugaguggcaaggaguuagaguuccuauugaaaaugagaagaaaguuaaacagguuaggguaagaaauuccaagauuagcuaaugaauaaguuagaaaaugcaaacacagcaagccacucauggaucagugcaguguuggcaggauaugccuuggaguggagaaguauccacaguccaaauggcuauuuccuuuccaugcuuuacagcugcgauuuuugcacuucguguuuacaugcuauuacuuccuugcuguauugccuccuuugcaaccaacuauuuugugauucaccagguuauuuacugacagucaguuuaccuauuuguaggcuggggaugaagaagacagggaaacaaguuauccuaauccagcaucauuauaccuucagaaaacacccaccuaagcaaucugcagcauuaauaugcugacugcuugccaucaaaagguguaaucauggcagagacauaauuauguugucuuuacuaucaguccuuugaacacuguucuccucaagggcuccagaaggcucugagagcugcuaaugaguuaugaggucauuuggcuucuagguuacugaacugaauuuugccuagagacugagagccauuugggaaaaacagacaguagcccuauaaaaauaaauccaauagcucaaaagauccauuuucuuacuaaauagaaggcacguaugaauuguaagguuacuugcuguauccuccaucuuauauauucugcuuuaaugcaaacuaccuaaguucuuaucagcuggaaacaguagcuuuuucuucagagacauacaacacugaaauggguauaagaaugauauccgugauaugcacgaauuacagcuaacagacauaaaaaacuauacaggggauacauaaaaaucaagaaagcugcugguggaauaacuaucucaacucaguuuagaccagacguagggguuauuguuggcagaauaugccaauuuaugagaaauuuuaguagugagaugagaaucuuugcugacucagagacuauccugggaaacaguucagcugagaugaaaaggugcugauauucaagcaggaaaaaggcauaaacuuugaaaaaccaaugggagaaauguaccaaaaacccuccuacauaaaaauggugccaagugaauuucaaaauaguucuuguaagaaaacaaaccguguuuaaauuaaggaaguuuuaaugccuguuucaagauccauuaacagaggaggcugggcaugguagcucaugccuauaaucccaguacuuugagaggcugaggugggaggaucgcuugaggucaggacuucaagaccagcccaggcaacauggagaaaucuuguuuuuacagaaaaaaaaacaaaaaacaaaagaaaauaagaaaauuagucugcuaugguagugcacaccuguaguuccagcuacucguggaggcugaggagggggacaucacuugagcacaggaguuugagguuacacuaaguuaugacugcacuacuguacucuauagccugagugacagagcaagauugugugucaaaaaaaaaaaaaaaaaaaaagcagaggcugaucucaaaccacugucaaccucaaaaccauucagaacaccaaccaagcaauuuugggucaauagugccaccugaaggcuggcaacgguagaacugucagauccaacguccaccccucccuccccaccaucugcagaucaccuacaagccuguucuuccuuuuccauucagcauucucaguuuccugauucacuucuuugccaacucugguugggggugggguuguuaggacuaggguuauagucucaaggugaaaaaaauucauuuagcaguuuaauguauaaacaaaucagugccauaaaccucuaaaaagccuugcaaauguccagagucaccuaguuucuuugcaugcuuuuucucuuccuuugcccuuuaaaguuaccuuuuuccaaacauuagauuaaaaaacaauaguugcuucaucaacuuugcuuuguuugcuuaauuaccauuguggcaucagaauauauuucugcuguaauugcacaguauuuccacaguuaguuaucuguaagcugguaugggaacuaucaguuuguuacaguguuuucaggaaaaucuguucugaauuccaagucccuuuauuugucaaugaagaggcaacagggauuccugaggccuagguuugacuacuggcucugucacuuaauccuuggguuauugugaacaguuacucaucuucucugagucuccuuuucugaaaacaaagcuugcaugacuagugcgaaaaugaguaacaguggcacugaguaguaaaugguaacuuacaaaaaagaacgagcccagaucuguaaguuugguuuucauauauucuacauagacacauuuguuuauuccuuguucuuaaucauguuuaagaaaaaaaaaaaaagagagagagacagacagauagauacuccauauaguaaaaacuuugugccucccuggaaugaugaccucauuuacaaagacugacagccagagaaacauagggagaggaccagcaccuugauaacuugacaagauagccaggaggaggaagggacucaguaggacaguagucacugaagccaucacaggaugcugcuguuauguccaugcccauuuuggaauguggcaaauuacugggauacauaacuuguaaguaaaaaggucacacuagaauaggcuggaacaugguuauaucauaaaauccaaguccuaaaguuuuaugacagagaaagggaauaagccuuuucaaaccugaaucccuuacuagaaacaaaggcccacuugcuaaacaggaggaaacugaaagugguuuuaacaauuaccaaugacacugcuuuguuguuuccuuccacagugcacagacacaugucucucacgaagaauaacacgggagcuuuucuuacaacgugcaugucaauuacauuuugauucacaugaaaccauucucggggaguacaagucacuuuaaguguuaccuuucuuuaaaugugaacuaaagaaaacuguacucucaugaaaaaaguuaacuggagcugaaaaugcuaagcaaaaacaaauuacucaaaugugcugagcaaaacaaauuaagcccacaugagaagaaaauucccauauuuuuacuuuggcauaacagggcaaacuucuuugaucuuuuugauaggucugaugcauuuaaaagauuauuucaauaaguggcuuuguauuagguuugccuuuucucuuugaaagguaaagaugaagugcaagaguucuuaaccgggaugugcuucagcguuuugaaaacaguggaaguguacaucuguaugccgauauguguauguauguguguguguaaauuguucugggagagagcuuucuccaguuucccaaaaaccauugguuagcagaacgcaccagcugcagaauaaaaaagcugguuggaaucucgccucugccuuuuaauggccacgucguuuuuguaauggugcuuauucucugccagguucucucaucgacuacacgaggacagucauacuaucugcgaugugaagcuaauaugcaaaauucacggcacagugcccacccuaauaaccaucaggauccaaggaauucacauacaguguacacacguugucauagaaacaaucuaaacauaaaaacaaucucaacagaaugcuuaaaaacaaaaaaacccgguaccgauuauuuuacggagucauagaggcaucaacggcacugaaaauguauuagcugcauucaguucaucaagaacaaucuucaacucccuccaccugacucgaucaugccugacugugauggaaacuguaguauugucaagucaaccgauguuugacucgggagcgcauuucgcaaauauuuuucuuaaauaucaccuuaccguauuuuucuuaaggugguuacaaaauuaaucugcagcccaccacccaaagcuacagugccgaaggccgugugaugagcagagaaacugagccuucuacuguuaaccaauauggaagagaguaauugcgccugagaggaaauuacggcagcggaaacgcggguauucuacguuuaagaaaucccccaacugaggcagaaaaaggccaaguuauuugugugaugcacgugaaccgcccgagcuggucacuaaugaaguggauucgcccuauuccuggcgacucuacaagguuggagacccccguagacuucgcagccaucgccccuugcugcagacccccaaagucaccgacagccuuaccuagaccugaccuuccucacccacgcgcccucgucccggaaggcccgcccucuacccggcuccaagcucgcgcaggcaacuauuacggggagcaguagagaaacggaagcuuggcagcuagagcggagcccuagugaacgacccggag

SEQ ID NO: 14598 - RNA, 1540 nt, Homo sapiens
accccagccugccuggaacauggccuucgacugagguugaguguccaggaaaggagagguugaggguggaaugagagcagguggcuaggaaagcacaggcuuucuugugaggacuccuccccucucuccuucuucuccccuaaaccccccugccccauuguauuuugagguugggguucaagaaacauuaauuagugagcuagacuucuggcuauuaacgugcuuucucugguccugauuuuuuaaauuuuuauuuguauuuuaccauuuccuuaugugcccuuuuguuguaagggaaggagauauaucuuccuuuggaauucugaagugccaguugucaaauagcuucuggaagguugaacugaaaugguuugaaugcugcuuuucacagaauguuaaguuuagucaggcucucugcagguagcuaaaccuugguaaauguuaaagagaaagcccucuuuaaaaauacucuguuuaaaaacugcuuguuguagaaaauccaaugcagaaggaauaaagaaagcaaaaaucuccuuaaauucuucuaccaagauuggcugauuugccucucucuuuuucucuucucuaucaucuggguacacaaauacauguacauacaaauggaguuuuauaauaaacauaugagauacauacauguuucaagcucauaauauuuuacacuggggugacauaccugcuguuuuucaaccuucuuauuugacuuaauauguguugugaucuuuccacauuagugaguaaauucuacaucauuauuuuaagggcugcauagcguaucacuuuauggcuguauuauuaucuaaccauuuucuuguuuauaggcauuuaggugguucuaauccuuuucccauuacauuuuguuauuaacuuguaauuaacaguuggagugccaaguacuguauuuuagcauuuauauauucaacaaguauuuacugagugucauacacuaggcuaggcacuauagcagugguucuucaugaacaagagacaaaaaucccugcccuuauagaguuuauauucuacuaugagacacggacaaugaacaagauaaauaaauaaaagauaaaguauguuagguagugauaaguacaaaguagcaaaaaaagcauggaaagggauaugaaguauugaagaggggauggaaacagauuuugagaaggguugucaagaaggccucagagagugggggacuuuuggauacagacaggaggaaacuagccaugggauuacaaggggucaagcaaauugcaggcaaagaaccagcaagugcaaauguccugaggcaucgagaugcugguacauucaagaaacugccuggaggucagugaacgugcaauagagugaguaagagagagcuuagugggagaugauguaagaaacguaggggggaagcagaucauuuaggcccuuggcuuuuggaaggaaagccauugagaagcuuugaucggaggacagauauuauaugaauuguauuuucauaggaucauagccugaagacagggcaaacucagaggcggagaca

SEQ ID NO: 14599 - RNA, 8526 nt, Homo sapiens
cugguucuauuuaaugguucuccucgccuuuccuccuccaccuucccucauuaucaaccucccucugcccacuccuuuccaccacccugaacucaauucaacaaagcauaaacgcaccuuucucauuucaaaaauuagaauguuaaacauuagggucauggaauacagauaauggacucaagccugacaugauucgugaggagauuuuucucuaucuuggccuuugccugcagagucaaacucaccauucugggcucuuuccagggggauuauucuuaggccagucccacaucauauuuuuccaaggccucagaguuaggguuuccuccuuguucuuuucuuuuucuuuucuaaaaaggcaggaagagauggggaaagaaauacaagcuauauauauguuccugaguacaaaauacugcugugggcacaguuagcaaucacaaagaaauaaaaaggcaguuucuuaccucuaaagacaggagauugacacauagguuaacgagaaugggcaggaauacaugcacaggccuuuccuugggcagagaagcaaucaggacuuacucaagugcaaauaaaaagcaacaaagauuuuuuaaacaauggaaauaaugucuaaugccuuuaagugcaaauaugggauagaauaaccuuucugaggaccuuaugggccaaguuuugugugugaaugugauaucuggccucaucuuccuuuucuuucuuuuucucuccuucacugcaucuuuuuuuuuuuuuuuuuuuuuuuuuuuugagacggagucucacugucgcccaggcuggaguacaguggcaugauauuggcucacugcaaccuccaccuccuggguucaagcaauucucccugccucagccucccgaguagcuaugauuaccggggcaugccaccaugcccggcuaauuuuguauuuuuaauagagacaggguuucaccauguuggccaggcuggucuugaaugccugaccucaggugaucugccugccuuggccucccaacgugcugggauuacaggcgugagccaccacgcccagcccugcaucacuauuuuuaucccacucuacugugugcguuuuguuaagccugcuuaagucuuuuuuggaacauggcaggacuauuaauauauaaguuagaauugaguauauaaguuucauagauuuuggucccauuauuuuauuucagguauucuuuuuguuccccaccuaguucuuuuuuaauaguauucuguuuuuguuucacagaggcaauaucuuucuucucuugucucucugcagauaucaaaaauaauuuugaaaauuuuuuucuucucccuguaacuuguuucugcacacuguuuuucuccccauucaugggcuuuucucagauauaugaagaugguuacuugucugcucauguugaaaaaugccugcgggcacugagugaaccccaguucaacuggggcuucauuguagaggggucugaggggcggauucuggggcacugcuagugucuguaggucuuuccucugugcuggucauccccagaaagucuucucccagucucuaggcuggagggcaaagcccuggcagcaggucugagagccaaguagaagagagcugggaucaaugcuaaaacucaacauccauaugcacacaguccguaacuccaucagggugcuguagugaacuucaguacaauacccugacccucaacugugcuggcugacccucaccuguugaucuccaaaccuaaggacuguguuuuacgacccccucguacccugaucccaggagucaagggagagaggaaucccucagugauaugcaguggccaaggugauguaggaaucuagauccaucuuaaauaacuuccaccaaaucccuguuuuauuucccuuucuucugcuuaacaaccagauccaaauggaccugcuggugccaguucaugagccuuuuggggauuccacaaguugguuuucagcuucucugauacugacuuuagauuugacucuuuagguccaauuuugacucuuuaggacagcauccgucagcccugcagacuuuuguuguugucaucccugucuccuuuucuauuuuccccauccuugaagacuuccgucuuucuaagaaaucucuuaacuguagucuggcuugguuuaggaggaggaaaugcuagacacauuuuuuucaaucggccguuauaacccagaaaucuuuaauugcauuauuuucucauguaacucaagaaugcagcucacucuucuuguaguacacugguuuugagauuauuugucaauaaauuauguaauuucuuuggauauugcucuccucaucuguaaaacuggaacauuucuuguccuaucuaccuuauaaguuguuguugcagcuucccugaguuaccacauaggucuaaggacaaaguaaccagcuguucaugcacggcucuggcaaaauaagguuuucagggugaugugaaaaucuuuccaggucaguggaaauacacaggccuggccucugauuuucauucuuguuucuagaucaacagcuuagcacaacccucagcuucugcugacaaagcccuuugggaggaggcaaagaguaccucaucuguguuagaggacaacagccccuccccgaccuggaacacagacuuuuggaagaggaauuauugucuucauuuugcugcuguucugccuuuuccucuguuuucuucuaaguaaaacacuuuguucucauucuccaacaacucucaccuucccucuuuuucuaauuugcauuuccauuuuguuuuucugcccagcccacuuucccauccguggccaagguggacaccucuuauugacccauuguccacuuaauucccccaggcagaaccuuugcucccuggcgucugcagagccuggggaacaguacaggccuuccaaugagcaaagccaggugacagcugggccuccagcaaggugggacucugcaaaguuguccugucuagugcugcugaaugggauaggauuucuccuagaaagaaaccuccacacaucgaaaagagaagggugcagaagaugaaugugcugaccguuuauaccuccuguuuguuuauuuuuaucaguuucagauauuuguacauuuuugggauacgugugauauucugauaaaugcauagaauguauaaugaucaagucgggauauugagaauauccaucaccuugagcauuuaucauuucuuggugauggaaacauuccaaacccucuuuuccagcuauuuugaaguacacaauacauuuuugcuaacuguaguuacccuacucugcuaucaaacauuagaacuuauuucuucuaacuguauguuugugcccauuaaccaaucuuucuucauccacacccgucccagccucugguaaccguuacuguacuuugauuagaucaacauuuuuaggucucacauaugagugagaacaugcaauauuugucuuucuguggccuggcuuauuucacuugacauaaugaccuccaguuccauccagguugcugcaaaugacaacauuucaucccuuucauggcagaauaguauuccauuguguauauguaacacauuuucuuuauucauucauugaaagacacuucucaugauuuugguauaaaaacacaugaaucaaugaaacagaauagagaacccagaaauccacauauuuauagccaacugauuuucaacaaaggcagcaacauacacugggggaaggacauccucuucaguaaauggugcuccgguaaauggaaagacuggauacucauaugcagaggaaugaaacuaggccccugucucucaccaaguaaaaaaauaaacucaaaauggauuaaauacuuaaacgcaaaauccaaaacuauacauccuguuuaaggaaguauaagccccuuacagggaaaccuucuuuucauugaaaauaagcuguucucucuuuuccucuucccaccaccuuuuggcccuugaagaugauggggaguagaagcauugguaguagaguaucccauuuccaggagaugauccagaugggaucacaugucaaguggggaccauugucuacugagaaggcagcucaggccucggucacuccagagucucuuguggugguggggaaagcagggacuaagguauagggcugguggccauggagacagcauuuggggagauggagggagaggacggcacagaugauucaauaagaaggggcaggagugcaccuucccuucucugacuggcuguggcugcccacgcaggccgcuggccucacaagcuccuauugugaucaaacgaugguuucagcaguuccaucugacacauaugguaauaugagcagggggugcagugcugcaugauaaucaggcacccugggcaguucccauaagugacuguaagcaucacuucuaccuggcugggacaggcaucccgggucagccagggcagacaagggcggcccuaguagagcaggaaccugcccuguggcucucaaagaucucugccucugugacuggagcccuguccuccuuccucuguaggccccuccucaccagaaggaagggucugcugcuguuccccuccugugccccgucucuccccacuccccggccaacuuccucccuggccgggggcugucagugucugauggucaaugucaggacaagaaggguggucuggaucccucuacagaggggucuuaagccaaacugcaccauaugucuuuuuguuugcucugcugggguuccccaugggguggcuggagugagagagaggaauggaggggaugggaccuggacaccuuuugagguauguggucucugagguauucuccaaagagaccugugggguguuuguuucucaggguugagaaaagauuguccaggcaggcugcagcagcuggugugcuugcacgggguguggaugugguuugcuucaggcacuucccuuugacagagagggacgcccaaggauccuccaggcuguucugcaacccccugggaagcacagacccuggggcagaggcaggauaaauagcuuugcuccuguguggagccccacuggcaggcuuagggcacaggcucagauguggauggguggagagagggcccagggagcugugguggguguuggugaaggguagagggguggguggcaugagcagagggucagaagguugagcucuagagaaggggugauggaugaggaaagugugcccggagcuggugggggcuggggugcggugggcacguggaaggguagggggcuugagagcagcucuggcugccucugcgugcaggagggcaggggugggagcuggggaggaagccaagccagaugcugaguggccaacugagccauggcaacagcucugcccucucccuucugcuaaaaauacugccuuuccagacaacccucuuccuccuggagcugauggguuagccaggcguggaacagagaagggccugacucagaaagcggggcugacccggggguggaggagauggaguaagugcaagaaaggggucugcucuggagcuuagaggagagcaggaaguguggcucuccuccugcagcccugcaugcagggaaagcuaagcccaggagccagcuuagaguugaaggaacagaacaccagaccccccaugcuguuagcuuucccucaccugcaaccuccuagugagaccaggagagccuggcaggugcagccugacuacccagauccagcagcccauuucugugguucucagcuccuuggagaggcugagugaugcuguguuuggaagcugggagugcuagacaggucuggguuccagucucuguucuaccgcuuacuagcagugugccuuucagcaaauaggaauaaagauaguaccugucucagaagguugagauagauauauagcuaggcagcgcuaugccuggcacaaaggaggcauagaagaaauggccacgauauugugaugaucugucccugugcuuaggaucuaaacugcuguggccuguuugugcacacaaggauagagucaccacaggggauccucccucugcaaagauugugugcuccuaucugagaagggcagguugccuuccugcuccuggagggccacucccucucugcacccaccccagggcugggguauacccuggcccucagucccaggcucugcugcugacuguugcucgccugcuuccccacagaccugcgcagaaugacggcuggcuucaugggcauggcgguggccaucauccucuuuggcuggaucaucggcgugcugggcugcugcugggaccgaggccuuaugcaguacguggcagggcugcucuuccucaugggagguaaggcuacgggcucggcuuguggguggcaguggacaggguccuguuuaccacaauuuggggagaauggccagagggcacagcagaggggaccaugacgugacugggguucucauucacucauccauugguucacaagcacuucuugaguugcuuuuagcuccucaccacugcaccagcuguuggggauacaaaggaaaauaagacacgguccucaccuuucgcucagagcugacugccuguguggaagaaagacacuuacggagaugaucaugagacgggugguuacggcagauggagauaucagaccuggaacaagcaugagcccaggaaguacuugggcauuucauuauaugcaggcccugggcauuagugugggaagcuggaagcaggugcuaucugggcacuuuccguccaaaagucuaucuucaccucugacuuauggauccugaagcugccccccuuucaaguaaggcggggguggggcaggacuagacccucucuuauaucugucucucuuacucuauuauuuuaccgucaugugcauaggaccacuccagugucccucuaaagggauucuacauaaggagaacugcacaacuaugugggaauagggguccaguccaugggaaguaacagugaguccacuccucuugugucucuucuuucccuguaagagcuaaacugugcuuuuuggucuccugguuugaguuucagucccaagcugaaguugaccacuggguauguccaucaccaucuaccccucagacaaagguagauggguggauuguguggggcucaguagagggggauuggggccuggacagagggaauuagaaauauuguggcucacaccuguaaucccagcacuuugggagaccaagguggguggaucaugaggucaggaguucgagaccagacuggccagcuugguaaaaccccgucucuacuaaaaaaaaaaaaaaaaaaaaaaaaaaaaaauuagccaggcaugguagcgcgugccuguagucccagccacuugggaggcugaggcaggagaauugcuugaaccuggcaggcagagguugcaguaagccaagaucgugccacugcacuccaaccuuggugauagagcaagauuccgucucaaaaaaaaagaaagaaaaagaaaaaagaaauguuuauggaaagaaauaaaaguaaguccugcauuuagaaacaaaugucaguuagaauuuaggcaccuguagcaaacacccaacucaggucccuucugugagccaccaggcucuggguuucugaacaggggcagagggugaaggagagagccaugcuggcucuuugucugcaggucaagcuggggacaggaggaguucauugcucuagguguauggagugaucuuggggguuagugagcugugggauuuggcuugaguucugaauuuauugaaggucuacccuuauucccuugaaacacagccauucugugccaaagacaggcagggucuuuccaaggaaaaaucacucagggcuaaaaaaaccgucugcuguuagagucaggaugccccaugccagagcugccuccucagugagccccacaccugugguuauggcagaggcugggggagugagggggacgugauggcucugucuaguaguuuccacacuccuccuucuggucucccacagagacagaggcugacaaaaccaggcaugcuucccugcucugugccucagcauacccuucagugaaacaaggagucaaacuagcuugaugauuuccacacuauauuuuagcaauggaagcuuuuuugguuuuccuuuugcaauccaaaucuuauguagccccccaaaauauaaaaagauaaaaguggagcagcucuguuuguagugaguguucucucuaagacucuuuuggauauauaaaggcaggcucugguaaaacaaggcuuuccuaaggcucuagagaggucucccaggaauccaagaaaagcugagcaaacgggccgcgggcagauaaggaauccagugagcccugggggccagcuucuuucaucuccacuucuuugauggcauuugaggcuccuucaugguuuuucauucuccccucucuucaugccaggcacaagguucagauccugcccaggugcuacaucuccaggacucuucaacucuuugacaacuucccucuggccuguugaagcc

SEQ ID NO: 14600 - RNA, 107639 nt, Homo sapiens
ggcuuugcccuagggcuggcucccuucauggaugaagaaugacuauagcaguuucaggcauuacauacacauauaugauccuauaggagaaaagugcgaccaucucuuucucuuuuuuaaaaaacagcuuuauggagauauaauucacauaccauacaauuuuccuacuuaaacuuuauguuucacugaguuuuaguagauucauaguuguccuacaaccaccaccaucaauuuuagaacauuuucaucucccuaaaaauaaaucccauacccauuagcaaucauuucccacuucuccccaaccuccccccaacugcaguccuaggcaaccucuaauccauguuccauuuucaugcaucugccacuucuggugguuucauguaaguggagucauacacuauguggucuuuugugacuggccuauuucgccuagccuaauuuuuuuuuuuuuuuuuuuuuuuuuuugagauggaaucucacucugucacccaggcuggagugcaguggcgugaccuuggcuuacugcagccuccgccucccagguucuggugauucuccugccucagccuccagguggcugggauuacaggcaugcaccccugugcccagcuaauuuuuguauuuucaguagaaaugggguuucaccauguuggcuaggcuggccuuaaacuccugaccucaggugauacuccugccuuggccucccaaagugcugggauuacaggugugagccacugcacccggcccaccuagccuaauguuuuuaauguugauugccauuucuuucuugaauucucccuuuuaagaaggaaaccuuuccuagagaucucucagcagacuuccuuuuaagacuguucuaaaucgagugacaugaucuauuccuaaucuaaucauuggagauggaagaggaaugacugugauuaccuaaagugacuguaaacuaacccuuggcaaaggggaugggguuaucuagucaccugcuuuguaguuacaggcaaacaggggcugggaaggugaagaguggaugucugaacaaaauuuaauuccuguuaggaaagaagaaaggggcaauggauguuagguaaggagauaaaauguacaauacacuuuaaugauacaacauaacaguuacgaaagaagcuaagaauggugaagggggcuccacuuaccuuugguuuauuuauuccaccagucuuccuuccuuccuuuuuguuuuacaccuguaagcuucagacucuagagugguggguucaccaaccacuccaaauccuaccccugcaauggauuuuauuauaccaccagguugagugaagcugaccaacuucaggggcuucagggaggugguaaaggcagggaggggauaacugagaggugagagucacacagugcccacuuucuagguaaucaauugacagcaauucagcaugccaucauugcuguucuagcuguauguaguugauguacacaacugagagggagguugcaaguaugagaauuuuuuauacacauauaaaaaauuauauaucucuauauaucuugucaaugagcaaaaaauugaaaugugagacuaccuuaaaccuugauucuuucucucgucuuauguucuugaacacucuuccacaguagggggcaaucugacuggagagugaaauacucuuucuuguugaaugaccauggcacuccugucuuaguuucuucucacccuauuucuaggccaaggucauuucccuguaacauccuuaauaacggauucugagcccagaccaggcacgguggcucaugccuguaaucccagcacuuugggaggcugagacaggcggaucaccugaggucaggaauucaacaccagccuggccaacauggugaaaccccaucucuacuaaaaauacaaaaauuagccaggcguggugguaggcuccuguaaucccagcuacuugggaggcugaggcaggagaauugguugaacccaggagguggagguugcagugagcugagaucacgccauugcauucaggccugggugacaagagcgaaacucugucucaaaaaacagacaaacaaaaccaaacagauucugagccaagagaauguuaccucaggauugguucuggacuaaugagaagcuacugggauggucagccaccauauuuggaaaaugcuagagaucuugaguuguaagacucuuccauuccugggagcuacuagaugucagucaguacauucguccucaagggaacauaaauucauuuuguaagcaacuggggcccauacuuucaaugugucacuuauuucaauaugcauaaaguauaguauuauauguggcaauguguuaguugugaaaagagacacaagucccuauccuugacagugcaaaauguucuucucugacgaucccaggcaagagcugaagacccaggcaaauuccaaauagcuccuugggaaccucgcucagcuguuagugauagugaacaaagaacauggaaaaggaaguacauaagccaagcccuucucucuggcugugugcauuuggaucugucuuugguccucucuguggcaugaaugugccauugagccucagggacugugcccgaggcacuguuccaggccucuaagggccagagugucagaccugagucuucucuggcaucguagauccuuaacacggaucagcaaaggaagcucuccaggacucucuuugacuaugagagggaacuuguguuaauccuugacuaagaguuuuguuuuguuuuguuuuguuuuuugagagguaguuuugcucuucuugcccaggcuagagcgcaauggcgcgauaucggcucacuguaaccuccgccucccagguucaagcaauucucuugucucagccucccauguagcugggauuacagacaccugccaccacgcuuggcuaauuuuuguacuuuuaguagagacaguuucaccauauuggccaggcuggucucaaacuccugaccuuaggcaauccacccaucuuggccucccaaagugcugggauuacaggcuugagccacugcgcccagccuaacagaaguucuuggggcugccuaagucagagugucagguuucuguugggcugcaggaacccauucagggcuggcuagagcuugugccugauuauucuggaaucugaaugcauccuaguaaaaugguauuuggaagagaguagaauugguauaggucuccaaaacuccaaccuacacaucugccugcagguguguauucagauucccuuaaucuccuauauuuccauccuucuucauccuucaucaaagcugaccuuuucuuauuuggggaaccacuuucaugcugaagcccuaaagcauacgcugagucugacccuuggaacaucaaaaucaagucucagauuuuucuagccugcaggugagcaguucagaagcuuauuuccaaacacaaacgcuuuagauaguuggaaaagaggaacugaaaauaauggucuuccauacccuaugacaacauuuuagagcuagaaggguuuuuuuuuaauaguaauguucucaguccccuaguuuacagauggagacucaggagagagggcuagaaauuucuugcuacuaaacaguguggcccaauggauuggugcacccuggcauaaggaauauguuuacugcaccauagccucauugaagguccccgccccggccuuuuuuuuuugaagcauucaccuagggagacauagguaggaugcaugucuacacguaggaaaugugcagacuagauagcaagcuccauggggcaggaaccaugaagggccuuguaccugagcauacccccagugccugaugcagggccuagugcacacucaaauguugguugacuggccgggugcgauggcucaugccuauaaucguagcacuuugggaggccaaggcgggcagaucgcuugaggucaggaguucgagaccagccuggccaacgugacaaaacccccgucuuuacuaaaaauacaaaaaaauuuagcugggccugguggcacacaccuguaaucccaguuacucgggaggcugaggcacaagaauugcuugaacccgggaagcagaggcugcagugagcugagauugcaccacugcacuagcgccugagccacagagugagacccugucuaaaaaaaaaaaaaaguuggcagacugaaugcuggaaagaagaaggaccuggcuuuguccccacaccaaucuggugggcgaguacagaauguaaacugucuggagguuggcauuggccuagcuucuccguugcucucuuguucucuagaauccaaucaagcaccuguggccagagagcugugugaaauggaaaccagucccaccagccccugauugcacccccgcaaugucuucucgcccuguuuaaugucauguccaaacuccuggccgccguggccugucuccaccucuccagcuuccucgcuuggccugucuccuuagcucucucugucucacccacacuggccugcaacucgccagagugccccaggcuuuucagcuuuugcacgggcccuucccucuccaggcucucuccccuggaucuuugcuucagcugcuccuucuugacauccaggucucagaccaauggccccuuacucagaaggccuagcgcaggccgccuaauuucacacaguucucccccuucccgcacugccuuccaucaccucguuucauuuucuucguggcacggagcaccaucuccaauggccuuguucauuuaguuaauuuauuuuccgacuuaguuccaggugcuaaaacaguguuaccuuggcaggcuucccaucaaauauuguugcgcaaaggauggauggaugaaaggaagagugagccaauaaacgagggaacgccgggaaaggcagccucaagccggugggcccugccacccccaccgucccugagcauccgagccgguucccgcccccggcccgaacuggcccgcgcgcgcucgcagccccgcggcggaacccgagggcggcggcagcgguuucccuugaacgagccggggaaucuggagggagcacacaggaaaggcagagccgcgagcuggaccagccguggugagugcagcggcgcccaggcggggagcgcagugcgggucgcugggacugagcgcgcgagcggggugggagucgggaugggggcccggggcgcugggcggagccucuggagucgcgcugggccgagagccgcggggacccaagcaucaggggucgugggugcaggcggcggcgcggcuugaggguagggggugcgggccuggccggcgcggcaggggagggccucgcgcggaucccguggucacggcgggagucagcuguccuggguucgagucccagagcugucgcuaacuuguggaccccccucacuucgucccuugggcuucagcauagcccuuugcaaaauggggccaauaguaucagauccauugauggguugguugguucauucauucuggcgcuuuacuagguucuggugcugcagauggauagacgaacuugcccaugagggguucacuaucuaguaagaaaaacauuuccaccuggauacuccacaggcgugucaaauucaguaucuccuaaaccgcacuacuuuucuccacaaaccuaccacucaaaucuaaaugacugaaaucacuauucaaccagucacccaagcacaaaaaccuggcuugguuccuccucucucacuuacuacagucaauggaccaccaacugcugccaauuucuacuuucuaaagcuuuccaaauccauccuuuaucuugguuuguucuuuuaggagccuacagauuauggcaauaacuuccuaaugguucucuuuagcuuuaauuuuagcuucuuccaguucauuuuucauucugcuauaaaguggucuuuuaacaguucaaauaugauuauaucacucaccugcuuaaagcccauuaaagguuuuucauugucuucaaaauaauagccaaaguccuuaguguggguucaaggucuuuucuaaucccaccuggucuucaauccuuuaucucuaaaccacuguuucucaaagucugguauaguggugaccuccauugcaaccaacaugggaguacuuguuaacaagugaagaugacagcuuaauuccagaacaaaugagacucuugcgggaaggggcaguucccaggauucuguguuuuuaacaaguucugcacuaaagguugagaaccccuguucuagacacuccaauuuuuacuccgcuguugaugagauucaggacacacugccgcaaaauaugacucguuggcauuagaggaaacaacugaagcaggaaagucacuuugugucuucccacuuuucuccccugaagcaggccauaaaagaauuguuugaccuucuucuguauaagacccuucagugagaggugcucauccuguaaguauaggaucgaggaaaggaaugcccuuaucuuugaagacacagguacacagagaagaaucagaacaaauaggccuugcuaaauucuccccagcguauuacuguuagaucauacccccuuuuuccagucucagccaugaaccuaauucuccccucaacuaucuacguauguuucucucaacacacuuuacugucuuuuaugccuuuguacacucucaguuugggcuacuguaaaaaaaaaauagcaaaaacuggguggcuuaaacaacagaaauuuaauucucacaguuccggaggcuggaaguccaaaguuaaggugccagcaugguugagugcauggugauagcucucuuccucgguuuguagagaucugucuucuugcuguauccucacaaugcagagagaccaucucuguagugucuagucucauaaggacacuaaucccuuucaugggagccacucuuaugacccaauuaucucccgaaggcucuaucuccuaauaccaucucaauggggauagggcuuccacaucaccauuuuuggggaacacagcauucagacaauagcauccacaaaacuccuucguuacuuuagugauuuccuccucauuauucaaggcucagggaagacuucauugacugugcaccacccccucagcccuagaccagguuagguucauucuugcagacucucacaaagccuugugcugacuccucgacauuuaucccacuguacugcaaucauaauuguauaauuguguuagcauuguggguuugacaguugugagcacuugagagaacgcaugagacccauucuucucugcccucacccccagcacagagccuaccauauagguguuuauuaaagggcucuugaaugaaggagugauuuagggccagauggagaggaguucaagaauuaguugggccuuuggaaucaugugucagccugacgguguaugggauucacaggaagauggucucccuggcacuggcuucacugcugcuuuugauaaggauguuucuacccuugagaggaauuuuaaccaaugggauuuaaagggagucauaaaagaacuggacuuuuaaguggaaacaguuuuuuuuuucuuggucuauauaccucacuaacagauagucauaaaaaaauuuugcuuaaauuuuuguuuaucuagaaaauaaguucauuuucaaaaacuuagaaaguacauugcaauuuuaaaaauaaacaucacccaccauuccacaaccuagagggaucuacuuuaaaauuucguuuuugagccaggugcaguggcucacgucuguaaucccagcaauuuggauggccaaggcgggaggauugcuugaggccaggaguuugagaccagccugggcaacauagugagaccuugucucuaacaaaaaaaggaaagaaaaaaauuagccaaguguagugguaugugccuguggucccagcuacuugggaggcugaggcaggagauuuguuugggcccagaaguuauagugagcuaugauugugccacuggacuccauccuaggugacagagugagacccugucuaaaaaaaaaaaaaaaaaaauuguuuuuguuuaauuguauugguuuucuuuuuaaauuuauacucauguuugaacauaauugguauaaugccaauuauauauggcuuuuuauccugcuaauuuuacuuaacauuauguuuuggguuuuuucccccaucaguaaaaauuuuggguaaaaaaauauuuaauugcuauuuaacuuauucauugaacaaauauuucuuaaacagcuauugugugccggaucuuacuuuaggcaugggauacagcagugaccagaauuauguccuuacucucauggaguuuacauuccaguaggauuaggcuaauaaaugagcaaaugaauauaagcaucaccaaauaauaaaugucaugaagaauaaagauauucuauagugucacucuguuuuuuaguaaagucuuccuaauuuaccuucuuuaaaggaguguaugagugucuaucauuuuguuaugucaucagugaauaugaucauuuaaaaauuuauuuuggucaauaaugauaguucuuuguaauaugcaugucugauuauucaggaaguugaacauuuuuagauagccauguacauugccucuucauugaguuuucuauccauguuuucuguuucuuuuccuauugaggaccugguauuuucuucuauuuugaacucgcccuucauauuauuauuuuuugggacacuuacauuaugauggauagacaaauguauacucuuaaacagugguacagugaggcuguaaggaguuagaaaaaccagaggaagccuggaauucccuuccucucuuucugccccucccucuuccuucuauugcaaugaagaaauagugaucagagagggaagaaguauagguuagguggaaauacgugaaggaagaaagaaagguggauggauguguggguggaugagaagaugaagaugauggaaauagaagggagaagaugagcugaggccagaggagaagugguaaggaggaagaggagugagugggaaaaaaaggagugagagaggauaaaagaauggaagacagaguaauagggacauuacaugaagaccauggauaaauuauauuuuuuucucuuuccgccucuacuaaccuagcaaaucucuagaagaugacgguguucuuuaaaacgcuucgaaaucacuggaagaaaacuacagcugggcucugccugcugaccuggggaggccauuggcucuauggaaaacacugguaacuaucugacagccccaucccaccuuugcaucugcagcaaaacagccccaaagggccucagguuaaaaucuugcucagcugugcuuaucccuauaaaacaugugguguaaaagaaaaauaaaugcuauucaaagcaaaaacaaagacuucuuguaaccagagcuggaacuacaugcauacuuauauccagugguuagagaauaaaguagagacaucagaaaggaagcuauuuuuauucauuauauuuauaguggaagagauuaagacaucuuagagaaagagaaguccuuucccaaguuaguagugugaacccccaaaaucugagacaggucuuagucaauuuaguaaguuuauuuugccaaaguuaaggacgugcgccugcgacacagccucaggaaguucugaugacacgugcccaagguggucugagcgcagcuugguuuuauacauuuuagggagauaugacacaucaaucaauauacguaagaugaacauugguuuuggucuggaaaggugggacaacuugaaacaaaggcaagacaacuggaaguaggaagggagcuuccaggucauagguagauaagagacaaaugguugcauucuuuugaguuucugauuggccucucuaaaguaggcaaucagauauguauuuaugucagugagcagaggggugacuuugaauagaaugggaggcgguggggcgcaguggcucaugccuguaacuccagcacuaugggaggcugaggcagguggaucauuugaggucaggagaccagccuggccaacauggugaaacccaucacuacuaaaaauacaaagauuagcuaggcaguaguggcgugcaccuguagucccagcuacucgggaggcugaggcaggagaaucgcuugagccugggagguggagguuguggugaucccagaucgggccacugcacucuagccugggugagggagugagacccugucucaaaaaaaaaaaaaaaaauaaagaaugggaggcauguuugccccaagcaguucccagcuugacuguuuuucuuuagcuuagugauuuuggggccccaagauuuauuuuuccuuucacaguaguaagcaaguacuggaacucaugucucccuggcauuuuauuccuuccauuucuuacuauagucucuugaucugucaucaagggacacuuacugaauuuguuccuccauccccuguuacuauccucaucugucccauuagccuacauuaauuuaaaugagaaguagacuuucaaaccuuuuguuuaaauaaagaauucagaggagucauggauuuuauuagucuuccugcauggagggagaagaaagugccagagcuccucuuuuaguuuaauaugguaauaagauuuaaauaaacagagaaguuuuuuuguauaaaaauuauacaaaagacagccaaucaaauugcagucuuuuggagauuaaggacuacauuuuaaguauguagcaacacugaaauccagaugucuuaaaugacugcuuuguugaacagaaaacagaacaguuacucuuugaauuagaagucuccacauuggaaaagagauucauauugauauuuugugaacacucaauucaccacugugagaauaacuuuaugauauaacaugaugucugcuuuuuuugcagcuguggaaaaauugcaauacauuccccuucuuuucuuucuaaguguugucaaggccaggcauucaaauuccauuagccagcaucuaaggaaaaaagcagacauaagaagcuuaaaauuuguaauuaagaaaaggguggagcggauauuuuaacaaauggagcauggaauguuuggcuucuccuuuuucuaacuacacuugaguccucaaggccccuuugcuggagcauccaaucuaggccauggcuaggucagucggggaaaauucccacccacugaggauuacugcuguuucuacgacuaggugaagauuugaggaacuguguacucuguucaggaugucuuuagaggaaccaugauaaguucuugcccauguagccuugagaccuuaaaaaaggaccauuaagucuucaggacuaauggaggccuuguucuaaauuggaucugaaacagcuugagccagaagugugguggcagccuggaggccucauuuugcucugucuucacccuugacauucaauguuacugccccaaaugcaaacucuuguuguccuauugcuuuucuuuuucucagacuguucucuugcaugauuugguacuauuuagccuuuuuaaaaaauuguggugaaaaaacacaggacauaaacauuuucaccuuaaccauuuguaaaucugcaguucgaugguguuaaguauauucacauuguuguucaacagaucucuagaacuuuuucaucuugcaaaacugaaacucuguacccauugaacaacugcccauucccgccccaacccagcuguccuugacaaccacuauucuacuuucuguuucuaggaauuugaccacuuuauacuuugugucagugagucauauaguauuuguauuuuugugguuggcuuauuucacuuauaaugucuauaauguuuauauuaucuuuaccuuuucuuuuuuuuuugagacggaguccugcucugucaccuaggcuagaguguaguggugugaucuuggcucacugcaaccucugccuccgagguucaagugauucucuugccucagccucccaagcagcugggacuacaggcgcgugcaccaugccuggcuaauuuuuccauuuuuaguagagaugguuuuuuuuuuuuuuaaccauguuggcccgcuggucucgaacuccugaccucaggugaucugcccgccuuggccucugaaagugcugggauuacaggugugagccacugcgccuggccuauauuaucucuaaauguaaagauauauucuuuacguuuaaagagguauggucuuuacaucugucaauggacauuuugguugcuuuuaccucuugacuauugugaaacaugcuauaauuaacuugaguguacagauaccucuuggagauccuguuuuuaauuauuuuggauauaugcccagaaguggggauugcuagaucauaugguagucuauuuuuaauuuuuugaagagcuuucauacuguuuuccauuguggcucaucauuuuacaaucccacaaacgguguacaagguuuucaguuucuccacgcccucaucaacacuuguuauuuucuguuucuuugauaugggcuauccuuaugagugugaggugauaugucauugugguuuugguuugcauuuuucuaaugauuaaggaagucaagcaucuuuucacaugcauguuggccauuuaaaaaucuuuggagaaaugucuguucaaguccuuuuuccauuuuuaauugaguuuuguuguuguuggccuguaggaguucuuuauggauuccagauauuaaucccuugugagauauagaauuuucaauauauugucuccuauucuguagcuggccuuuuuacacuauugaucauguccuuugauauauauuguuuuuaguuucguuaaggcccauuugucuacuuuugcuuuuguuugccucugcuuuugguguuauauucaagaaaucauugcuaaauccagugucaugaagcuuuucccuauguuuucuucuaggaguuuuauauugggucuuacauuuaggucuuuaacagauuuugaguuaauuuuuuuuauaugguauaagauagggguucagcuucauuauuuuccauauggauaucuaguuuuuccauuaccauuuguugaagagacugucauuuccccauugcguggucuuggcaucccuauugaagaucauuugaccauauagaugaggauuuauuucugggcuuucuguuguucauuagucuauauaucuguauuuaugccaauaccacacuguuuugauuacuauugcuuuguaauauauuuuaaauuuaguacauauaagacuuccauccuuguucuuuuucaagauuguuuuggauguuuggggauuucuugagauuccauaugaauuuugggauguuuuuucuauuuuugcaaaaaaugccauugggauugcauugaaucuguacauuguuuuguagaauagacauuugaacaauauuaagucuucuaauuuaugaacacgggaugucuuuuuauuguacucuuuaauuucuuucagcaguguuuuguuuuuagcguauaagucuuuuaccuacuugcuuaaguuuauuccuaaguauuuuauucuuuugaugcaauuguuaaugggauuguguucuuaauuuccuuuucagauuguucauucuuaggauauagaaauauaacugauuuuuguguguuguguauccuacaacuuugcugaauuuauuaguucuaacagcuuuuuuuuuugguguagaaucuuuaggguuucuacauauaagauaugucaucugugaauagagauaauuuuacuucuuccuuuccaguuuggaugccuuuauuucuuuuucuugccucauugcucuggcuagaacuuccugugcuauguugaguagaagugaugaguggacaucuuugucuuauuccugaucuuagaagaaaaacuuccaguauuucaaaauuggguaugauguuagcugugggcucaucauaaaugaccuuuauuaugcugugauacuuuuccuuuuguugcccucccuccguuuuuuuuuuugccuauauauccccaaccuuuucacagaacagugcucacauucuuuauaccaaacuuguuuuuacccugagaagaucuuacccuguagucuucuugaguggaagcugccuuguccuuucuuucuucuucuucuuuuuuuuuucccccaucaggucauuuuauuauuaugguuuuuacaaauuuuguuuuauuuuaauaguuuuuggggaacagguggugguuugugguuacauagauaaguucuuuaguggugauuucugagauauuggugcacccguuacccgagcagcguacacuguacccaguguguagucuuuuauuccucaccccacucccaccuuucccccugaguccccaaagucccuuauaucauucucaugccuuugugcccucauagcuuagcucucacuuauaaaugagaauauaugauauuuggcuuuccauuccugaguuacuucgcuuagaguaauggucuccaacuccauccagguugcugcaagugccauucuuucuuuuuuuuuuuuuuuuuuugagccggagucucgcucugucgcccaggcuggagugcaguggcacgaucucggcucacugcaagcuccgccucccggcuucaugccauucugccucagccucccaaguagcugggacuacaggugccugccaccgcacccagcuaauuuuuuguauuuuuaguagagacgggguuucaucguguuagccaggauggucucgaucuccugaccucgugauccgcccgccucggccucccaacaugcugggauuacaggcgugagccaccgcgcccggcccauuauuucaguuuauuuuauggcugaguaguauuccaugguguauauauaccacauuuucuuuagccacuuguugguugaugggcauuuagguugguuccauauuucugcaauugcaaauuuugcugcuauaaacaugcauaugcaagugucuuuuucauauaaugacuuauuuuccuuuggguagauacccaguagugggauugcuggauuuaaugguaguuccgcuuuuaguuauuuaaggaaucuccauacuguuuuccauagugguuguauuaauuuacauucccaccagcagcguaaguguucccuuuucaccauauccaugccaacaucuguuauuuuuuaauuuuuuaauuguggccauucuugcaggaguaaggugguaucucauuauuuuuuuuaauuugcauuucccugaugauuagugauauugagauuuuuuucauauacuucuuggccaucuguauaucuuuugagaauugucuauucauguccuuaggccacuuuuugauggaauuauuuuuuuuuucuugcugauuuguuugaguuccucugugguggagugccaguagggaacaaggaccucuucuccaaggcccuaugugaucacagaggcugccugccuauugggguuuaggugcaacuuucccuacuguguccagugcugcaauuuugucucugcugugagaaacuacccacaagcagaaggaucuggaacucaaggccugcucuucagauucuuuugucccaugaggcgauaucuugauguggugcucuccugcuccuccuagggauggggcuuccugagaaccaaagugcagugauuguuacuggucuucuggaucuagccauccagcagggauagcgggcucuaggcuggugcuggggaaugucugaaaagaguccugugauguaauccauauucaggucucucagccauggguaccagcaccugcugugguggagguggcaggggaaugauguagacucugugaggauccuuggcuauagauagguuuagugugcuggcuuucuugaaugcugguuaugcaagcggugaaguugucacauggauagacucaggaccuuugguuagccaggauguugcaggcagugguauuagcuguuguuuucuccuucucgggagcaguguuacucugucaugaguugcgguaauguccugaguugguuggccuucagccaggagguggcauuugcaagagaacaccagcugcgguaguaauagugggauuugaacuugccauaaguuggggcaaguauucugguuucucaggcgauggguggggccauaaagcucccaagaguuucuauauuuuguguucagcuaccagggcucauagagaaauaccuucaggugggggcaggguuaggugggucugagcuaagacucuccuuggggagggcuugcugugaccacaguaggguauggggaggugguucucaggccagugggguuauguuccagagggcauuauggcuacuucucuugugccguauaguucaccagggaaguaggggauaacugauagugaaaggccucauccagcucccacgcauuuaguguggcuggucucacuuccagagugcucugcuaacagugccaaguuuagauccaggcagccugugcgcagaacucagaucugccccaggucauaagcuuccccgcugagaaagcaggcaaggcuuucaggccaugcuucucgcugucugcucacaauguugguggcuccugcaagauauagucagggauggcaucuuugggcuugagcuggagacugugugccuacaagguuuugcccacugcugcuucuacuuuuuuauuucacagaguuuccuaaauuuguuccagcucuagguaagguuaaauccuucuccuaugaucuggauuuucaaauuccccaguggggauguguguucagagguggguuuuccccccucacacuuuggggaaucacgguuuuucgucugucuugcagcauuugcaacaguguguugcuucuuucaaagcaucugugaauucuuucaguuuuccugguacauuccuguggugguucuuggaacaaaagaucacagugugauucuccacacacuguucugucuguccaggugggagaugcaaugcacauuagcccugccuuuuaucugucaucuugcucccaucucuguccuuucaaaugggaucaggguguaaggauguugggauucuccuggcccuucaguagcuauuccaaaccauuuaucuuccaucuuauacaucuuccauccuucaagacuuuuaucuggcuauccaauaaaacuauaaaucuuccagccuucugggaucucaguuacauucagcuuaggcuuuggcgccuggcuuaucaaugccauuuucuuucuaaguccuguuaucuucccggacacccugaguguccauguggaugaccuaccuaacaacuugcccccacuuuccuugacuucuucuguaucugugacuuugacccacuacuccaccuucuuccaacuucacccccuucucauugguugaaugcuaaacuuuaucaucacuugcuccuguuccacuucugaaauauggaacuucaguaucccauucugucauuacggccuucuauuauuccaguuuuucauuccauuacuucugcucuucaguguuauuaggauuucuugucccuuggcuccucuguuuucuucccaauccaucacucuuccuugcuuuucaucuuuuucauaucguagauuccuugauccaacacaucauacguuccucaacuccauuuuucacaugucauuccugggcuuuuuaagcucucauuuccucucguuuucacaacuaaagguuuguuucuguuguuguuguguuuagagaugggaucucgcucugucacccaggcuggagugcaguggugugaucauaacucacugcagccucaaaauccugggcucaagugaucuucccacuucagccgccugagaagcugagacuauaugugcaugacagcacacccugcugauuaaaccuuuugaauagguucucucugcuuuccuaucucccucucaugccacauccucuccaauuuucauuauaauuauuuucaccaguuuuauuuugcauucuucuugaccacuguauuaguuuguucucaugcuucuaauaaagauaccugagacuggguaauuuuaaaggaaagagguuuaauugacucacaguuccacauggcuggggaggccucaggaaacuuacagucauggcaaaaggggaagcaaacacauccuccuucacaugaugacagcaaggagaagugcugagcaaaaggaggaaagccccuuuaaaaaaaccaucagaucuugugagaacucacucacuuucaugagcacaggguggagguaaccacucccaugauucaguuaccuuccauugggccccucccaugacacauggggauuaugggaacuguaguucaggaugagauuugguggggacacagccaaaccauauaaaccacucagcuuuagacacaguugacucuccucgaaaugcuucauuucuuugucuuuugacucccauauuccuguuuuuccuccucugucucuggcuguuucuucuucuucuccuuuguuacuuuuuuuuuugagacagaguuucacucuuguugcucaggcuggagugcaacggcaugaucuccacucaccacaaccucugccuucuggguucaagcgauucuccugucucagccuccugaguagcugggauuacaggcaugugccaccacaccuggcuaauuuuguauuuaguagggacgggguuucuccauguuggucaggcuggucuugaacucccaaccucaggugauccgcccuccucagccucccaaagggccgggauuaaggugugagccaccgugcccagccuccuuuguuacucuucucugcccuucuacucagacauuagaggaguaguucucuaggacucugcccuaggccuucuucucacauuauauucucuuccugcaugaucuaaucacucaugaugucuucaguuaccagcaauaugaagccauaucccagauuuuugucucuauaaagaccucuuuugaauuccagaccuguauauacauucagcuacuugucuauuuggaugcuucacaggugccucaaacuuaacagauggaaaauaaaguaaaaaguuuuccugccaaaccuguuccuucucaguaauugguaccacucaccauccaucuaauuucccaaacuaggcuaggcuugguggcucacaccuguaaucccagcacuuugggaggccgaggcgggcagaucaacuaaggucaggaguucgagaccagccuggccaccauggcaaaacccuaucucuacuaaaaauacaaaaguuagcugggugugguggcgcaugccuguaaucgggaggcugaggcaggagaaucucgugaacccaggaggcggaggcugcagugagcugagaucguaccacugcacugccugggugacaaagagagacuucgucucaaaaaaaaaaaaaaauucccaaacuaggaauuuaagcaucauccuuuauccuccuucauucccugcauccaggucauacauucuaaaggauuuugcucccucuacaucucuuaauguauugaguuucuuuauccuguccucacugucuuggcuuuuguccauacuacuauugucgcuugccuggguucuuaauaacagccuccucacuguucuggcaccuacuuuugccuguuccuaauccauuuuggauaccguugcuagaguaauccuuuguaaguacagauugcuauugcuuugagacucaagcacaauauucuuaccagcucuacaugugcuuggccccugcauacaucucuagacuugccacauuuuauacuuuaacacguggaccuuuccgaucuucggaagugacauguucuuucuguuucaggauuucuuggaauguccuugcacauguuguucuccgcggaacauucugacuuucucuucuuccugagacaacuaucauuucuccaagucucaaauguuauuucuuuaagcaagccuucuuuguccucucuagucaggauuaggcaaucaucuuacauuuucuccauaguacuaugaacuccuccuauauauuauucauugcuauugugauuuucuguuguuuguuucuucuguuauaagacucuacaggcaggggugcuguuugucuugcucaguguuguccugcaggcccaguacauagaagauacuugacacacauuuuauuuaugaaagauggaacaaacaagagaaugaaaggaugagugugcagagggcaaauaucaaccuuauugucugaccauuaggaauucacaaaccuaggcuguugaguccuucugaaggaaauuauacccuaaauucauagguuacucuuucaauuucuacaacauuuauuuugaaauacucaugaauuuccuuacccgcucuauguucucuauacuuauucuuagacaaccuaacuccuaguucaaagagaauauaaaaaacaugggcaguuaccccagagugcauauugauguucugucucucugucucaguggcugaagcugccauccuccuguucagccccucugacucucaucccauuguuucaccucccauugguuguccauuuccucacuuguaucuuuagucucagacuuucaguuucucucuccccuauuugucagaaucuugcucauacaucuucacucaagucugcauucccauguguuuggugaccuguucucaucuuccauugacaccguccucagaaguguaccucacacuugcaguccuaccuccauuuuagaauaagcuuaguaaaauggcuuguaucccaucaucugauugaaccugcucuugaugaggucauuaauggccucuuaguuguuaaauuaaagggauacuuuucaugccacauuugauuuucuuggcccauauccuuuuagguaucuuuagauaucuuccugcuuuguuugugccuugaauguuggugucccucauguuccauucucauucuacacacucuguaagggaucacaaccacacaguuguuuucagguaugauauauggauuuuggagucaucauauuuuuguagcccagguacugcuucucuugacauuuuguaugaauagaaaacaaauauuuuuugguaacagauuugugaaaaauugcauauuuuaauuucuuuuuaucugaccccuuuugauuacugcucuuaguuugucuuuugguaucagauauuauuuauuuggagguucuauuccauuuuuacuguauuuauaauuuuuuuucuccauugagaauuccacccccuucuuuuucucccuucccccaaguuucaaagaaaaaaaagucugugauauuuuuccccucugcauaauuuccccucagcagguugcagcaguugacaagagcagcagggacugcucucaacuggagaagagcaauugcagaggagaaaaugacccuguuugcugaaaguaaagacaguuuaaggauugcucauuccucuucaacugcuuuuaccaagcuuuccagcuucccuggggaagauuauguuccagguuguucgguuuaucaugucagcaguuuaccugcaauagucugucacucauuucugguccuuuuaguagcaaagagucugcuaauaaaaaguagcauaagaaaggaggcaguggaguauaaaaguugucucuggaguuggacugaacugacgcuuccuagcagugugacccugugcucucuaagccuuagguucuucaucuguaaaauggggauaauaauaauaucucaaugggucacugaaggauugauuaagugauauaacuggaaagcuguuagcauccugucugcuagauuuaaggguugaauaaaugcuaguaauugugaguaaacuugauauaauacauacucagcccuguggaaguuaaaaccaagugcugcuggugacuggguugugagugacuugagagacugccagugggaagggagauguggaucugccagguggucuaaggucugagccuuuuauuuauuucgccuuucauauguaacaagacagcuuggaaaaguauaguuucaagacugacccaacauaacuacaaaagaggccugccauacaugguuaaaagcagcaagccgugucggaagccuuuuccaucugauuugggcucagauuauuccugcaucacuggggaccuuguccucgcucuucccagcucuggucugucuccgcaugauuuuggcuggugagcuuuggcacaacuccccaacuaacucccuuggcugagcaguuaacaauagcuuggcuccugcuuaguucuggcacaugguucucaguuuacuccuuuggcucagugcuucugacaccaguucugcuacccaccucagccugugacccagggccaucccauuucuuucuuucuuuuuuuuuuuuuuugagacacagucucacucugucacccaggcuggagugcagugacacgaucuuggcucacugcaaccuccaccucccagguucaagcaauucucuugccucagccuccugaguagcugggacuacaugugugugccaccauguccggcuaauuuuuuuuuguauuuuuaguagagaugggguuucaccauguuggccaggcuggucuugaacuccuaaccucaagugauccacccuccucagccucccagagugcugggauuacaggcaugagccaccacgccuggcaccucccauuuauuucuauggagcaucuagcuucucagcuuaggauccugguacuuuccuggagauuuuaaaaucccacagacaccauaaauuccuugacauuaagcuugcaaagcaagugugcuacuguagcaaugguccugguccuuguguuuaaggguuuuaauuaauacuggaguuuucuuucuccaaacauaggaacauuaauuuugauuacuguauauuggcuuuucuaagcauuggugcaagccaccuuucaaguucuauggucaaaaacaguuucuuagaaguaguaaaauuaaaugguuaugaguuugccugagggguguguucagugucauucgauuuuacugagaacguacuacuaauaauaaugauaggcugggcgugguggcucacaccuauagucccagcacuuugggaggccgaggcgggcacaucacgaggucaggagaucaagaccauccuggccaacauggugaaaccccgucuuuaaugaaaauacaaaaauuagccggguguggcggugugcgccuguagucccagcuacucaggagguugaggcaggagaauuguuugaacccgggagguggaggcuacagugagcugagaucaugccacugcacuccagccugggcaacagagcaggacucugucucaaaaauaaaauaaaauaauaauaauaauagcuaauacuuaaucagugauugccaugugcgaggcacaguucugagcacuuuacauuuauuaacucauuucaucuuccuuauaacucuaugagaugguuauuaaucucauacucaugugagauuaauagcccuauauagaugaagaaacuuaggggcagcaagaugaaguaauuugcucaaggucacacagcugguaucagagccaucauacaaagccagauaguccugauccuaaccucucaaaauggccacugugucuuaggagcgugagagagaugaagaacuguaagcugagauuaccuucugucauaaaauccauuuggaauaagagaaauuguuauaccacaaugcuucagagugugagcuucugagccaguggagucuggguuuaagucuugccuuugccacuuucuggaugugugacguugggcaaguuauuuaacuuguuaaacuucacuuuuauuuaccugugcaauaugucacaauauuaucgugaugcuaaucacugcuccuggcacauauuaaaaauaguaccuauuuuaggccaggcgcaguggcucacaccuguaaucccaacacuuugggaggcugaggcaggcggaucacgaggucaggaguuugagaccagccuggccaacauaaggaagccgcgucucuacuaaaaauacaacaaauuagcugggcaugguggugggcaccuguaauuccagcuacucgggaggcugaggcagcagaaucacuucaacccgggaggcggagguugcagugagccgagaucacgccauugcacuccagccugggugacagagugagacccugucaaaaaaaauuaccuauuuuuauuagagauguauaaggcacuacuaugugcuauguucuguucgagggguacaaaguacauguuaaggaugucuaaagaaaaaaauuaauuuaaaaaacuuuuuauuaugaaaaucuuaugcauauaaaaauuagagaauaguauaaugaauccccaaguaacauuuacugagcuauagcagauaucaauauuucacuaauuuuguuucaucuauguccucuacuuuuuuuuuuuuguuuuuacuggaguaguuuaaaguaaacccagauauuauaucauuuuacccauaaauauugcaguaccuuacuccaauaggaagggaccuaaaaaaaaaucacacugucaaugugauuaucaugaacuugaaaaaaacaaaaauucuuuuaucuaauauucagucuguguuucuauuuuucuuauugucuccacauuguuuuacuguacauuuuguucaaaucaguaucaaaaugaguuucugucucuuaagucucuuaaaguauaacuccucuucuuuugauaauauuuacauguuuuagaaacuaggucuacguuugcccuguagaauuuuucauacccucgacugggcagauagcuucugcauagcugugcagagccauaugggagccugaggcaagaagaaaaaccagugauacuggcccugacuuuauuuaaaauuguguuauuauauucauuauaacuuuuuugcauucauuuuugauuuuggaaaauaccuauuaaaauauuuaucuccaguacuguauuuuuuggcacaccuuuaaauggugcccuugaggcaagugccucaucacuguguucuagccccagccaugaguugcuuaauuuguuccucuaucccuccugugucuugucagcuggugauuagauccacauucuggagcuuugcuauucacaguguggucccgcagcauaagcaucuccugggagcuucuuagaaauacagacucuuaggccccauccagaaccuacugagucagaaucugcuuuuuaaccagaucccuagaugauguguuugcucauuaaaguuugagaaguacugaguggagccauaauuagauuccagugcaauuuauuuggcaaggaugcuuauaggccuguggugaauugcuuauuguauaacuuuaagaggcauauauugucuagguguccuguuuuuggugauacuaagauugaucaguagauccucaugugaucagcuugacccauccaugaaaguuaagaaggaucacuucuuagaguucacuagagcaaaaugguuaagaaagggggcucuagagcccaauaguauggauuugaaucuugacuuuacacagcaaagcaacccuggauaguuacuuaacuguucuauguuucaagucucuaucuguaaacuggagauaauaguaguacccauuucacuggucaugcagauuuuuuuuagaacaaugccugacacaaagaaagcucucagacagaaauaacacuucuuuucuucuucuuuagucuuuucccuccucaucagagaaagcauccuuacaaagauaucauuugaguuaaguccugcagaaugaguuggacaguguucuaggugauauuaauuacuuaauuauaagcagaaaaugggaauucacuccauauuuuuggagaguggcaaagaauuagacuugacuguaaaguugcauguuuucaggaggaugggggaaaauccagcugauggaaggcuuuggauauaggaagucuguaguauuuggggaacagugaaaauuuuuaagggaagagaaugucaugaacaaaguagcauucaagaaguuucaugcagcacaccugugcagcaggauacauuugaaggaaaaaagucugaagguuaagagugcauuuaaauaguuuacacaaaagguaauaaaggccuaaaccagagugauggcauuaggaauggaagaacuuguggguggaugugagauugugauagugugaauaauacaugagcaugggugccaaaggcagggggugucucugcuuugaguuuugcugcuuacuagcuauguggccuuuaucaaguuacuuaaccaccugaaccucugagccucaguuuccuuauaaguguaaugggaauaauuacaccuguuuggcagguuaguugcaaggauuaaauaggugugucaagugccugguacugugcucagcuuauaguuaucccucaauaaaugcuaguuauuauuauuacuagguaguugacugggcauaugauugaaggagaggaagguaguagaaaugauuuuuuggcuucaagacuaggauaauuggugauauagaaauaagaaaguugccagggagaauugguuuaaggaggagauuuuauauucuguuuuagauacguugaguuugaaaccccgacaggcuaugggggggggaaauguguuggaugccgggguaaauuaugcauaagccacacuugacuagacucauagauuuacuuuuggugcagauuaugguuucaauaaugguuugugcuccguuuuucaguaucuuugggguuucugacaaagcagaugucuuaccuugacaucaguucagauuagacucugacuuugcagucaauggucuggggccuggcggcuucauccacagcugaagguagggagguuuuuuucccccucauggcuuuuccucauucagauucugcugacauuugaagaaagcaguuuguuuugcuuuuuagccauuucaaaguuuaucuuuuucucucugugcacaggcugaugcugaaauugggguauuaaugggugcuauuuaaagaagcucauuuaugggcaauuaaauaacaugccugucagcccagauuugauagggaauaggggaacauuuuuaaauuuuuauuuuaaguacaaugaaguuuaauuauauuuccuuucuuucaacucuuuuguuagauuauccagaaagcagauuucuucuuuuaaaaaaaaaaucuauauauuuauuuugcuuccuccccucucucuugggaguggugggcugagaugggcagccaguauauuuaauuuauauucuguuuuguugauuucacaugauuuuaagggaguuuuauaucaaugguuuuacacguuccaagcguuacagagagaauaauccagcugaugcuaaaacuagacccucuguagguaguaacugacaucucaaacauuucaugucccagaacagcaaaaagauugacaguaguagcugcuaacuuauguguuuauaggccggaaguuguccagaucugucacguauucuggaacccaaaguaaauaucauuucacgcacgcuauuuauagagaacaacuugugaggcagagggacguggggacauagggacucucucauucuauucuuucuucuggaguagcugucaggagcucuauguaaucuguuuucucuccuuuuucuuuauuauuauuauacuuuaaguuuuaggguacaugugcacaaugugcagguuaguuacauauguauacaugugccaugcugguaugcugcacccauuaacucgucauuuacucuccuuuuuuuuuaaauguaaauagauuugaguaccuuguauguaauugagucucauuauauauauuuguuuauaauuguauaugcaaauacauaauggcugauggcacaaaaagaacuaguaauuugguugccuaguaaagauaauguuacacaguauauggaagaacaguauauggcauaaaguauuuaaauuggaguguuggauggaagcaaauaaaugaaaaaagagcagaaaaauggaagaagugacuggaccaugaaagaaugucagugcuuaugagaauuagggguagaaaucauugaaaaaauggcuggugguagaaggucagagaaggaugcccauuagugguacccagagcuuugccugauggugguacagucuggacuucagcauaaacauagcagccagucagaggcagaacuuuuuccccagugcccacagaacucagcugacuaacgugggcuccugugaauauuaggaacagaaauugauaucucgcggagaccugaggcuaggauaagagagugaaaauagaaaaauuucauguucuaacaggagaaaaagugagcuaugaagacaggcuuccuccacuuccauuucucuuggucaauagaaugaggggauaaacugcagaacuauccucugguuaaugaaaaauucugcagaacagaccaaaaugauuagcuuaguuaugugagagaagccuccaggcgauacauuuuucauuaagucauuucccauccugaacuggagagggaacaaauuguguggagaaaaucugagaaauuagaagguacuugaaguauucacaaguaguagcuuguuccaccugagugcauagaaguguagaguacagugguugggauuugauaagaagggaaguugugguuuugggauuucuauacuuuauuucagggagcgagaaagaauagguaccaaacuggagcuuuacugcagccuuuagcuguuauuuuaggugagguuauuagguuauuuagguuauuuuaggugaggccuucccauggagggcagacguggcguuuuggcuaauaaguguucuugaauuaaugaauucaagugggguuagguuuagcugggcuuuuuccuaaacccacuugcagggaagaaaaaugguaguaaucacuauagugauaaaucauaaauugaggugacguaaguguggcauuugccaguacauaugguggaacaguggacagcacuuucuugauugcguuuuugucauuugagaaugucuguagagaacagaagagaagcagaguauugagggggaaaaugccauguugagaagcaggagacuucaguucuaggccuaagccuuuuaguaacuucuguccaagugggcaaaucaccaggccagaugcuuuuacagacuaggucaauuaguuauuuucugggagcucuaaggagaugacagcauccugcuuaagugaacauaccagaaucacuuggcacuuagagaccugagcuuauagaauuacaugugcucugugugugugcccaaaugagaauuauugcuguauugaacuuuguuacuaaugggauauugucauauauuuguuucagggguuucaggguguguagagagguugacaagcauuggacuagauaauuucuaaggacucuuccaaucugaaaaacuaagauuuccaggaaauggaaauugggcuuagaugccuuuuacaaaggccuuuuuuuuuuuuuuuuuuuuuuuuuuuuugggccuggcugcuucuagggcuuucaaacuuucacagaaaauaaaaauaauuauaguaaaaacagggauuuuagaccugaaaauugcuguaaauauuuggaagccaugguuaaacaguggguaaauucauaucucuggggugaaucacaaucucauguaaugagguaaaacauauuuuggcaaaaggcugcugggaggauugacuuuauugagacacaagaugcugcagcccuguuuguguugguucauuccucauuccuuggaauagcuauuuugucaauuuaaaugcugaauuaaacaaugaacuugcuaacuaugaacuugacuuccucccuucuuuccuuaaugcuuccccacuucuuggaacaaaaaugcucuuggcuugcuuucuauuaauauuaaauauguugaucguugccuuguuaaauauaccacuaacuaaagaaauucauucagaggagccauuuguaaaccaaaaauauaucaauaaauuuucagugccaccaaagaaauagcacuggaacauacauuuaauuuucucagcaaggcaauuuuuacuucuauagaagggugugauucauggauggagcaauggugagagcacaccugaacaaggaaggagaagggauucuuauuccugaugcagguagccccuacugcugugucauucccuuguugucuaggguuggaccacacagucuaagcuaauuccgaucugcuauuuuaaagagagcagggguaccagccagaguggcagggugaguaguuuggcaggaagggcaguuacagaacagguaacucaggaugagucaggauggagcaggugaccaggggugacucaggucaaagcagaugaccaggggaacagauuugaacuacugauuagaacuggugggauacuagauacuagauacuggauacuagauacugauacuagagacaagggggcgaagaguaccaggaaguuaaaccuuaaaauggagaaucaaagaauaagagagcugaacauacugacauagugauucuuugaagacaaacuuggaguucacuauaucuaacaaaaaauaaaauucaggccaggcgugguggcucaugccuguaaucccagcacuuugggaggcugaggugggcggaucacaaggucaggagaucgagaccauccucgcuaacacggugaaaccccgucucuacuaaaaauacaaaaaaauuagcugggugugguggcgggcaccuguagucccagcuacucgggaggcugaggcaggagaauggccugaaccuggaaggcagagcuugcagugagcugagaucaugccacugcacuccagccugggcgacagggugagacuccgucucaaaaaaauaaaaaaaauaaaauaaaauucaaaggucuccccagcccccucaacuaucuaaguggacucccuccucagccagggcacucuaaaauuuaaccugaaagacugguuugggccaugaaaggaagaguagcggugagagggacaggccucauucugucuuuccaggguuaacuucagcaccaaccuuaaggcugauaagaaacauuuacaauccauuuucucugaagcuugcuaccuggagauuucaucugcaugauaaaaccuuggucuucacaaucccuuaucuuaauucagacauugcuuucuacagauaauaacuuucaaccaauugccacucagacuauguuuaaaucuaccuaugaccuagaaccaccccccaguucuguaguaggacuuuuccuaaguucagcuaaagacaggguccuugucaugugaccacaaaaaauuaggcuugcagacaauuugaagggugagaaaaauggaauuuauugggcaaaaaggcaaaaauaaagggaaacagggacugucagcagagugagaguccugcuaccauagccuuccugccuugcggacugaauuccagguuccgccccagagcaggagaggccagucuccucccugcugcaaaaggcaggaacuuccugaggcuucaccccagugugcacuccacccagugcacaggccgguugggguuucucggggaccccuuagucuuggcugucucaauucaaguuguccugcccuuccagaucgaaugccccaacauaaaucuucuuuuuuuuuuuuuuuuuugaaacagagccucacucugucacccaggcuggcgugcaguggugugaucucugcucacugcaaccucccagguucaagcaauucuccugcaucagccucucagguagcugggacuacaggugcaugccaccacgcccagcuaauuuuuuuggaauuuuuaguagagaugggauuucacuauguuggccaggcuggucucgaacuccugaccucaagugaucugccugccuuggccucaguaucacgcgcguccaugugaagagaccaccaaacaggcuuugugugagcaauaaagcuuuuuaaucaccugggugcaggcgggcugaguccaaaaagagagucagcgaagggagaugggguggggccauuuuauaagauuuggguggauaguggaaaauuacagucaaagggggcuuguucucuggcuggcaggggugggggucacaaggugcucagugggggagcuuuugagccaagaugagccaggagaaggaauuucacaagguaaugucaucaguuaaggcagggaccggccauuuucacuucuuuugugauucuucacuugcuucgggccaucuggacauaugugugcaggucacaggggauacgauggcuuagcuugggcucagaggccugacauuccugccuucuuauauuaauaagaaaaauaacauaaaauaguaucgaaguguuggggcagcaaaacuuuuuugggggguggcauggagagauaaugggcgauguuucucagggcugcuuccagcaggaguaggggcagugugggaaccuagagugggagaggucaaguugagggaggauuuuguaguaaggggugacauugugggguuguuagaaggagcauuugucguauagaaugauuggugauggccuggaugcaguuuuguaugaauugaaaaacuaaacagaagacacaagguccgaauaagagaagaaaaacagcuauuaaaggacuaagaauugggaaaguccaggacauccaauuagagagugcccaaggagggucagcauagcccugccagcaaagauuauuuauguacuuuaagagggaguuaagaguggcaguuuggggauagcaccaggagauaucagcuaugauggcuuggagaaacaguguaaaccggcaguguaaacaagagcagggcauuuaugaguaguugagaauggugaauaggaguaugacuagacagaagauaguagggaugacaaguuuuuggggcacaguccaaguugggcuggugucuggaaugagacuggggccuaauaaaaaggagcauucauacaggagcucaaaugggcuguacccuguagcauuccaaggacaggcccgaauucugagaaggcaaagugguaaaaguauuguccaguccuuuuuaaguugguggcugagcuuggugagguguguuuuuaaaagaccauuaguccguucuaccuuuucugaagauugaggaagguaagggguaugaggguuucacugaauaacaagagccugagaaacugcuugggugauuugacuaguaaaggccggucuguuauuggacuguauagaggugggaaggccaaaccgaggaauuaagucuuacagaagggaagaaaugaucgcgguggccuucucagucccugugggaaaggccucuacccaucuagugaaagugucuacccagaccaagagguauuuugguuuauugacucgaggcaugugaguaagguuaauuugccaguccugggcaggugcaaauccccgagcuugaugaguagggaagggagggggccugaacaaucccugaggaguaguagaauagcagauggaacacugaaaauugauuuccuugaggauagauuuccaugauggaaaggaaaugagagguucuaagagacgggcuagcggcuuauaaccuacauggaagaggcuaugaaaugacgacagaauagaaugggccugucagccuggaaggagauauuuuccuuggucuaagaaccauuugccuugugugggaagagauuaauaaguggaaguuucaguaggggaguaggugggagugaccaaugagaaggagaaaaacuggcugugagggacagaaguuggaaugcuaguggcuuuuuuagcuaccuuaucagcauaaguguugcccuaagcaaugggaucugacgccuuuugacagcccuugcagugaaugacuccagcuuccuucggaaguaaagcagacuugagaagaguuuuuauuaaagaggaguuaaugauggaggacccuugcauagugaggaaaccucuuuuugcccauauaacagcaugguggugcaggauauggaaggcauauuuagagucaguauaaauauugaugcguaguccuuuugcaagagugagggcccgaguuaaggcaaugaguucggcuugcugagagguaguggagugggggcagagugguagcuucaaugauagauguggaagauacuauagcauagccugccuuugcuggugaguggcaauuaggccugguagaacugccaucaauaaaccaaaugugaucagggugaggaacaggaaagaaggaaauauggggaaauugggugaaugucagguggaucagagagauacagucaugggggucaggugugguaucuggaauaaugugggagccuggaaugaaguccggaccgggaacaaugguaauugugggagacucaacaaagagugaguauagcugaagaagccagggagcagaagguauaugugucaggugugaggaagaaaauagauuuuggaaguuaugagagcuguagagagugaguugagcauaguuugugauuuugagggccucuaaaaguauuaaggcagcagcagccacugcacgcagaccaugagggcuaggcuaaaacaguaaggucaaguuguuuggauaaaaaggccacagggcgugauccugguccuuguguaagaauuucgaccgcacagcccugcacuucagcuguauguaaugaaaagggagugagugaugaguuagggagagcuagugugggagcagcuucuaaagcugucuucaaggaauggaaagaggaguggggaaaggauuuaggaucuauggagucagcuagguuuccuuuuaugaguguauauaaugguuuuguuaggauggcaaaaccagguauccaaaggcgaaaguguccaaccauggccaggaaggaaaggaguuguuuuguagaagggguugggguuugagagaucagucggacacgaucggcagggagagcacguguguuuuuaugaagaauuaugccgauauacguaacagaugaagaaauuugggcuugacugaaguaaugggggcugucugugaagucuugcggcaguacagcccagguaauuugcugggccugaugggugucagggucaguccaagugaaagcaaagagaggcugggaugaaggguguaaaggaauaguaaagaaagcauguuugagauccagaagaggauaauggguuguggagggagguauugaggauaggagaguauauggguuuggcaccacaggguggauaggcaaaacaauuugguugauaaggcacagauccugaacuaaccuauaaugcuugucugguuuuuggacagguaaaaugggggaauuguaaggagaguuuauaggcuuuaaaaggccaugcuguaacaggcaaguaauaacaggcuuuaauccuuuuaaagcuugcugugggaugggauacuggcauugagcgagguaagggugauuagguuuuaaugggaugguaaggggugcaugaucaguugcuaaggaggaaguagagguguccuauacuuguggauuaagguggggagauacaaggggaggaugugaaugaggcuuugaacuggggaaaaggguggcaaugagguguggcuguagccuaggaacagucagggaggcagauaauuuaguuaaaaugccuagaccuaauaagggagcugggcagguggggauaacuaaaaagagugcauaaaagaauguuguccaaguuggcaccagaguuggggaguuuuaagggguuuugaagcuuggcugucaauacccacaacaguuaugggggcaagggaaacaugcccuugaaaagaagguaauguggaguggguagccuccguauugauuaagaaagggacggacuuaccguccacucugagaguuacccaaagugucugugaugguccaagaagcuuccgaggcaacuggacagugucagucuucagccgcuaagucaagaagaucugggaaggagucagucagagccuugggccgguuggacaguccaauuuccagugggguccuguacagaugggacauagcuuaggaggaaucccgggcugcggacauuccuuggcccagugaccagauuucuggcacuugaagcaaguuccugggggaggugguccuggaggaaugccuggccgcugcgguuuagguguuuggaaguucuugugugcuggagauguggcugggguuucucucacaguggagacaaggaauugcaauucagaaauacguugcuacuugccugccucuacucuauuauuguacaccuugaaggcaagguuaauuaaguucuauugugggguuugagggccagaauuuaauuuuuggaguuuuauuuaauguugggaaccgauuggguaauauacuguauauugagaauaagacagccuucugaccuuucaggaucuagggcuguaaagcaucuaaggguuguugccaaaugggccaugaacuggacuggguuuuuuauauuugaugaaaaagagccuaaacgcuaaccaauuugggagaaguuggauaaauaaaaaggagcauuaaccuugauuaugccuuuagcuccagccaccuuuuuaagaggaaauugcugggcagaugggggagagcuagccauggaacgaaacuguaagccagaccgggugugaggaggggaggugauaaaaggauuauaggguaggggagcggaggcugaggaagaauugggaccuggcucagccuggugaggagcagccuggggaggaggggagaggucagauggguccauaaaaaaggaagauuggaaagacucagcaauacuugggguugggacugaggggacaggcaggagggaaagaaggaagauuugggacaaguugcauugggaacagagacuaggaagggaccgauguguaaaagaaugccuggacaucaggcaccucagaccauuugcccauuuuacgacaagaauuaucuagaucuugcgggauggagaaauugaaagugccguuuucuggcuuuuuggaaccauuguugaguuuguauuggggucaagcaguauugcagaagaaaauaaggcauuuagguuuuaggucaggugugaguugaagacguuuuaaguucuugagaacacaggcuaagggagaagaaggaggaauggaggguggaaaguugccuauagugaaggaggcaagccuagagaaaagagaugguagagacauggagagaaggggugggggugcuugccccccaggaaaguggagaggagagagaggguagagacacggagagaaggggugggggggugcuugccucccaagaaaguggagagaaaagagaggguagagacacgaagagaaggggugggcggugcuugccccccaggaaaguggagagaaaagagaggguagagacauggagagaagggguggggggugcuugccccccaaaaaauggugguugccacuaagggugaaggaucuaggaagguguccccaugguuaucagacaccucuuaaacaugggugaauaaucaagcaggcauccccacagugauuaaacaccaagggaagauugucuuccugcguccgugacuggugccggaguuuuggguucacggauaaaacaugucuccuuuguuucuaccagaaaaggaaaggaacugaaauuaagagaagguagagacggaaagauggcaccaagauugaaaggagaaagagguugagggauagugagagagguuggagaagagaguaaaaagaggccgcuuaccugauuuaaaauuggugagauguuccuugggcugguuggucugaggaccugagguuguagguggaucuuucucauggagcaaagagcaggaggacgggauugaucucccaagggaggucccuugaucugagucauggcaccaaauuucacucguguccaugugaagagaccaccaaacaggcuuugugugagcaauaaagcuuuuuaaucaccugggugcaggugggccgaguccgaaaagagagucagcgaagggagauaaggguggggccauuuuauaagauuuggguagguaguggaaaauuauagucaaaggggguuguucucuggcuggcaggggugagggucacaagguguucagugggggagcuuuugagccaagaugagccaggagaaggaauuucacaagguaaugucaucaguuaaggcagggaccggccauuuucacuuuuuuugugauucuucacuugcuucgggccaucuggacgcauauacaugcaggucacaggggauacgauggcuuagcuugggcucagaagccugacacucaauguaaaucuuaaauguauugauugcuguuauuaugucucccuaaaauguauaaaagcaagcuguaccccgaccauuuggggcacgaguacucaggaccucuugaagcugugucauggcuguguccuuaaccuuggcaaaauaaacuuucuacauugaaugagaccugucucagauauuuuggguucacacauuugaccuaaaaauuccugaacacaaguugguguaguuuuuacuaguguaggaggcagugcuguauauuuguccuuugcauuugauaguagaauuuuuagcuguuuuucuuuugcuaaacuuuucaccaucagcaaugcagauguugaaauuuuaaugcaauugccucuguggcccuuauuuucacucacaucuucuaagcacucuaaggggcauugaaaugaagacagccaccacuuaauauaugguugucaauaggauuucuuccugaccguuuaugcuuucaugacauuaggaaacuucuuuguugcauugggcuugggagagguaagaagauacaaauuucuuugguagcagguagugcaugauggugugguuuggagaacaagaagagauaaccuuguuugguuaaauggggaagaccagacugguaggcccuaaaauccuuuuaaaaaucauuaacauuuucauuguucccuuggcuuucugaccuguuacacugcauaccuucuauccaaauggagauucugucggccgaaaagaucaagcauucuuccuuagcaagaugcauuuccuccugcuggaucagcugucuuucugucagaaaggcagagcuggucacuauuuucccauuaucuguuuggguagggaguccgggaaauggggagggcuaugcaauauauaguuuagaaaagcucucucccucugcacacacuuuuaagauucauuuuugucuuugcucccauuucuuucauuccuauugcuccaugggcaaccaugggcacagccacuggcaauaucaugauuaauuauucuaggaagccuggauaaguugaagugguuguuauaaacgucuaaacuugaaaucuauuuuuuuuaaagcaaagacuguguuugcaugcaccaagggaaaagcuggugguagaaauugcuguacaauuugccucuagacuguaguuggaaauauucuuuuugggaaauaggacagaucaaggugguuuuucucuccauguaaaguugcuauuggaauaacaacuugucuuauuuuacaguccuaaaguaauaaauaaaacauuuaugacuuggaauaaauugagagcaucccauuaccuauaguagcaggcauguucuuauucuuuucaagccucaggcagagugacaucagcagauuuuuuucauuuucuaauccagagccuucuaauuucuuucugucaaagaaccugcauuuuaauacugagcagaucugcagggacccuuuuugauaugacuacguuuuguagcaccucuuuuaaauuguauuuaacuucaguucucagaagacagcaugguguaguggaaagaacaugggcuuagaauuuauagaguguacuuuuuuuuuugguuggcuuggaaaugaggucuucaguucacauucagauucuugacucauuaguaaucuggaauuuucugaugaccacacucagaguucuucuagcuacagggccacuucuuguggugcuuguggugugucaaaaggaacuccccgcuuagccucuuuagaggguacuucuuccauuacacucuacacacccacacacccugggagcuucuugaucugguaacguuuuugugcguuuggaauuuuuuaguuuuucauccuguacuacaccauaaugacucuuacccuugcccuuuggugauuaucacauuggagaaacauccccgcucaucugugcuuucagaaugccaaauccucauacaaagaauaaccuucaguuucuccugcaggacaaagcaugccugucugagcacagugagucaaucucuccuguucaaacauuugccacuuauuuauuaaacaaguauuuaccaaguacccucuaucuacgagugugugcugugggcuguggaugagaaaauggugaauuauccaugauuucaagaagucuauaaucuaggaaggaaaauaagaaaagcaguuuuuguguggugggguaagggcauggguuguauugugcuuggccuuuuuuaaaaaggaagggauaaaaugauccaauccuugaagauguaaaguucguugugucucuuaagaacagcaaaacaugcaguuugccaagagcagaagcagcaucaagggggaaugguggaagauaaggaaaauuuuuccucaguuaucuaccugauuuuuccuuugacuuucaaaugaaguacagggucauuuuauuugagauucauuugguauucucugucaacuguccaugaucaggguaucucuuccuccuacuuuucacccuacucguauagaucaucauauccacucucauuccuucuaucaacauguagcuaagauugcuauacagaacuucagaccugcauuuccagcuguggccuagacaccuccacccggguucucaccccaccucggauagacagacccagaacuaagcucaguuuccucucucucacacuugcacuuucugcuucauuccaucucugugaaugguacugccuuccagcaauugcuuaaugcaggaugugggcgcuaucuuugaccccucaccuuuucuuuaauucccaccagccaucccucaaauuuaccuccugaauaucuguugagucuguccucuucucuguguccccucugccaccauccuaguuccagucaucaucaccgacugucacugagggagccucugaaguuucacuagauucagucuuaccucugaccaaugccuucuucacacacugcagccagaauaaucccuccaaaauguaaaccuggucacaucaauucucuuaaaaccuguuaauggcuccuuauggcccuuaggguaaaauccaaauuacuuaaauagcugaaaauguccuuggugaccuggccuuuacuggcuccucccacagcggguggccuccagcgguuccgaacuacuuucucuuuccuaaauuggccauguucuagcacuuguacgcuuugacaugcuguuucucuugccuagauucuacucccuauuuuugccuggcuacuuuuuauuuuuccccuagaucucagcuucaaugucauauccuguaaaaagccucuaauucucucaaaacuagguuagaugcccccauuaugugccccuuuuauggauuaccuaaaagugaaauugcaucuugauuaccuguugaauugucaucguucccuacuaaacuauaaacuucacuaggacagggaauguugggcuuauucaccagcguguccaagacacccagcacagugccuggcauauuauuuaucaagaaacauguuuuacuaugccaccaauauuuaccaagagcuguucuucuuuaccacuugauccuaagcuucuucagggcaggaccaaaucauauuugugugccauaggcagcacuuuguguuaaaugaguuuguuucaacaacuaccuucagaagcauuauugcaucugaccuuuuaaaaaauauuaugugagugugaauauaaauugaaaaauuuaaauuagaugagacuaugcaauuuaaaaaaugugcuauaaaacauacaacuaaaugaguaauugcccauugaguauugucugaaguuuagaagaaaaagcaucugcuuuccgacccuacuguuagcagaaaggggucccaauccagaccccaagagaggguucuuagaucuugcacaagaaagaauucagggcgacuccauagagugaagugaaagcaaguuuauuaagauaguaggccaggcacaguggccacaccuguaaugccagcacuuugggaggacaaggcaggcggaucaugaggucaggaguucgguucaagaucagccuggccaacauggugaaaccaauacaaaaauuagcugggugugguggugcacaccuguaaucccagcuacuugggaggcugaggcaggagaaucacuugaacccgggagauggaaguuucagugagccgagacagcgccacugcacuccagccugggggacagagugauacuucgccucggaaaaaaaaaaaaagaaaguaaaagauuaaaagguugacuacuccauaggcagagcagcagcauggaccacucaggugcuuauucuuguuacuucuugauuauaugcuaaacaggggguggauuauucaugaguuuuuucagaaagggaugggcaauucccagaacugaggauuccuccccuuuuuagaccauacaguguaacuuccagauguugccauggcauuuguaaacugucauggugcuggcaggagugucuuuuagcaugcuaauguauucuaauuaacauauaaugagcagugaggacacuagagaucacucucaucgccaucuugguuuugguggauuuucguuggugucuucacugaagguuguuuuaucagcaaggucuuuaucagcuauaucauaugccgcccuccuaucucauccugugacuuagaaugcccuaccuccugggaaugcagcccaguaggucucagccucuuuuuacccagccccuacucaagauggagucacucugguucaaaugccucugacacuuaccacuuaguaacucuguguuuuugggcacgucacuuuccuucucugagucuuggcuuccuaauauguaaaaugagaauauuuucuguuaccugauaaugccuaccuugcaagguuguuacaaagauuaaagguuuaugaaaacaacugccauaguacuugguacaagguaguugcucuaugaauuuuaaguuuugucuuuuauucugacaaugcugauauuacugaaauauuuuuggaauuucuuugcugagauaguuuucagagcuugcuauagaucaucagacuaucucaaugggagaaaucuuuuuucuuugaggauguguuugauuuuuaggaauagucggguucagauagcaagaucaagaugguuaacaccauuuuugauauuaaacaaaguuaaguaugauuuuuuuuuuuuuugagauggaguuucgcucuuguugcccaggcuggagugccaugacgcguucucggcucauugcaaccuccgccuccuggcuucaagcgauucuccugccucagccucccaaguagcugggauuauaggcaugugccaccaugccuggauaauuuuguauuuuuaguagagacgggguuucaccauguuggucaagcuggucucgaacucccgaccucaggugauccgcccaucucggcaucccaaagugcugggauuacaagcaugagucacugugccagacccaaaguuaaguaugauuauaaugagaucuucuuuuguaauaucaaaauuggaacauauucuggcucucucacagguggcauugacaggauauuccauuuggcacauuaaauucagggaauuaacuaucacaaaaucuuuuuauuuugaauagcauucugauaaauuaaucaaaauuaauaaacucaggagagcugaaaucuuuaauaauauauuuaaucacaagcuaauaaucagaauuuuacuucuagcaacaaagaacuuagggaaaaaaaugaucuaaggugcuaccccauauucuugugcauauucagggcuauugucuuuucagcuagguccauggaaaucagugugccugaguuguggcaaggguaauguucuuuauuaauagcccagaggagccuguugccuuuuggagaccuguccuucauaguagaggaggagccuggaaaugggcaggauauagagaugggauuguagcuuuuacagaagcauagagggcuugugcagaaaaaauccacagggcgaguuuuuaggagagauuggagguacaagguaauuagucuacuaaaggaaagcauugaaagcaguggccggugggagcacaguccggagaggcuggaagcugcguucccagggccugugcaaguuggacuaggggucagcacaguccagggggagggucagugacaaugcccagguuacuaugaggaaccucauauuauuuuguuauccagagguuacuguggguucaguguuuuaccucuuuauuguauauaaggucauaaaugcaaaguauccaguaagcuauaaggaguuagugacauguuaauuauuuucaagauauuucgcuaguuucuacccugaauuuaccucaucuuguauauuuuuguuguuguuacugauguuagaaugauucagugagagcauuugauugggagggacgcaagaagaaaagugaaacaugaauauguguuauuuccugugggucauucaaaaaaacaugaauauuugugaauacuggguguggaggaagagaagguugcacaacgcucuuugccaccugggcacaggggagcagagucacuuaagccaauggggacugggcugacuugugcuggauuucacaaggggugagucuccugaaaaucuuuguuaucaaacaacaucagcuuuugggguacugaugucaugauaauuucaguaaaacaugguucuuaaguuguuuuuuuuuuuuuuuuuuuuuuuuuuugagacagagucucacucuguagccccaggcuggagcgcaauggcgugaucuuggcucaaugcaaccuccaccucccggguucaggcaauucuccugccucagccucccgaguaguugggauuacaggcaugcaccagcaugcccggcuaauuuuuauauuuuuaguagagacggggucucaccauguuggccaggcuggucacgaacuccugaccucaagugaucugcccaccuuguccucccaaagugcuaagauuacaggugugagccacugugcccugcgguucuuagguuucagauuucagauucacagcguccauacuucccuguggaugguguucucuuagugaagccgccugcuuugugaacuucagggguuguuuugcagccuggcuauggaaucacugagcagcagccuuugacagcaacucuggcaaaaagcaaagcuugcuuauuguuuuucauucacuguaaaugucaaaucacccagaagagccuguugccuuuugaauuccugugaaaaugcaaaauuuaaaguuuucaauguuauaaaaaaagucuagaaagagaauauaagcaaaauaaccuuuuuucaaguuuuucuauaaauugguuauuguucaucuuuucuggguauuugauuucuuaacuuuuguuaaccacauugaaguuacuaucuuagcagugccagcaaugugcauuagcacaagcucuuagaugaagauucuggagccccggaggugacuggagccauuuaaaaugcuuuuaugguagaaaccuauuuuagagaccuugacguuaaauaggugaucacauucugacagaaugcuuucauuuuuggaagccaaaauuuugccucaugacaaaauucuccauuuaugauuuauugucugacagugauauaaaaaacaagugauuuagauaagacaguagcagaagaaacuuaauaucaaauuuacuuguggcaaaugaccuaauuuccacuggguaagaaaaaugcaggauauguauauuaguuuucuguuguuaccuuaacaaauuaccacaaauuuagugguucaacacaccacaaauuucuugucuugcauucugugaauuagaggcccaaagcagcucucacugggcuaagacaaaguguggcaagggcuauguuccuucuggaggcucuaggggagaauccuuuugcuuuuccagcuucuagaggccaccacauuccuugacucucuucagagccuucuuccaucuucgcagcuggcaaaguugcauuuuucugaccauucuuccauaaucacgucugccucugaucacaaccacgaaacucucuguuuugggaccuuugugguuagauugggcccaucuuggaugauccaggacgaucucccaugucaggguccuaaguugaaucaugucuguaaaaucccucuugccauguaaaguaacauauccucaaguucugaggauucggauguggaaauuuuggggggauguggcauuauucugguuaccauaauauggaaauauuuaacacagacuuuuauucggaggauguauuuuucaaaugugaugauaaguuguuaucagguuuuuuuuguuuuuuuguuuuuuguuuuuuucagcagagucucgcucugucgcccgggcuggagugcaauggcaugaucucagcucacugcaaccucugccucccagguucaagcgauucuccugccccagucucccgaguaguugggauuacaggcacccaccaccaugcccggcuaauuuuuguauuuuugguagagaggagguuucaccauguuggccaggcuggucucgaacuccugaccucaggugaucugcccaccucagccucccaaagugcugggauuacaggcgugagccaccaugcccggccuguuaucagguuuuuaaggaacuuucacugggguguuuuuagagaagaggugccuauauuaaaaaauuaaaaagcucacaaauuuuguuuggaucauaaucuauuaaagcuaaugauuauucucuuuugcuuacuuugauagugauaaccuccuaaggagagcagccugucaagaagcucagguaauacuacuuaaugugauaaaauuaagccccuccuuaucuucauugugcagaaaacuuaagcucuuucaggggacuugcacagugucuugcaucugugcagucuggcuauuuuuuagcacuaucaggaugaaucacgcugggagccaacucugaguagaacuccaggaaguuaaccaucuggugaagagcaguucugacgcccaccccuauagacuguuuguuucuggauuggucccaagaacacagaacuggacugguagaagcucugggaauuuguuugugucugcaguugucuuuguagauuugucuaaccccugaaucaucccugaucugaauaacccccaaggauaucaguucagagcaaguguuaccucuaaaagucaaaucuucuuaaaauuguugauucauauuuuuaaagcucaucuccaaguucaacugauccauaucauguacacuguuauauuccaugagauuuuacuuaaauauucauuuauauggcuaauuauagcuggauuauaauauuuguccuuucaaauauaagacagcauuuuugcccccccacugcaaaaaugugcauuauaccuugcagaugaaauucugagacugaguugccuuuuuguuuuauaucauuugagcuuaugaugucagaaauaccaaaauagaaacaugaaaaucaaaaguggcaaaugugugaagcauuuaguaauaaaaauagguggcagaccucauguuuguuucugaaauguuuuaauggaugacagugagaauagauacuauaaauuaauuccucucuuuagcgauuguuacaauagauacuauaaauuaauuccucucuuuagcaguuguuacaguauauacuauaauuccucuuuuuagcgauuguuaucuagcuguucuaaaccuguguuuuacgaauuugauuacuucuuuguuuaaauguauuaucuuucauauggcucuaaguuguuuuggaaaucaauucaaauaaacuuuaauauuaaauuaaaggugauccccgucccaagccaaucauuagcgacuggaaaaucuuccuggaguacaguggugugauguuggcucacugcaaccucugccuccuggguucaagcgauucuccugccucagccucuugaguagcugggacuacaggcacacaccaccauguccagcuaauuuuuguauuuuuaguagagauagggguucuccauguuggccaggauggucuccaucucaaccucguguuccaccugccuuggucucccaaagugcugggauuacaggugugagccaccacaccuggccccuuucuuucucucuuuaaggaagaguagaccugugugauuguagggcccucccuuucuuguugaaaguaaaugccuccaccucuguucuaaauucucucuccucauacuuuuucagggaugauguuccuuuaguuauuuucuccuucucauguauuucuuucuuucuuucuuucuuuuuuuagacgagucucgcccuguugcccaggcuggagugcaauggcacaaucucagcucacugcaaccuccgccucccagguucaagugauucucuugccucagccuccugaguagcuggaauuacaggcacaugccaccaagccuggcuaauuuuuguauuuuuaguagagacgggguuucaccauguuggucaggcuggucucgaacuccugaccuugugauccacucgccuuggccucccaaagugcugcaauuacaggugugagccaccuugccuggccuuauuucuuucuauucuaauucuccacuuccccugcauguuuaguuccuuccaucucacaaauggaaguggaucuguccuuauagccucagcuggcuaauuuuccuaucuguguacuuccuuuuacagucuaaauucuugaaaacaugauauuuaauaacaaaucucacauaaacuuaauguagucucacauaaacuccuuagcucacugugaaucugagauuugauuugcaaguagguaccaacuuuagacacuaagaaaugagggcaaggaggaauaaucuuacuaccauagguguggaaucugauaggccagagagaaugguuagugauaucauuucugccacauuccagaaauaguauagauagaaaaaggaaaaauuacaguauuuggagauuuagcagcaaaauguuaaagucuaaguaagaaugaaaacagaauagaaauuauaauguuccagaaacuucuuacaaagaaauagucugucuuuuucucuacuucagaaaaaaaguauuuuuguuuuuguuuuuguuuuuaaagcaagcaauagacaauaauaagaaaggcuccaaaaugaacugucagggagauagcagauuuagaguaaguuauucaauaaaaaauauuugcauuacuuuuuuuccuccuccuaucuuuacuuuguacuuccauacuagaauucugcuuuguugguucaggccaccucccaccauucaagaccccaauuuuugcccauuuugguacuuuccuauucuuuuuguugacaucauuuccaauucagacauaauagcaagaguucccauucauuucucauuuggacuccucacaucuaguccucugccuuuuaauucuaccucauccuugauccucucuuuagagcuuagagaggcuuuggaauuagaagauguguauuccaggcuuguaauugaucaacucugugacuuucaggaacuuaaucuuccugauucuggacuuucuaaucuggaaaacugagauuauuuuauaccuccuugguuucugagaacuaagaauaauguguguaaaaaugucaaauaaaaggugcuugguauauauuaguuauguuucuuuuccccugccaguugcugcuauuuaguuaucauacaggguugcaaagaagagaaggcaaauagaguauucgguuuauuuuguauguguguaaacauaugaagauuaacugguaacacaaagauucuucaugaacaaauuuuaguaaugagcuggaaagaauauuguacucugaaaacuaaagacauagauuaaacuucucuccugacagacuauggccuuacuaauuauauguuauaauaaaccuagcuauaucuuauagagaaaauaaauguuauuugccucuaguagauaaagcaggauuuuuuuauuccaauacaaaauacagcuuauugucauuaaauaauguuacuuuuuguuguuguugaugguguuuucguuaauaugagaucaugaaagaauauuuuuccccaaggguagauaccuuaugugcugcaaguacauuuuuuuuggaaugaaagaauacaugugacauuuaccaaauaaauggacuuuuacugaaaacuuugcucuuuucuuuuuuagguguuuggcaaucaacucauuccucccaaugcacaagugaagaaggccacuguuuuucucaauccugcagcuugcaaaggguaguuccguuugugacuuguuauauacuugcuuuuucuaagggggaaagaaaucacagacuaucaggcagcuagugagauuguguggaauuggaagaacuagguuuaguacucuucuagcaauaagauucauuuguaauguagaaauaacaguuaaaugagaaauaacuauaaaacuaauggaugcuuagcaaacuugucuaauugaaguuuaauaaucauuccaugauuaacaccuacaaagaugucuuauuugcuuggaaguaguccccucgggagcgacugcuguacugcuaggacguaaauccuuaggccaucucuguccacaggauguucagaaauggccaagaauacugugggcuugggagaucagaaauguucuuuccaaaagagaugauccuugagcuagaccugggaggaagcaggcaggagaagacuacccauucuucucagcugaggaaacagcccaugggacaggggccuggagacaggagugaccuaguuauggcuuuguuaugacacaggacagccuuuaacugaacuggcuggccuggaaaugucaugugggaauugugggaauuaaggugugaagaauuguugagacuuggguauauaaugauuugaucauggcaguucauugauuauacaaaugaaccacacuaaaacguggagaggcuguauguggggguggggaguggguguguggagacucaaagucuguuaaggaaaaauaaauaggcaaaacuuuuuuuuacaauguuagauguaacuauuauucaauuggaaaggugaauacaaagaccuugauggcuuuagaauaaauaauuaacauuuuauuuugaaaaaauagucagaauuaaaggguugaguguuaaaaagugauaucucuuaugucccuaaugucgagaacaauucuuuuuggcuuuuugggaaucagaaaauuagcaguuugggugcagugguucacgccuguaaucgcagcacuuugagagccugaggugggcagaucacuugagcccaggaguuugagaccagccuggguaacauggugaaacucugucucuacaaaaauacaaaaauuagcugaaaaaaugcaaaaauuagacacacgugguagcauuuaccuguaguugcagcuacuugggaggcugaggugggaggaucaccuaagcccaggaggucgaggcuguagugagccaugaucgcgcaacugcaguccagccugggcaauagagugagacucugucucaaaaaaaaaaaaaaaaaaaaaaaaaaaaagaaagaagaaagaaaauuaguaaauauguauuaaauuggauucuauaagaucuaagucaagugacauuaagguaauaagaacaacaacaagaaagauaguuugggcugaauuguaagugguaggcauaauguugucuggaguaaaacacagggucucugaagucaguuuuucuagucauuucuugagaggcagugagugugacuucacagacaggaggacacauccugcuuuauuucuuuguaauucagugguuuaauucagauugucuaaacagacuauucugccuaacugaaucauaucugcugggcuuuguuagagccgcuucccucccccauaaacgcaccagucauaaugccuauugaucauuuuuguuuaauaucaauacuaaaucaugccaacaaaucaacaagcccuaauauaacacagucaaaauaccuaagauaaguaaauugucagugguggcccguggcugaagauaacagagaacucagccugggucugggaguuugaggaaucuggucuguuuacuguuuugccacuuacuagcucuaugauauugugggaguuaauucacuucuuaaauccccaguuuacucaucuguaaaaucagaaaggcaauaguacauacuuuaaaaauuauuauguggaauagggaccuuugguauuaaaugagauaaugcuuauuaggcacuauuuccauuucauaauaagcacacaauguaagaaauauaaacugcugaaauuguuacucuugacuauggguuagguucagaacagucuucacuucgcuaucccauccuucccagaagcucuuguaccucuccuucgaccuacuucaguguaacucuucuauuccuuuagagaccuaauaaauuaacaaccugcuaauuucugaugaaacuuauggcaauuuguuuaagcaauaaccaguuauuuugaguuccugcuucuaagagguaucuacauuuuuaaaauuaauaagcaaauuuuucagagcaauuuuagggucuuuuuacauguaaauauauuugcauuuuuaaagguagauucuuguuuaaaacuauaacaucuuuaucuaaagguaagcuaaaauacugccacugaaggaaagucuuuucuaaagguguugucuccuuuaacaaggugaagaaucccugcgugcuucugggaaagucugaaacucuccagcauccuuucuuuuuuucuuuuaaaagcuuucacuauuuaauugcacuauuuuugucaucauagcucuguccugacacauaauuuauaauuuaucauguagcuauuucauuauguaguacugguuuaaaacuacauaagagcuuuaagaaauaagauaacuguguguuuagcauuaauaaauaauacauaaaagaguaauuauuuuuuguaugugccugagucuggaaauugcuaaaaguaccuaagguuuuuauuuagccucgguguuaucucacccuuaauuauguaauaaauaauuuauuucuuauuaguaacacuuguuuuucaaucuuuuauauagaaaauuagaaggaaaaaagucuucaccuucauuuuagagguuuucugaacuuauaacaucauauaaagaugugaauaaagacccaaauauucuaaccugauuucuuaaacuaacucagaggagguuacagauuuguugugauugauauggcagauugagacuucuucagaauuuugcuuuuaggaaauagaucugauccacuuccaacugauccuuuccuaucaaucuaguaaugaaagcaacccuggaaggagaauuguuugcaguaccacuagcucagugcuuuaauguuggguuaagcccccagaaauggugagcuggaaaggagaaauuaucauuuacccuuuuauguucauucuaauaaucauucagagcaguagaaagguagaaaauauuuaauuugcuuauaauacacucaggcccuugguuugagauauucuuuuggaugguucuugugaaaauuugugcaagccucucaauuucuauuuuaauucacaauaagaagugauuuguguucuauaugccauuuggugguucuuuuuaguuuaaagaauauugagcuuggccugugcauaacuauacguguuccucauuagcugccuuuguagcugaauauaaaaugucucuucuauaaaauauccuuaaauucuuguauaaaguauccuuaaggucaaaggauacagccuuaguuuaaaaauaagacagaggacugaguaaauguggauauaaaaguuagguguuugacauugauugaaaguacuggauuuuuuuuuccuuauguaauaguugaaauauuugaguaaaaggucaacuaauugguauguuuuaacauuaguuugacuuugagacuaugccauugguggaagagauuguuuugcaacuucugugucccuggauuccuagacuguguuuuugaauucugaccugaauuggacaagaguucacugucagaaugauaugcauaauacuuuugaaauaugcaaacucuuugaaggcuguuuuuucucuucuuauaagacaucguguuguuuccuuuuccucagaauuuacaugucuacauuuggggcagguuuauucauucguuugugcauuaauucaucagauacuuaguaaguacuuucuaauugugccauacauaauccuagaggucaggggauucaaggauuaauaagauuugguauuuauuuuuagaacgcuuccagucuaguccugacaacagucuuggaagucucuaaucaccauacaguaugaaagucacuaacagagauguguauaagguacuaggggagcacagagagggcaugacugugccugggaguuucagacuagcuucuggugaauuaguaguuuggucugcuuuguuauguuguauuccuagcuccuccaccugugucuaucacacaguaggugcucaaugaauacuugagugaaucaagcauuguugccugaauggaaccauaucuaguguucguucuuccccuagaggaacuacuuugugaacuauaagccucccaaauggauaagagcuuauugcauuagauaaacagcaaauucucaaaggccccagaguuuaagguucuauuuuuccauucauauuaacucauuacuuguuguuaaacuuucugugcuugaacaaauaaaggaaacccguauugcauagucuuucuuauucugcccugaagaagauuguaaggcuuuuuguucuugcucuugauaaccuguguuaaaauguuuauauuuuuuccuuuguuaacagaaaagccaggacucuauuugaaaaaaaugcugccccgauuuuacauuuaucuggcauggaugugacuauuguuaagguaagaauggcuccugaauguuuauuucacccaagcagcugccucuuauaacaaccucuucucuuggcuucuuagcaaaaauugcuugucacaagagcaaagaaauuaauguuguauccuguucugacaauuaauaaauguaguuuuguuuuuuuccaaauagugucagcuuuucauuuucagaauaggauuggauggaggcuuggagaacuugacaccuuucaucugagagauaggauguggaauuacaucucuuggaagaugaaaguuguuauagcuguaagaauucuuuuccugaaaauacacaaccuucaagucugaguaauuaauuuaauuucuuaguaguuccacaaacagguaaaccauuuucucucugguaaggaauuaucuuuggugaagaauuuuaaaugguaaagcuuuagaauuugugagauuuaguuaagaagaaaaggaggcaagcauaaauuacaaggaauuguacuauuucgaagaugcaggacucuacuuguugaauuuuaaaugagauauauguggguaaguacauacauguguauauagugaaaaccucucuuacugugguuauaagucuguugaccaauuucuaauauuguacacuuccaggaaaucauagaaguuaaaaaggaucauuuagucuaguuuaccaugcaauguugaacccucuuuuccaacuuuucugucaugauuuuccaguuguuugcccccggggguaggagaaaggggaagaaaacuaacauauuugaguaccuguaauguggcagguaugagagacccaaguaugguuaugugagacugauguuuguuucuucaaugauuggugaaacucacagcuaaaaccaucuggaucuggagcuuuccuugaggggagauuuucuuguguguguguguguguguguguguguguguguguguguauguagagacaggagcucacuauguugccaaggcuggucuugaacuccuggacucaagugaucccccccaccuuggcuucccaaaguacugggauuauagguguaagcuaccaugcccagccuuuuuuaccuuuuuuaaauuuuuaauguacauuaaauuucuuuaacaguucuagaaguacucagguuucauucuucacuuaauuuuuguaagguaaauucuucaaggaauuuguuucaucuaaauuuucaaauuaauugacaucagguuguucauaauaucuucuauuuaacuuuuaaauuucuauagcauauguaaugucucauuuucauucucaauauuguuuauuuguacccucucuuuuuccccucaguaaucuugugagagguuugucaauuuagcccuugccaagaaccguuuuuuggcuuauugauccucucauuuauauguuucauucauuucugaucuuuuuuuauuguuucauucauucuacuuuuuaaaaaaauuuuucugcugugcuuuuucugacauuuuaacuucauugcuuauuucauuuuuaccuuccuuucuuauuguauguauuuaagcuacagauccacucuacugcuucagcugcauccuauacuuuuugaugcauaauauuuuuauuauuuauuuuuaaauauuuucaaauuuuccuugugauuuuucuugaucuauguguuuuugaauuuccaaaucuaaaguuuuucugauugucuuuguuaaugauuucagacuuaauugcauuuuggccaaaaaauguagucuauaaaauucuaguauuuuaaaguuuguugaaauuuguuuuauggucuaacaugugcucuguuuucauaaauguuguaucuaugccuaaaaauaguauauaucaguuauugggcacuauauucuauauauguucauuaagucaagucuguuaauuguguggguucaaaucuucuauguccuuacugauuuuuucuucuguuuuaacuauauaaauucucaagaggggguauuagaaaucucccacuguaauuguggauuugucuauuucacuacauagauuuguccauuuuugcauuuuguauuuugagacuuaggucauuagaugcacuaaaguuucagauuauuucauuuuucuuacauuucgacccugucauagaauaacuauuuuuagcacaaauacugccuuuugugauagucuaucuuaucuaguacuauugguaauuuauacuagcuugcuuauuuuuaguuuuugccugguaucauuuuuauaucccuuuauuuuuaucuuuuuucucuccugagauuuuagauguauuguugauaaaagcaugaaagcaggauauuguaaagcccauuuucucaucuuuugacuugacuguuuaauucauuccaacauucuauaccaguuaucuauugcuacagaacaaaaggccucacuguuuuucugcuuaugauuccauuggucaguagucucgccugggcucauaguggcauggcugaggaaggguggucuucgauggcuuuacucacgucuccaaguugaugcuggcuguccccuggcucauguugucuccacuauguaucuugacaugguagcucgguucccugaagucaguuacagauauccucuaauuuuaucccuaaauacuuuuauguguauuuuuaaacaaauaagaauacuuuuauauuuaucuacagugccauuuucauacuuaggaaaaguagcgauucucuuuuaucaucuuacacugucuaaccccaucuuauacuaucaaauguccugugacucauguauuugugauuuuuuccaguuuaagauacuuaucaauuauaugcaaguacuaauauguacauuacauauacagaaaauagacauuuagaaggaugagauuaaaaaauaaauagaaauacuaauguuuacuuuuuaugccucaguagaaaccacuacucuuuacaggguuuguuuucuuucuuuuggauuagcuuuuauuuugaaauaaucucaaacuuauaaaaaaaauguacaggaauauacaaauucccauaucacuuacccaaacuccucaaauacuguauuaacauuuuaccauguuuacacaugcucucucuuuacauguaugugugugcauauguaugaauguguguguguguguauauauauauauauauauauauauauauacacauacauacacacacacacauauuauuuucuggcuuguuugagaguaaguuucagaaauaauguuccuuuaucucuaaauaucuauauccuaaaaacaagggcacucucuuauauaacugcaagaacaguuaucaaaaucaagaaauuaacauugauguacuauuaucuuguagaauuuuuuuuuuuuuuuuuuuugagacagagucucacucugucaccaggcuggagugcaguggcaugaucucaucucacugcacccuccgccucccggguucaagcgauucuccugccucagccuccugaguagcuaggauuacaggugcgugccaccacacccagcuaauuuuuguauuuuuaauagagacaagguuuuaccauguuggccaggauggucucgaucucuugaccucgugaucugccugccucggccuccaauuguuccaugaaugccauuuauaacaaaagaaaaaacacuuuuucuuguucugcauccaaucugggaucacauauuguauuuaguugugauauuuguuuaggcaacuuuaaaaaauuccucaauuuuuuuuuuuuuaagaacguccuucaguuuggguuuaucuacuguuuuguuauaauuagauucagauuauguaguuuaguggaaguaccacaaaauguugugucuuucucaaugcauaauauauguaugacaguccugugaauucuuuaaauuaaauuuuuagcuugagauuuuucagauuauccagguagcacgcauuucgguuacuuauguaaggacuagccuaaaguuauggauucucagggaagauguuuaucccuucauuuagcaccaaauuucagaacacgaaaguuucuuugcagugcccugggaaucgucgaggaguaugagugagucaaccccgcuuuuauucucucuaaacugcacaugcagucuuuuggguccugguuuauagugggaugugguucuguacuagauucacuaaucuugagcagguccugggauuuuuguuugcuuuuccuagaaccuggugaagcuuugaaaaccaacauucagaucuaccugguuuacuagaugcccucagaacauuuacugcauaggugcuaguuuuauauuuaguguuccuuacuuuauucucguuuauugaugcaucaaagauguuuucauuauuuuacucaguagcuuuaauuuucaguggcaggguaccuagccuaccauucuuuuagaaauggaauuguagcacuucacauagcugguuuuauuuaagucacauaaagcucagugaaguugaguguuaucaucuuuauuuugugaaugaggaaauugaagauacaaacaucuagaaaccugcucaguuauacaauuaguagugacaaaacucauuuaaaccuaggucugucgacucuaaggcaugugcuuucuaccuuaggcuuugucucccauuugacaugaaagcuccaagacaaccuauuucaucuuaggauagcacuauuagaauauucuuccuaauuuugagaagaaaucuguuucccaagaguuuuuacacauagaucagugguuuucaacucuggcugaauaucaaauuaccuggaaauguuuaaaaauguaagucguacccaggucacacucccuagauauaacuaauguggaguggagucugucuguauuuacaaaauaauuucauucauucauuuacuuguucauuuguuuauucauucccaggugauuauaauguguaguuggauugagaaucauagacuucaggcuugguucuaucccauggguucaugugaaacaagccuaaucuuucuuccgcaaaauagucuuuggaauaaucaagaauguuauccugaugcucccuugagccuucugugguuuaaacauuuccgguuucuuuccaugagguaugggcuaucuaaggaagaguaaagcaagaccaccaagucucuuguuccauauacuauucuuucaaacagcucaagcucagagucuuuuguuguugucgauauaucauauuuugagucauauuggacucauuaucuuguuugcuauguaccaucaagccacuuuauaaaaaaguagacuuuauuuuuuagagcaguuuuagguuuaaggaagaauucaagagaaaucacagaaaaccuauauuccuucucuccccugcccacaauuuccuguauuauuaacaucuugcguuaguguuauaaauuuccuacaauugaugagccauuauucaugcauuauuauuaacucaaguccauaguuuucauuugcauuugcucuuuucauuugcauaguuuucauuugcauuuguguugcacaguucuauggguuuugacaaaugcauaaugcauuguguucaccauuauauuaucagacggauuaauuucacuguccuaaaaauccucucuguucuucugcuguaccuauucauccuucccuccacagcuguuuuuacugucaccauacuuugcuauuuuuaaaaugucauauaguuggaaucauacaguauguagucuuuucagauuggcuucugucacuuagcaauaugcauuuuagguuucuccauuguguuuucauggcuuguuagcucauuucuuugcugagcaauagucuauugucugaaugugcuacaguuuauccauucaccuacugaaguacaucuuggucacuuccauuuuagcaacuaugaauaaaauugcuauaaacauuaaugugcagguucucggguggacauaaauaaguuuucuagucauuuggguaaaugccuaggagugcuuuugcuggauaauaugauaagacuauguuugguuuuaucggaaacugccguucaaaguggcuguaccauuuuguauuauuaccaccagugaacuagaguuccucuuguuccauauccucgucagucuuugcuauugucaguguuuuggauuuuagccacugaaauaaauguauaaugaaaucucauuguuuuaauuugcaauucccuaaugacauauaauguugaguguauuuccauaugcuuauuauccaucuguagaucuuuggugaggugucuguucagaucuuugcccuuuuaauugggcugguuucuuuuuguugaguuuuaagaguuauuuauauauuuuagaugcaagcuguuugcuaugcauuuugcauauauucuuucucaggcuguggcuugucuuuuuauccuuauaauaguguuuuucauagagcagaaguuuuaaauuuuacugaauuuuaauuuaucaauuuuuuuuucuuucauggauauugcuuuuggugauguaucuaaaaacucaucaccaaccccaagaucacuuaaauucccuccuguguuauuuuaccuuuaggccuaugauccauuuugaguuagcuuuuuugaaaaguguaagguuagugucuagauuuuuuuucugggagggggcaacuguuaggccaccuuuuuauccuuccucuuuuagugcauuugggauuuuuuuucuaagaucagagccucaaauauauuaauauuaucucuauuaaucuuugaaauuauggucugucaaaucugucaagaucuuuuaaaauuuuuauucuuuuauucauacaccuuuucacauuuauuaauguguuuuuacaaauauuuauuuagugcccacuaugagcuaagccuuguucuagguauuggggauauagucuuaacaaaauaaauucccuauccguccuuaaagagcuucauuucaagguuugaaagcaagaaugcaggugagaaacaaauauaucaauaaauguauaauuugucagauggcaaugagugcuaagaagaaagauuaagcaggguaaggagacaaagguuauuuuacuuauuacuauuaacuccuaauagggguguuauuuuacugcagauggucaaggaaggugggucugacaagaugagcuuugaacagacacccaaaggaaaugaguuagucauguagaugcuugaggaagaaguaucacaguaucacgagcugugauacugcauguccaaaggcccugaggcauguguguauuugacauauuugaagcaugguaaagaggccaguguaguuggagugaaaugagcaaagggugagaguaagagaggaugagguuagagaaguaaggaggggaaaaugucagcuuuguaucauuuauguaucuaguaaauuaccuuucacuuccauuguugacaaaguauugccuaagaaaaggcugaagggggacccucaaugaaauguccuaggaaucuuccagcaauuugacaucauuccaaugagcaucacauuuuggacauagauauucaguugguagcucauccacuuacuuguuuucuagcauguuguuuccacaugucuucaccuuguccacagggauaucauaaagugacuugccaggcaucuugcuaaagaccugauguaaugugucugucuaauuuccaagaucuacuaauguagcuaaucugucaaagaaggaaaugaggacaguaugaaaucacuuggccuuagugagaacacaggcuaauuccucaugaucacuuauuucuggguguucaugaaccauccuuuucaucaggauugacauacauacauuuuuuuaaaagucaaauauuugcgaauauguaacuauaaagcccauaauuuuauuuuuagaauaaaaguggaacuauucauccuaaaauuagaugguaguauuuuaaggagucuuccuuuuuccucuguguucacugugaauuaaugucauauaggacuuacuggcucagaugcuggagucuuuucuugcacuaguuggauguccaacaauucaauucaauuugauggaauucaauucugauaccaacgccuggaguuagugcagacuccaagggguuaagggcugaguuucacaagacuguccacacuucaggcgccagucucacaucuuggggaaauggucaccuguucuucugaccugccaacuacaaauccaggguucucccaaccuccccucagguucgguaacucaaacucaggaaagcacuuuacuuaguuuaccaguauauuauaaaggauacuacucgggaacaacaaauggaaagauacauaggucaagguaugggggcagagggauuggcauagagcuucuaugcccucuguaggugugccuccucucaacacuucaguguugagguauuugcuuccagccuggaagcuccucacacuccauugcuuaggaagguucccuuaagcaggcaugaucaauuaaaucauuggccauuggugaguuaacucaaucucaggccccucgcuccucccuggagguuagggguggggcuaaaaguuccaacccucuaaucaccuugcugaucuuucuggugaccagcucccaucuugaagcuauucaggggcccaccaaucaccucauuagcacaaacuggcaagauugagagggccuugccaugaauaacaaaagacauuuuuaucgcucaggaaauuccagggguuuuaggaacucuuugccaggaaccaaggacagagaccagacauacauauguauauauauguacguauguauggguuuuuuuuuguuuuuuuuuuuuccugagacagagucuugcucugucgcccaggcuggagugcaguggugcaaucucaguucacugcaaccuccaccucccagguucaagcgauucuccugccucagcuuccugaguagcuaggauuacaggcgugcaucaccaugccuggauaauuuuuguauuuuuaguagagacgggguuucaccauguuggccaggcuggucuugaucuccugaccucgugauccaccugccuuggccucccaaagugcugggauuacaggcgugagccaccgcaccuggcccagauauauauauauuuuuauuaugccauaggugcuuaagcccaucugaaauccagacauuuaauuuuugucuauuaguauguauagugugauaucaguuggagggaguguuuccuauuuuaauauuaguugcauuaugucuauugaaauuuaguguuugguuuuagaaguauacauauuauugguggcuuaaaugguucauugaagucuauguauguaucugaaaucaaaugguaucaauaaaaaugguaagucuuaggcauuguuuugugacuacuuugaauccuaccuguauuucuuuauguauggucauaacaaaacaauaauaaccuccuuuuauuuagugcaauaccaguuaugaacaguuaccuuaccaguugcuuuacauacugcuuuacaacugguuuacugagaaguuaucauuauucccucccucaacacacauaauuucagugaugaggaaauuaagauccauagaauuuaaggucacucagcuaaaaaguagcagaguugagauuuaauccaggucucuugggcucugacaucugugcucuugucauuacaucugcuucuuccuauuugcauguacacuugacuuccuauaaaggauguaauagaaucugcacuugacuggaaaugaugcccuugacuagcuagcuguguaagagacaaauuauuggguuugaauuuuauuuucaaaguauggagcugacuagaugguuucugaggucccucuggcucuaaaaguguaaaacuguaacgacuauacauaauugcuuugauagcuauuuuuuucaugucuaucaguuauguaaaauuuacgaagacagucaauguaaaacuuuaaagaagauaucccacauuuuuaaaccuuuaaccuuguggcucuagguugauaaacucaccaaaggcuuccuugguauuucagacagauuaugagggacaagccaagaaacuccuggaacugauggaaaacacggaugugaucauuguugcaggaggagaugggacacugcaggagguaugacuguuuuucucuuugaagcuauuuugaaggugagaaaaauggaaauuaaauccuagagcaaugguauguuguaauuuaaagaaauuuuuuauuuuaauucauuauuuuaggauuguugcucucuaaagcuaguauagcuuuaaauuuuucuccugcacuuccauuucauugcuuuuuguaaacccucuacccagcacauagaaggauuuuuguauuaucauauuuaaguuugauaauauugaauauaacagaagaaaaaaugaugguggaugggauaaucuuguuauauuuugaagacucuuaugaaguagcccuguuuguaauggaaucauaguuuccaucaacagguauguuucuuauaaaauaaacagauauucagcuauccauucucaugucauuuccauuacauauaauauuauacuacauuaauaggaagagguauacauguuaagauacaugcaucugcuuuuguuuuaauauugcaucuucucaaugagaugccacuaugcaccuauuagaauggccaaaauuucagaacacugaugauaucaaaugcuggcaaggauguggagcaacaggaacucucauuguugguaggaaugcaaaaugguacagccacuuuggaacagcuggguguuuucuuacaaaacugaacacacuguuaacauacaauccagcaaucaugcuccuugguauuuaccaaaggaguugaaacccuguguccacacaauugcacauguagcagcauuauucauaauuaccaaaucuuggaagcaaccaagauguccuuuaguaggugaaugaauaaguaaagugagauauauucagacaauagguauuauucagcacuaaaaagaagugagcuaucaagccaugaaaagacauggaggaaaccuaaauguauguuacuaagugaaagaggauagucugaaaagacuacauacugugugauuccgacaauuugauaucuggaggaggcaaaacuauggaggcagugaaacgucagagguuaccagauguugaagagagggaugaauaggcagagcacagaggauuguuagggcagugaaacuauucauuaugauacuguaagggugaauacauuuguguuacacacaaauuuguuuaacacaaauuuuuuguguguauuuguuauacacaaauguauaaguguuauacauuugugggaacccauagaucugcaacaccaagagggaacccuaguguaaacgauggacuuugggugaugauaauaaggugucaauguagguccaucaguuguaacaaaugugccacucuggugaaggauguugauaaugggcggaagguucacguauagggggccagaggggacaugggaaaucucuguauuccucucaauuuugcugugagccuaaaacuacuuuuaaaacauaaaauuuauuaauaaagauacccuuaaugcuuacuuugguccauuaagggcgguaaguauguuacccugcaaguacucuucuuuucuagcagcagaguagugcauucauuauauuuuggaaaccccuaaagagcccagugcaggugaucccacgcacugcuuaauuuuucauuccuguauacuauauuucauauucauaccucauuucugauugccuguuguccccauucauugguuuuaccaguguucagggaucagaagcuaacagcagaguacuguccuauguuugacuuagucauuaugugagccuuaguaagcuucuuuuaaaaaggcugugcuaaugauguuguaauuguuuuuauggcuuuuuaaugaagugugaagaauauugauagcaugccuacaaagaaggaaguagaccucucaacagccccauuuauuccugaaauucagugaggcaggagaagaugaagggaggagaucugggucagguuuuacuuuacaaaauguuuuuaaagaaauuguguauuugguauaauuacagucauauaaaaauaugcacugauuagaaaaaggauuggagggaaauauaucaaauauaaacaagugauuuauaauugguuaucuggggcugggugugguggcucaugccuguaaucccagcacuuugggaggccaaggugggcggaucaccugagguccagaguuugaaaccagcgugaccaacauggcgaaaccccgucucuacuaaaaguacaaaaauuagcagggcaugguggugggugcuuguaaucccaacuacuugggaggcugaggcaggagaaucgcuugaaccugggaagcagagguugcagugagccgagaucaugccaucgcucuccagccugggugacagagugagacuccacugcaaaagaaaaacaaaauaauaauaguuguuuaucuggcaugguggaauuaugagaauuuuuuuuuguauuuagguauuuuucaguuuuuacagaauacuauccuucuucauauuugucaauaagaacgauuuguuaagugcacacucucugaguguagcaaagugcuuuuuuccuguauauguacuucauagugguaaacuaggguuuucuguauaauugauguguacaucauauuuauacccauuuuauagaacuuaaaacauauuuuuaguaauacaacuuggaguuuuuauaauuauuuuaucuuagccuuuauuguauuauugaucauaggucaaaaauaaaaucuaauuuagcucugauucuauuggagaauacuauauguuuuaagauccagugcaucuuuuaacagagcuucuaagaagaaaacaggaguaaguuuauggucuaugaaaauugaauccaauucuuuuauuguaaaggaaauacauauuauuuauaacaauguuuuauuauuacauuuguagguuguuacugguguucuucgacgaacagaugaggugagcauuaaagaguaauugcauuuuaacuuuuauuuuucuguucuuuuuuauugcuuuucuuucuuuuacuuuuuuuuuccauuguauauuuuaaaacggguacaaauugugcuuucuugaauuuuagaaaagaaaauacugcuacccaugucauagaacacguauauuaacacauggggacuuuucugguuugguaauugaugguauccaauaacuuugacaaugguuauuuaaaauuuuguuauggaaucuuuuuuucaaagaacuuuuucauaaaagaaauuguggcauauucauauagugggaaucaucuaacaguuaaaaugaaugaacuaaauguauaaauaucuacauggcuaaaucucaaaaguuuugaauaaaaaaaaaagcagguugcccagguauguuaugcauuucuacaguguuuuaaaauucagaaaacaauacuauguaugguuaauggaugcuuaaauauguagcaaaagaauaauaauguggaugaaaaggaaucacaccaaccucaggauaauggucuccucugggaagggagagaggagaauaguuuuagaagggacuuucauuguaucucuaucguuuuauuucuugaaacauaugaagcaaaaagguaaauguuaacauuuguuaaauauagguugugggcacauggguguuuuuguaacauuauuuuaugcacuuuucuacaauagcuagaagauccuucucagucccuuugguaauaguacauugugcucagaauuguuuugaaccuuacaguaucuauuguauguguggcauuuaauuaacugcuaugccaguaccaucuauuauuugaacuuguuuauucucuuugccuuauuuguacuuaagauaguuuauaaagcaccuucaccugucauuggucacuguauaaaugguagacauuuuuaguugaauuuuaucugcaacuuuaucaaauagugugacaauguuauacagucucuguugcacuagugcauugauauauuaucuucaaaacccucauuaucuuaaccaaauuucuuucaaacaguugucauuaaugaguacuaaaauauuucuuccaaauucugagucauuuuguuuucauugacugccuuguuuuagaaauuacccaccuagcuuuauuugauuacuggucuaaggauguggaaaggagauggggaggcagauacagggucaguuauuugucauaguggacacaccugugcuucuccauuaagccugauuuucugaucauaacaauaaaacuuuccucuucuuuccccccccaggcuaccuucaguaagauucccauuggauuuaucccacugggagagaccaguaguuugagucauacccucuuugccgaaaguggaaacaaaguccaguagguugucaauguggggaauuagcauuugugggugagcgagacugggaaugaaaaauuuauguguaugcuauaacuuucuugaguuuugauagccugaaacuucaaauaauuaagaggaggaccuagaucagaguucagccuuucaguucauugggaagucucccaacuugguugugggacucuuauaauaagucuccaggucagguagggaggugaauacuugauguccuuuugucaguuaugaagauaauaucccugaccuaaaccguuuuugugcuuguacauuguaagauucuuuagugaagacauauuugugcugcucauuuguuugcuuuaaguauaugcaaugacaaauaacaagucccuugugaagacugaacuaguagccuggcuucauuaucuugauauuaaaaauagcuaaaacaaguaaauauagccacauccuuuugggaauacuuaaagugguagacaguguagacaaaguagacugggaaagcaguguagcucugacaucuaaauuaaauugcugugagucucacaguguuuuugggagucaagcaaauuguuguuauuauuguucuuuuuugcuugaaggcauuauguaaacaaagcucugcucuuucaagaagauaggaaucuugaauuugagcuuugacagugauuaauaacaucauuuugagcaaauaguugucaagaagacccaaauaaauggagagauagcugagagaucaguugccugaugguuaacguaagcuuugugacacauuggaggaagucaauaaauaaauauuuguugcaugauuuaaugaaaauuuucucaugauuuuucugguuauaaucuucuagaauaaauaauaauaauacccaagugauuuucuguuuugguuaaggauuuuuuuuucugcuuuggaauucuuugauuaggcuggcuuuugugaauuuauuuuugcuauuguaauguuaggagucaacuguaucucuuuuaacaauucuauauuuuaauaagcaucuuaguccaguuuucaaaacacuaggcauacacacauauauauaugucagaucuucauucaaacuucuuuuauauuucaaaccuuaauauaauggggauuauucagcuauucauuagccauccugagggccuaacuacaggagaggccauuucaguuggccauccuuuuuuuuucuuuuucuuucuuuuuuuuuuuuuugagacagagucucgcucuguagcccaggcuggagugcaguggcgcgaacucggcucacugcaagcuccgucucccagguucacgccauucucuugccucagccuccgaguagcugggacuacaggcgcccgccaccacgcccggcuaauuuuuuguauuuuuaguacagaugggguuucacuguguuagccaggauggucucgaucuccugaccucgugauccgcccgccucggccucccaaagucaguuggccauacuuuuuauucccgguuuagaauuucugaggggcaguagauaaugacaguuaauugcucacauuuuugcuuuuccaagaugaauccugucugauucagguguugguuacauuagagagcuugucuucuccuugugucaguguagauuuuuugaauugcuuuagccaguauuccaaauagcauaugucauugauccaaggguagaccauuuuccuuggagaccccuugccuguccaaaagcuaauuuacacagaguguggcaacccccagggucugagagagucuucaguuugggggaacugauuuucucuuguaguuaaacuacuacuguugcugcugcuauuuauaguuuaaaaauuuauaaaacuuaauuuauaagcaugccccagggcuguuagguaauccaggaagucuguccugaguucagaguucuguaggccucauaaaauggcagaagccuaaggcuauuuaaaaagaacaaggcuuugcuuuuugcacugcugucaagauuuguuguaccauaguuaccacagaggaaaaaagaauuuugaauuuggaauguugcaaguaaauaaucugaaaagugcuauuccaugcuacagugcugcuuuauuuagaacuuuuaguuauuggcaggagaaugauaaauuauagguugcaauuuuagcugucuucugccagcaauuuaggaaaaaaauuuaauauaaaaagacuugaugaguuacaacaauuuuuuuuuaaggucagccucucaaaggcauuuacuaaaucucucaguguguuaaauacuguucagaauaaguacagugcuuuaggauucuuucugauagcuuuuuucagaauuaauauauucauaucaaauuaaacuugugagcaugcugcuuacuuucuccuacacugaaacucauauuccaaacugcugccuacuucccaaguagcaucuauauuggagagaaaaaaaugguguaaaaaugaguugauagagaaacaugagaaaguauaauaguuucagcuagaguuuaauccaagcauuugaguuaaugugucuaucuugggauuuuaaaguaucuuaaguuguaccuaacuuuguuagaaacacugguuuagguggauuugauuccuuagguguuuacauuuaguccugagcacauugauggggaggccuguagagcacccagauuuuagauguggauuuuuucuuugggaauccauugauauccauuugauacguccaaagcagccuuacagguuaaguuagcacaucuuuggagacaaauuucauuuugugacaugcuggcucuguccucuugguaauuucauucaaucucucugaaccucaauuucucuuacauguguuuaucaaaugcacacuaguaguaccuacuucagaagauuguuaaaaagcuaaaguaggucuauuuacguaaguguaauuaugccuaguaaaguggacuuuauucauauuuauuaaaaauucauuuggggggacaaacaguaaauaaauagguugacuacaauuacugagucuagauucuauaauuaaaacaaauauaaaucaaaacagauaagccucuauucuauugcuaacugcuucaccuagaaaaguuuuuuuuguuuguuuaaaaaaggaaagaauguuuuguagucauucaaaucaguuaccauaggauggcaacaauuucuaugaaauucacaguaucaaccaguucugcacauagcagaauagauuaggaggugcccuguuugguuaggaacugcccuuuuuugaauggaaauuaaaguacuuucuaaaugacuucuacuuguaguuguacuuaaacuccagacaaaauauuuuacuuuauuaauaauaauuaccguauuuauuuuuccaaaauauagcuauguaacaauagaggcaauaggacacuaacacugauauaccuuuacaaaaacaugaaauacauauggauaaaucuaacaaaauauguguaagauuuauaugauggaaacuacaaaucagugaagagagaaaucaagaagaccuaaguaaauagagauacuucuguguucauggauugugaggcuucguacugagaugucauucucuccacaacugaucuauaaauucaauacaaucccaaucaauguuucacaaggcuuuuuguagaaauugaaaaauugauucuaaaauuuauauagaaaaauaaaggaagcagaauaaucaaaauaauuuugaaaaagaacaaaguuuaaggauuuacccuaucuaauuccaauacuuacucuaaagcuacagugaucaaaacaguguggugcuggcaaaacaagagacauaaaucaguagaagaaagaguccagaauuagacccacacacauauggacaauugauuuuucaauaagggcaccaaagccauucaauguauaauagaaaagacaguuuuuuucaacaaacaguauuggaacaguugaacauauacaaaaaguaaacuucaacccauaccucacacuauaucuaaaaauuagcaucaaauggauuguaaaccuauauauaaaaccuaaaacuguaaagcuucuagaagaaaaucuuuagucauuagagaaaugcaaauuaaaucuaccaugagaugccacuaugcaucuauuaggacagcauaaacaagaaaaaaaaaaagcaaacaaaaacccgucaaauaaaugcagcaacugaaacucuuggauaucauuggugcaaauacgaaaugguagccacuuuagaaaaugguuuggcaguuucuuguaaaauuaaacauauaccuaccauaugagcagcaaucacacuuauagguacuuauucaaaagaaaugaagauauauguccguacaaaaaccuguacaugaauauuuauaguagcuugauuccuaacugccaaaaacugggaacaaugccaauguccaucaacugaugaauggguaaacaaauuccaguacauccauacaauggaauauggauagucuacugauacauccauucauaaacaauaguguagaugaauuucaagcucaugcuaagagaaaaaaacugaacuggaaaggcuccauacuuuucgauucuauuuuaugacauucugggaaaggcaaaacucuagacgcagaaaacauaguaauugucaggagcugaaggugcaggcaguggguuggcugcagaggguuaugaaggaacuucuugggauguugaaaauguuauauauauuugucauggugauaguuauaugacugcagcuuuugucaaaauuuauaaaacaguguaccuaaaaguaugaauuuuacuguguauauaucauaccccaauaaaucuaacuuuaaaaaagaaguuacacuuccaguuuccaguuccacauguaaggagcuuggaaguugucacucuguccuaacaauaaacaaaaagcugaacaaccugaaaacucagcaacucuucuuguaucugaaggagaagguaggacauagggcaaacugcugcccccaagauuggagagacaggggaauacaggggauuuugacuuaacgaagacacacacuggaaaccacuuuggaaaccacuuuggaaaccagugccaggguaggaaaaccugaccuguaauugauaaauugcugaagcucagugugauuagcucugagaggagucccagucuacugggauccagucauaaggagucccccacaauauuguaagauaugccuccaggagcucaaccaggagcucacaauaaauaucagagaaaaaucgccuuauacuucuggcacugguggggaaaaggaaccauuuugaaauaugccacaguauucuguucuucuuaacaaggccuguccucaggagaaacaaguuaaccagagcccaaccugcuggaguauuaucaagguuuaacuggagaagggaaauacuuaauucuagucagcuccagccuugcaugugggagaagggaaaaagccaauuccagccuacucuagccauucuguccaccuaagggaagagaaaaaacugagaaacauuuguucaaaguccagagacaggcucauuaaagccugagaccuaaucaucgaaccuaaucauugcuuccccucccuucacaugcuacauggaugucaauaguacaugccuuuugaugauacuuuuuuuaaccuauagacuuuccaaauggcucucagaauguagauaagaacggucuguguucaaaagaaucagcaauuaaaaugaagcgcauccuaguaguccuggaaaauaagagaaauaugucucagguucuggauuauauuuugcuaagauaacuauaacaaauucugcccuuuaguuacucuucuggcuguuagagcaagaauaaguauuguuuuuggaaaugccugaauuucuuacaaugaauaaaaaaaguuauuaagugucauauuuuccaaugguaaauaggagucaggcacaauguagagacucaguaaauguuaaaugaaugaaugaucagugccuuguaugaacuucuccuugccaaagcuuucucuuugagucccuauaaacuacuaguacuuuggcaggagggagggagagagggaaggagggggagagagagagagggagagagagagaaugagagagaauauguguguguguguguuugugcaugagugcauguggcaguguggugggggagauguugccuauuuuucauaauaugaucauuuccuuuucucuuuuagacauauuacugaugccacacuugccauugugaaaggagagacaguuccacuugaugucuugcagaucaagguaaaucuuuucaucacauauuggaaaaauugugaaaguaauacucgcuuacauguuaaagaaaauaaaauguagcaguucaaaugagguuauaaugaaaacaauaguugcucuuccauuccuaccccaaguauuaguccccagaggaaauaauuuuaccuguuaauucuaguuguuaucacuaauuaauaugcuuuugcuccuauuuuuaaaauguggcuaaaagcauaauauuuaucauuauagucauuuuuaaguauacaguucaguaguguuaaguacacuuagcuacuuuuuuuuuuuuuuugagaaggagucuuggucugucacccaggcuggagugcaguggcacaaucucagcucacugcagccucugccuccuggguuuaagcaauucuccugccucagccucccaaguagcugaaauuacaggcacccaccuccacaacuggcuaauuuuaacuacuuuuugauuuaucacuuuuagaccuuaucuuugaccucuuuguuauacaggcauaccucauuuuauuacacuuugccugacugcauuucacagauauugugcuuuuuacaaauugaacgucuguggcaacccugccccaagcaagucuaccagugucauuuuuccaacagcaugugcucacuucaugacucugugucacauuuugguaauccucacaauaccucaaccuuuuucaucauuacuacauuguuauggugaucugcuaucggugaucuuugauguuacuauuguaauuggggcaccacgaauugugcccacauauaauggcaaacuuaauuaaaugugugcguugacugcuccaccaaccagccauuucccuaccuuucucuguucccugugacacaacaguauugaaauuagaccaauuaauaacccuacuuggccucuaaguguucacauaaagaagacgcaucugucucucacuuuaaaucaaaagcuagagaugagaccaggugcgguggcucuugccuguaauuccagcacuuugggagguccaggcagguggaucacuugagcaggaguucaagaccagccuggccaacauggcgaaacaccaucucuacuaaaaauacaaaaauuagcugggcauuuaaaaaaaaaaagaaaaaaagcuagaaauagguaugcuuagugagaaaggcauguuaaaaguugagauaggcugaaaacuaggccuuaugccaaacagccaaguugugaaugcaaaggaacaguucuugaaggaacuuaaaugugcuacuacagugagcauaugaaugauaagaaaguguggccuggugcaguggcucaugccuguaaucccagcaguuugggaggccgagguggguggaucacuugacguugggaguuugagaccggccugaccaacauggagaaaccccaucucuacuaaaaauacaaaauuagcugggugugguggcacaugccuguaaucucagguacuugggaggcugaggcaggagaaucacuugaacccgggaggcagagguugcggugagccgagaucgcgccauugcacuccagccuggguaacuagagcaaaacuuuuucucaaaaaaaaaaaaagaaaaaaaaaagaaagaaaaaaaaaaagaaagugaagcagccauguugcugauagggagaaaguuuuuguggucuagauagaagaccaaaucagccacaacauucccuuaagccacauccuaauccagggcaaggcccuaacucucuccaauuuuaugaaggcugagagaagugaagaggcugcagaagaaauguuugaaccuaacagagguugguuuaugagguuuaaggaaagaagcccuccuccuaacauaaagugcaagguggagcagcaauuagcugauggagaaggugcugcaaguuauccagaagaucuagcuaagaucauugacagagguacccauacuaaacaacagguuuucuauauagacaaaacagccuuuuauuggaagaaugugccaucucagacuuucauagcuagagacgggaagucaaugccuggcuucaaaguuugggacaggcugacucucauguuaaaaacuacugcagcuggugacuuuaaguucaagccaaugcucaucuaccauuccaaaaguccuagggccuuuaaaaauuaugcuacaucuacucugcuugugcuguauaacuggaaaaacaaauccugggugauaguacaucuguuuacagcauaguuuacugaauauuuuaagcccacuguugagacccacugcucagaaaaagcaauuccuaucaaaauauuacugcuuauuaacaaugcaccuggccacccgagagcccugauggacauguacaaagagauuaauguuguuuucuuguuugcuaacagacauucauccugcaucccauggaucaaggaauaauuucaacuuucaaguuuuauuauuuaauaaauaaauuguggaccaaaggucaucaauagaugaacuacugucuuggcaacaaagugagaccccaucuauacaaaaaaacuuuguaaaaaaauuagacaggcaugguggugugggccuauagucccaguugccauagauagugauuccucugaaggaucugggcaaaguaaauugaaaaccuucuggaaacgauucaccauucuagaugccauuaagaacauucaugauucaugggaggaggucaaaauaacaauguuaacagaaguuuggaagaaguugauuccaacccucauggaugacuuuaagggguucaagauuucaguggaggaaggaacugcagauguaguagaaauaacaagagaacuggaauuagaaguggaaccugaagaugugauugaaaugcuucaaucuuauaaaauuugaauggaugaagaguuguuucuuauggaugagcaaagaaagugauuucuugacauggaauguaauccuggugaggaugccgugaaccauguugaaaugacaaaaaaaggauuuaaaauauuacauaaacuuaguugacaaagcauuggcagggauugagaagacugacuccaacuuugagagaauuucugcuauaggucacaugcuaucgaacugcauacaugcugcagauaaauucaugaaaggaugagucaacagacauugcaaacuucauugcugucuuauuuuaagaaauggucacauccaccccaaccuucagcaaccaccacccugaucagucagcagcuaucagcauggaggcaagacacucuacagcaaagauuaugacucacuaaaggccuagauaauuguuagcauuuuuuaauuuagcauuuaauguuagcauuuuuuuuaaguuaaggugcauacuuuuuuugacauaaugcuguugcacacucaauagacuauaguauaauauaacuuuuauaugcacuggaaaaccaaaaaguuuuuuugacucauuuuauugugauacucacuuuacugcaguggucaggaaccgaaccugcaacauuugugagguauauaagaauugcucucuaucuccucucaauauaauugaaaugcuauuuuuaguuccuuuauuuuauuuauuuauuuauuuuuggacaggaucucacucugucaccgaggcuggagugcaguggcacaaucacagcucauugcaaccucaaacuccugggcucaagggaucuuccugcuuccaccuccuaaguagcugggacuauaggcccauaccaccaugccuaauuuuuuacaaaguuuuuuuguauagauggagucucacuuuguugcccaggcuguaguucaucuauugaugaccuuugguccacaaguaauucgucuaccucauaugguuguuuugaauauuaaaagaguuaauaaauauaaauaaauauaaaauacuuaggacaaugauuuuuaccuguguguaugguggccaccucuuccucucaugcccugccaaaggugaaacuguucucauaucucaucacucuauuagaguagcuuuucuuuuuuugaauucaggcuacuuggucaucuugcaaucuuagcucuuuggugagcuuuauuaaaguuaugauuuuguagauuaucuggcuuuuucucauuuuuagggugggacuauguucuucguacuuuccugcaugcuaggugggaauagaauuucccauuuuucuuauuguguaauguuuucuuacugauuuauacaugaacugaugaauuauuuuagaaauauauuuuuuaaaaagccuuagaagcaaugauaccuaauagcagugaucauaccuggcacccagaaggugguuugaaauaccauucccaauaaaaauagccaaggcgcugugaaggauuggcuuucgcagggcaauaacaagacaagaaaguacucaaaagcugauggagauaucacaaaagauguagccugcagguguccuacucgccaauuugggacucuuugaauauuacaaagaacaacaaugauggaucauaagccuuaaaaaugaagaauccaugaguuuccagugauauuucaggauugccagcuuguaaaugcagaaggaaugauagaaaaucgccauuuuuuaaaucaccugcguaauaauugauucagguagagaucaucagugaauacuaaaaccacuggauaaaagauuguugggaaacaaagcccacagucucaaaguaucucagauuacuuaauaauuuaaaagggaaaaauauacuuugauaauggagaaaucuagugaucaaacuuagcaucaugaauaauggauaaacugacauugucugccucccgaagugauauacugagaaggcuauaacaucaccuauguauuuugcugcacaaaguguuaacuaacugaauauaaucaugaagaauuagacaaauccaaauucuaaaagcaaaaauuggacucaucaaaaaaugucaaugucaugaaauccaaaagaagguagacagucuguucaggauuaaggaauacuaaagaaauaacuaacugcaguacaagagccugaauuggaaaaaugagaaacaauggcaaucaugagaggcaguauuggaacaauuagagaaauuuuaguauuaacuauaucuuaaauauuauguauugauguuagaugucuugagagggacagugguguuaugguuaagucuguguauguucuuguucuuaggagaugcaagaugaaauauuuagugguacagggucaugaagucugcaauuuauuggcaaauuuaacaucucuggagaacauauacacauagauaaagcuaauguggaggaaauguuggcagcuggugaaucugggugaaagcuauaaaugguguucauuguacuguuuaaaaauuguuuugguuugacacuuuuccaaaauaacuuugaggguaagaagguccaguagcuguugucaauucuugaucaggguucucuauuaaaaaauaauuuaauucuuagaaaacagauauucucacuuggauaguaguuacauagcgauuccuuuuucaucuaaacucuuauuuuuuuuucuggaaagggcaaauuccuaggaaggcaaagcugcgaaguaaaauaacccuauaaauagugagccccauguucuuagauuuggccuuaaaauguaccagcuacuuucaggaugaacaucuuauauucauucacguucccugauauuugugaaagaaggauccucacugugucaugauuccaaaguucaaucccaaaaaguugcuguuaguuacauagagcuugcucuauguauauuuacaacuggugaacccaugggcuugccuuuuauuuucuucucgugcacugaugucuggacucuucaccaugaccucacugaucaugauaaaagugauuuaaauugcaguugaucuuuuagcauauaauaaagcuaacuuguuuucauaaaaugggauggcuaugcugaaauuucagccuaagaaagguacuacagauuauuaucuauggagauacuauuuaaaauacuguuauuaccaaaggaggugcaucaggauacaucucaauaacugauuuauucuuucuuauauauguguuagaaguaauccaucccagaguaucugagauuuaacuggaaauucuugcugugcuuucauuuauuuauuuauugagacggagucucacucugucacccaggcugaagugcaguggcacaaucuuggcucacugcaaccuccaccucccagguucaagccauucuccugccucagccuccugaguaacugggacuacaggcgcaugccaccacacccagcuaauuuuuguauuuuuaguagagacggaguuucaccauauuggucaggcuuguguugaacucuuggccuccugauacacccaccucggccucucaaagugcugggauuacaggcgugagccaccgcaccuggccugugcuuauauuuaaaugucucuugucucuuuuauguuuuucuuugaaauaugcugauuuugugaauugaugaaaccaguaucaaauuuaccacaggcucuguguauugaugacacaacccaggaagaaaauucugaaaaucaguuccuagaaaacgugguacaacagucucugcucugguuucugaggaacccaacuaaguuggauacauuuucucuuuuuuccuuauuucugaaaauuaauuucagaauauggggaaaaagauuauagacaaagccuuguacuauaagcauuauagauaaagccugauaccacauuuuucuucuuuuaaagaacaauccaacccuauuaaacauauaucugacgauucuccauagauaaaagaaauaguucuuggaaacaauaaugccuuauauuuagcuuuuuagauuguucaaucuguguucacauuucacuugaaucucccacucagugaggaagucgaggugagauucguauccucauuugacagguuagggaaaaaaagaauccuuugauuaugacgaguugugcuggagauguaacuagaauuuagauuuucuuucucauagucuguugguuuuuccacuuaagugcuuuguccagguggcaucauaguuggcaccauuccaugauuuuugaagggcaguuuuucccauauagacaucuaugaugccugauaacuugacuuuaaaguaauuacugggaagguuuauagaauucuuuguagcuuuuucuuuuuguuuuuucaacuagauucuuaagacccugccaacccagaaccaaauaaggcauagaggggaguucauggggaguuagaaccuuucccuuuucccuauuugccauuccuggcuaauuacauggacuccuucuuuuuagacccuggcuuugaugauucucuuaagaugaugcuugaagcugcuucagaacuccuuuagaacaccuucuacuuuguuucuuucucuuuaucuaggaucccugaaauuuccagauuaggcaucuaucuaguuuauaggacuuguuuucuuuucaguguuccuuaagcguuuauuccaaccugcucgcuccauuauuuucuuccacaaacccuaggccauuuucucccagggauuuacuguuucuaggggaggcugugaauuggggcagcacaucuccuuugcugugaagaucugacugugugcuugucuuucuuuuucuuuuuguuuuuguuuacugacccaaccaucucaaaauuugacugccuacccagaugaguggguuaagauacagugggacuuugucuauuauuggcuucuacuuuguccaucugaccuugcaugcuuuuucuguguucauguguaccccaacagggacuagucucuccaugacugguccucagggcuauucugaauccugacaguccuaugcccaucuggaauacuaauuauucucuagaucugcucacacauauucugccuugcuggcucauuuccuguuguccagagccauucucaccuuuugcuaggauacagcacuccacaucaguggaacuuuggggucacaaggcuuuuuauuuaauucuaauggaauguuccuaaaaacucuuccccccgagaugaagaaagagaaaacaggguuagaggaucagucggcaacccucaguacuuaucucagugcuucuugccuacacuacaugcuuuagaacagcauuuaccaagaaauaugaauuauacaaaaauguccucccaaagaaggguugcacaguuaacaacucaggaaagcuguauauugugcuuccucuuuuggaaauguguaauguacauuaacauauuaaagacucuaagaacuguaguaaacauaacuggcuucaaaccaaguaaguuugguauuuuccaauuuauuucaccauggaaucuucuaucaucaucaucagcagcagcaucaucauccucagacauagcacuuguuaacauguuaugaaacauuuggggaaaugaugcuaaagacauauacuguuauuucucucccuuggacuagaaucacuuucuucucuccuuucucuucuuuccaguucuuuccaaucuccccuaaucuagguaccuuguuuuuuaaaugauggccaaauagugcaaaguugcaguuagauaggaggaauaaguuuugagaucuauugcacagcagggugacuauaguugauaauaacguauauuuaaacauaacuaagagaauaaacuucaaaugucucaccacaaaaaaggauaaguaaaugaggugaugaauauuuaauuagcuugauuuaaucaucccacaugucaauuacauuguaccccauaaacauauacaagugugauuuaucaauuaaaaauaauaauuuauguuuuguuuuaaaauuuauauuuuccuugaccaucuccuuagcuccccccacccauuguacaauuguaccuacuucccugauacucaauagguaucucaauauaaaucagaagccuuugguguaugaaaacuuaccacacuauuauacuuacuuagcaauuuuguuaaguugaaggcauuaagugggauuuaauuuagacaauuuuuagauucaguucuagaugagagaauuaagagggacacugacaagcaacagaggggguuggguaaacaagauaaugaggcuguaaaaucauggcggaacaacggaaagacuagacguuuagcuuggagagcauuaaggcuagggagggaauguaagugcuucgaggcagagaguauguuaguguguucaccauuguguccucaacucccagcaccaugcuuggcugaguagggguuccaucaauacugaguggaugagugaaaacauaccugucuucagauacaugagaggugagguuugugaaauuccagugaggguaggaauauuuuuggcucauguaaaagcuuuaugagguuauucugucaccucauuuuaugauuaaauauaguaauuuuuaaauuuuauguauuuauuuauuauaaauuuuuacuauuggccacucacugcuagcaauugaggauacagugcugauaaccccuuuauacacucauaggagauaauguagagaagguuguuuaagcaaaagaugacccuguuuucagagguagaagccaacguucaaaaguuaagugacuugccuaggaucacuuagguauucugugaggauucucacuucaaaacaauuguucuacguuauuaugccauuuuauagaucuguaguggucagcauguaacauuccuaagaaauaauacagucuuuaaaugaucacuuauacuuugauaaaaucaucacuuauuacaccccaaaauucuggagucaucuuugacucccccauucaggcaagaagucauguuggcucuaccuucaaaauauauccaaaaucaagcauuucuucuugccucuguucuuaccacucuggucccagcugccuucaucuuuuaucuggaucauuccaggaguccucaaauucuuaucauucccucuccccuugccucccuacaaucuguugucagcacaacagccaguguguggucaggaauuagagcaugucacuucucugcccagagcccaucaacagcuucccaucuccgaauaacaccaaagucauucaaaggccuucaaggccaaacacaguccagucccucugaccucuccggccucauuuggauuucucauguacuucaggucucuguucaaauguuagugcaucauugauauccuccaucaccuccuuauauuaauaagcaauccugggugugguggcucacaccuguaagcccagcacuuugggaggaugaggcagguggaucaucugaggucagcaguuggaaaccagccuggucaacauggugaaaccccgucucuacuaaaagaauacaaaaauuagcugggcgugguggcgugcaccuguaaucccagcuacucaggagguugaggcaggagaaucacuugaaccugggaggcagagguugcaauuagccgagaucgugccacugcacuccagccugggcaacaagagugaaacuccgucuaaaaaaaaaaaaaacaaaaaaaacccacaaaauuuaaaaauccuccuuacccucaaugucuuugggcuguuuuuucaucccacucucucugcuuucuacuauuucuagcuccuuuauuguugguacauaaagcaaugauuagagaaaaaucuuuuuccuuaccauucccucuugguugcugaugccccugugcuggcugucuuauggguucaugugugaauucuuugggauuccuccccauggcguacauaguuuucugauguuagagaucuguucuagcuccacuuuucaacuuccuguggagagcauccaggcuuggcucucuccacagcuucuaacuacugggauacuaucaucccugggcuaggcucuuagauggggcauugucaagaugacucaaagcccuguuaucuuacacacuauccacuaggcacccagaaaacuaauauguccuugcuguaccagccacugaguugcugcacguucuccuuuuuucucugccauuucucucugguucccuugucccuuacuaaagcagguacagagagugaagauucaagucuacugcaugagcagauacucgacaaagggaugagaggccagcauccuuuccuugcaggcuucuuuuauuguguuugauucuccuagaaauuucucugauucuccuagucauuccaaagcaagugaccugcuuuuggcguaguggaaacaggagugaaugugguguugggggaagcacucuuacccuugcggagaagacagcaugcuuucucuaggcagcgacuugcacugccaaggauuugccuccaguuccuacucuucuccuugcacuggcuguggugggaaucaagcugguucugcccacuuuuagcaacuucuguggagucuuauguagcauucgguagcucucuuuagagugugggggcacugggugccugucaguuuucagcucuuagacuuuagaugaaauucugagcuacaggaaaaauuccauuuagaauccugguaccuagauuauuuauaauuuuuaaggaagguucaggguagaguauaaacucuuagggacauuggcuguauugugcauuuuuucuauauauugcuuaauucacugauuuauuagaaacucacugauuauaauaugcaguauuuggccauaaagcauuggaccaaauccaaaucacuuuuuauuucgacuuuuuguaacacguauuugacuguaguuucagauauucaggugaaacauucuagaguaccaggauucugaucugacuugagagcucuugauccuauaaggaaaaugcaggcuuaaguuaucuuugccuuggacaaguacaugaaagaaaagaaauucuagcugaccugacuacugacuggcucgagagguaacauaguuagguacucucaaauuuacaguccaaaguaugacaguauguuccccugccagcagauucaugaaaccugauguguaaaaauuaccuucauauuacaguguggcuuauucaaguauuuuuacuaagcacucacaggguuaaugucuuuaauguuugagcagacuuuuuagaauuuugguuugaugaaaaguaggccaugaacauuugcugaguacuuagauguaaagaguucugagugauuauagucaugaauuuaaaugaaauguauuuaacuuccagggugaaaaggaacagccuguauuugcaaugaccggccuucgauggggaucuuucagagaugcuggcgucaaaguuagcaaguaaaggauuacuauauugaugugugauguuuuuuaaaaaaaucuuauucugucccugccuuucagguuuuaauucacagugaucuucugggaauaaauuuggugggccuggagguugaauuaugugugaauaauggagguaggaacaaucagguagagguuuauguccuauaugcagaaaggcuggggaaaguugcagcuuccucaacacuagcugggcaguagcugaagaggagaaggguaugucucuauuuuuagacacacuauuugagcauagguuaggcucaagcuaggcuguagggagaacuggauugccuaucauucugcagcugcuuagcuggguaccaaguggaagggacugccugggcuacagccuuacggagcuguugcagucagacaacuuuuccugagagguauuuuugugaaggccucgcagauugggagaccacaggccgcugcucuuagaggaggaagaaaggcggcgccuggcugugcugugagaugggagaaacaggccuaucgaggagcugauuagagggccaguguuggcuuuucaugagaauugacuuauuuuuggagaauccauuguaugcaaugaaacucuuggcuuggagagagggugugucauguuccauuugcuguggagagguaaaguaggcaagggcuugcugagcaggacugcaggggacaccaugugagauucgcuucauaccugguggugguauuuucucuuuaccuuuucuuaaaaucgagggcuuacaguuugaguauaguuuaaaugaauuguggcugaucucacacauagcucucaagaaauugcucuuucacuuaauaggccagccugccaugcuuuuuuuuuuuuuuuaacagaaauuucucucacuuguuucacuuuauuauucuugcuaaugagauuccugacagugaaaugucaaaagagagacauuaccauauuauauuacacauugcauucugaaguauuucacaucuuuuuauuugcaagugugccaugauuaugggauucuacaaauuaccuuguguuugaucugaaaucucaaauccagcagcucaccaagagaaacugcuuagcuuuccccaaaaaagucugguuaggacaaauugcuuuccaaaauguguuaagcaacaagaaagcacaguacagaucaacgcuuuuaggacuauuuuauauacuagccccauaucucgauugguuucugcacaaagaauuuuaaaauucugauuguuauuaugugcuaccuuggcuaggcccuuccacagaguugcuguuuguauuaagaaagaaaugguagagauaugagaaaucauuuccuagcuggcuguaggaagacuacaaagucaguggcaaaauguacuauugguagagaugaaggaaacugaggaaauuuuagaagguaacugccugaguugagaugaccuucuacuuggcuaacuagggaaagaagcaaacuauaaaguaaauuuuaaaaaauaauaacacaaaaaaucagaugaucaagggccucauuaguaguagcacaguaucaaccugaauaauaauuuagaauguuucugcauucccucuuggauuauaucuaagcucuuugucuguuauuccaggcccaacuuacucugucaucaccccuaauuauauaauuauguaucuuuacuucuaagcuuuucucucuuucucugacuguuauccuauuucccauacucuaaguuuuguacccugacuuuauucugugccauucauuuuauaggcauggcugcuccagugauuuuaggcccuuaaugacuuugucucuuuuugauuccccuuaccaauaagcagugaucaguuuaugcuuuuccuuauagucauucauuguuugcuuuuacauauuugggucuuauuuucucaaaucauaagcucucaaaggugggaaauuuauacuuuauauuucuucuguuuccuccgcauucauagugggugcuaaauaaauguauaugaucagaaucaacagagagcaguuaauguugagugauuuguuaacagagauaaguuuuaagagaagaaucuauuuuaugccguuuucuaauuccgauuaggugucuuccucucuccaguagcuuuuauguauuuagcaauaugcaauagauucucguuauucccagauuuaacauuugccauuuuagagcuauauaacaugaguaaugugaaauuaugcugguuuacacauuuuuaauugagugugcauaugugcauuugugugugugagaggacaugguguacaggaucuagucauuuagcuugggaucagcacaucagagcaugcaguguuugcaucuuaguguggcuguaucauccuuuacucauagcucuuuugaacguacacuugacccauuguauccauagauguaaacaaaugcagauagagaauauuuggggaaaaaaauauuccacaaaauuccaaaaagcaaaacuggaauuggcugcacaccgaguacuguguugaauccgugcaaauaaagugauguguaggcacuguauuaaguguuauaagcaauguagagaugauuuaaaauauacaagagaauguacauagguuacgugcaaauaugccauuuuauauccgggacuugaacaucugcagacuuuggacugagggacaacucuauaccaaacuguauucuauggcuuaaaggauguguuuaaaggauguugugaauuuagugacucaaggagccugguuauauaucucucauaaauugcaagaaucuuuacugcguaacuaauuacauauaacuugacaaggcaucaaaacguggauuuaaaauugaauguaauacucuuuuauacuaagccauaaccuccuagcuaccagaauagccacucauagcagagauguaauucuaauguauugucugccaugaaugguaucuaucacaugauaguucuuuugauauucuuaucagauuuuuaucuuggucuuuucacagguacugguaucuugggccucuaaaaaucaaagcagcccacuuuuucagcacucuuaagguaaaugugauuuacaguguagaaauuugcuguguuauuuuguuguuucucuguaaugcauauauuugguauuuuuuuuuaauuccuugcuacagaugaauguggcaugcuucaacacuaaaacagggcauguuugauuaaauacaaauauagaacgcauuccuguuuugauaagcaaucacccuuuaucuaccaauucauucccucuacuaccaaacccauauuuaaucucucuuaagcauucuacuugccuuugcuauuaauucacucucuugcccgacagaccuugaacauaaugacauauucuucagcgauuauuuuaugcuugucuauguuaguaccuggaaaugaauugaagauuuguaucugaauauauaauaucuaauuguacagguuuguguuuguaucaguagguuucaaacuguaccagcuaaauaugggcggugguuacuguauuggagaguauagauauggaacauuuccaugaucagaaaaaguuuuguugggcacugcuacucuauaugauacaauaaaaaauacuggcauagagaaaagccuaacaauuuuuauuagugaaaaugcuaauagaaaagucaucuuuaacuguggacuacagacuauauucagcuuuuaugcaaaucaaagugguauauugauaguuuggccaaucugaaaauuggcagaugggguuugaauguagugagaagguugguuccaauguuaauauucagaguuauugaauguuuuucuaauuauaaaaguaauacauguuccuugcaaaacauuuggaaaacauagcuuccuuuaccuuuuaaaaaaauucuggcuggauuaaaaaauuaaauguaaaacccuaaaaucacugaacuacuagaaguaaauguaugugauuuuaaaaaugaacuuugcagggcaaggucuuuauauaccaagggcaaacuggauuaguaaaaucgguuauuccucgaguuucauugguggaguugugagugcauuuaggaagaaauagaguagcuacauauuuaaauggaauauaaacuguugccacuauuuauucagcaaacaauaguugacauaugcuugggauacaaagucaaaugagacagguuuccugcccucaagaaguauucagaugcugggagggaaguguaaguaaaucagcaguuuggcaagugcugugagagaaagauagaaagauuaagaagggagcagagaggaggggcaucuaaaucuaaugagggucagaaaaucuucccagcagaggagacacacuaaauuuugaaacauuuaaaggcugugugaagucacaguggugugacauggcccuuaauuaugauuaaugcaguaaaauggcaggaagugaagccaguggguuagguaagggcagguuauggcggguuuugaugugcaauuugacuuuuauccuuaaagcaauggggaguuauugagucuugagcagaggcaugaaaugagcagauuugcauuuuagaaaaauuguuuuuuucuaaacagaaaaacagauaggauguagguagcucaaggcaaggacauuagauagaagguuguuaaaguagucaggugggaagugacguauagacuaaggagguaacaguauugacaauagaagauggauuaaagaacucuuaaguuagaaccucaaaagucagaagaauguaggauuaucagauuucugguaugagggacuagaguuugguaacuggaguuuuccacugauguugguaauacuagaguaaaucaaguuugugaagagagaugaaauuuucaguuuaaucuauguagaguuuaacauaccugugguacagacaagcaaagauacaauugugauuuaggucggaauucagcagagaggucuggacuaaagaaacagauucaaaugucauaagugugugagcgguguugaaaccauggguugggugaaauuaccauugaguacagauggccaggaauaucccuaagggacauaaacauuuaaagaaccaccaaaaaugacugagaagugcuaagagaaaaugcaggagagaauacuaacauagaagccaauagaagagagaauuucaagaaaaaaguaagaguuucgagaagcaaaagcaaagacuuuaaauauacagacaagagaguauccaucgaauuuggcagccuccaaaagcugggcagccuccaaagugugguggcugaagccagacugaagaaagucaagaaauaaaagugauguaaagaaguggagacagcaaggacacgcuacuccuucaagaaaccugacuuugaagagaaggagauagggaaggcaaaagcugagagaaacauggggucaauauggaauuuuuaaaaguggagaauauccauguguuucuagacugaagaaaaagaaaagaaugugaggaggugagaagggagacagaaagcaugacugaauuggcaaaauccaagagcggguagaagggcgugggauccagaguacuggauugucccuggacaggacaaggggcaccuuuuuucauugauacagaagaggaguaaaggguagguccagaugaaaaugagauuagagaaaguuaagguauucucacugaugucccugauauucucacugaaguguaggaagcaaagugauccugucagaaagguggugaguagugguaugggguauccugaagaaagaugaauguaggaggaggcuuaggauuaucaaguagcacugaagaccugaggcuaacaauuuguagacaugaaugcuccuuugggugacugcuuuucccuguauuaauacucagcaggaguaucauuuucuucucuaguaauacugagccaugauguaagaguacaggaacuuaaugacaaggcugauccagaacuggggcuuuuuaggacauauuguagaagaauaaagacacaggaaagccaagaguaaguggaaaaagaaagcacuugaaaguaauugacuaucaguuuggcacugaggggaaaaugaguggucagggaguagaauccucaaugugauugaaaacuuggugcaguuaggucuucaggggcccacaauaaaaccccucucuuccucuuuuuaguuugaaccaagguaugaaaacaaaugcaggaacuaggcagaugaagaucaaaacgucaucuuuauaaaugucagcaggaguggaggacagagcacagauacguggucucuaucugaucuccuaauacugugaacaaagguguccauugaaacagcuccuucagggcagagaccaccacaagaagcuaauuuucaccacaugaaaauuagaagcagugaccguuugagacaaggacagcugcugucagagagaaaggaaagggcuggauccaugcauugguccuucuagacuuggggaggagugaguaagcaguggagugagagaagccaguguugcuacugcuuuguaauucaccaccuggaaacuugagaacagggaagcauuucacccuaagagacacaaugggcacaaaagaaucaaccagaagaauaugggaugugauuagagagcaggaucucaggguuuuagauuuccaaaguggaauaguucugggugacauuaggggccaggauguggccauggaaauggguggauguggugaaucagaggugaugucaagggcugagaggcugggguaugguuuuauucauucaugcggucaggaugugauccagggugacacuggacuugggaugccaggacauagaagacaaaaaaaauuagagugugagggugaugggcuuugaagcagaagugagaagccuugggcuggauugugagccugggcuaaaccauucuggccuguguguggaauaagauuccagaagugagguagguacuugaugcaacuggauuuccucaguuucauuuugcaucaccaucuguaagccaaagauaaauuuauuacggaugacccuauguucauucacccucuuuuuggacaaauguaaaugguggugguuagccaauuuuagggggagcaauggaggcaguacuugcugaauucaugguuuuuaagauguagcuuuaagaggaaaagaaagcuugaggauuccaugcuccaaacuagcauuccauccagugagaggagauuauuaguucacuuucuagcagguauagguagacaaauaaauaacuuuugcagagagaaacucccagaguggaauuguacaugcauaacaaaauuuuucucucuccacauuaaaaggaguggccucagacucaucaagccucuaucucauacacgggaccuacagagagaccucccaaugaaccagaggagaccccuguacaaaggccuucuuuguacaggagaauauuacgaaggcuugcguccuacugggcacaaccacaggauggugagcaauguggcgacuaaagauuggagggcccuggucaguuuagaagugcccuaaaguagaccuccaaaaucaguuuuagagacuuaacuagagcaggagaagccucucagggaucacugaauucauccuucugugugccaccagagcaggcccaagcaaugugccaucaaugggcauagcagucucugugcacagucuuucuguuaacgugacugcuuuugguagugauguuuuaggcacagagaugccauuuuuaccucuauguauaagaagcaugaaauaaauaaaaugaaggcagagucagcagaaagguugagaagcugagcugagcagcuagcagcuagccguccgugguggguggugaaauguuaauggaagaaacugaccuguaucuaauggauucccacagcccuuucccaagaggugagcccggaggucuggaaagaugugcagcuguccaccauugaacuguccaucacaacacggaauaaucagcuugacccgacaguaagugugcuuuuuuauuagaaaagcauuugguaccuaagaaaagugacaauagcuauaguccucucccacuaauucaguuauuuuuauuuuuacccuguggagauagagagggcagugucaggagaaagaggauguggugugccuuuaaggaauaacagcaaugaggagaagcugccaccugcaggaguggcauaaaugcuucuggggcucugauuacauguucugcucauugcuuaauuggcauucagagaacuuagggcaagagggcuuuagaaaugaaaauuagcuauucccauuugucacuggaaaaaaauuguggaacuuuuaguugaguaaauauccacgauuuuugugacuguacuaaauaugucaaauuagauccucaggagaaaaauacccacacacauacaucuguaucuauaucuacauauuauuuauuuaggcccaaucuauagguaugcacuaucccauacgguagcuauuagccacauguggcuaguuaaauuuaaauuaauuagaauuaaauaaaauucaaaacuuaguuccuaagucacacucaccacauuucaagugcucaacagccauauguagcuaguagccaucauacuggaaagcacagguauacagccuguccgucagugcagaagguucuguuggguggugcuacuauagacaacacacccaaaaguauugaaauaaagcaggcauuggcaaacuggucugccaccuguuuuuauauagcccagaagccaagaaucuucuaauuuuaaaugaugcaaagaaaaucaaaagaauaauuuuugugaacagaaaaauacguaaaguucaaguuucaguauccauaaauaaaguuuuauuggagcacagccauauucauucacaaauauauugucuguggcugccuuugugcuacaggggagagcugaguaguugugacagauuguauggcccaaagccuaaaauguuuauuaucuggucacuuacagaaaaaguuuacugacccuaguauagagaaaaccuugguaauuuauaucaaugagaaugccaauaggaaaguaauuguuaacuguggacuaauuacauucagcuuguaugcaaauuagucuguucacaguugucuaggccagucugaaaauuagcagauggaguuggaaugucgugaaaaguuugauuccaauauuaauagagugauaaguuugauucuaauauuaauguucagaguauugagauguuuucuaacuaugaaaauaauacauguccauugcaaaacauuuggaaaacauagcucccuucacccuauaaaaaaaauucuaguuugauuaaagaacuaaauguaaaauaauaaaaucauuaaaguaguaggguaaauggcacacguuuauaccuauguaacaaggcugcgccuccuguguauguaucccggaacuuaaaauagaaguuugaaguuaaaaaaaaguauuaggguaaaaucuaagugauuaucaguauaaaauuaaggaggacaaggccucucuaagcaugacauuuaaggcaaaaaucauauugaugcauuugucuuuuuauuuaaaaagacauucuaaacaaacuuuuaaaugacauauugggaaaaauauuagcaugugauagaccaggaauucacuuuccuuuuaacaagcucuuaggauaaagcaaugagaaaugggcaaaggacuaauauaaaaagugagcaagggguaagaauagaaaauucauaaaagaaauaagcauaugaaaaaauagcuuauauuugcugauuauuuacuacaugugaggcaccuguccuaagaauuuuacauaauauuauguaauccuuauagguagauaucuuuaucugcauuuuguagguaaggagacagagugauuucagcaaagaaaugcaaauuaaaauaguaagauugaauugucaugacuaaaaagcauguuauagauuaaaagcuuaguggugguguguguuucugaugggaauauagauuggaacauccugucucagcaauuuggcauaguauacauaaagugucuaaaauauaugcauaccuucugcccuauuaacuguauuucuaggaauuuauccuacuggaauaaccugaugaauauauaauguaggcaguccuuuuuuacauaauggaaaucugaaaaacacuggugaaaguggauaugugaaugcuaaaaaaaaaaaaauagauucuguuccagaggaauuuaaaagagaaagauaaaaugucuaauuauacaucuccuuuauaccaagucuuuaauaauauguauuccgaguauuuuauucauguucuuuaccauuguucuuuucucugaugacugaguaccacugaauggauugaguucagugaguaugugagugcgcucaagauuagccacacucacaaugccaagugcuuuuuaucuuugugccuauuuaaaaguauacgauacugugccgcuuaucacuaguagcagcaaauucauuuguuucguuuuugcacaguucuuuauaaaaauaaaagcaaaugcaauacaauaaaggcaguguagcugccguguaauagcucaaaauguucacuuauuaaaagcagcacauucaguguaugaaagaagcuguaggaguauagaaugugugaaaauuaggaucucuuauacaacuaugcucacuguauaauaguaaaauauuugcaaugaacuaaucagacugaauaaauuuugguacauuuauuaaaagucauaucuauuuuauauauguauuauuuucuaucuauugacaugggaaaaauaggugaaaagauuugcaacauaguuccauuuuucuuuaaaaaggaaauacccccacuuauaagugaguuuugugaaugauggagguaaagcuccaauuuuauguucuuuccaaauagaaagccaguuguccaagcgccauuuauugaaaucuccauuuucccccauugaucuucaauaaaccucugccauacaucaugucuauauacauguaaauguuucuagucucuuucuucuauuguuguuccauuuucucauauuuauacuaauacucugcuucucuuauuauaguuuuauaauaaguucuauguuuuucucuuuuuacacagucucuuggcuauucuuagcucauuugaguucuauaaauauuuuagaauguuuauuuuauuaaauuccacauaaaaauguuauaauauugaucucacugcauuguacccauagaucaauuuggagagaaaugacauuucuacaauauugacuccucuagcauaugaacgggguauaucucuucauuuauuuaggucuucaaugucuuucaaugaaguuuuauaguuuucucuggaauauccugucuuuugcuggauauauucccaguuaucuuaauuuuuaugcuauucuaaauaauaucuauuaaaauuucauuuucuaccugauuuaguagauggacauauaauugauuuuuauaucaaugcugaaucagcaaccuaauuaaauuauuauuaauuauucuaacuuucuuucaaugaauucuuucaaauuuucuacagauuuagucauggccaaugcaaauagugcaagguuuguuuucucucuucaaauacuuauccuuacaauccuucauuuuacuuagagcacuggauaggaccucaguacaugguuaaauagaaguagcaguaacaggaguccccaucgucuuucuuauuucugauuuagagagaaagucuucauugcuucaugcuuguauuuaaugugcuuucuuuuuuuauagacacccuuuaucagauuaaggcaguuccuuucuauucccaguuugcuaagcauuuuuaucuuucauguuaaauaucuuagauauuuaauuuuaucaaguacucuuccagcaucuauugagauaauaaaguuuccucauuuaaucugucaaagcaauaaaaugaauugauuuuugaauguuaaugugagacuuuuggccaagauguagcaaaaagcaccagcuuuauaccuuaaacaccuuaaaaauuggacaaaaucuuugaaacaacuauaugagacauugguaugagacaagcagcauaggacagugaguccagagagcaagaaguugaacacagugagccugaugcuugcccgaggugacugcuggagagaggccacagccugcggagagggagcccacacagagcccaugcccuaccucaguugaggggucuuugagaauuugagaaaucaaggcagcuagaauugcaaggcaggauacaagagagccccauggagaggagagccgcacccagaaccaagcuagagguuuacggagguguccucuggaaucuucagcugaguacugacaggugcaugcaugugagaaaccaccacccgagauagagguugaguuaccuaccagugagcaggcgggacagucucaggagagucaguccucucacaaagccaggaauaguucguguucaaaccaauuagaguagaaaauccucuucagacauggggcauuggguaguguccucagaaagguauugccucaguagugagucaaaauuaauucuagacuaaaggcugcccucuucccuguuaacaaagcuaaaggcucaccuccaaagaaccacaguuucuuucuagguaacuuaauugugccuccagaacaaagcuuuagaacaggggucagcaaaggacagcccacaggcccgacuauccugcugccuguauuuguacagccuugaagcuaacaauauuuuuuacauuuuuaaaucauugaaaaaaaucaaaagaagaguauuuuuccccguuacguguggaaauugucuucaaauuucagugucuuuaagucaaauuuuacuggaacacaggcaggcuaauucauuugaguauauucucugguugcuuucagcuacuauggcugaguugaauagcugugagagagaccucauggucugcaagccuacaguguucacucucuggcucuuuacagaaaauguuucccgacccuguucuagcugaaguguggcucuccccugaguuuugccuuucccacagucuuuaagcaguggcugugcuuucuuucuuuuccuccccuuguaugcugggccuggugacuuggugguuguccuccugacucaucacugcuuuaacccauucuuccuccuccucucuaacuacccccccacccagccccaccucucaauguccuauugucagagcagaucauugcuccugggagcuccugaacccugggccguucuuacacauuuaucuauaauguuaauuccuagcccacugucucccucuccaaucuacuccugucuuaauucucaacacggcagccagagugauccuauugaaaugaagccagaacauauuucccuccuuagaacccuccaguggcucucugauucauucagccuaaaagccagcuuccucgccauggucuaugaggcucugcugauguagcuccucucuucccugucuuccucacuuguugccccugucauucgcucugcuccagcuacacgggcuuccuugcuguucccugcugucagacauguucccccagcaccaccugaaggccuccgccccaguaguuccccuuguguggauugcucauccccggauuagggguucucaaaguccaguucucagaucagcacaucaguaucacauggaaguugcucgagaugaaaauucaugggccucaccccagaucuacugaaccagaaacuugggauggggccagagucugaguuaaaaaaaaauuauuuuuauugauugauugauugagacggaguuugacucuugucacccaggcuggagugcaaucgugcgauauuggcucacugcaaucucugccuccuggguucuagcgauucucccgccucagccucccgaguagcugggauuacaggcgcccgccaccacacccggcuaguauuuguacuuuuaguagagacgggguuucaccacguuggccgggcuggucucgaacuccugaccucggcugauccgcccgccucggccucccaaagugcugagaucacaggcgugagccaccgcgccuggccaaaaauuauuuauuuuuuaguugacaaacaaaaaccagagucugaauguuaccugcucuacaguggcaccugcuaaaguuugagaaccacugcccuggguggccacaucgccggcucccucaccuccuucaggccuccucuccaaggcuucuccacgggacccccuuuuucauaacacagccacugccaucagcgccaccucauguuccuugcucugcuucuuugaucuuauuuucuaauaaacucuaauauaguuguggcauccuuaucuucuaacagaguuuauaauuuacuaugauccaucuauucccuccagucucuacaguagaaaguaaguucuuuguaggcagaaagucauguggguuuuguucauugguguaacccaagcuccguggguucauggugcaugacuggcacucaguaaguaguuaaauaaaaggugaacuuucaaagucauccacuuuauguuuuguaauucuuaguugagaguucuuuguuaguuacccuuuaaucuuaggcaaaggcuuuaaggcucucagaggccucaaauccugggccugaacauuuugaaccuaccccaaaagaaacaagaccucuauuugaagcugacauagaaguugugggauugauuuacagagggcuagguuuguauggcuagucacugacugguagcaaauuaugggaacugguccaagaaccaagucuguuuugauagccauuuugucguagcucaaaucauccagagcuuucuguggcuggaaauggaaaguuuuuaaacauuaccauagaauaaacggauugcuguuuuccaacucugguugcacaccaaauuuguauguagagcauuaaagaagcacaggcacuugggcucuccacaccaagcagccgauuccaugcugucaugugaagcucauguacagugaacacugagauugcugggaugggcugaaagcuuggccugcaagggaaguaauccuagagacuagaacggcuaauaauuacuagugagugacagaacguccagaaccucccacucugaguuuuguuugcuuauguaguaaaaaaaaaagccaagcaauggagaugaauuuucuauaaauuauaccucaguaaagcucuuugugaaaaaaaaaaaaaaaaagauugaaaauagguuuggaauuaaaucacuacaaguagaguccccuaucuauauauagcuucaaacuaugaaccaucaaagcugaggaugacaacaggcugcauuagccaaauuuuaagaguaaugacguuaguguucuuaaccuuuuuagagcaaagaagauuuucugaauaucugcauugaaccugacaccaucagcaaaggagacuuuauaacuauaggguaaguggacugggguucacaggaaaugaggcuugugauuuucucagauuuuacuauucagagugccccaugaagucuaagacagaaauccagccaaagccuugucuuguuugggaauuucgauguuauuucuuuccuaugggcugacauguagagugccccucuccuaugcuggccaucacuguucauuuuguggggaucagaauguaagagcagucuuuguuuuucaauugaaaccaaagaauucaauggagcaugacacagcgucaagaacuuugguuucagggucaaagagcugaaugcaaauuuugauucugccacuuacccgacgucaugacucggaucauuuagcaucucugaauucuuuccgucuacagaaugaaauaaucaucucugccgaucucaggacuggcuuucagccuugaguaagagaaugugugucaagccuuuuuauauuuugaagcacuucacaguauccauuacuauuuaugucaguucaccauguccuccuauucccagggccuucaugaaaaacuggaaaagguauugaguaccuuggacauuucccaggccuuuuucccuuuuccaauacagaauacccuuccaaguucugugauuuguuaaguccuaccucugccagaauuuuauugguaaagaacacuauaaauccuccuucagggcaucugaggagcugguguguucccaugccaacugguaaucugcucagcuccgcuuuucugugcuuugucucagagcucccucucgugcccauuuagggaucacacauuucugcugcagcggccuggucuccauggcuacuucauuaucuacacaggcacauaaguuuguuguucuugccuuuggcauaaauucuucagagacugaauagcugauucugcagccuuugauuuucuugcuguaucuauaagaagggaaaauccuguuccuucuacagaauguccagaaaucacacaaucuucauugacagucuggccagugagaccagcaauauucaaaucuccuuuaugauacugguauccagaaauagagaccccaauucuauugcuaagguuaggcgaagccacuauguucugcauuguuagcaccaguggcagccaguguccuucuguucucuacaggaagugaaaucaaguaaugucuguuuccucuggauaucugaagagaacauagugaagcugcguuagaaaacucugauaccguuuuguagaguuacuguuguuaauaaaugauaaauggacugauuuacuuagauuagcuuuuacuguauuuccacugccuaaaagauacaucugcaugagguggagugugugucuguauaugcgcuggaaauuuuacuccauagucacucagucaagguagauauuguaugccaaguagaccgcguuauaaauacagucaucccacgguauccuugggguauugguuccaggaccucccucagauaccaaaauccacagguugucaagccccuucuauauaguggcacgguauuugcauagacuuaggcacguccucccuaugcacacuaaaucaucucuagauuacuuauaauacucaauauaauguaaaugcuauguggaugguugcuguccuguauucucuaggggauaagauagucuguacggauucaguacaggugcaaaaauauguauucucuauccucaguugguugaauccacgggagugggacccacagauaggaaggguuaucagagaacuucuaagacuaguuguucauauacauaaaagaaauaucuacauuaaaguaaaaauauuuuauccuucaaguaaucacaagaaguaccaaauaccagacguuuaguacuuuuccuaaagaauuucauucuaauuuuuaaauuugagacuaacaaucuaagaauuagguacauguggaaugauuauuuuuaaaucaaucaauuuuuaaaucaaauuaagagcauuucagagaaagucauaacuucaugcccaguucucuacuuucagucuagaauguaucacaaggcuaagcaagaaucacuguuggaaaaauuauuuacagaauucuauggcuuaauagaccaucuguccacuuauguaagcucauaaaaagggggaaagaaguugcuacauuguugcaaccuagugcaguugccaucacuggucuuaagcuugcuuuuuccugugcucacagaagucgaaaggugagaaaccccaagcugcacguggagggcacggagugucuccaagccagccagugcacuuugcuuaucccggaggugaguggggaaggggucgguagucacagcauuugauucguucgucaucggccugccccucuguggugucccauccuuccucucuguuagcugaccuagacuuaggcacauauugugugccaagcauuuugccaggcucugggucauauuagcggggagcugaaaaggauggcagaaucuccuugggagucauggauuuagaguuggacuucugaagacucccaucguuuucgaaccaagguucuucccuaaagugaguuuuaggucuccuuuuauuuuuccauauguaaauaaugcagaagguuacuacauuaagacacauagagaauugucuagcuggcaaauguuaauaguggcuuuuacuuuaacauuuuuuauaaaggaucuggaagcaguuuucaguucaacacugaauuuuucuguauuaugaaaugccaugcuuagaauaaccuauguaagugaaaaaaauuggaaauagaaucuggaauugggagguuauucaauugucaauacggaaaaaaaggaggcucuucauauagccuuugaagacauguggccauauauuacuguauucagacaagacuauagguaaacagaagguauccccauagugacuggcgucacaguuucgauauaaauauugaauuaaaugcaugaguuauggaaggguuucauagacuguaaugauauuaauguugauacaccuuggguauaucaagcuaaacaagucuuagagaauaaugaaaaugauccagcagauacaauagcaugucauaagagaauuagcugucuuuauuuuuauuugagaaggauuagcauaauauagaaagacuauguauaugaguuccuuaagacauggcaggacccuugccuuuuaauacauauuugaaaauuauaaccauguuguucaaaucccaaaauacucugggaggagauaggggccaaaaaaagaaaauaaauccuuuuucauggaugguagaauuaggauguuuccagaaccagcacugugcccaucguaguaggcacugaauuuuuuuuuguaaaagaacauuaggauagcuccucaagagaggauguuguuuuccauaaugaacuucuucuggugcugcugugagaccuccaacuccaguaggccacugauguguuugagcuguucugaauauucucuucuccccagggagcagggggcucuuuuagcauugacagugaggaguaugaagcgaugccuguggaggugaaacugcuccccaggaagcugcaguucuucugugauccuaggaagagagaacagaugcucacaagccccacccagugagcagcagaagacaagcacucugagaccacacuuuaggccaccggugggaccaaaagggaacaggugccucagccaucccaacagugucgucagaggguccccagggcauuuucauggcaaguaccccucugcccccacuccagcagugcuucccaaagugugcucugucaccugcuuugcaaucggcuuccauuagcgcauguuuuauuuuggugugacgguuggcccuccuaaacacggacuuuccucaggcugguucaagacggaaaaggacuuucuucuguuuucuuccaaagugcaaccacaguggagagcccacggugggcuuagccugccuaggcccuuccauuucucuucuuugaccgugcuaggaauuccaggaaagugcauuccugcccuggugaccuuuuccuaugucuaggcuccuccacaggugcugcuauuuugugagcuccggcuccuguuuagcuuuuauuucaguucuaaccucaguccagaaacauaugugagguuguuucccucuucagccacggcuacaauaccggaaaaugcuaguuuuuauuuauuuuuuuaaguagugcuuccuaaaugguuugcaugagagccaccugggguacauguugaaaacuuauuuggggucuaccccaaaccuaauaacccaaauuuggggauggggcccaggaauaugcauuuuuaaaaagucaucugcccuucccaggugauucuguaaguugucccucaacuguacuuggagaaaucguguuuuaaagcaguaguccacaaaguauucugcucaugugcccccaaaaguauuuugaaaaaucauguauacccucacccaucuaaguugauaucuaaaauuuuaucuaaguugguaucuaaaauuuuucaugggaaguuaaauaguugacaaaguauguauuugcuggugucguguaaauauugguauuuuaaaauaaaaacuguuacaucacuauuuuaaacauauccaguacaauuuaaauaucacaacaauuugacacccuucauucauuuauaaaaauaaaugagcuaguucuuuaguaguuaa

SEQ ID NO: 14601 - RNA, 46123 nt, Homo sapiens
guauggacgcaaggaugaacguuccggccgcacgcgucccacacacggacgugcacacgggcgccuccgaauaggcucgcgguucccgaagccggcuccgcggacgccugcucuggcuccgugggaaaggcgccuccgcggcggggccccgggcagcgccagacccggcgggcggcggcggcguuggcgcggccaggcgagggggguucccgcagcccgcccgccccgccccucgcgcccgcggcuccgccucgccuagccaugguggagcagggagacgcggcgccgcugcugcgcugggccgagggccccgccgucucccugccgcaggccccgcagccgcaggcgggaggcuggggccggggcggcggcgggggcgcccggccggccgcggagccgccccggaggcgggagcccgaggagccggccgccccggaggugcugcugcagcccgggcgccuggagcugggcgacguggaggaggaccaggugguggccguguucguggucaccuucgacccccgcucgggugagggccgcgccggggccaggcgcguggggagggucggggugcccccgagcuuugggggcgcgggggaggggcucgcugcgcgcgcaccugcccucccggccccgcaccccgcaccagggccggccccgggcucccgggcuuggggaagggcgggggucggccaguccucagcucucucccucggggcgcagcugggugcuggcgcgcggccucucggagcggccccgagggcuuuguuccagccccgccgaccuccucuccccuccccuccucuccucugagucccagccccacagugguguucgcacuucagugacagggcauccgguuuguggccacguuggguuuuguuuucuuuucuugggggcuagaagauuuuucacguugugcggaggaaaccccccgggcgagcgcccugagcuccccgcucgccccccaucccgucccccgcuccccgcucgccccccaccccgucccccgcuccccgcucgccccccaccccgucccccgcuccccgcucgcccuagcuccccgucgcuuccucugggguaacuuuccuagcggccaaguucacuuucucugacugcauuauuuugaggaauuaacgccgggagcauuaagggauggggcugagggauucagcugaaggcugauuaaaggagaagccuccccggauaggcugucuuucggagaugcuuggagaauuaaagucuuaucccacauaaucuuagccuaaccacccggcaggggggugugcguuuuccaggugagaguccacgggggacagaagguggaagaacgacccugcgcgcccaggaagccuuggagggucagcuagggacuucugacucugagaguggcucugcuguucgggguugggggaaggaggugucaucgcaggagucguggugucagggcuuaaggaaacccaggugugacugucaaugucuccagggcagcugcuggaguguggagugccuguucgugcgggaaaauauuggcugcuuucugggaugaggugggauggaguggagaaaaaaagggguuaggaucuggagaaggggaaucugguauggcagcugaugauggguuccaggccgguaauuuugggguucucagcuguaggacacaggaagaaugugggauucacuguggagcuccauuugcagggacagaguuuguggggacaauucaggccuuugugacuucugcuuguuucuuugccacauuccauggcuuucaaacucuuuugacugaucuaucaugugaaguuaauuuuacaucacaaccaauaugcucacauacacguacaguacuuauguaacugaaauagacauuucaugaaguagugcugacuccuucuacauguaaugcauucuuuuuucucucucuuuuuuuuuuuuuucagacagugucucacucugucgccuaggcuggaaugcaguggcucuuuucucuuuuuuuuaaguguucaucacacaugcugguugacucgcauuugagauuccuagauaccaguaguuugaaaaguauuggucuuuuuugaccaaaguuacccguaaugcuagacaaaaaccaauacuuuguaacuaaucauauugcuuauacuguaccccaucauuuacagguaaacagcuaccagcauuugacuuauccugggaaauauuucagaguaacuagaaggaauagaaagggcacauucacacggucugauuuaguauugguagcuccagugguagagucuuagggaagggaaagagaaaagaaguuuuauacuaauuacagacagauaggguggauaauacugauaauugaucaauuauugauauuggccaauugauaucuaucaauugauaaaagcgccagagggcuaguaccugcccccauuccuugucagucacaggcagugagcauggcuuugugaauuuguguauacggagugugugugugugugugugugugugugagugaugguuuucagacuaaggcuacugugcaaagaagggauuguaacacauuuagacauuuugugcaggcauuuuacuauaaugcuguuugauuuauucugaucacugcucuguaauuugaugaucauuuauacccaauuuguaaaugagggaacauaccagggaugguuagguaauuugggaauauuaaguagccaauaaauacuugacuguaagucccauugucuuucuaguauacuaugcugccugaaccccugcucccuggcaccugauccuuacuuauccagggauggaggagaaaggagggaggaagagagagcgcagugugagagggagcacuuguaacuuguguuuuuuuuguguuuuuuuguggggggaaagcaguccuuuacugaccauaaauguguuugucucuuuugucaucuauccuaguccuaaauggcacuuugcuuccuguaaaaauacucugauagaccuuguaccauauaauuuuauuuuauauauaucuuaaaaguaggagauguagugaaugaaugcuacugagcuucugagggccucaagguuagcacuaggacagggcccucagagagugccugauguaccccuugugugaugguuccgguggagugaggcccauaguggcacagugagcuggaccaucacuggcccagcaucuuccccccuuuacugcugaggcagaucugcuauuuguuccuauuuaauauuggcccacccagacuuuugccccuccuucgccuguguugccaaaagcgauaaagugaauauugacuucuuuaccaaaauuagagcauauuuuagaaguucuuacauaggugugauuugucugcuguuuaguuucucucgcuggccugccugcuuagccacuuccccaugucucucccaccuguguccucaguuuccacuccuaggagauccuuccuccccccaccccacacccaccucaacccuccgccacccccaucacuuacugcccaggccauggcauuaugugcaucuucccauguaauguggguaacuguuggcauguguccaaaucagugugugugccugagagagagggagagugaaagaggaagaagagaauucauagcuguacauucauuagguaguagaguaagagggaaaaggagggguggauccuuguuagaaaggguguguguguguguguuugagcaggaauauaugcagugauucucuaagguguggaaauaagaguaauccuuuugcacuuuuagauacaaguuuuggaaagcuaggcuggccaucugugggaagaaucagagaaagagucuuaaagcuuauuuccaucagacucauggauugaaaauuaugguugcugagucuacaggugacuuaagaacuaggggcuucagguucaaagugaggcuuacacauacacucaguccucaucuggagcagggggcccuaggaugguggugcugaucaucugggccacaaagcugcuauugaaaccagacccagaugcuaacucugcaagcuggguggaagauguuggaagccagaauauugcuguuucauuuuguucaaccccaugauuuagagccuugauuuuaauuuuacuucauuauuugggcuucuaguaaaauguucuuagucugcuuaauuaaaggagaggauauugucacacuuggggagcaccccugcccccagaugguggcaagagcgguaucaccguguggcugaggacuugugugugggcaggauggaggccgaugaagcuuugaacauacaaugucuggacaucuuugcaucugccucauuagacuguuucuuuauaagagauucacuuuacacugcugcguuuagaguuuuauugugggugucugggagaaauuccugugcucccuguguuuguacuggggcagcuugcaagaggagggguaaggugagaggcagaucaccugcugagguuuucaagauguuucucccuuucuucuugggaaugaauuucuaccuguuccucagccucuagccagugcccagauuacaucuaaacaccuauuuaauuuaauguauccgagcgcuucuauguuuaugucacaugaguacauuuaaaaucacacacacuaauuuuaaucucuguagauucccuguauagucuaugaaacauaagcauuuuuuuuuuaaacaauggagaugauggaggcccagugagaauagggcuaggucuggugucugaggcaccacuuggagcgcugcccaggucaucugacucguggcaaauaauaaauggcucuagcaaugggugggaaagugacaaaguagaaugugaauggaaaauuuggaggacaauuuuaagaugcaaagagcagucguaagcauggacagcucaaaugcaggcaaagaaaaagccuguucugauauccggccagaacgucucgcaggaagagaaacucugucaugucgccauccuuccccuguauuuccaccuaaugccaguggaauacaauugugguucauuugcuuaaucccacccggguagaaucuuucccaggcuguuggugauucaccugcuugugguuuucagggagaaaucaguuuguagccaucugcugugaagucaguuucuucucuugaaaauugaggaggggaaaauaaaaaugguaauuguaauacccaccaccuccugagugccugcugugugccaaggacugugccacauguuucagugaccugccucugauccucccaacagacuacaccaucaucaugagaaaaacaggugcacagagccauuaaguugucuaaaguuagggccagagcccaagucuaccugcaccccuuauccacaccacacuaccacccaguggagaaugauaugggaucugugaaauggaaggucuuucuuuguaaagugaaugcauuggaauucagccauggauuggcauauagcugacuuuaaaucagcaggauuagcuucuuccugacucaggauucuuuauccugaugcuuuucucuuugcuuuggaugugcucucagacuaggugguuuuaagacuguuucaaaccauguaagacccaaagucaacucaccuggguuauuuacuuuucugauguuagggucugaaccaaauacucuuuggagguuuccaccugugggaucugauggccccuuuaggugguuaugugaagggaauguauuguugggaccuagaauacucuuugauucaugccuuuauuccugaaacaggauuuguuuugacuuccugauuacaaucagggcauauguauacacagaugggaagagaaccguggaaagaguaaaaccucaggcacgugcuggggugggaguuccacuccugaggucagaggagcuggaagaggaucuccagcugaggcagucucuggauaggaaaugaagagcucaggaggaagugcuugcuugggaaccaucuaacagaggaggaagaagaaauucacauauuuccuauuaaaaagagauuguuuugguucaagaucauugcuuucucuauuuuaaauauuuugaggugaacuuucuagcagacagcaguuacugcaguuaauguccaaucucccuaggaaauagugaugaauuuuaagacagcuggggguuuggucauuucucauuuaaacagaacuaguuuuggaagacagaggcaguggucaaccuagauaggacagccuaccucuggccuagcccaugggcuuauaaaaccccagcucugggaggcccuggugcacagagcugucaggcugaccuuuggagcugugaaguggcaggguucagaccaucuguacauccucagccaggcgcgacacugaccuucuggcuuugccuggguaacugagcugccagccucguagucgguuaguccaaguuccuuuaaacagagacauauuugccuuugcaugagcucagcaccuggcaggcaccgugcugccaaguugugcuccaccaauauuuguucaaugaccagcugaauguacacaaugcauauugccacauuugugccucccguggucaugugaaucccuccucagaaguugucuuugcaguagaggcuaggaagugccuguaaguaccuguaauagguccaagucaugguccaagaugagaaaggacacagagauggaaagagagcaaguuaggggagaaaaaggcacuugucacuggcaccuccucucuuugauggacuagccaugagaugaccucuuuuguugaaucuuccaggccccagcucccuggcugaguucuuaauacagugaggauaucuggaaaaccuaaaagcauggaaugugaagacugagccugggauaaguagcagucaggaugaguuucuuucugguauuaaauggcaucccauaaggauuacuaauuaugcaaaaucacuuuccauuaagucuccucaaauuccauauguaagcugguuuucauuuguaauguuucuguaggauaacuucaagcccugauagcgcuucauucccuauuaguguggugcauugccucaauuauuuuuggcuuuugcaaaguccuuuaugcucuccuuuuuuucacauugcuauuauuucaauuauuuuccccaauuuguaaguugaaauguuuugaaaaguugaaagaauagugcagugaaaaccuguaugucuuucacuuagaguccccguuuauugacauuuugccccauuugcuuuauucuuacauagucauauccccuauaacaugaaauauauguuccaaaaaucacugugcggcaaaaaaaaaucaugaaguaaaaaucacagggcuuaugagaaaaacuuugucaguggcacauuuuuuuuaaaaaaaagauaggaaccuaccaaaaacuauaggacaguuuugcauaugauaaaugguuaagaaauacauacuuaguaaauguggaacuguaccuuuaaaagaccugguguuuguaucuggaggugagugcugaaaggauugagccugugaauuacuauguguggugggaggggggcugucugaaaucagaggcaaaacugugacgcuagaggugcauggcauggcccagaacgaggugaccugagguagcaggagaagcuuaagguggguguguuuuguauauuccgacauggcuugauucagcuggguguaguuuuccacauugacuuuguguuuuucaugauugaaaucacacauaagcaaaugucaaauucccuaauacauugauugcuuuggaacagauucaacaagcauuauagcagaacugacuguguguggagauauaaauagacuuuucuuuuuuuugcugaacuauuugaaaguaaguuguggaugucauggcauuucauuucuaaauuuuucaguaugggcugggcgugaauacauauacuaacgccuguaauaccaacacuuuggaagacagagguggaaggauuucuugaggccaggaguucaagaccagccugggcaacauggcgagaccucaucucuauaaaaauuuaaaaaauuagcccggcaugguggcgcauaccuguagucccagcuguuugggagguugagaugggcggaucauuugagcccuggaguuagagguuauagugagcuaugauugggccacugcacuccagccugggcaauccugucucuuaauaaaauaaaauaaaauacuucaguauaaaucuccuaagaauaaggcuauuuuucuacaucaccauaguaucauugccacucuuagggcaguuaauuuagguuaauucaucaauuagguuuuuuuaaauaauuaauguauuuuauuuuuuagagcaauuuuaguuuuacagaaaaauugagcagaaaguacagaguucccauauacuaccucccccucacucauacacauauaauuucccuuuauuaacaucuuucauuagugugguauauuuguuauaauugaugaacuaauauugauacauuauuguuuauuuaaauccauaguuugcauuaagguucacuguuguacaguucaauggguuuugaaacaugcacgauguuauguauccaccauaacaguaucauacagaauaguuucacugcccuaaagauccuaugcuugaccuauucaucccucccuuccuauugaucuuuuuauugucucuauaauuuugccuuucccagaaugucacauaguugaaaucauauaguauguagccuuuucaggcuggcuucucuuauuuagcuacaugcauuuaaaguuccuccaugucucuucauggcuugauagcucauuuuucuguauugcuauagaguauuuccuuguauggauaucucacguuuuauuuauccauucaccuaugaaggacaucaugguuguuuuccaguuuugggccauugugaauaaagcugcugcaaacaucugugugcagguuuuguguggauguaaguuuucagcucauuuggauaaauacaaaggugcaucguugcugggucauuugauaauaacauguuaguuuuguaaaaaacugccaaacugucuuucaaagugguugugccauuuuauauucccaccagcaaugaauuccugcugucccacauccucaucagcauuugguguuuugaauguuagccauucugauaugugugucaugauaucucauuguuauuuuaauuugcaauugcguaaugagcauaugaaaaaauagucaacaucaugucauuugccaucuguguaucuuccuugaucaguugucuguucagaucuuuuacccuuuuaaaaaguuggauuguuuucuuauuguugaguuuuaugaauucuucguauauuuuagauaacaguccuuuaucagauauguguuuugcaaauaucuucucucagucuguggcuugucuuuucguucccuuaauagugucucucauagaucagaaguuuuaaauuuuaaugaaguccaauauauccauuuuuccuucaugaauugugcuguuaguauuauaucuagaaacucauugcuaaacccaaagucacccagauuuuucuccuguguuaucuucuagaaauuuuauaauucugcauuuuacauuuugguuuacauauuuuaaaaaauuauuauuauuuuagagacagggucucacucuuuugccuggguugggaugcaguggagugagcacagcuccuuguagccuugaacuccugggcucaagugauccucccaccccagccucccagguagcuagcacgacaggcacacaccaccaugccuggcuaauuuuuuuuuuuaauuuuuuguagagacagggucucgcuauguugccuaggcuagcuacuuuccauauugaauaaauuuuugugaaagggguaaaguaggugucuaguuucauugcuuugcauguagauguccacuuguuucagcaccauuuauuguaaagacugucuuuucuccauuauauugccuuuguuccuuuggcaaagauuaugugauugauuugugugggucuguuucaaggcucucuauucuguuccauuaaucuauuugucugauauuucaccaauaccuacucucuugauuaauuuuauauaagucucgaaguugggugcauuguucgucuuccaauuuuauuguucuucaguauuauguuggcuauuuggggucucuugccuuuccauguaagcuuuggaauuaacuugucgauauccgcaaaauaauuugcugggauuuugauugggauugcauugagucuauagcauaagugaauaugaaauucccugugcucaaauugcucucaaguacaucuguugcauugacacaaauccaguaagugauaaaaguagaacugacuauauacagauauggauaugccuuuuuuuccugaaccauuugaaaguaagucacagauaugauaauaugucacuccuaaacguuugaguauaaaccuucuaaggauaagaacauuuuccuauguaacuacaauauuauuacuauugcuaagguaauuaacacuaauucaucaguuuuuuuaaacacaugcgugcccuuaauaaaucuguuuuuuuuuaaauacccauucuguccugugcaaggcaugauacuauauagaaaugugaagacaaggaaaauucucaccuuguaaaaguuaacagacuccugcagagacagacgucaaagacaugauuaucauauguagagauaagggccauaguagcucuaccuacuucccuuucauucaaggaguugucagcaggaaugugcuugccaugggauaaggauaccucuccccagagugguguucuggagccugugcccuguucuuugauuugccagccucuaauggaccuuucuucccaacccagaugggcuuauguccaccuaggagugaaggauguaacuaacaguaugucauucgcucccucuguuccuuuccauuucugugcaauuagauuugguaggcacagaggagcaaggaagaggguuugagaaccaggcuaaggaauggggacuuuaucuucuaggucagcuguacuaaguaggacauaggcuggacaugaauacuagaagcccaaaucaacaguggcauaaucaagauaggagucuauuucuuuuucauguaacgaucaggugauagcagccuggggcuagaauacuggcccaaaucuccagggucauccagggaccuagacccacguugaccaauggcuccagcauccccucugugauacgaugcuacauccacauuccagguagcaggguggagaaaggggcaaugugcuccuugccuuucaggcaccuucuggaagugaugcaccucauuucuguccacaugacacugaccagaauucacucaugaagguacugagaaacauagccuucauuuggaaggccaugcaccaagcuaaaaauaacagguucugauucauauaagaagagaagaguggauauggaaggacagcuugcacaccugauauaccuguauuucuuuuuuuuuuuaaaaagugccuucuauaaaauuagucucuuaagauacuccuuuuaaaaagauuuaagauacuccuuuaaaaaagauaauuuggggaaacauuaagcacuguauugaucucacggagauucacgaugcagaguggcauauuaaaggcucugagaaguacuucaauaaaggaaugugucuagcuuuguuuaagcuaagauaauuuggccaaaaacacacacauuucacaaaauuuuguuuucuuuuuugcagaagcccuauuaaccuaagcuugggaaauacuacuuugggaaucauugaaagugucuuaguuugcagugacgcaaacauuuuuaaagcaauucuauuccuagggauguagucaguagaaaugugcauauuguguuggucaaaguucaaucagaggaaccgaaaaacuaggagauacauaaaggaauuuguugcagggauuugguuuuaugcaacugugggagcuguuagacaaucuauauaaggcuguucuuuguaucugauguuggaguuugaagucuacugggcagacaguuaugaaggaagagaguaaacuucugaacaagaggaggaggaggaggaaaaggaagaguaagaagcugaaacucaugaagauaggugggaacgcggaucaggcuguuacuguauccagcuuuggugauguggguguccuaaggagaagccgaugcccuuuauuauggaacuaaacauacaccuggcuuaggagucagagaaacugaaggaagaucaagggaugguggcugcagcaucaucagggcuggcugcugccccucaccacucuaguaagccugcagagaagcagcuaugcaguggaccuucugcacugaccuuacagaugcaaacauaacguggcuacugauucacuuccaaaucucagcuggaaacauacaaagaagggaauucugagaaggauaguucagcccaaccaggucaaugcauuacaaugccacuuuacgcuauuucagcagauggcaaauacaggauuguuuacagcagugcccguugcuguaacuucaaauuggaaguaaccuaaaugugcaucaccaguuaagcagguaaacugcuacaugcauaugauagaaguaauagaugaacaaacuguugcuacacauaucagcauggaugacauaaaagacauaaaagcaaacuauaauuacauuuuguagaaacucagaagaggcuaagcuaauucaugagagaggguuaaugacuuggagcugcuaugagggagguuucuguuguacaaauaauguucuuucagcuucuugaucugggugcuacuuacacaaauauguuuacuuugggaaaauccauugaguuguacuuugugcacuuuuuuuaaaaguuuaaguuccaggauacaugugcaggaugugcagguuuguuacauagguaaacaugugccauggugguuugcugcaccucucaacccaucaccuagguauuaagcccugcauguguuagcuauuuauucugaugcuuuuucuuccccuucccugcugacaggaccugguguguguuguucccuucccuguguccauguguucucauuguucagcucccacuuaugagugagaacaugcuguguuuggguuucuguucccauguuaguuugcugaggauaauggcuuccagcuccauccaugucccugcaaaggacaugaucucauuccuuuuuauggcugcauaguauucuacgguguauauguaccgcauuuucuuuauccggucuaccauugauaggcauuuggguugauuccaugucuuugcuauugugaauagugcugcaauaaacaucuuugcacuuuucuauacuuaugcuauacuucaauauaacauuuggguaaauaaaguuuuaagacacugaguagucaugggcaggcuggguuggaggaaagaagcuaaauuugagcuagcugaaccccguaauguguggcguguggguaaacaaggcaguaaguauuagaagaagcagguugguugaguaugaggaggacagagccuaucgagggucauuguagcucugucccagacagucccuuuccucugcugaccauauacugccacuguuaagcguuaggagcguguauacagaggcccaagcaggggcucuuauugcuggcaugcaucagcagaaucacccuguggcagggcagggaagauggugauucuauagaccuaggguagccccuggcaccuuuuaaagcucccuagcuguccugaugcauuccacaggaaaaaaacgacuggacugugaagguaauagacauggaugguaggggaaaauauaggaaagcgugggggaacuuggugcuuaaaaaacucgucuuauccccaaggucaccccucuuucuuucugagugcuuuuucuuaucuuugacccugacaaacauaacauuguucgaggcuuucugcuuuaugaacucuuaauuccuuuuucaugcuuuucacuuuagugaauugacuaaaugaucagaaucauaauuccucuuuugaaaauaaacuauuugaaagugacuugggcuguugagugugagauucgacaaugcucuaugauaucuaccauguccugagacuagauuguguauucccugaugcccugaacaauuaucugaaagcguuguuuggcugggaucauugaugguuuuucuaaugccuagcaaauuaggauuuggaguguuaauaagaaguuuguucugaaaugaaaucucacaaauagcuuaguguuuugcuuuaaacccuuuugaauaugcaugaaaacaacagggaguauucuauaguguucucucaagacucuagauaacacugcuauuguguaguucccugauucccgcagcccgaggcaugcuuguacuuuuaaaauccuacuuuggccuagagcgguggcucacaccuguaaucccaacacuuugggaggccgaggcagguggaucaccugaggucaggaguugaagaccagccugggcaacuuggugaaaccccaucucuacuaaaaauacaaaaaaaauagcugggcauggccgggugcgguggcucacgccuguaaucccagcacuuugggaggcugaggugggcggaucacaaggucaggagauugagaccauccuggcuaacauggugaaaccccgucuccacuaaaaauacaaaaaauuagccgggccugguggcaggugccuguagucccagcuacuggggaggcugaggcgggagaauggcaugaaccugggaggcggagcuugcauugagccgagaucgcgccacugcacuccagccugggugacaagagcaagacucugucucaaaaaaaaaaaaaaaaaaaauuagccgagugugcugguaugcgccuguaaucccagcuacgugggaggcugaggcaggagaaucgccuugaaccugggagguggagcuugcagugacccgagauugugccacugcacuccagccugggcgacaaagugaaacucagucucgagaaaaaaaaaaaaaaaucgcaccuuauccucugucauaacauugaucccacugcacuguaacugcugaucuccucuagcucuccucauuucucucuggaaucuaaucucacugaggucagggacuuuguaucuccagcaucuagcucaggagaaacugaauaaucaaugaugagugaaugagucccaaaauucuggaagcaaauaucauugucccuugaagaaggaccucacuuagagaggagagagagaggaggggaaacagaguuacauuggucagagagguaggaaaagcacuaaaauaguauucuaucaugaaaauccaggaaaaagaggagaaauguuugaggaauuagcaaaugcuaccuagagguaaacgagaaugagaauuuaaaaaauguuuugggauuuuuucccagucauuaguggcuauagauagaaucaagaucucaagggauuaaggggagaacacaagauaaggaaaugaggguggaagguuaaaaaaacaugcagagaagugaggcuacaaaaagcagauuuggaagugguugagcagaaugacagaagcaaacgcagcauccucaugagggaggagaacaguguuugagggcagaaaugggagguucuuuuaguguccaccuccacguccuccggcgucaccccugccagugauggaggggcugagcucugagcaucucgcuggucugucugaggcugagucagcagucgguuuauugaaaagccaugugugcuaagcccuguacuaacccauuuucuuugaaugauguuguuucuuuuaacuugcaucuuccuuuuccugcaggaaacaugguagaauggugcuuaccucaagauauugaccuugaagguguugaguucaagucuauggccagugggucccauaaaauccaaucugauuucauguaaguacuucugaacuggagucaucuucguaccauuccccccaccuccacacuuuccccaaagcugaagggcucuuauuaggaggucuucgugugcuguguguaaaugccuugaaaauacauggauaguuuuguguuuacaucauuuuucuagugagaugucuagcuuucaucagauucucaaugggcuucaugaccugcaaaucuuaagaaucccugccuguagagguucucucacuuucucagaaauuacauggaccucacuugagguuugguuuuaaugaaagugcacaguuucagccccgugugaguuaacugaggauaucuauguguucaaccuugaaauuucagcuuuaaguaaggccauuuuuuaguccuguguaguggggcauucagagaguuuugcgagaaggaacaauggaaagagcuuaaggguaaugaaguggcuuuaaucuccucauggggcuuaauucaugauugauacaagugugagaagaggaggaaauaaaauggcagcucagugaaaaauaucagagccucaggaaguaagggaagaaucacugugguuuaugcuacgaaagagaguccaaguuccagaggagccugaagaggaauguugguucugcuucacccauccaagucauuagucguggugcaggagagaagagauguguccaugauugugggcagcugagcggcaggcuugccacggacuaagucccagcuccagccaagugacccuuggcaaguuauguaaucucuucaagcucaucagugaggucauguggcuuggcccgcuuguuuucuugaggcugagcuuugucauugacagccccgaacacaguucauuuguuuuguuuaggauugcaucucaaaauuccucucugaucuugagccacacuacguauuuggucucuucuagcuauuuccgaaaggggcccuucuucggccuggccugcuuugccaacaugcccguggagagcgagcuggaacguggcgcgcggaugaagucugugggcauccucucucccuccuacacacugcuuuaccgcuacaugcacuucuuggagaaccagguucgguacguggcuuccguacaugugcagggaggcagcaggauccaccagcuggugcauauggcacgagcccucggagacagcauuugcgugccagagcagcagaugucuuuccaagaacauccauggcgauguuucacgccucgggugguguccuuucguuucagccaacguccugcaugaugagucuucacucuauaaugaaagcugggguauauucugccuucaguuuggauuuaauacuaccaucacuuuuuaaaauuaagucauuuuuugacagguacaugaucuuuguuuaugcaaagccgcaauaguuaccuccuugccccaaguaggcaaagaaauccuaaacuuucuuaaagccuacuucuuuuauuauugggauucuuacuaugauugggauaauagaaagagaacuuaaaaauauauauauauauauauauauauauauauuuuuuuuuuuuuuuuuugguagagacaggcucuuacuauauugcccaggcugguccugaacuccugcagucaagugauccuccugccucagccugccaaagagcugagauuauaggcaugagccaaggugccuggcauaggaagagaauuuuuaacagaagcagcaaaacgauuaguuacuuuacauuuuuuucaucaugcagguaaccuaauuacauuucagauuuugaggggaaaauuuaucccuaaucccugaagcacugacaaaauguuaccacuucuuuucuguguauguguguacguuuaaaauauauauuuggcaucauacaauauauauccucuuuuauagucuauacuuuuaaaauuuaucacuacguaaacauuuuuaugcaacauaauugugaucuucagcuuugaacccaugaacuuguuuguggaaaacacguuuauuauuuaaaaauuuauaugaaaguacagaggauuuuuaaaaauccucucauauauuaacacucacagauauccauugacaauauuccaugaaugcaauucuagaauacaaauaucuuuacaaaaauaggauuaauauuuuaugaauuuaauuuucucaaauagcaggcuguguuaaugaaauauauuaaacauaauuugacuuauaacuucaaguaaauguuuuuucacaguaagauauacuauuccuugaaauauuccuccaaaauuaagaaaaacaauuaugaaaaacgugacaauauggugucaguacuuuacugggaaacaauauauaaacauuaaaauugaucaggaaugguggcucacgccuguaaucccagcacuuuaggaggccaaggaggaucaauuuaggaggaucaguugaagccaggaauucaagaccagccugggcaacaaagcaagauuccaacucuacaaaaacaaaaaaauuagccaggcaugguggugugcaccuguaguccuagcuacuuaggaggcugaggugagaggauggcuugagcccagaaguucaaugcugcagugagcuaugauugcaccacugcacaccagccugagugauagagcaagacccuguuuaaaaaauaaaaaaauaaaaauccuuaaugguugaauuuuaccaucaagcacuuuucuuucuuugaaaggaucuugcaugauuaauacuauuggccuguucccuuuauccucagcugguuguacaauucuugaaugcuuucuucuuccccugaggaugcuauagauauuguucuacuguuaucugaaauuagucguuuuggagaaguuucuccauccagauaccuauagagucugucuuugucugugcuguuucugaacuugccaaauguuuuguuuuguuuuguuguuguuguuuuuguuuguugagauggagucucacucugucgcccaggcuggagggcaguggugugaucuuggcucacugcaaccuccgccuccuggguucaagcaauucuccugccucagccuccugaguagcugggauuacaggggcccgccaccacagccggcuaauuuauuuauuuuuuuuuaguagagacgggguuucaccauguuggucaggcuagucucgaacuccugaccucgugaucugcccaccucggccucccagaguucugggauuaccggcaugagccacugagccuggccugaacuugccaaauauuuauuaguucauaucaguauguucugggauaguuuguccccuuugcucaauagauaguucuuuuauuuuuaauuuuaggaacuuuuucuucuuuaauaaaauauuuaacuuuugcauucuguuuuuuucuucuccaggaauacccaugaugcauauguuuuucucccauugucuucccuguuugucauuuugaugcuuauuuuaauagcucuucaaugcuggagcuguccuauacauuuacuugguuauucucuguggcugaacaugcagcauguuucuauuuacuguuuauuuuuuuagcugcuccucuaccuuuuggagcuguggaaaauacauuugcacauaugucuuuuucuguacucaaaauauuuccucaguuuuuuuuuuuuuugucucagaaguaauauuaugaaguucuaaaaaagaccauuuuauugggauuuugacacuuuuaaaacaauauuauuccuuuuaaaaagcuaauucuccaaguaggcaauacaguuucaugguucaaaauccaaaaauuuuaaggugguauuauauuggauaggguccuggcuaaaaggcaagaacagaggcccaaaauuacuauggccggauuacgauaaaagauuauugcucaugucauagcguagagguaggcagguggucaaguuggguagccugcucuguuccauacaauuguucagggacccacauucaucucuuguuauuccaccguauccuaagaaugguuuuguauuguaaggugcucuuucccaaauguuaaaagcugcucacuacuauuauguuugcauuucagcccauagggaagaaggaaagacuagaauuuacauaucucacuucucauauuccauugucaaguccucaaucacagagacacacccaacagcaaaguagccugggaagcaucacuacuaggugggugacccugugaccaguuagaacucuggggcauugguuacaaacaggaagaagggaagacuugacuuugagaaaaaguuagcagcuucugcuucaguuugccccucuggccacucagguauccauguauacucuucuucccccuuguagaggccauuccucccaccccaaaggagacaucacagagucucauucaguucaugcuuccagucuaaaaucuaggauuucucuguagugcgcaguaguccuuuacguuaggccagggcaugguucuucuuacccugaaaacuuauaaaagaauagacaagucccucuacucccuaccucccaaaugcaauauaggagguaaaguaggaaccacaauacaagcuucuguuuggaaaagggaagaaugagaaauacggauggucacuaguucauaacaacagugaaauucugcugagcaagaauugcagagucaguaugcucuuggcucaacuuugguucuguuguguagaaucccuuguccauuguccuccauggcacuuggcuuugucuucuagaagauucuuucuucauuuuccuccauaaccacaucuacagugggcauuggagaacaugccuuucuugaggcuguacagcuuuagaacaccuuuccugcugguauagauuuggaggucuagugguuucuuaaggggucaagaagucacaggcuuuuauaagccaagcaugugacaauacaugucucucaaaaacuaaauugacuucucguuuguuugcuuccagucaguuccagguaaaauauccauggccaaagaucuucuuugggucauuguuuuuaauuagcagacuagauuauaguuacuggccucucuuuuuggcccaucccuuucucccucauuuucauaauaacuuccuugaggugauucccuaaaucugaucuuuguaaauaagcugacucccuugucugcccaagaauacuaaacuggagacuuucauagaugcccugagagagacuccugucuccugcuuuugguguacaguagcauuggcuuuuccagcccuguggggucccaaauuguuggaaucucaguggauuuauauugccaaauuuagaacacaugacccuuaguaggcuguauuuuauuccguuuuuccuugcaaaccagccaguucuuguuuguuuuuaucuuauucuuacaguagcucacuaaaagcauacaaggggcagucaacacacaccagcauucuacugccaacugcuucccauaaagcuacaaauucagaugacacagggucucccaaguuauugaaguuuuagcagauguuuugcuacaaguguaacaaggguugccagcuuucuagucugcaauaucuauuuucucaccacccuccccuuccagcaacaaagccagugucucuauaugguuuuugauacuguaguaacucauuuccagguaucguuuuuggcuuuuagaguauaggcuaaguugcuauaaugaagaagagacccccaauacagugacacaguaagauagaauuacagcuuuuccagcauggcagucguaguaguucauuguggguaggugguucuguuccacuggucauucuuggaccugagucauucagucuuacauuaugucauuuucuagaguuguuguccucauccacaugguagaagcugucuccccauuacauugucauuuucuagcauguaggaagagggaaagaccuuggcuccauggaaugugagcagaggugcuguguucaacuucugggaucuggaacuugagugaucuggaaguugaacacaccaccucuguucacauuccauugaccaguucuugguuacuaggcacacauaguagcaaggcaaucugggaaauguggccuuuagcugggcguccguguguccaucuaaaauuuggaagguucuguuacuaaaggaagaagaguauggcagacuaccacucacauaaagugaaaaaucuucacccaguucccauauccauccaaauaaucucaguaaucacaguucauuucucauguaucaucccaaaguguguguguguguauauauacaaauacaaauguauauucuuacugucucccuuuucuugcaaaagauagcauguuauuuguguuguuuugcaccuagccuuuuucauucaacagcaugaaagaucucauaucaguagguugagaguuucuuccuuguuuucagcugugucauaugccuucuauagaauuauagcauuuaucaaguucauuauuaauagacauuugguuguuuccaguccauuuccugcuacaaaugaugcugcauugaauaucaugcauuucacacgugagggguauaucuguauauuaaauugucagaaaugaaauugauggcucaaaggauauauguauguaauuuuaauagauucugucaaauugcuucccauagagguugugccauuugcaugcccaguaguaaugcaagagaaugccuguuucaccucaacguugccaacacaaaaugaaaguuugaacauucuaaccugauggauaaaagaacaguacaucaguauaguuuuaauuuguauuuuucuuauaagugagguuaagcaccuuuauguauguuugagucauuuguauuucuuuuucugugaaccauuucuagccuuugcuacauuuuguuguuuaccuuuucuuauuaauuucuuuuacuuuuuuuuuuuuuuuuuaaaguuucgcucuugugucccaggcuggagugcaauggugugaucucagcucauugcaaccuccgccucccagguucaagcgauucuccugccucagccuccagaguagcugggauuacaggcaugugucaccacgccuggcuaauucuguauuuuuaguagaggugggguuucuccauguuggucagaguggucucuaacucccgaccuugggugaucuacccgccucagccucccaaagugcugggauuacaggcaugagccaccacacccagccuuuucuuauuaauuucuaggaguuuguacaauagggaaauuuuuucuuuguuucuuuguauaaauugaaaauauuuuaccacuuuuucauuugucuuuuaacauugccuucuugucauguagguguuuuucuuugaauucaugcaucuuuuuauggcuucuagauuuugagucauagcuagaaagguuuugcagcuuggugguuaaagagggcuauagguaacauaagagaagagacuuguaugacagaguaugaggaaaagaaagaagcacaguuagauaagcuuaggucuagcuuaggauaauacuugaauacagcagcaacuuuuacauaaauucacuagucuucauuucugcaacacuuaaucuguguuuuauauuucuucugacuucugauguuccaaaccuauuuacuuguauuucaucuacaauuuuugcccucaguaucucucuaaagagucuuuuuaaugauuauuucuuaaucagaagauauuggagaacuauuucauaauuuaaaaaauuaaauuagaggcaagagggacuguuauugaauaaagggaccuacgacucauaaccacauuuuaccuugcucagaucucaauucaaacaaaccaacgguaaaauagcauuugggggacaguggcuguauuuugaauguggacuagauauuuauauuaaggcauuauuauuguuaaaugagauaauggcauggugauuauguguuacguuauuuaaacagacuuuaucaguuagagaugccuuacaaagcacuuaucaaugaaauguuaugaggugggauuuucuuuaagacauucuaggaaaaaagugguaaugguaggguauaggguauagauauaaccauauggaucaaauauuauugaagcuagaugauaaauacaugggguucauucucuucuuucuacauuuuguguauauguuugaaaauguucauagugaaaaguuuaaaaugacuaaguauaaaauuaagaaauaguuauuauaggaaacuuuaaaaaauagagaaaagcucaaagaaaaaaaugaucucaccagccagacauaucuacuguuaacauuucguuuuauaccauucuagucuuuucccaugugcaaauauauauuauacauacacguuuuauuuuauuuuauuucuuuuaaaaaggauuauuggccgggcgcaguggcucacgccuguaauccuagcacuuugggaggccgaggcaggcagauugccugagcucaggaguucgagaccagccugagcaacaacggugaaaccccgucucuacuaaaauacaaaaacuuagcugggcguggcagugugcaccuguagucccagcuacucgggaagcugaggcaggagaaucgcuugaacccagagguggagguugcggugagcugagauugcaccacugcacuccagccugggcaacagagcgagacuccauuuccaaaagaaaaaaaaaaaaagauuauugaggucauucaguauguaaauuuuguaacuugguauauuaaccuuuccgguguaucaugaauuauguccucaacauuauugugguuucacagcauuucaguauauagauacaucacaauuuauuuaacuguuucacuguuauugggcuuuuaggguguuccuuguuuuuuucaccccugugaacaucagcauccuugugaguaaaugacuguucaugucuagaaauaguucuuuaggccucacuccgagaaggagaaucauuagaucagaggauguguacaauguacaauuuaauacaagcuguaaguuacccuucagaagguggugucacaguaucccugcacccgcaguaaaugggagugcuuaguuuucugcauuugcaaagccaggagcuagaagacgauuuguucagacagauauauauauauauauacauauauauauauauauacacacacacacacacauauaaauauauauaaauauauauacacauauguaaauacacacacacacacacauauauauguguauauauauauauauauauauuuuuuuuuuuuugagacaagagucucgcucugucacccaggcuggaugcaauggcgugaucucucucgguucacugcaaccuccgccuccuggguucaagcaauucucgugccucagccucccgaguagcugggauauuuauuagagacagguuucaccauguuggccaggcuggucucgaacuucuggccccaagcgauccgcccaccucagccucccaaagugcugggauuacaggcgugagccaccacgcccggccuguucagaccaauaauuaacacaccagagugaugaaguguaauugucgcacaaaggcaucucugauucugaucguggaugaauuauugccagugugguagggacaggcagggucaguugcacugggcaucugcauggccacauauggcuguguuuuaucagugaaggagcugugggcuuaaggagaaucccagugucucuggcccagcagccuauggcuucugauuaauaauauauauugagccgguuauucucuaguuuuuacagugucacggcucuuggacaguuuccauaggugguuuggcaugcauuucgguguggugguuucucaauuucugcauucuuguagguaaguucaccaggaagggcugcuuugacaucaucuuugaagacuaacuuaucauccagcacucugagccuugugucaguacuuuuugguuuuucuugauauuguaguuugacaaucuuguuuguugcaaaaucuguaguguguuuaaauuuugagucuuucauacagcaguugcuuaacauucauccaggaacugccaauuuguauuuuugucuauguucagauuccauauuauugccuuguucugucccaucagucaguaauaucugaggcaaucaaaggacagaauccucauauuaguucuuugucuaaaggacucuaacuuuuguacugaacuuuucuuuagaaucgugguucaaguauagaguuuaauguagucaaacagaaaagacaacugagcagcaaaucagcaaacaauaaaccuagaaaaugaaaaaauauuucccuugacacagcccccuuuaacacagaaaauguaguauuaaaaauauaauaaaaugauucucaguauucuuuuuagggaaauuugauacuaaugaaacaacuuugaaugaaaaaauauaaauuacccuugacacagcccccuauaacacagaaaauguaguauuaaaauaugauaaaaugauucucaguguucuuuuuagggaaauuccauccuaauaaaaacaccuuugaacauaauugccuuuguaugauuuucugugaaucagacuuucgucaguuugacaaacuucccuaaaaaguaucugaaaucugccaucuucucagaauagucagacacagcuuagaccauggguuuccugucuagcucaugaacauuuguaaaagugaacuaagugacuacaagcaaccuccucccaacuaguuauuuguuauaggaggacuauauuuguuauaguaggacuaccuccuugucaaaacuuaaaaugcauaggagcccugaaauuggcgcuaucauccaucuuacauuaguaaucauuauaugaauauagugaugauuuuuuuccuuuuuaaaauauaaauuugucugaaggucucuugucaucacuuugacauaagagcuguaaaucacucuggaguagagaugguuggagaauagaaggcuauaguugguugaugaaaaucuugacucaacaguuugugucauaguuugggguaagccaccguggcaguuugcagaggcgguguggcagcggggagugccuauuuuuaaucacugcuguuccagggccaaccauaauuagggauguuucccuugcucagugaagcuauauuuugcuuuuuguucauugauugauggaaauuguaggacacugagaaaauaaagaugggcuaagaggguuuugucgcuuuuuauuccucccucaauuagggcuuuuccggggcugcauaacaaagugccaaaacugaguggcuuaaaacagcagaaacauacugucucacuguucuagaggcuggaagcccaaagucaaggucucagcagugugaguucccucuggggcuaugcaggagaauccguuccaggacucucccugagcugcugguggaugcuggcaaucuuugggguuccuuggcuuguagaugcaucaucccagucucugucgucacguucaccugcuguuugcuguaugugugugucuauguguccaaaaguccccuuucuauaaggacagcauucauacuggaccagggcccacuccaguaacuucauuuuaacuugauuaccuauguaaagaugcuauccaaaaaagucccauucugagugaggugcuggggccccaucuuuuuuguggggacaaaauucaaccuauaacauccccauuaaauauagugacaaacaguccucacagugcuccugcgcuccacuggggggcaggauucuccacuguugaaauggcccagggcuucggugcugccuucuggguucuggggucugggguuggccagcagggccagccacagccaggcucugugacccgagcugguggagcgggcagagaagagauucugaugcuuuuuauuucuuuauuauuauacuugaugcagaaauuaugagcccugaugacauccaauaauaauuguuuucccuuauuugagacauuugggguaagcuccguauucuuccauaacaacaaagcaagcaggcaagcgugaguucucuaaacaaagagcggcuuuaagcagggaauuuuaggcuuccaagcuggcccuucucacaggaagcagccauucucugggaaguggcacccagucuccggcguaccuugcucaagaacaauagacauuagucauagucuguuaauucugucuguuucccaugagaaaaagaauguguuccaugguguugucagggaguuucaggcccauguuugaacuuuuccuaaggaucuucuguaacaucaaaggaggugaccuaagcaaccuccaaauggggaucuuuggaguaugucagggccuuugccccugaguguuacagccccuugaggugggcggaggguaggagugguagcagagcugugaccagggcuguucucacuguguguguguguguguguguguguguguuuuucugcaggcaccaguuggagaugccaggacauuacucucaucuggcugccuucuaugaggacaaaaagggggugcuccaugcuggucccggcagaggcagcagccugcccccugucuacuggcugccuuccauccaccgauacauguacccugagaugaaggugagguuagcccugcuuuucuuacacuauacuggaucuguaucugggaauaguagcuguugauuacuuuuuaaugaauaaaaaauuuaugucuuuggaucauacaaaaugucuacuuuugauagaacagaguugcaacauaagcauuugguuuuuuuaaaacauaaggcaaguuaucuuaaacaauaugcuuucuagacacuucuguaaucauaguauaaaggcgugugugauaggccaguugugaaaagauagauuuaauucuguugauugcuucugauauuuuaacacuagacauuugaacuaaagaugaagagucugaugaagaaguaugacauuucuuaguuaagacacuucugauguuacuucguucuguauuuguuccugaaguacuuuggcuuugguacuagaauaugccuauuuacaguuagcaaaacacccagcaaagcguuagguguuggaagggugcaaauaugacuaagaacaugaaucuccucuuucucuucccucucugucuccugugguuggucacaggauauuuccauggaaaccuagggcuccccugguagagaaauuaugccaagaguccaagggagaacucugggaagaugccuuaggagaggacgcagucccugaguauuuggcuagguggaaagugaggaaugcugauuccagaaccaggaaaggugugagcagcagugagaaccauggucugucacuuucucagcaccuucugggaguuaugcauugugccagcuauuuaucuguaccuguugcagcauucucuaaaauaaaaguaaauguuuuuuguuuuuuuuuuuuuauuccuuguuuuccagcgaaaacaaccgaggcuuauaaagggcuagugacuugcuuuaggucuuauagcuaauaggaguuagagcuaagauuuaaacagaggucuagugccacagccagugcauguuuccugccccacuucauugccuuugcagagauguggacacggaaaaaugcaagacaaguucaugagacaugagcaaacuaguuuggcugggauuaaauguuugucagcuggcaugagggaagugauuggagaaauaggcugaaauuagauuguagagagcuuuaaauaguagacccuggagcuugaauccuaauaaguaccaauuaggggcuuaccggguaaagagaccauguagguauuucaaacuaauuuaagacaggaaaucaguaauauaggaguuggaaggcugaaggaguaaaaaaggaauagguaacccauauuuaguaauuauagauaauagccugacuaacacccuauauuagugauuuauugcuguggaacaaauccccaaauuaaugguuuaaaacaguacauauuuauuauuucacagcuucuguaagucaggaaucccagcauggcuuaaccagauucucuaugucacaaucucucaugagaugguuucagccaggguuaggggcucaucugaagguuugacuggggagguauccaccucuaagaucagguggguguuggcaggaucgaauuucuugagggauguuuugaacugaaggccucaguaccuugcuggcuguuaguugggggcuccccucaguucuuagccaugugggucucuccacuaugugagcuugcuuuaucuaagccaguaagagaguauacuagcaggauggaagucagaacccuuuguaaccuaaccauggaagugacagcccugcaaugucaccauauuuucuuagaagcaaauuacucaagagcaagaggggauugcauaaggcuguaaauaccaagagguggggaucacuggggacuaucuuagaggcugccugccacccuuccuuagggcuaggguaacaaagcaagagaagcagaaugagcaaaaccaugggagccugcaggaggggucccugcacagccagugcucagaucgcugagggaggcacugcgcaucugugcugggaccucucaggagguguggcuccacgugugcugugcaugcuaaggaaagcuggaggcuggagucauaggugucuucugcuccuggagaaauacuagcuggagcaagaaacagaagagauuuccuucugccuuucaaucuacaguccaugcucuccauugaagaacucuaacaggaagccaauuggcguaugaguuuaggaauugucauuugcagguuucccaaccccguggcguaggcugagagacaaucauuaagaaaucguuagagggccauuagagguacucugggcuugcacugaccugaguccuguucucuuucugucugcucauaacuuagacccauuuuuuccuucagaguccaauuucuguuggaauuaucuccaaauccacagggaggugaccagcaucugaccuaaauguacucguauucuuccccauaagaguccagggaugagggacuaagagagaaaaaagaaaauggcccaugcuuuugaggacagcucauuaacauaacuguuagacccuaggagaugcagggaagaggguaccguuaugguugcagauacaaauaacaguggagugucuucuuuuuacaaaacaauaugucagcacaucaaaauaaaaaacggccaggcaugguggcucacgccuguaaucccaacacuuugggaggccaaggcgggcagaucacuugaggucgagaguuugagaccagccuggccaacauggugaaaccccaucucuacuaaaaauacaaaaauuagcuaggcuugguggugggugccuauaaucccacauacuugggaggcugaggcaggagaacugcuugaacccgggaggcagaaguugcagugagccaacaucgcaccacugcacuccaaccugggcaacagagugagacuucucuaaauaaauaaauaaauaaaacaugugccuuuuguuucagcaaccuuacuccucaggaucuauccaucagaaugacguauguguaacaauauuuaauucaacauuguucacagugguagaaaacuagaaagccauagugaguagugaauuagagcauaagaaggugacauggaaggaucaccagaucucauuugugugagaauagcaacgugcagaaaacucaucauuccuugguauuugcagggccuugguucuaggcacccucccucagauacccaaaucugcagaugcucacguucccauguaguaggguguaguaugugcauauaaccuaugcaguuccucccauauacagauacuccucaacuuacugugggguuacacccccauaagccuauuguaaguugaaaacauuguaagucaaaagugcauuuaaugcuggcaacccagccaacaguccuugacuuacgacggguccacuuaauguaugauuuuucgaccuuaugauggugcggaagcaauucacauucaguagaagccauaaucccaucaaagucuuaaggagcuucuugacuuaacguggggcuacauccuaauaaacccaucauacaguugaaaacuuggugaguugaaucaugguaaaucagggaccuucugugcuuuaaaucauuucuagguuacuuauaauaccucauacaauggaaaugcuacgcacauaguuguuauacuauguugguuuuuacauguauuaaauuuucuuauuguuauucuuuauucuuccaaauauuuuugaucugcaugcaguugguugaaucugagaauaugguauuaggggauacagagggccagccgacuguacaugugauaugauuacacuguuguuaaacaaucacagugucugucuagauagagacacacacacacccagacauaaacauggaaaguauugauggguguauaugagcuuauuaaguuauguauucccuggaugagguaaaguaugggaugcgguagggcaaggcuuacauguacaaaaaaggcagggaccaggaaaaaaaaaugacaguacuuaaaaauagcauguaugaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggcgugaaccccagggggcggagccugcagugagccgagauugcgccacugcacuccagccugggcgacagcgagacuccgucucaaaaaaaaaaaaaaaaaaaauagcauguaugauauaauaauacuugucauggauggaaaauaauguaauauaucugucaguuuuuauugaaauauaacauuuuauaggaauaaguucaaaaauaguauauaugauacaauacuugucauguauggaaaauaauauauauauaucuuuaagcuuuuuauugaaauauaaaacuuuauagaaauaaguucaaaaaucauacguauauaauucaaugaauuuuuacaacaugaacacacguauaaagaaaagcuuuagucugagcacggcggcucaugccuguaaucccagcacuuugggaggccaaggcagguggaucaugagaucaggaauucaaaaccagccuagccaacauggugaaaccccaucucuacuaaaaauggaaaaauuagccaggcaugguagcaugcgccuguaaucccagcuacuugggaggcugaggcaggauaauugcaugaacccaggaggcggagguugcagugagcugagauagcgccacugcacuccagccugggccacacagggcaagacucccucucaaaaaaaaaaaaaaaaaaacuuuaaagaaguaagcuuuuaauguaggagucagauauaggaauguuucagagggaaaaaaauaaacuggaaaggaagcagagggaagaggaagaccucucugagagguccagauguggcugcuaaaugcuccccuuaggaaaaugggggagugggagagggauacaggggaggggggcugggccccgggaguggagggcuucccuaguggcaggcaugggucuaucagagccugcuauggacacugaacugacagugguuagggaguaaaaagaaauuggagugaaaagaggauggaguauggacuugaaagguuggagggaaaacaugaagguacgcacuggagacaucaagaaaagagauuucucuguaaaagccagagaaacaaggcuggaaaaagggaaagagauuucaaugaaagcaggaggaauuucuguugcaugugcaggugagaaggggugagaagucucuagagcugacccuuuuagaagaaaggagguggcccugugggcagugcuucccuggcaugggccugggcacagggccugaacuacuugcaggucccaagaagggccauguugccucuuaccugcaggccuuuguaugugaacaccuucccucagauucaucuguuuuuguuuguuguuuguuuguuuguuuugagacagucucgcauuguugcccaggcuggagggcaguggugugaucucaacugacugcaaccucugccucccagauucaagcaauucuucugccucagccucccaaguagcugggauuacaggcacgcgacaccacacccagcuaauuuuuuguauuuuuaguagagaugggguuucaccauguugaccaggcuggucuugaacuccugaccuugugauccacccaccucggccucccaaagugcugggauuacaggcaugagucacagcacccggccucagauucaucuuuaugucgaagcuucaacaucacuucccccaggaagucuuuucugucucuccuagagugggaucaggcacccuccaguuugcuccaccaugccccauucuucucccaucauggcucugucaggcuauauuuuaaucgcuuucucccacuagccuauaaaauauacauugggcaagccccaccuggccucugugugguggaagaacaaguugggagcuugaagauaaccagugggaaagcugggaggaaccggcacgugcuuuggcacccuuuccuaucugguugcuguuagacuuugaagagaaauagcgauuggagggaugcaaccagccuuggucacuuggugccucuccuccucaugauuuggguugcgguggcagaggaguaggcguggguggcaaacaggacauguucaguucagggucgccuuuauccuggcaugggguaggggaaugguaucagugcaggagugaugccuuggaaagggaaauccucuccggguagugcagacacagcuucggaggguccaggacagcccuggcuuggacaggcagagugcagaggcugcccugaggcucggguauaggugccucugaaggcuggugguuguuaaacccuagcacgcagcccgagagucggugccucucucagaagugcucuugccugccucccugaugggugaugagcucuuucuucuggcacuuuggcauggaaaugaccuuucacaaagcucacaaggcccaggguuugaagccuuucuguuuuucaaagcaacaguaguggccaccccauauuggcuauuuuuaugugcuauuucauguuuugucucaggcgguccuuaaaguaacccuacgagguaggugaugauuccguauuucacaguuaaggauagugaaccggaaacauuagcuaacuuuccccagaucucccuguuaguaaauggcagggccaggauuggaauucagcucuuccugggaucagagcuuaugcucuuaaccccuaugauacuccuuggcucaguguuccuagaaggcaauucagggguugccaguuagugacagaaggaagaguggggccagucgugguggcucacgccuguaaucccagcacuuugggaggccaaggugggcgaaucaguugaggucaggaguucaaagccagccuggccaacauggugaaacccugucuguacuaaaaauacaaaaauuagccgggcaugguggugcaugccuguaauuccagcuacuugggaggcugagguaggaaaaucaaacccaggagguagagguugcagugagccaagaucacgccacagcacuccaaccugggugacagagugagucagacuccaucucaaaaaaagaaggaagaguggucagaggugaagugcagcagggguuaugccaggggcuccuuccuaccugugacuucugcagacaccucacuuugcacaguagcagcccccauagauuugggaucugacuggggacuguuugcucaucauguuauuacuuaacagugcuuaguaauguuuucgaguugaguuuucuuauugaagcagaugcuuuuauucugguuuuuuuaaauuuaaauuuagcuuuguuuccuuugcauuguucuccugaguaaaauaaugaucacucaacucaaacaucaguguaucagggagcuguuguauuauagaaauccaguuuaaagguaagacuuuuaaagugaaaaacaucauuguguguggaaauaagcauccuuuaauguaucuguuuggauggacuuuagaauuucagagaaggagauuagauaccuuuugcuauauuucuaagaagcuguuccucacucuuucuccucccuauuccccucaauuuuuucagaucacacacccagcuggcugcaugucucaguuuauaaaguucuuuggagaacagauccucauccucuggaaauuugccuuacuucgaaagcgcauuuugauauuuucucccccaccugugggcguggugugcuauagagguaaccagaagccagagucaggagugcugcuuaaaucccuggagcagaaacugcuugagucuuucugucacugaccaaguuuggaagagcuugggccacauccaggggaugggguuuuaagcccgggagugaacugauuggcugugaacacuguugacaauguagaagauggguuggaugacacaucaguggccuggccaaagauuagggcuggauuaaagcagagaagaugcauucuagauggauuuaagagaaacuggacaaaacuuguugucugauuggguuguaaagguucugaugugugugagguugcaguggaagcagagucuaggauaacaagggugguggggccaccagaugggggacggaggaggagccgggggcuggcuugauaagguuagugugggaugugaugagggugugcugccuugagaccuucacagcaggggugucugcccacccugccuagcugggucgggaccugugggcguuugagcuggagauaaagauuugagggugguagauuauuucugcacucauauccaggauggacagcguuaccuggggaaaguacaaguguggagggguguuccaggcacaggaaguggaccagaaagguggaaggacagaaaggacuagggagggacaggcagaagggggaaccggaagacacaaggguuacagaggccggaguucugacaaggucaaauucuaagcaagaccagcuagagaaagacugagaaauguuuauuggguuugggaagcacguuguugacgucaccuugaggggucaguuucugccauggcaccccaaaaggcuugccaccuccagucuccucagaacgccaggaccaccuggauccugaagcaccagauagccuggagcagagguguugagccgcaggcuccgagggaggaagggcuguggaggggcagacccuccccgcucaccuccucuauccccacaguguacugcugcugcugcuuggccaacguuucacugccuggcaucgggggcaccauuccugaguccaaaccuuucuucuacgugaacguggcugacaucgagagccuggagguagagguguccuauguggccugugaguacggggcccuccccucaucuugcccucaggucccagcccugcuccucccagacacagggcuccugggcgccuuguuucccaguggggucggguggguucccaccucucuaaccccggguuccacaggcaccacagagaagauauucgaggagaagcgggagcuguaugacgucuacguggauaaccagaaugugaagacacaccacgaccaccugcagccgcugcugaagaucaacagugcugacagggagaaguaccgccggcucaacgagcagagguaguggcagcuaaggggagaaccaggggcuccacccuccucagggcagcuccagcaugggggucucugcaaagccugucuucugccccuucccugacacauuucucccagucuccaugcugccugggauggagauggaaaugaagggaagccccgcaguagaagaggccaggcucccuguaugcugcccugauaggaggggaguagauccacggugcugguuuauuucuucucauggacuuuggaaucuguggaaauuaccuuagcugccagcugcucuccacgugaccuuuagauguaccugugugugcggcuuagaagcaccuugacugagcaccuucauuguguuggucgccguauuagaagcuugcuuauauguaucugaugucauugucaauaaucuggugauccugugaaauaaguaucaucaucaucaucauccccuucugauagacaacuaggagauuguuacuugccuaagauuaccaggggcagaacuggcccuggaccccagggauuuugaguccaaacccuguugaucccuuuccuggcuggugcugcuuccugggaggugguggcccauugaagaugccuggcugaggccucaccugugacugcgguccugguaccugcaccagagucucacggugaucuucccaacaggcagaugcuguuguacucccaggaaguagaagaagacuacaacccuugugaagaggaccucuucgugcugugaguccuggggccguggauguggagucucccugaggaucccuucggcacugagugaccugcaucccucccaugucauucacugcgggccagggaugccguuuauugcugccaagggcacuuagagccgggcuccuuacagaggcaaaccugagcccugaaaugccauuagggggaacccagaagacuuagggaaagaagcaggucccuuaagagaaaacaggagucuuaguguuucuuuccuuguugggcuuuuacaucgaggauguccacugccuggaagcucugucugucccucaggacucagggacuucucauuuccauugccuccuuugaauagaguaguuccuugcgcugaauauuaugggauaaucugaaauuuuaauucuugaaucaaaugaaaucucuuugccccguaggugcagaagccagggccuuuccaccucacaguacugauuucauuccuagacagcugggugaaguagccuucuguggcaucaacugaauucucccagcuuccuguuuggucuuccaggggugagguugugguuugaugcugaaaacuuaaugugggcauuucuacaaagguguagcaccuugauucuaauaguggacuucuaaaaccuacauccuguuuagguggaaaguaucugagacuugagcacagccauagucucauccagguaugacaugugccacugugucugaaauuccugagcaccgagggccgcuucaggcaccaggcacuuugccaaccugagagcuguauggggcuggacugucuagucuaacuaggcagugaacccuguccugaacagagcuuguuuguucauaaagcacucuaaagcagugacuuuuaaaucuugaucugugcauaaucucacuccucccaaagagucaucaagggagagcaaacacccaaggguaacguuggcucacguucauuuuguuguuguuguugaauuuuugcuuccuccuaugacuaagcagaaagagagaaaagcaguguuugggggccucuucucaggcuguguuuaaacccaggucacuucccucaacaggaaaauggauuuugacaggccaucuugcuuagagauuucccuaaucacaccauaauuaaugccaaaugguuucuuugcuaaccuuaguagcacuugaauaauuaacuuuuacucuuuucuuuuuuuaaaagauaccugcgaauccacugaaaaguacauuaaacaaaacaguauaguuuugguuccccauauguggauuaucuggugagcuuuuuauucccccccgcuuccuuuccugugucuugucuuccaaaugcagguuuuuccuagaacaaaacaaccggauauuucagacuuuguuggaggugucugccagucaagacaaaacucugacagcagagcaugcccggggcaugggccuagacccccaaggagaccggagcuuucuccuggaccugcuggaggccuauggcauugaugucaugcugguuaucgacaaccccuguugcccguaggaggagccaacaggacugggagccacuucacgugggaugucagcagcccggaguucaccccagggccccagagggccucauuuuuuauuaaguugacacaaaggaauauuguuuauacuuuccaacaaacauaauuuuugcaauuuccuuucugcccuuuucccuagagauaaggugagaucaccuugguuuuguguccugccauguuaggauauuggaaucugccacuuucucccagagcugcugguccucugggcuuggucaugggaguuguaucacuaggaguaggcugagcucuggaaacauugggauggacuguucagaaagucuguguggucuuugucccuugauguauuugagaauaagacaaccaccuguccccuguggccuuagauguucaucugccuaaaggcagaaacuagaccagaugaucuuuuaagguuuuuaguaguucuaggagucuauagucuugggaucaaaucccuuuucuuguucauuagggcaacuuuaugucuucucuguuuacuugaguagggaccacaaagagggaaaaaaggauguuucugacaccaaauaugagcuuaucuuauggucagaaugaaagagguugcuuaucagugagcugaaaacuaaaauuauagaaugaagccuggaaaccuuccucaaaguaacuugaugguggccaugcaauguaauguuccucuuugucugaaccuuccucuucuugggaugaauuggugaauugcuaagggccaaugcuggccuuggagcuugcaagcaaauuaauuuuccaguuuagucucuuaaggguucaauaaugcucuuggaguaaguuggguauuuuuaaaggcugaaguuuggacuaccggaggauagagcaauugaaguucgagcaggauggagaagccacucuaagucucuucaucuggacacgaauucucuggaggcauuagcagcagcaccucugggucaacacagauuuacuggauuccaaaaucuagcaaggaucugagcugguuaacucagaggguggagcaugaugcuaacaagacgguuuaucauuuuggaccccucacaaacacacuucucuuuagcagaggugacauuccuuaggcuaaauaauuggauccagggacauaacagauuuguugagagaaaauguggcagugccuucacccgggacaguggucaggaagcccugagcaucccugauggauuuauccauccucuucugaagugcucugcucuaggcuggguccuguugccaccugccuguucucugguuggcuuuugcaggagggcagcuuacguguuugucaaccaguuagaaagccaguuccugugggucgaguuuaggccuuuuuggccauaguugagaauuuugacuugggauacuggguuguuggugacaaauaaugucuuccuuuucccccuucccgccuggcucgguuaugggaauagccgucagugcauccaugucugugaccaacacccagccagacuaauguacacagcagggagaaauaacauucaaauggugguucacacaucucaucucaagauaagauucuuaggguucacugcuuuauucaaaaguguuuucacuguagcuccuucauauggaauaucaaaacugaagaaauucacauguggaaaugcaaauagacauugauuaaucaagguagcaucuuuauguaaauauauaaauaaguuugggcauugaaauguaaacuguacagcuaauagacuuuucuccucugcaauguggguugcugucauuucaguaauguguauguuuacaaaagaaaaaaaaaucuguguuucgagguugaagccucaccuuuuauucuccuuuacaugcaacccucucuucuugccucucaaggguugagggguccuuucugucaaguaaugguuauuuuucgugguauccugagguucaggguguuuuaagcuggggguaggugguuagaggcaggaguagaagugaaaggaaaggucugauucuccuagaggacacaagaagaccuccuuuuucuggaauuagggaaucugccggaaggagcuguuugaggcauuucugcucugagccuucuauaugcaaacacugcaguuuuaacugcaagcucagaagugcugguguaaacauagcagggugagaaugaaguuccuguuuuuuccuuugaauggugagucagggcuucuggguucccuuaacuuugugcuugucucgguagcuuucugucucacaucuccacguguccacccuccugcucaugcagagggccaggguauggguggccccagaggagaacgugccagugaggcagugccauguuucaggucauaggggccuugggcucagcugaccccaaugcagaacuucucccuuuaagagagauuccaauaaauugguccuucccuaccuugccagcuucuucauaggaccagaaaucuugugcagagccucugcuuggcugaacagcgugugcuuuaucucuucaguuaccuuugccacuguugagcauccucagaguaugucuugccugggcuaugaaguggagccuguggcuucggaaaucaccuuucgaagccuugcucuaugccagauucugcuccccaacaugacagauuaacaggcacaaccuaggauccuuugcuaccaguucucuacuagggaauuccacaguggcagcagaagcuaggagccauguggaccugcuuuucugccagucuugaaauauuuucugagaaaccaucugcuuuuguucagaagaaagugcugaacaucguucacagacuucuaggucuguaagcucuuuaggggcgggcauuaugaugaccaccggccuccuggaggaggguuggauaccuguggugugacaccuucugccaccaucuccugccgggccucagcccucgccugccugagcaggccuaguucuccugugaagcugucagccugaucucaugccacacugugaaaugaacuaugugccaguuuggaaaugauugcugaccugagaugcuggcugggcugcccuguuguuccugaauaagucagaagaaguuccaggugggaguggaauucagguuuggggcucguugguauccaugcaaaauaugacaaaggccuguucaagagggcauuuucaauucuguaggcucagcagaugauacugcccagccuuugggaaaauguccaguuggccccuggcuuaggacucuccacaaggaguuugaaaugguagggcuuauccccuaccagacuaaaaguauggcccaaauuauguguuuagaauuugcuuggccuuuaaacacgaaccauucccuaugccugguagagaccauuccagugucagugucccaccugggaccuguacaguccucaguaaauuaugauugcaaugaauuagaaggcuuuugccuuccauauccaucauccauuauagcaucugugcuuccaccugguuagggggagggaagcugaaaucauugauguaucaauagaaguaauuuagcuuaggaacuugcaucuauaacuuaccuuguuuuguuccacuuuaaagucaagacaagaaaguuaagauagcacacaggugcacaugcuuccagaugccacaugugaacauuuguugaucaugugacuaccgaugacacuuuagcuagaagauaaauuaaaucuuagcuaaaucauuguuuuuccuucugguggcuaugaggaugaauuugcucucagucuugaugcacugaaagcccuucaaacacaguaaaagaugaaaucacucaucuuuaaacugaggccuucagggaagcuuuuguaaaggacaguaaugaauuaggcuuucaguuuuaggacaucaacccuccgagaaaaggcagaaacccgagggaccauuuauuucccuucgaaacuguauagcccagggaauggauugagaugcuuucuccagacccuguauaggucaaccuugcagagguaaaggaggaggggcagguggaugaauaaaauaggauaaugcucagcuuggcaguggacuugccuuagugugaugacaggucuaacaugggcaagacaauuagaauggggaccaauaugccaggcaugggcuuuuaucucccuaguagaucccaagcuaguaggcuuggauucugccaaauggccagcccuccugucuucuccccguaccuuguaguuagaccgaggugagaauccugcugaccccagucccauccccucucauuucaggaaaacccuuuugugauucagguagggggagaggaggaguuaagggcuccguuuacucccaagucauggauuuuuaauauuccauuuuuaucacuaauauaccucucuuccuagaagcuacuggaguauugaguguugugggaaaaggcuaacugugaauuaaguuaauguuuuucuuauaagaaauggaaguuuauuuuuuuauugauauuacuaugugaugaacugaguaugcauauacugaaauggaaggaaauuuuaaaacuauuauucuagaagaaaugggcaguuuuguaauuuggugguggcugagaccccauagaaguuuuacuauguaaauaauuuggagagugaauaaggagauugugcuaugaaauccugacagcgcucuuuaggaggcagacuugacaguccuaggaagguugacauaaaaauaccaaccuucaguaaagcucuaguacaaaaaaggguaaaugucaucauucuuauuuuuaggccucuuucuugagagaggugggagugggagguaguguuauaacuggcacuuuaauuuguuuuuggaacuagaauuuaggggcaguuggaugaaauugcaaauuuagaaggggaauaagaauuuucuagugcuauauaaagaaaugaugauggagacaaaagccuugcuuuccucuuuuuagaauuuauuuucgauuuuuagcauacuguggggcuuuuagagcuaauaugaucuaaauucagaaaauuuaauuuucauaguaggccaggugugaauuacuuauguuugcuauagaaugcuuauuuagacuaacaauaaauuuacuuugcuuucuaaggccagucagcgaauguggggaugaggcaggauguuuuaaaugagccagagaugauccacaaagugaacagucgacacagaggucuuugaguuggaugguugcaaauauauugacauuagagugaaaacuccuuccuuuggguaaacuaaagaaagauaaaguauacuaaaaaauuuuaagaugguguuauacaaaaaaaaguuugggucuaacguguccacaaagacugucaagugaagaaugguggagauucuugguguuugagcagccaaccuggaugagugacuucagggacagagcagaggaaagcaaaaugaauuuccuuuauuuacccaaaacuuguugacugaauuuuuguauagguccgggaaaauaagccuaaacaaauaguuguagccuuagaaaaacuguuuucccauuucuuucugaguuagaaucagcauagccucccugucgccuuaaauguaaaaauccuauuuugauuaauaccccagccuaagaguuauagcaauacgagagacugaaucuauuuuuguuucgggucuuuaccucauaguaugaaauuaguaagacacugcauagauuuugcccugaauacuggugugcccagguaugccgugcucucucucuguuuccaguggugguaauuuuaaggccuaaagaaagcugggguuaauccugaagcuaaaaguaaauguuucuugaauugauuuuguucugugguacaaauaacaucuaugaauaucauaucuguauauaucugaaccaaguugugugcagagagguugauauaacuauauuuacagaaaaugauuuuuacaauuaaaguucacauuuuaacaugaacgugcgugcugcaaucccuucuccaguccgagaaaugugguuugugguaggaaggaaugguggccuacuccaugagcagagccugugggggcugaaccugacuucacuuacagugaugauggaggagauuggggagcugcuaccuguccuucuagaagccacggucuggacaaacuuucuccagguaaugggaaacaaaguugggaauaacugcgccacccagaagagccagggcuguguacccuuaauuacaucaggaaacuucuagaaucccacagagaccaccacccuuuuacuuuacaaacucucuuaucaaaguucaguuuaaaacuuuauguacuugauauauauuugguauauguguauauucuaaacuuuuauuucauuuuuaaccucuuggggaguuacaguauguauuuagaaccgguauagagua

SEQ ID NO: 14602 - RNA, 1738 nt, Homo sapiens
ggggguaaaaugcugcauaaguacauucuuuauuguuauaucauagauuuuagauuagaaguggcagccuagggcagucauugauuaucuucuuagggauagggguuaaaucacauuaucauugcagugcugacguguaggacacggagguucauaaacaucccguggaguagcacccagcacauagcucuacuggguccuuuugcgaacaggcaaaccauggagccuugcugaacccuggaugaacuguguaccuccuucucuugccaccuccuucuuucuauuuuaauagcuauuccuauuuuuauacacaucuccucuuaaagaguuacuuagcugcuagauuuaccucaaggauugaggcauguaaaauuuauuuuuaaauauaaaauggggguucacagaaaaccccuaauccauuuccaaagccaucagcuuuagagcugacuuuccucuuucuccccugagcaacuuccuuuuccugaucuucugagggaauaucccucgucccacaaaugcuccagcaccuccuaauuuaauacccucaaguuguauauauaccaggaaauaaacucauaaucuccauccuaaucaguuuguaauauaaaaggaagaacaaaauucccaaacuuuaacccuauggccuuuucaguguuuauugaugaguauauugcaaacaccuggguagccagagcaccucugcuucacuccucugcuuagaagcagcuucugccacacauccaggauuauguaauacauaucugucacgguccacaggaccagcggacuuuaaaaaauaauggugacauaaaaacucacagugguagcuauaccacggaacccuaggugagaaggcaccuccacccgcacacagguguauggacgcaaggaugaacguuccggccgcacgcgucccacacacggacgugcacacgggcgccuccgaauaggcucgcgguucccgaagccggcuccgcggacgccugcucuggcuccgugggaaaggcgccuccgcggcggggccccgggcagcgccagacccggcgggcggcggcggcguuggcgcggccaggcgagggggguucccgcagcccgcccgccccgccccucgcgcccgcggcuccgccucgccuagccaugguggagcagggagacgcggcgccgcugcugcgcugggccgagggccccgccgucucccugccgcaggccccgcagccgcaggcgggaggcuggggccggggcggcggcgggggcgcccggccggccgcggagccgccccggaggcgggagcccgaggagccggccgccccggaggugcugcugcagcccgggcgccuggagcugggcgacguggaggaggaccaggugguggccguguucguggucaccuucgacccccgcucgggugagggccgcgccggggccaggcgcguggggagggucggggugcccccgagcuuugggggcgcgggggaggggcucgcugcgcgcgcaccugcccucccggccccgcaccccgcaccagggccggccccgggcucccgggcuuggggaagggcgggggucggccaguccucagcucucucccucggggcgcagcugggugcuggcgcgcggccucucggagcggccccgagggcuuuguuccagccccgccgaccuccucuccccuccccuccucuccucugagucccagccccacagugguguucgcacuucagugacagggcauccgguu

SEQ ID NO: 14603 - RNA, 3596 nt, Homo sapiens
ggcggauggaucaacgccgccaaguggugaguuuggaagguuucaaguuuagaagguuucaaguuuagaagguuucaaguuuggaaagaaaugaaauuaugugaugagguuucuaacugggcccaggagggggcgagguaggcaaaacagagacuagcucugccuggagggaaaaaaaagcaacauuugugaccagccuaggcgacauagugagaccugucucuacaaaaaauauauaauuagcugggcgugguggcgcgcgccugugguccaagcuucuccggaggcugaggucgggggaucgccugagcccuggaggucguugcugcauugagccgugaacgcaccacugcauuccagccugggcaacagagcgaacucuaucucaaaacaaaacaaaacaaaacaagaaaaagaaaaaaagaagaaaauuaaaaaaaaaaagaaagaaaaagaacgucccaggucuguugaagcacuaagaaaagcagaaaaagaaaggggagccagggaagggcuggcaggcugugcaauuuaagggagcaccagaaaaacuggcaaucaaauaauauauuaauguaauauuuuaaaaaguaaaaauuaaugcaggaaauccgggaggaacaaaauaagagucauguguaccuuaacaacaggguaaggucugaggauugcgucauuaggcgauuuuguugcuguacgaacaccacagaauguacuuugacgaccuagaugguggagccuggacacaccucggcucugugguguggccugcugcuuccaggcugcaaaccugacagcauggggcuguacugaauaccgcagaccauuguaauucaugguaaguaucugugugucuaaacauauguaaacauggaaaagguacaguacaaaugcgguauaaaagauaaaaauggcacaccuguauggggcgcuuaccaugaauggagcuugcggaacuggaaguugcugugggugaguaaaugagugagugguggcccaacaugaaggucuaggacauuauuguacccacuaaacacuucauaaacacuguacacuuaggcuacacucaguuuauaaaaaauacuuuucuuccuuuaauaaacuuucacucacuauaacuuuauaaaucuuccaaauuuuuuuacguuuuaacuguuuuguaauaacaauuagcuuaaaacacacacuguaccacuguacaaaaauauuuuucuuauauccuuauucuacaagcuuuuuucuaccuuugcuuuuuuucuuuuuuuuuuuaacuuuuuagccauuuuuuaaaaaaacuaagacauaaacacacacauuagccuaggccuacacagggucauuaugaucaaucucagccuuccacuuccacaucuugucccacuggaagguuuucagaagcagugacacacagggagcugucaucuccuauaacagugucuucuucuggaaucccuccugaaggaccugccugaggcuguuuuacaguuaacuuuuaaaaaauaaguuaaauaauaauauaauaaaaaguauaguaaauacauaaaccagugacauagucauuauuaauaucaaguaacacaugaguaauacauugcauucugauguuuuagcagguaugaugucacuagacgauaggaauuuuucaacuccauuguaaucuuaugggaccaccuuuguauaugcacuguuguauaugcagucuuuuuccaaaacaucauuaugaagugcaugacuguauuaaaauuuuaacugaauacaggauccaagccagacuggagccugaggcacaaggaagaauaugcaccccuguguauauguguacuuauguauuuuuaaaaauuggggcuaggaagguuaguggggggcuggagggaagguggggaugguuaauggguacaaaaaaauagaacgaauaagaccuacuauuuucgauggcacaauagguugacuauagucaauaauuacuuaacuguacauuuuaaaauaagaguguuauuggauuguguguaacucaaaggauaaauuaagaugauaccccaucccccaugaugugcuuauuugacguugcauaccuguaucaaaauaucucauguacuccauaaauauauacacuuccuuugaacccacaaaaauuaaaaauaaagacaaaaacaaaaaaaaauguuuaauuaaaaaaauuuuggccagguccaguagcucauguuuguaaucccagcacuuugggagguugaggggguggaucacuugagcccaggaguucaagaucagcuugagcaacauggcaaaacccugucucuguaaaaaauacaaaaauuagccaggcagccgggcgccguggcucacgcccauaaucccagcacuuugggaggccaaggcgggccgaucacgaggucaggagaucgagaccaucccggcuaacacggugaaaccccgucucuaccuaaaaauacaaaaaauuagcugggcgugguagugggugccuguagucccaacuacuagggaggcugaggcaggagaaugucgagagcccgggagacggagcuugcagugagcugagaucgugccccugcacuccagccugggcaacagugcgagacuccgucucaaaaaaaaaaaaaaaaaauuagccaggcauagugguaugugcuuauaaucccagcuacugaagugggaggaucgcuugagccugggaaguugaggcuucagugagccaugaucacaccacugcacuccagccugugcaacagagugagagacccugucucaaaaaauauauauauguguguauauauauauguguauauauaucaauauguaugaaugaaauauguguguauauauaucucaauauauauacacauauauauuuuugagacgguauauauauaucaucacacaaaauauauguauguauauauguguauauauaucaauauauauguauauguguuauauaucaauauauauacacauauauuuccagaacauuaaaguaguugaagaaguauugaaaauuuuuaaaguagauauuguaacaagaaaaacccagaauugcauuaauaaaaaccuucccccaaacugagaggaagccgagaaaccaaagauugacccagacaaguccagcuuggcgaguagaggaguuuaucaggacuuacauacaaggcacuccuggauggcagcaugacagcuguagagauccgccuggccucccaucccuaagcuacuuguaagcuaauuuucuggcuuuuagccuacugugugugauggagcuguuuucuuugguagguucucagauauucucugggauguuuggcuucucaaacagcugcucuuuggcuggucaccuuggccuugccacauggccuucaggauucaggcaguggacauacacucuuuaguaacccgggugggggggaccuguuacacuacagguguauuaaaauucacaacauuguuuuaaguuuaaauauuuuauuuaugccaagauggauguaauauaacuuuacuuuuaauggaaguaaacugaucaguaauguguucaaaucugcuuugcuuguuuugagagaauugccaugccuucacaauuuuucuug

SEQ ID NO: 14604 - RNA, 21165 nt, Homo sapiens
gggaaucuguggauacggagggccaguggagaaugaaugcaaguggaggcaggcauugggcagaaagcaaaaugcaaacuucacauaccugaguucaaccuccaggugugcauccuggaagaugcaugacuuugacaaguuauuuaaccucucccaguuuuggguuuccucaccuguaaaaugggauuauuguaccuucuucuuaggauaauggcuaaaugagacaaugauaaaaaguacuuagcuuagcucgguacauaguaaccagaagagaaaugacagucauuaauaugauuauuguuacaucuuuaagagauuucccuguaauucauuaaccuuggacuugccucucauuuuccacaacgauuuucuugcuguuacucccacaaaucuucacagaauauuaugcaaacucuaacagaaaaauagcaaggugauccugcccucauuuucuuuucaagucccaccuaaccgaaugacaaacauuuaucaaucuccaugucacugugugaggcugaguuagauuggggaaaaagggugguuuuaguaaaagaaaacccugccuucaagaauugccaugaucucauuagggaacaaagggaaaacagcacuaauuucuccuaacuuggcugcaaaaguuaggcuguaauccacauugcaaugacaaguaauuccuaaagaaauguauacucuauugccaaaacugccacagaaauauaucuuugguguuuuuggaucaucuuugaauaaaauguccaguguguuuuaagaaaugauugauucuuugagaacuguaaaggcagcaaacaguagaucucauauagguugguuuuuuuguuuguuuguucguuuuguuuuugagauggagucuggcucugccgcccaggcuggaguacaguggugugaucucggcucacugcaagcuccgccuccuggguucaugccauucucccaccucagccuccccaguagcugggacuacaggcgcccaccaccacacccagcuaauuuuuuguauuuucaguagagacgggguuucaccauguuagccaggauggucucgaucucccgaccucgugauccacccgccuuggccucccaaagugcugggauuacaggcaugagccacugcgccuggcuagguugguauucaaaguaaaucauuuugggcuguguacacguauuaacagaugaaugaauuauaaaagcaugagaugcuaaaauacagauagugggggaaaauauauaaaagauuuucucauucauauccaguaaagugguacucacuaaaagugaaugaguaaauuagucuggcucagaaauaauggaaagguuuuuuuccccagauaaaaaguuuuauuuuuuuauuauaaaaguaauauauguucaaugcuaaaauauauauuuaaaaaacuguaaagaaacaaggaaaaucacgcauaaucacccucucuagagauaauaacauccucauguuucucccuccagacauuaagccuaucuucauuacaacuucuuuuucaaaaaugggauaccccagacauacuguuugaaacuuuuucucccauucuucuagguauacuauucaucuuaccauuuaacaggaaacuccaaaucgaggucacagugcaguuuucugagguuuauucccugacacuaucacaucaaaaagggaaaugcaagacccaaaacuuggguuagaagaccccuagucuuuuacugcuauuuacugcuaucauauuuccaaaugcgcucuuccuagaccagcuagggagcaggagaaaguuucucagcagauagggcuucccagggguaggcaaaguuucccuagcaagucugacugacuugaggcgagaaucauucugcuagaaucauacgcaugcugaagacugcaugcuacacaccuaagucugauaaagcaccacugcuucagcuccacagccuuucagaggcauggagagaagaggcaaccuccaggggagaguuuaaagcagagccccucggcucacaaugauccagcacagcauccucuuccaccccugcauucagggcugagaaacugcuccagguugguaauuaagcucuucuguucaccaugucauuuucccaaagcagagauuuauuacccugcuuaaacaggacuguuaaucugcauaauuucucacaacacuuaaggaguauaaaagcugcugugcugauagaagaaagaguugcuaaaaagauaaauuuuauauacugcccaauuuugcuuaaggaauguggcaugaaggaauaaagacuacaucaccaggcaguuuuaaugugugaacuuaagagagcagaguuaauaugcugauuaacugucccagcugcaggaaaaagaaagauggcuggcaggagaaaacagcaaugaauuuucuacuguuccugagcaaggagaggauaaagcuaaaaaauuccaucuuuccucaaccaaaaugcauuguagguauaaaaaaagcuacucaagugugcagaaaauaccuuaaaacaaaaaagucacagaccuauaacauagcuugggaauucugaaccuaauaaaguccaauaugaccuaagcuacaguuagcacuguacucguacucucaggcagagaggacagaacauguaggcugggaagcaaauauauaggcugggucagaggccaaacuggagacagaguggccuagacaguacgagagacuucuaccauuugaacaaaacaaccugcacaguggcagccaaccucugggauacagcagcaaacuggcaggcagaccucgggagggcugauguaaacuuuaaagagcaaaagaugcacugaaaaacugaguuacuauuucaucuuuauuggcaaauuauuaguauucuaaaauuuccugaaucuuguaauaaaaaguaagauuacaugauguacauaaugauucauguggaaaaauaaaaggaaaauguaggaccuaaggcucuaagggaggcacugacagagguuguuaagaggauccucuucuaccuuccccaagaguucugaagaagacucuaaaaggauagauaagaggggcagagaaagauagaauagaaccacagcuccuguggcaucaccuggagaugaacgauuucaucucuaguuauauuucagguccuuauugcugguaaacuauguuucaucaaugcuaguaaugaaacuguccaaaaacaaaagauaugaagaagguagguuagucuuaaagauguuuagguuagacacuaaccacugcucagcaacccccuucaauuugaacugaagcuuagaaucccauugggaugauucaucuaucaaugccccauccacagguguggaggggcaggccaccccuucaccuggugcccaacgugggugcuuuucucuagggugaagguacgcucgagcguggucauugaggacaagucaaugagagauucccaaguacgucuacagucagccuugcgguaagcuugcgcgcuuggaaaaagccaggguaacaauggggcaaacuaaaaguaaauaugccucucaucucaauucuauuaaaauucuuuaaaaaaaaagggggggaguuagaguuucuacaaaaaaaucuaaucacacuauuucaaacaauagaaaauuuugcccaugguuucuagaacagggaacuuuauaucuaaaagacugggaaaaaauuggcaaagaauuaaaacaagcaaguagggaggguaaaaucaucccacuuacaguauggaaugacugggucauuauuaaaguagcuuuagaaccguuucaaacagaagaagauaguguuucaguuucugaugccccugaaagcuguuuaauagauuguaaagaagaggcagagauaaaaucccggaaaggaacggaaaguuuacauugugaguauguagcagagccgguaauggcucagucaaugcaaaauguugacuauaaucaauuacaggaggugauauauccugaaacguuaaaauuagaagaaaaagguccagaauuagcagggccaucagagucuaaaccacgagggccaacuccucuuccagcaguucagaugccuguaacauuacaaccucaaaugcagguuaggcaaguacaaaccccaagagaauaucaaauagagaaagauagagucucugucacggcaaugccaauccaaauacaguauccacaauaucagccgguagaaaauaagacccaacugccaguagccuaucaauacuggcugccagccgaacuuaagugucggccacccccggaaaaucaguauggacagccaggaauguucccagccccacaggacagggcgccauacccucagccacccacuaugagacuuaauccuacagcaccaccuagugagcaggguaguguauuacauaaaauuauugaugaggcaagaaaacaaagagauauugaggcauggcaauucccaguaauauuagaaccaauaccaccuggagaaggggcccaagagggagagccuccccuagcugaggccagauaugagucuuuuucuauaaaaaugcuaaaagauaugaaagagggaguaaaacaguauggacccaacuccccuuauaugaggacauuauuagauuccauugcucauggacauagacucauuccuuaugauugggagguucuggccaaauugucucucucacccucucaauuuuaacaauuuaagacuugguggauugauggggcacaacaacaggucggucugaagaaacagggcugccaauccuccaguuaacauagaugcagaucaacuauuaggaacaggucaaaauugaagcacuacuagucaacaaguguuaaugcaaaaugaggccauugagcaaguuagagcuaucugccuuagggccucggaaaaaauccaagacccaggaaccgccugccccucauucaauacaauaagacaaggcucuaaagagcccuacccugauuuuguggcaaggcuccaagauguugcucaaaagucaauuaccgaugagaaugcuuguaaggucauaguggaguugauggcauaugaaaacgccaauccugagugucaaucagccauuaagccauuaaaagguaagguucccacagaaucaaauguaaucugaguauguaaaagccugugauggaggaggagcuaugcauaaagcuauguuuauggcucaagcaauaaugggaguugcuuuaggaagacaaguuagaacauuuggggggaaauguuauaauuguggucaaguuggucaucuaaaaaagaauugcccagucucaaauaaacaaaauauaacuauucaagcuacuacaacaacagauaaagagccaccugacuuauguccaagaugucgaaaaggaaaacacugggcuggucaaugucauucuaaauuugauagaaaugggcaaccauuguugggaaaugagaagaggggcccgccucaggccccacaaaaaacuggggcauucccaauucagcccuuugcuccucagggauuucagggacaacaacccccacugucccaagugccucagggaaugagccaguuaccacaauacaacaauugucccccaccacaaguggcagugcagcaguagauuuauguacuauacaagcagucucucugcuuccaggggaacccccacaaaaaaaccccacagggauauauggcccacugccugaagggacuguaggacuaaucuuaggaagcucaagucuaaaucuaaagggaguucaaauucauagugguaugguugauucagacuauaaaggcgaaauucaauugguuauuagcucuucaauuccuuggagugccaguccaggagacaggauugcucaauuauuacuccugccuuauauuaugguuggaaacagauaaaaacaggaggguuuggaagcacugauccgacaggaaaggccgcauauugggcaagucaggucucagacagcagaccuguguguaaggccauuauucaaggaaaacaguuugaaggguuaguagacacuagagcagaugucucuaucauugcuuuaaaucaguggccaaaaaauuggccuaaacaaaaggcuguuacaggacuucucggcauaggaacagccucagaagugcaucaaaguacuaugauuuuacacuguuuagggccagauaaucaagaaaguacuguucagccaaugauuacuucaauuccuguuaauaugcggggucgagauuuauuacaacaauggggugcggaaaucacuaugcccgcuccauuauacagccccacgagucaaaaaaucaugacuaagaugggauauauaccaggaaaaggacuaggaaaaaaugaaaauggcauuaaagucccaauugagacugaaagaaaucaagaaagaaaaggaauaggguauccuuuuuagggguggccacugcagagccuccuaaacuuaccauuccauuaaguuggaaaacagaaaaacccguauugguaaaucaguggccgcuaccaaaauaaaaacuggaggcuuuacauuuauuagcaaaugaacaauuagaaaagggacauauugagccuucauucucgccuuggaauucuccuguguuuguaauucagaaaagauccagcagauggcguauguuaacggacuuaagggccauaaaugccguaauucaacccaugcgaccuauccaaaccggguugcccucuccggccaugaucccaaacgccgggccuuuaauuauaauugaucugaaggacuacguuuuuaccauuccucuggcggagcaggauugugaaaaauuugccuuuacuauaccagccauaaauaauaaccagccaccagguuucaguggaaaguguuaccucagggaaugcuuaauaguccaacuauuugucagacuuucauaggucgagcucuucaaccaguuagagacaaguuuucagacuguuauaucauucauuaugcugaugauauuuuaugugcuacagaaacaagacaaauuaauugacuuacacauuucuguaagcagagguugccaacgcaggacuggcaauaguaucugauaagauucaaaccucuacuccuuuucauuauguagggaugcagauagaaaauagaaaaauuaagccacaaaaaauagaaauaaaaaaagacauuaaaaacauuaaaugauuuucaaaaauugcuaggcgauauuaauuggauucggccaacuuuaggcauuccuacuuaugccaugucaaauuugcucucuaucuuaagaggagaaccagacuuaaaagaauauuaaccccagaggcaacaaaagaaauuaaauuaguggaagaaaaaauucagucagcgcaaauaaauagaauagaucccuuagccccagguugggcgccagaugaagggguggccugccccuccacaccuguggcuguuucucgucagguggaacgagagacuugagaaaacaaagagacacagagacaaaguacagagaaagaaaagugggcccaggggaccagcgcucagcauacggaggacccgugccagcacuggucuccgaguucccucaguauuuauugaucauuaccucuaccaucucggagagggggauguggcaggacaacaggguaauaguggagagagggucagcagcaaaacaugugaacaaaugucucugcaucauaaacaagguaaagaaaaaggugcugugcuuuugaugugcacauauguaaacaccucaaugccuuaaagagcaguauugccgccagcaugucucaccuccagcccuaaggcgguuuucuccuaucucaguagauggaauauacaaucagguuuuacacugagacauuccauugcccagggacgagcaggagacagaugccuuccucuuaucucaacugcaaagaggccuucuucuuuuacuaauccuccucagcacagacccuuuacagguggcgggcugggggauggucaggucuuucccuucccacgaggccauauuucagacuaucacauggggagaaaccuuggacaauaccuggcuuuccuagggagaggucccugcggccuucugcaguguuuugugucucuugguacuugagauuaaggaguggugaugacuuuuaacaagcauucugccuucaagcauuuguuuaacaaagcacauccuacauagcccuaaauccauuaaaccuugagucgacacagcacacagcacuuguuucuacgagcacaggguuggggguaggguuacagauuaacagcaucucaaggcaaaagaauuuuucuuaguacagaacaaaauggagucucucaugucuacuucuuucuacauagacacuguaacagucugaucucucuuucuuuuccccacagauaacaggggcagagaaagaacagaacuacagcuccuguggcaucaccuggagaugaacgauuucaucucuaauuauucagguccuuauugcugguaaacuauguuucaucaaugcuacuaaugaaacuguccaaaaacaaaagauaugaagaagguagguuagucuuaaagauguuuagguuagacacuaaccacugcucagcaacucccuucaauuugagcugaagcuuagaaucccauugggaugauucaucuaucaaugcuuacugaguggcuauucuauguaaagcaugguuuaaagugcaggcaaacagaagauucaguccuugccuucaugucuacagagcaaaacguuaagaaaaucaauauuuacaaauaugggauaaaugucucacauacagugaugcucaguaaauucacugauuggacaaaucaauauuguaauaaaaguguauacaaaaaccaggagaccuucccaaagcauauuuaucccuuugccauaacacaaaugagccugaaaguuuacuauuuuguauaccuguacauagaaaccacccuuagaagaauaaacaacuaguaaaugccauaacagauaguagcuaccaagauuauaccacaaaaaggagagcgagaacgacagucagaaaaaagauuauuacucauuuuacguaaaagaguauuuuaauucuuguccuuggaagccauaaagauuauacaugacuuggaaaugagacuguaccaaaugauggccaaagaagaaucauccuuucuacuccuucucuuucgucuggucacucagaaauauaauauuaucuguaaaaaagccaaaauguaaauauuaauuucagaacucuuucuccaucucauucaauaauucuccucuaauacauauaacuuuagugcuguucauuaaaaggauuuuagccaucuuuucaaaauauuaaaucacuugcuaugcucacgagagguauauauacaguuggcauaaguggagcuacaaguuaggcacuggcugcuuuucgaacaauucagaucuuguuagaagaggugggauauuucuugucuuccagucuucucagaaacaauuuccugcaaaagaacuggucacaaaauuggaugcuugcaauggucaggcagauuccacgacacuaggcagcacauccucagagaaaaggacaaaaguguaucacauucuacacucugggggucuagaggaaagaguaagaguccauauguggcccuguuagcaaugacaggauuuacuuacguuuuuaacuuuaaaaauucaaauagaagaaauuuuauuuuuaaauuacaauacagaauaacuuuuuguuuuuccuuuggagauggagucucugucacccaggcuggagugaaguggugcaaucucagcuuacugcaaccucugccuccuggguucaagcgauucuccugccucagccucuccaguagcugggauuauaggugugcaccaccaugccuggcuaacuuuuguauuuuuaauagagacaggguuucaccauguuggccaggcuggucuugaacuccugaccucaagugaucugcccgccuuggccucccaaagugcugggauuacaggcaugagcaccgcaccuggcccagaauaauuuuaauauaccaauucuugggaacauuuuaugaaucaacaucacagaguuagcauuuuuauccaaaaauaucagacguugcucuuaaaaugcuguuccagagggaguuagcuaaaaauaaacaaaagaacagaggcaaguaguagucauccuucaguauccauugggggacugguuccaggaccccuauagauaccaaaauccacaaugcucaagucccugauauaaaaugguauaguaaucacauauaaccuauguacuuccucuuauauacuuuaaaucaucuuuagauuacuuacaauaucuaauacaagguaaaugcuauguuaacagcuguuacacuguauuguuucacuuguauuuuuguuguuguuguauuauuuuuauugguuucuuuuuuucacauauauucaaucugugcuugguugaauccacagaugcagaaacaagggacauggaggaaugacugcauuuccuuuauaauuccaaaagauucuuguaacuauaaaauuauccaccaaggacugaauauuuguucaugaccauagucuuccaaaaacuagaauguuuugguccagaacgguuacuucagaacaaacuacucgaauuaauaucacuguggaaaaagccaagagugccauccacugguggugguuuuuuaguuacagauaggaucccuaggagaaaaaaaaaucaccaauaaaacagaucaaccaauaaacucuauuuucuucaauucaaaugucacugaagagcucuucaauuuuaccauuagacauaaaccuaaaguaaacugacugugcuaguggaaccuagugacaaggaaaaaaaacaaaacagcauaucaucugaaaugcuuccguuuggcuuauuaguaacaacucaauaauccgaacaaucuaaaguuugcccacacuugugguuuauauugggacccacaggaggguaggaaaauaccuacacugcuuuucaagguuaauacacuuucaaagaaacuuagcaguaagaaaccaugugagcauucuauacaaauuauaaauuauuaauaagguauggugguuaagacaugaacucuggagcaaaggaaagaagaaagauaaaaggcaaaucuaagagacuuaagguagaaaucauguaauauaauguaugaauguuuaugaaguuaucaaggaaauuugaacacuacgauauuuaguaaaaaaauuaacaguaauuuauuaauauuaggugugauaauagcacgguaguuacauuuucaaaaagacaccuuaucuuuuagagaucccuauggaaauuuaugaauaaacuuaugucuagaaucuguuucaaaauaauccagguguaggucaagucgcuggaggcauggauauaacacuguccaucagcugacacugaagcgaaaugguaggaguucauuuuaccauuuuuucugcucuuauacauguuugacauuuuccauaguaaaaaaaaaaaaauuuuuuuuuuuuuuuuuuuuuugagagagucuuccucuauugcccaggcuggagugcaguggugugaucucaauucgcuacaaacacugccuccuggguucaagcaauucucaugacucagccuccugaguagcugggacuacagacacgcauuacuagacccggcuacuuuuugcauuuuguguagagacaggguuucaccauguucccaggcuggucuugaacucuugacuucaaaugauccacccaccucagccucccaaaggccugggauuacaggcgugagccacugcauccagcccaaaaaucaauuuuuaaaaaauauuaucuagccgggcacgguggcucacgccuguaaucccagcacuuugggaggcugaagugggcagaucacgaggucaggaguucgagaccagccuggccaauauggugaaaccccaucucuacuacaaauacaaaaauuagcugggcgugguggcgcgugccuguagucccagcuacucaggaggcugaggcaggagaaucgcuugaacccgggaggcgaagguugcagugagccaggaucgugucacuguacucuagccggggcaacagagugagacgcugucucaaaaaaaaaaaaaaaaaaaaaaaaucuaauuugggcauaucucagaaguucauaaacacagaaacauuaauauaguaaaauuuaguuuauugccauguauuuauuuuaaaaagcuuucuuaguauuuauguccauaaaagcaaacaaaagcacaaaauucacaaugucuaauuuuagcaauuuacucaagaagugaaaaaagcaccaucuaucucauuuaaagacauauuuccaauauaauuuaaauacauuaaaauuguuuugaucaauuagguacuaaaaacaacuuuaaugauaagucaauugagaagaauuugucauagaauucuuuuaaauauuuuaaaguuucuuuuaugcaugcauuuuuguuacaaacaggguaauaaaaaguucuuaacuauaccauauacuauuaagauacacuucugaggggaaaauaaaaacaguaaaacaaguucaaagaaaaaagaauaauggaaaauuuccaaaugcugaacugguauuuuuuuacaggauaguagguaucacauugcuaugcuauuuagauuccauugauacauuuaaaaauaacacaauuuuguauugaaaaaaauuucuuaaugucgcuugcagacauccagagggguauauuauuuucaaaauucuuauagcauuuucaaaaguuuaaaaacucuuuccuaagggauaucuucuuaaucuucuuuaaccuuuacguguacaucuuuucuauguuguacuguauuuuguuuaaagagaauauuaggccgggcauaauggcucaugccuguaauuccaguauuuggggaggcuaaggugggaggaucauuugagcccagcaguuugagaccagccugggcaacauggugaaaccucaucucuacaaaaaaauugacaaauuagccaggcaugaugguguacaccuguugucccagcuacuugggagaaggcugaggugggaagaucaccugagccuggggagguagaggcugcaguaagcugugaucacaccauugcacuccagccugguugacagagggagacccugucucaaaacaaaaacaaaaaaagagaaaauuaaaaacuucuuggcugggcacaguggcucaugccuguaaucucacaacuuugggaggccgagguggauggaucaccugaggucaggaguucaagaccagccugaccaacauggugaaaccccgccucuacgaaaauuacaaaaauuagccaggugguguggcacgcaccuauaauccuagcuacucaggaggcugaggcaggagaaucacuugaauccaggagacagagguugcaaugagccgagauugugccauugcacuccagccugggugacagagugagauucuggcucaaaaaaaauaaaauuaaaaaaaucuuaauuucaaauagaaauuucacauacuaaguaccaaagagguuccgaauaaaucugcacacucacauuaguguaauucuuaucuuggcauacgcuucuuccugguuagggcuagauccuuccaaaagacaauacauucagaguuuuuguaauucucaacaauaaguacugggauggauaauucaguuuuaggcuuuauucaaaaguuacuugugacuaaaacuguaaguauaaaaauaauuuuuuaaaggaagggauaaauguacaaacucuuagcaaguagagaaauaagaguuauggacaucuucuagugaguugccuuaacucauaaguacugguacucuuaacccuaguuaguuacaguguagccaagcuuuuaaaaaagaaaaggagaaaaagaaaaaaacagcuauuuucacaagcuucuuaccagcuaugauuguuguugcuugucgccucacauuauuuuuauccauguauucaccauagucuauuuucccuuccaaauaaauucgagaccugauauaaauaaaauguacaguuuuuaguugagaucuuaauaugcuuuauaagagucaggucagggugguacugaguauaugacaaggaugaaauauauaaucauauauaagcuaauuuuugcuaccacuucucaagguucaggauuaggaguacugaaacagaguguccaaacagacuugguaacaucuagguaaaacagacaauguuuucaucugucagcuauuucucuuacggaaguuaaaaaauaaaacaaaacaguucaaagggaaauuuaguggcaacauuuaaaucucuaggaauaauuuccaauguaucauuuuccuugaccuuugauuuuggagucccuaacagacuugauuuucacuuauuuaucaauuauuuucuaugaccuuagaaacuuagaugauuaaaauucaaaauauggauuuguaguuaguuuaguauaauauuacccugaguuaauuacuaagacuauuucuacacuguaucagcuuaguauaccacuuagagguaauuacuaagacuauuucuacacuaucuagaggcuaaacuagauaacaaaccuaaucgugauuuucaagaguggaaagaugacaauaguaccaguuuugagagucuaccaccaccaaaaaaguacaacacagaaagauuagugaaacaucaggugcuccccaccccacacacacacccaucaaucaguaagugggagugcagacacuucccuugaaauaccuuauauguguuuguguguguaugugcacauauucauaaacauacauaaagggcaaugaagauacauaggaagaaaagcuauacaguuauugaaaagaaaaauuuuagugauugcuaaauuauuuuucauaaaauauguuuucuuucuacaaaacaaguacauuucuaaacauauuaacuaucaauacaacugcuguuacacacaccguuuuguccuucuaugaguuuggaaaacauacuuuuuauacauacucaauccaagccuuccaaaagggaacuauuaagccuacagaaaaucaucaaauauaaaauaacugccacgaagaugaaguuggcaugucaggcuucagacauuccagauccucugcuggaaauaccauguggcagccaacaggcaagaagccacccucagcauccccggccacagaggcacaggaauuccucaaagcagauguuugacuugcucaaaugccacuugauacacuuugccuucucuccugccucaucuauuucuauuuauguacacacccuguuugcccuaaacuguaaguucuuagaaagcuaaaacuauguuuuauauaucuucaaauuagucacacauggcaacaugccaugcauauaguaucaaggacuuaguaaauaccucuuaaauuaauacagucauuaguaguacucagggauuuaagagacuacacacuccuugccaugagaacacuucuuaucgguucuuuaaaucauucaauucauaagauccuucccucuucaacuuaccccuuuuucacauauugauaugccacgucucugaggccuggccggaauacugauauucugugccauguugucuuuugacugacaucaccuaaaucauaaaaauaggaaauugguuacaaaugccaacagacaacaugcccaggaaaaccaaugucacgauuucuaagagaacaaacagaaugaaagacagaucuuguuuaaagugguuuaucucuaaauuagauaacuggcaauaaauaauaucuauuuauugcugauaaaauuaaaaccccagucuuuuguacucacccaguugguaaacuucacuauccccugaucgccacaucucauuaguugcuagagaaaauauugugacuggauuuuuuccuuccaccugucucaagacaggguccugacccacucgcccaaguaagugcacacgauucagggcugaaacacaacaucaagaccaaaugagacaaccugcuauagacugaauaguugugccccuucccccaaaauuuguauguugaagcucuaacccucaauguaaugguauuuggaagugggauccuuaaaagguaauuaggcuuagaugacgucaugagggugaggugucccuauaggaacaggaagaguucagaacuuucugucucuaccauaugaagacacggugagaaggcaaccaucugcaagccaggaagacagcccucgccaagagcucaaucauacuggcacacgaaucuuggauuuuuagccucuagaacugugagaaauaaaugcuguuggugaagccaccuggucuaugguauuuuuuuauagcagccucuaagcugaccauuaaagaaauccacaccuggcugggcgcgguggcucacgccuguaaucccagcacuuugggaggccaaggcgggcggaucacaaggucaggagagagagaccaugcuggcuaacacggugaaaccccaucucuacuaaaauacaaaaaauuagcugggcgugguggcgggcgccuguagucccagcuacuuggaaggcugaggcaggagaauggcaugaacccgggaggcagaguuugcagugagcggagaccgcgccacugcacuccagccugggcgacagagcaagacucagucucaaaaaaaaagaaauccacacucaagacugagagaaauguccagaagaaaugcuauaaauaugacuucaacuucaaucucugcauuaaguaaaacccaaguucuggaagaucagaaaauaaguuaaggaaugaauaaggagagguugcgagagaagagaguuggcaagaaagaagaaaauagucauagagaaagcagccccacaaaacaaacuguaagcucuagaucuuaaauucuuuaagauaucuuuuuuaacugacuguggagcuaaaagaacaaaucugagaucugaaaaucuuuauaaacacaagggaauauuucugugaagaaacaauaucuuuuacaaucucagccuaauacaacauaacccgggaagacucagauaaccaaauaugacucaaggaaauucuuaugcaggacaguguugacaagaaugaguaguaacuggcugauaaggagaacaggggcucaguuuauacuaugucuccacagccugaugugucaaggcuaagaucugaagagcaaacaugagcuaaaagcacaauggcaacaugguuaacccaagcagcauaccucuucuacaacacauuugagauuggcaaauuacuaaaaauaacauuuuaaacuuggaaauuagcuacuuacaucuuucaagaaccaaacugguaguuguuucggacucaugucuuacaaacugacgaaguaccuaaagaagaacaaaugaauaacauggcuuuaauuuuuuaggaaaggcaaaugcaaacagaagaauuacucacguucauucaccauauagucaguaguuccugaaaauuccagaagagaagagaagcucuucucauguucucccaacagagugccagaaggccccggcaaacacuucaagagcagccuaaugcagaagcccaaagguagaaggaagguacuagaaggcaugcucaaaguuaaguuauaguacucccauuuauuuugcgacaucuccuugauuauggcacuucuguguuugcacacaaaaggaaaaaucaaaauaguaucacuuuaacauuacagaguaugauaauauuuguaaauccaaccuguaccuaagaguugcugccaaguauuuucaaaauccagcuuucauuagcuggaaagacaaaaagagacaaaaaguacuacauauauucaauauauacauccucuaauuuuuuuuuuuaguauaaacaacugguauauuacuacuguauuuugguuacaguagacuuuagaaauuaagaaauuuagauccaacauggguacugauuuaauccaucauuagaccaaaggagaguuaaaagagaugcuuuauaauuaauaauuuaauaaguagauucauuaauaacauaugcaaugaucaaacaagugucaggagguguggaauaaaugcaaagccuuacucucaggcauaacgaacagccaguuagaggagaguccccaaccuccagggcugaggacuaguagaguucuguggccuguuaggaaccuggcugcacagcaggaggugagcagcaagcagcgagcaagcauuacugaccaagauccgccuccugucagaucagcaguggcauuagauucucacaggagcagaaccccauuauaaaccgcucaugcgagggaucuagggugugcacuccuuaugagaaucuaacuaaugccugaugaucugagguggaacaguuucaucuugaaaccauccccacggcaccccccuccuccauggaaaaauugucuuccaugaaaccaguuaucagugccaaaaagguuggggucugcugguuuagagaacgagagauagguuacauuccaacaaaacaauacauucuaaaacuaaucacaugaaugacuuucugacacagcaacaggaacauauuccaaagucagauucccugugucuaugaaacugccuuccccugguugcuccuucagaccuuaaaaggaauuaggauaccuaauaugacuaaucuaaaguguuucauuuuaaaauaagcaaaaauuaugauacauaauaccuacuucacaaggcuauugcaaaaauuaaacagcuucaguagugagcuuagccuaauacaguuuuuauaaauauuucauaggaaauuuccuguuuuuagugcaucaaaaaaggucuaauaaauuugguucuuugauuaaacacaaagacucgacuguccaagucaaagucacaucacugucagcaaagguagucacuaccacauaauagcagcaaucauuacugaauaucagcuaagggauuuaucuauuaucaauucuaaaacuaaaucuacaaguuauguaaaauuauucccauuuagggcugagaaaacaccucagagagacugcaucaccugcccaagcuccugcaggaaguauguggcaagugaucucaaggacccagggcccuugacaccaaugcuacugcuuucccgaagcccucugcugccuccuuaauuucaagagcuccuguaaagaugggaguacacaucacugaauucagagcucagagagcuagccauucuaucagagaaacauuuuugaaguggcaguacuguuaauauaaaaagcagaaguccaccaaucaaauaaacaccaauccccagggugcuguuggcuaucuaauccuaucacuaaacuuaggagcagagggcagauaagaaaauaaagauaugaguacaacauacuauagaaucaaacugcuaaugagaaccugugucaugauucuggaaaugucauuugagugcucagacaagcuagaccucauaaaucuuacacagagauuuauaauaacaaugucucauuuggggcacacaaaaaucuacuggagaagauuaggaaaggauuauuuaacuuggauaauuuuuuaaauuaaacuuuuaacucuuauuuaaagacauuuuaauacuguaacguuaguguuaagaagcaauaacuuuuucauguuucacauuucaauacagaaaaaaauagauuaaagauacauacagguuaaaguggggauccaagaauauaggauuaagguggggaaaaugacagagucauggaggaacugguucuucauuggucuucacaggaggauggggaguaggagagccaaagaagaaucuacaggagcuggugcccgaaugugguaagugaggaaaaaugguagucuaagcuggcucaaggugggcuagugucuggaaaagugaggacccauacuaaguggaaugagaaggcauuuucuacauagugaaaucucuggugaccacugagacuugagaugcucucuucaguguggaaagaugggggaagaggaacguuuagcaacacaggagguagauggucaaaaaagcaacuacaugccuuaagaaaaaaguuggaacaaugauuccuacagucuuuaggucacuaaagaccuuuaauguccucucacugguuaaauucaagcaacacacacacauuuuaaaaauuaaugauuccuauuacgugugaauaaaccugaacuuuuuuuuuguuuuagugaacauaauuuacacuggcaaaaucguccccaauccuccauaucaaaugaguauagaggugggugggugagcucaaaggucuuuugccccuguaguuaaaagccuaaagaagucuucugaucacuguggcugauaguaauacaucucaguauuaauacagacaagugacuaccuguaauacaggucuucgaaacauggcuucuauuuucuuuucuuacagucuaaucuuuaggcuuuuccugaaggaaaaaaacaaaauaagaaaaaaacauuaccucuuauggcaaaaguacaacucaccaguccuaaauuccuaacuauauucauaauuuuuaugcacuccaauuuugugaccacaacguaccaacauuccugcacaucugaugaggauuccuuccucccucccaaauaaacucacaccuguaugucuuuuuggucccaaauaacuuccucuuccuccaacccaucgacaaaauuuugauucugaguuaaucccacuuccaauccacugucuucucaaauuucauuacuaugcaagcucccuuagagcagagauuuguaucugcuuuauucacugccauuuucuaaacuucuaaaaaaguucuuaaugcauaguaaggccuccauaaauauuagcaucaccaagggacuuauaucugaaaccuguuacugaaaaauuacugccuucaucuccguuaacaaagaccaagcagcguagagacccccgggcuagccagccacaccauagggagagguggacacccuuuaccgaagauggcgccaccaccugaaaaccgaggagaacuggaaggaaaucacgcgguccuccgcacgacugaugaaagggccagacaccuacacagaaacaccucccgacccacgcaggaucacgcgcagccaaaacacacgacuccagcacuuccuucgcgcuggcuaucccuuccucccucaccugacgaucuaacccgagcagcccagccacgcaggggaucacuuccggcgcacagggaacgcaaagcucgccagaggaaaaaggaaacagaaacuccgcaacuugcgccuuggaaaua

SEQ ID NO: 14605 - RNA, 1004 nt, Homo sapiens
ucuaagagaaaaugggucccuuggauccaggcuucagaugaccagacucacaccggagcaucacuacaaaugucugcuucagcuuacuguuccccagaaugagaauaaaugaguggccagcaggauaaaacauugucauuacuucgccaaucaucuuagccaucuugguuuuugguaggaaauuaccaaaugaugcaauuaagaaagcaagaaaguaaaguaagaagagaaagaagaaggaaaggaugauucugauggcccucuugugggccucagugguuggaucucuggagcuugucccauuuugcagcaucugccgugugugccuccccagggagaagaugagcaaagaguaggaggccagggacacaauuaagggaggcagguaccacagagucccaagaacauggaucagauaauacucacuccucuucuuucugaaguguucagucacauuccugguggccucaauuccccuaaagacagaauagagcuuaaacucauugaucagagaugcgguacuaccacaggauaagagcagugcacccaacagcauccauaccaucacccuagaaacucuccacuugagccagaggaauguggggugagagaaacuggcgauuuucaggcaguagaggacaccaagacagguggcaagccaaaugcucagaugguuuguaaauguccaggaaacaucaauaauuugcauuauuaucccugaaucauguguguugggagagaauucuauuaaaaaacuaucagucaagauaauacacagcagaaugauccucaagagugccaggguggugaugaugaagucagacaaagacauucucuuggucuugaaccagcugcuaccauugaccaacucaaugaaacaauugaccagaauucccagugugaacugagugccagacagaaucaggaacacccccucggugagucccaucaugucagcaauuaggcagcccugaucuuuguucuuucuguugauacauagaauc

SEQ ID NO: 14606 - RNA, 5233 nt, Homo sapiens
aguaugcuacauucccaaauuuucauuuggagauuuuauuuugaauagagggaaaauuaucugcuuguauaguccauggcagagccaguggaaugcagagggagaaguagggucucacuuguccuuagcaguguucucaauccaggauacauauuuguaaacauugguguagaugccgacguccccucccaugaagugccccaccucgauucccuggagcuugucuuugcagaugacaguagcaacggccaccuccuaccggagaucaugcagagagagagagagagagagaguaagagugucagaucuucucacaggaacccuagugucccgcuugggugagcccugucugcaggcauaugcuggacucuugaaaagagcaccgaaucaggggacaggaugcuugagccuuuuuucucauuuugcuguaauuagcuuugugugaccuugaaaaagucagaggacagucucucuagaaaucacauguaaaaugggucagacuccauuuuuuugaacuggugaaggcauuuucuauuugugaaaagucugauuuauuuuuaaagaaaugccuauuuucacaauuuugcuuguaguuauaagaaugaauaccuaggaaauggugugcuuaacuggaaguacuuuauaauguccuuuaaugaauaaagacaauuuaaggggaucccauuacugaagaaacaaugcuggcuuugcagcagccuuaucaaauucucaaaaaauuauuuagacaucuaaaauaguuuuuacaucaagagucaauaguuaaccgggcauaugcaaguaaaugaaagcugaauauagagauaagauuaccccaaaaauucggcugaauacuuucacaaauuucacacauaaggaauuccuguggcuuuuuccuuguucuguuuuuuggcauucucgaucagacaucacgggggccuccagguucugccgcaagucagggugucggccugagggagacggggauaaaauaaaacauccuguugacagugguuauuuuaguccuucugaccaccagccucuauuucaacugguaucuuuuuguguguguuuaaagaaaauaaggaaugcgacaaaggagagaaaucaucaagagugugguuaugagcuaaucuugaggauuuugaaaaaggcuuuacgucucuuuaagguagaguauauuuuuaauugguggccugucuuggagaacuaaaugaccugaggcaauucucagagguguccuuuacaugugaaaugagcauguaugagaaguaggaccacaccuuguucaugugaauugugucucugccaaucaggaauggcugggccucugugcagagucagauggccugguggcuccagcugccaaagcccugcagaggcagugggauauuagacacccugggaaaggaggagcuuuguuccucugggcaggucucuguuugccagaccacucagguagcaucucuauugggucuccuuucacucuccuuuccuccucucuccucacagcuaugaggauauggauguuccuccuaaaggacaacugaugacccugauuugcuguggaaggcacacuuaccacuguuuucuuggcuccaguccaaaccugagaguagacagacagugccuggccugacauuggugguggcgaggguaaggggcuggacuuugggauugagcauggcaggcuuagccagcuugaugagcaugaggucauccuguggggcgcuaugacuguaguuccaguagcggacgaucugaaugggguuaauugucuguucaguaccgucucugacucugcucuugaaauuucccagcaucacuuucagauuucuggagggagagggguuggaaguaaucaucaucaucaucaucaucauugcuaagauacugaauguuacaaagugccaggaacuguaccaagugcuuuuucuggauuaugucauuuaacucacaacaagucuaugcaguggauuccauuuuuauccccauuuagcacaugaauuaaugggggcacauaggaguaauucacucagggugauauaguaaguaguggagcccuucacuacauuuuaauguuguguucuuuaauguaguggagaggaagaggaugcaugucaaggaaauguaauuuucucgccuaucuaacugaacaauguccauuuugguggagaccagagaauaaauaaccuaguucugggugucuccuguuugguucccuagcugaugcacuaacaguccuauuccauucugcucugcaccuuuggaaggggacauauauggauuuaaucagugggcucucuuguccucuggcuuccuucuauuggccaauaggaagcaccagaaaguaacuggaggaagaagagugagauuggaguacuuauccucccaggucccucccugcaguuuugucacagaguggcugugcuccuugacuagggguuacaauccuuaucaggcugucuccucacacaggucucgcuuuuucucuaucucuccuugccuccuuugaaauuaucuucuccucuugccuuuuuaggccuagaggugguaacugcauuuucuuaauacaaacccuggugguauggaacuauucuuaauauugucccuuuaaugucuccauaccuuugcaauugguuccuucuuaaaacucaccucaauugacccaauuugagugcaucaucaguuaccugcuagaucuuuaagugauaaaaugcauucauacugccaguaaaaaaaaaaaaagaaaaaaacuuaugagagucugaggaggcauaacauguaacacaggguuccucaacaguggcacuauugcuguucugggcuggacaaaucuuuauuguggggacugugcugugaauuguaggauguuaaacagcaucuuugcucuagccucuccccauuagaugccaauagcacugcccccugguugugacaaccaaaaauaucuucagacauugccaaguguacccuguagagaaguuacccuuauaugagaaccacugaucuagaaugaacaguagcuguuuuggggauggggaugcccaaauacucaacgguaaauagcagugagcuggggccagcacccagcuggguuugaugaggacgcccacacagggguugaagugagacuugagguacaccaaauagggagcagggucuucuuucugaacagaugagucagcaaagaaaaaugucccugagaaaauaaugaacauucuuaauacauaaauauuauaaaaauaagguaacagucucuuacuugaaaaggaaucuggaugauucuuaaacaguuaucaguuggccaagaaguguuaacguauuugacauguuuuucuaauaaaaauguaaauuaaaacgauaugccauuuuaucuuauauuuauaauaauuuuguuuaauauugauaauauucaaucuaagagaguauaaugagagacacucaucacugcuaguaaauugauuccaucuucuugaaaagcaauuuagaaacaggcaucaagaaucauaaauuguuuauaaccugugaccuaaucauuccaaccccaagaauccauucuaaagaaaaaaaucagauauagacaaggauuacaaacaaguaugcucauguuagcuauaacagcugaacacuggaaacauaaauaucugacauaguaauguuggacauugaagcacaucaaaaaguggaacaucauauauaauaaaaauuaaacuaauuagaauauuaaacagcaaaagaauauuaaugcuuauuuaaguuaaaaagaacaagaaaauuguggauauaaucuauuugucuaaaaacaaauaaauaaaaacauuuaaaugcaaaaaauauauagauucugagaguaaacucaaaguguuagcauguguugacuaagaggugggauuaugaaugaugcuuauuuuucuacuuuaaaaaugucuaaauuuuguaauaugaacauauauuguuuuuauaaaugaauuauuuaaaacauacccuagagaauaaaggggaggaaggcugauucuaguaucagaaauaaagcccucuucuugucuuggcuucucuugcuacuccuguuaaccuuccccaagacugggucuguaccucaccacacccuucugugugaucacacaguuagaaaccccaaagagaaaaggguagacuguaaacaagggcaagagacauugagcucucuauagcaggcauuguucuaagugcuuuacauagauuuauuuaaucuucacaauagcucuauaauauggguagucauacccccauuuugaagaaauugaagcacagaagaguuaauuaacuuggcuaaucucacacagcuaaugugugauacaaccuaggcagucagagaauggugggaaaugccucaucugcaaauucugcugucagaagaaccccauguggggcaaggacuacagaagguaggguccuaguacuugaucuuuuguuucuacuucucuguuuucugcauuagugucggugggaggacacucacuguuaagccuucuccaaggcacaugugugccuuaacccacccuauagcuuaacacuagaaaagugggcucagccuauccggagagccuuuggauggagucugagaggcaggacuccuaauucugcugaugacacuauuuuugacucuuuuucugcacccuucgcaauccugccucugucucaccccauccauuaaacugugccuuacaggacagaguacaaggucuugaguacauaccagcgaggacacccaaauagaagacauauuucauggugauccagcucuucccccugugagauguagaagaaaaucagcagaguguggagcgguuggcuuaguugucuucucaggaacaccugguagacucaguggcuaugguuagauacggaggcacuccaugggauuggaaagcagcucugggcauaaacaggggagggagauggcuucagagagacagaugaaagcccucuguuccagggaagguggaggacugugccucuguuggggcauuucagggaaggaaacuccuggauucagcuccuucuaucugcugccccuaaaaacacaucuguuugaagguaguucaguugucuguggaaauggcagcucuaggcucaggacuuaucuuccccacagaguuucugagaccagggcuaugagggacaauauucuuuaccuuagcucagggaguaaguguccugagguuugcucugaaccuccuaauaguuacuuaua

SEQ ID NO: 14607 - RNA, 435 nt, Homo sapiens
guuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaag

SEQ ID NO: 14608 - RNA, 19394 nt, Homo sapiens
ggacuggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcagguaaguagggaacggucuuagggcuccuuaggggagcccagggaaggggagcguggcccccaggcgugcggcccugcagcccccuccccucggagccccggaaagcagccguguccgcgcuuccugccaagggugggacgcccgcccgagccgcuccgagccugacuccgcgcaagggcccgcgggcggaccucuuggccuugucucucgugggaaaagacugccccagccucccuuuguucaacccacgaggguucuaaaggggaggucuuugcaguccugcccgcucuuggguucucuugaagauucuucauccuuuccucuggcucccuuaugagggaaacuauaaaaagaccauacucugucuccuuaaaaaucgacgagaccuucugcagaccucggugcucugccugaugugcauuugauuuguaucgauuguaucaugaucugcauggcuuugcauagaaugaccagauuuucaaagaagucaauacaggguuuggaaauugaguacuuuuggcagaacaaggggguuccuguggcuccgaguguccaugccucugccccggucauuccauuucauggcagucaucacccaggagaacauuguaaugccuccugcucgagacugaagauuaaggucuucgcaaagggaaccugcagaaggacacagaauuaagacguaggaacuccguggugcccuucgccccuccuccccuuccaguuguguccugaaauucuaaaugauuggaaacuuuuauaauguucacguuuaagacucucauacuacagaguagaggaaggagcgggugugcagagggggugaugcuucagauuaaaacuaaagaguugauugaaaauucaagucuggaacucgagagaguuaagaacuauaagucaguaaguugcaaguaugggugagauugucuagggaaaggcucuuugaaggggcgucccuaauggaauaucaauauuaagggcaggccaaaggcccucuaaagaaaacaggaacuggguaggcagagagaagacucccaaagaaugcugucauggaaaccagaggaagagaacgauuuaaggagcgaauacuacugguaaacuaauggaagaaaucugcugcaccacugguuaguaucccagcugcaguguuauaugugaucguuauuacugcuuugacguauucgaaagugauucauucuuaaauagguuuuuuuauuuguauagcucuuuuucuuguagccaguuuuuccugaaagucuuggguaauggaaauauuacaguaaaaagaagaaaaaauggaguuucagacucauuuuuccaaaccucagauucauuggcugcuuccaacccacuucaucuguuuuaggaucccaccugcuaucuuaguucucccaguucuuccaggacccagcucuucccucuucuaacuauaaaucucucacccaauagcaucugcaagccaagugcauccauuccauagaugugugguauuucacugacucuaagauacacauuuuuucccucccuuuuuuuuuuuuuuuuuuuuuuuggacggagucuuugcugugucacccaggcuggagugcaguggaaugaucucagcucacugcaaccuccaucuccaagguucaagcgauucuccugucucagccucccgaguagcuaggacuacaggcaugcagcaccacacucggcuaauuuuuuguauuuuuaguagagacaggguuucaccauguuggccaggcuggucuugaacuccugaccucaggugaucugcccaccuuagccucccaaagugcagggauuacaggcaugagccaccgugcccggccuccccucauguuuuaacaccuuagaaaucagaaugcauuuuagaguagguuuuuaaguuauaaauggaaguuauuguauuuucacugcuaucaggugccacccuuccugcuguuacauauguggaaaaugugacggggcaggcuagagaacucuggauuuauguaaacuaggcauguagaugacauauuggcaauaggauuauuuuaguuuauaagcagaagcugaucucuuugcaagccuguagcaaaauuagcuggaggugacagcacaugccuguagucccaacuacuugggaggcugaggcagguggaucgcuugaguccaggaguucugggcuauagugugcuaugccagucacguguccacauuaaguucagcaucaguguggugauguccugggagucaggguccaccagguugccuaaggaagggugaacccgcccaggucaaaaauggagcaagucaaaacuccugugcugcucuguaaugggaucauaccugugaauagccacugcacuccagccuggguggcacagugagacucuuuuaaaguaaauagauaaauaccuauccacugugacuuucugucauacuuucugcuuauccacaucuuaacaggauucgccauuuugucacuggaacuuaaaaguuuuaaaaaacauguaauuauauguuuauaucacuagugaaagagaguuagugucugccucauuuauuuucuguuaaagccauuggcuugaguuuuuaccauaguguuuuaacccucaucuaagaucauuauaaacuuacaucacuuucaccagcuuagauaaugugagauguuuucugaaauaauucucuuuauuaaaauuggucuaucagagaaguauuccuucucauaaauauguguacuuggggguauuguuuugcuuaagacagauauuucccuccucuagucagaccauucaucucagaugaucucagcugaacauaaaccauaaggaauuagacauuauuuucuuaugaucaauguguuccugcuuaguacaucuuugcuuuaaccagauuuaagaaauaugcauaaucuugguuauuguaagucuuauucuuuuuguucuuccuauucaugccucuuccacuccacucuucugugucaaauugugacuugacagccuuuccuucuaccguuuaucuguaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccagguaucuggaggcaaaagagagaagauaaauugaucauggggugggaauagagcaugacaaaauauggaaagggugucguaucuuucuuccuuuuuuuuuuuuuuuuuuuugagacagagucucugucucccaggcuggaguacaauggcgcgaucuuggcucacugcagccucugccucccagguucaagugauucuccugccucagccucccaaguagcugggacuacaggcaggugccaccaugccuggcuaauuuuuuggauuuuuaguagagacaggguuucacuguguuagccaggagggugucgaucuccugaccucaugauccaccugccucggccucccaaagugcugggauuacaggugugagccaccacacccagcuggauguuguaccuuucuaaagaaauggaaaugcccuucuaccguagagcauuugagagaaaugauauauaacucaagaauaacagaaaggacuucacccauacauacacuuuuccuguaaaaagaauucuuggaugaggacacuacuaggaagcucauguggagaaauagaauuauagcuagagaaguaaauaugauuucauguuuuauucuugugucuuaggccaaagugggcaguuucagccagaauguggaacuccucaacuugcugccuaagagggguccccaagcuuuugaugccuucugugaagcacugagggagaccaagcaaggccaccuggaggauauguugcucaccacccuuucugggcuucagcauguacucccaccgguaugaagcuuuaguaauaugggguguugggaaggguuaguuugacuggaaaggaauuuguaagucagagugagggagacuagauuuuguuguauuuggaccggaccacuucccuaaggucugucaucaugaguuuugauuucuuacaguugagcugugacuacgacuugagucucccuuuuccggugugugaguccuguccccuuuacaagaagcuccgccugucgacaggugagaauugauggacuaaaaggggucccaggccaggugccacggcuuacgccuauaaucccagcacuuugcggggccaaggcggguggaucaccugaggucaggaguucgagaccagccuggccaacauggugaaaccccgucucuacuaaaaauauaaaaacuagcugggcaugguggugggugccuguaaucccagcuacucgggaagcuggggcaggagaauugcuagaacccaggagacggagguugcagugagccaacacggugccaccgcacuccagccuugccaacagagugagacucagucucaaaaaauaaaauaaaauaaaauaaaaaggaggggggugucccagauugacuuccccuuucuugucugguaucuggcuuuguccuaacaugagcccuuuuuuuuguuuuuuuuuuuuuuuguuguguuuuuuuucagaaauagggucuuguucugucacccaggcuggaaugcagugacaccaccauagcucacugcagcguugaacuccuggguugaagggcuccuccugccucagccucccaaguaccugggauuacaggugcaugccaccacaccuagcucauuuuuaaauuuuuuguagagaaggagucucacuuuguuacccaggcuggugucaaacuucuggccucaaaugauccuuccgccuuggccucccaaagugcugggauuauaggcguaagccaccaugcccagcugagacauaguuuauauugggaacaguugucaguaaauuuguuaagggcuaguaggacaguuuaugcaggaguuugugguuuuuuguuuuuuuuuuuucuugugauggagucuugcucugucguccaggcuguagugcaauggugcagucucggcucacugcaaacucugccuccuggguucaagugauucuccugccucagccuccugaguagcuaggauuacaggugcgugccaccauacccagcuaauuuuuuguguuuuuaguaagagaugggguuucaccaucuccugaccucgugaucugccugccucggccucccaaaguguugggauuacaggcaugagucacugcgcccggcccaggcaagguguuauuaauaguugguccauuucccuuccaccccagauaacaguuuuugugauaauugggccuuugaguagcauguaugggcaggaaguucaugcucaauuggccucuaaaaagcugaauaagaaaagacuacauuuggggccaccagccugcugauggagcauccuagugauuggaacgaggcuuuuaucagcuagcccauucggucauucagccaguugagcauaugcuucaugcaggcuaugugcagagaauccuuuagugagcuaaaacuaagagucucugcccucaugaagcuuacagguuuggguagugagugagaccaauauuuaucacaacccaguugcaagagaugucugaaguuacaaugacauauuaagauugaugguuaaguuauauacuaguuuuuugguuuucugucuauaccacagauacuguggaacacucccuagacaauaaagaugguccugucugccuucaggugaagccuugcacuccugaauuuuaucaaacacacuuccagcuggugaguuuuugcauaaugacaagaggaagagaguugggaaauuagacacccuuccugggaaccugaacuuaguuugcauguacauuuccuuucugccuuauuagucagaaaguuguuacugguuaaaugccuucugugagcauuugucuauuuuuaccugcuggagguuaagaagaaaaauacgaugucuuuguuuucuugaaaugucuaaucuagccgaggaaucaucuguuaucaagacgcucauggucuaacuggccucuccuccacaggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacagguaccugaggugggaaaaauugacauguaaauuagaggacugaacaacacuuugggaccagagacaucguuuguuccugugccugcugggauaugucuuaaaaguugguuuauucuacuuacauuuuuacucacucuguucugccucucaccuugcauucuaguaagaaagaauuagggccggccagccauuuuaguguugacaucucagguugugguuucauaaaguaauaauaguccacaguuggugucucacuuuuuuuuuuuuuuuuaaagacagaguuuagcucugucacccaggcuggagugcaauggcacgaucucggcucacugcaaccucugccuaccagguucaagcgauucuccugccucagcuuccugaguagcuggaacugcaggcgcaugcaaccauaccuggcuuauuguuguauuuuuaguagagacgggguuuugccauguuggccaggcuggucucaaacuccugaccucaggugauccgucccccucggccucccaaagugcugggauuauaggcaugagcuacggcaccuggcugggaaaguauucuuaacauuuguguaaucacaagucauaggguagauuguuuguggaccagauuucuagaaauuguaaacauuuucauuaugggcuguucgucauuaaccucaguuacuguacugcacaacugacuuugugaccuuuaggguuucuauuuugcaaucaauaauggccuauuuguagauucauauucacucuuuauuuugauuccagaauaguagaacuuucuucaacuugcuuugagguugucaguggugaaauuaaaauugcuaggagauucacuuugaucuguugggauagaggaucuuuguuuuccauucagcauugucuguagucuucauuucucuuucuuagcugcccuccuucugugagaguaauuauguauuuacuauauuuuuggcaaggccaguuucauccacagguaccuggguguuguccuuuacaugcuauuuuugccagcuucccccuuguagcauaugcaauguaguuaaauccacccuugcuucaaagccauggcagcaacagcugcuucagucaucaaguauucagguaguuuauaugcuuuccugagaagucugcugggcauaaaggggcaaagggcaggguaccagccauaauuccuacagaaggucacuuaacaaaaugugcaguguguguguuuucuuagagguuuuggucuagccaugucuuuuacuagaaaucuauuaugucaugguuuuucaaguuguaugcagcugauaaaggaucuuacaugucuaauaguuaaagauaaaauacugagucacuaagucaacuauauauacugcuguuuucucagagacugucagauuuggugaguuuaugagcucacuucauaaauagcauuuccauuuaugguaagccugaugcauauucagugaccuauuggauucuaauucuuugguugaauugcucuguaacuggaauugcaguagaguugaacuucaagcaccuuauaaugggggacuaugugagcugccacagauuuuaaagaucagaugagggaguuuugacaucagcauaaaaggaaguguguccucuuauauuccuaacgaccaaacaagauuagagaaaaaaucuucugucauagcuaagaagaagaagcgccuagguagauaugaucagaaggauaaguggaggaggcagaacuuaagcuggccuugaaggauagaaguuacugaagcagagaggaguggugaagccacccuaggcagggagaacaguauguggacaagaaauguguguguuauaaaccagguaguugcaaugggugucauaauuugguacacugggcaucugcacagaaugcucucuuccuggugggaucucccuagagagucaacucguuuaucauauagcuauuuggcaagcaaagaaacagaaccaaaaaaaaaaaaaagauccuuuuuucuuucccuaucaaaucuuucuuacuuaagagaggaauuccauuuaaaaacaggaaauaguauaauuagucuuagagacuccucuuccccugauagugcugcagugaacauggguauucucacugcccagauguuuucacuuuucucuuuguuauuaaguuuuuauugcaucuacuucaugagguuacuaguucuagaauuaugauuuacccuauguuaggaaacguacucuucaaaguggaaauuuccuuuuaccaugugguauuguuuuuuuagcuugcauuugggucacaaacugcuuugaaaauguaaggacaagcuauggguuaucccuggaaaaugcagcugcccauauaauuuagcauauaauuucagaggguucacaaguuacucucuucacaugucccccaaccccuagccaaaaauacacuuaggaguuaagaacccugcuauuuauagaaguacuguaauuuuaucaaaaacaaaucugcagauccuauuuuaagcuaugcuacuuguagaaaaauuccuccaaaugucuaauccccauuuauugaaugguuuagucuuacuaaguuugguuacaaagugcguguauucuuuuuuuggacauuguuuucuauuuacugaccuaaucucacuaaauucaaaaugcucgugauucggugcccagguauauaauuuuuguuuucuuuuuuuuuauuuugagauggaguuucacuuuuguugcccaggcuagagugcaauggcgcgaucugggcucauugcaaccucugccucccagguucaagcaauucuccugucucagccuccugaguagcugggauuacaggcgcaugccaccacgcccggcuaauuuuuguauuuuuaguagagacaggguuucaucacauuggucaggcuggucucaaacuccugaccucaggugauccacccgccucggccucccgaagugcugggauuacaggcgugagccaccgcgcccggccuuuguuuucuucuuugagcaaaauuaacuucuuuaacuauuaaauguuaaauucuauuagcaucagcuccagaggaacauucacaguuauguauucucuugaaauuauauauucuugaaagaauuuuuugauuaucugucauuaccuuaagauuucuauuauuaugguuugcuucuacuuagaaaauacagauacuuuucaacaacaccagucucuuuauuucuaguuauauugcagacuuucaaauauuuuauguaauugcaucucaauuaucuacaaacagaaguauuccgaacagaucaauuaguagcucucaaacuuuaacauaucacaguguccuggagggcuuguuaaaacacauuuugcuggagcccaagauuucacguuucuuccaaguuccugggugaugcugcuguugcugcuuuaggggccacucugagaacuacugcaauauguuauauuauagaagugugcuuuuuauuuuggcagugugugugauuaaauauauguguguuuuaacucuuccacccagauaacuuacuuauuuucauuacauuuuauucaaguuuauaauaaaaugaacuuguuuucuuucugcccaucucagaagacccagacaucgugaauuauagagggaggcauagguuuaaacaugugugcccaauuauuaugcucuuuagguacacaguauaaccuucugauggauggaccaaaugcuuaagguagugcucuucauguaucgcaacuuagugcaagauaaacaagauucuccaggcaugguggcacaugccuauggucccagcuacucuagaggcugaggcaagaagauuccuugagcccaggaguucuaggcuguagugugcuaugcugaucagguguccaaacuaaguucaucaucaauaugguaaccuccugggaguggcggaccaccagguugccuaaggagggguguaccagcccaggucagaaauggagcaggugaaaacuccugugcugaucaguagugaucuuacaccuguaaauagucacugcacucaagccugggcaauauagcaagauccugucuaaaaaaaaaaaagauaaacaggaaaacaguucuuaaguuggacuacaacauugaccaguaauagauuucuuugagaaaaauacucuuuauucgacaugcacauuguaauggcacauuuuuugcaaugugucccagacacagugaucgguuuuugguuuuuuuuuugagacagggucucucucugucacccaggcuacagugcaguggugcagucacagcucacugcagccucaacuuccuaggcuccagugaucccuccaccguagccuuuagaguagcugggacuauaagcaugcaccaccaugccuggcuaauuuuuuuuuuuaaagauggagucuugcuagguuguccaggccaaguccuuugucauaauaucucauuuuuaucuucacaaacuuagagaaaauauccucauaauuuuuuuuuauaaagugaaaagugaggucucaagggucugaguaagcuguuccaacucaugaagccaagguucaaaccuagauuaaucugaacccaggaccuguguauguaauuacugcccuguacagaauccuccuucauagcgugcucuuucugaaacaaagcauuuuauacagucaucaucauuaucucuuggacacuuagaaucuuagaagacaacauacaaguauugcuauucucuacuaucaugaugcugucacagaacaguuuauuuucguguagcugaaugugcauguuacuuauucauagcuacacuuugagucacccuugugccauuuauauacaagggcaguugcucuaaugaaggaucugguuaugaacagggaauuaaucagaguugaccagcucaugauuagcuucuuuaguaacuugcuuuaauccaggagcuguuugccuaucucagugagucugaaucuguauucagaauauugugucugaacucauaugcauuuuucuggugaguccauagcuuucuuuagucucucaaaaggucucuucuuuuaucauugaccacaggaauauacauaaagcguuuuaucuucuaauagcuuaggguuucaaaaagaaaccaaacuuugaugcuuauguuggugcugaccuuagugcacaacacuaaacauuccuuucuuuuaggaaaugcaagagaaacugcagaauuuugcacaguuaccugcacaccgagucacggacuccugcaucguggcacuccucucgcaugguguggagggcgccaucuaugguguggaugggaaacugcuccaggugcggauacccugguggaagccaacuguugaaaccaggcugcuuuaccuccugccugcugucugucaagugauggcuacuguugcauguguaggacuuaggaggccccgcugaaugcuuaaccucucuucuuccuucuuucuuucuggcagcuccaagagguuuuucagcucuuugacaacgccaacugcccaagccuacagaacaaaccaaaaauguucuucauccaggccugccguggaggugagugcccuagcagaccagcaccugggugguggcuccugggcagccucccaccagcucucacuuuccuguuugcuccucucaggugcuauuggaucccuugggcaccuccuucuguucacugcugccaccgccucucuugcucuguaagugucucccaaugcauggggugugcugggacuugggcagcccauggcucucaggcuggucagcucuccgugcaccaccauauccuguuuucaggucucuuaucccgugucuuugccuuccuuucugagaacucuuacucuuuucugugcuucauuaacucuggugcccuuuuuuugguuacucauuccaguuacggauuuuugaucugucuuuuuccuguccuucuuauuuuaucuccuuucuuucacucuuuguucuuuucacuuguuccauauacuucccuguuuaccuacacuuccaugcuugccuccuuucuucuuucuucuuaccauucuugggucaugcaggauagcagaacagaauccguguuggccuuugacucuuccuuuuccgugagcugcugcugccccucuuucucucaugcagucuguuuuacuccuuuaagagccaggacugcaggacgaggauuaaaagacacauaggugugcuucucauccuggaggaaaauaauaguaauuaagagcccuaacuuuggagucaaauucugacuucaccauuuacuaguaacgugaaguuaaagaaguuaaauggcaucccuccaucucaguuuccucaauauaaaaugaaaauaguccuuguaccuacuucauaaggugcuugugaugguuaaaugagauuaugcauuuaagggcuuacauagcucaguaccuggcucacagcacauccacaaaauaugccagcuguaacucuuaaaacacgaucagugccguaaagggcuuauaguuugcuuuaaaggucacuuuguccaaacauucaaauaauuacuuuuuuaaucucucauguggccaaauguaaauagcuaauauuauugucauccugaucuaguauuaccgcagaauauagucugcugaggcccugcaacaugacucagacuacggcaguuacuaccgcaaaagcagaaggaaauguggccucucuaaggagcagaccaguuacucaggaaaauaaaguaaauauacaugaaguagcuuaagacuaguucacaggccucauguaagcaaaggugaaauuagcaagguacaaacuguacuuaggaaggaguaugcaguaagaguagaucauuuuaagugaggguaguuuaaagagauuuuuuagauaagauaaggcuuaauuuguaccuggaguaauuugauuuacauaguuauagaguaguaucuagagucugucguaggaaagaaacaauacaauaugauaaguacacugagaggcagagggcauguugugucuccccuccucccaaacagaugcucggaucugauuuuaaaauagcaucugugugaguaugugagauguggcuggucacaaugaaguggguucaccuccuuacaaaccuuuagucauaacugagguuuuggacaucagcagguaaaaguaaggaacaguugggagcuuaaguaagaaauaaugugaugaauuguuuuuccagcaagguugccauggagggggcugcacuaaggaaagagguuaugggucagcaacuuuacuuuucauucccugcucuauccccaggcccagggcacugccugaugcaugguagcacuuauaaauguucaaugaauggaugaaaauuaaucugccugaaaaacuguagguauuauguaaaaaacaaauaugaggauauugugacaaaagaaccagugacauuuauugauugauggaucugugauauaaaggugagagaggaauucuccuuucucuuuagcuuggccuguuuccuuuaggcgucuuuacuaacaaaacgacguuaaauugugauuuucucauccuauauccagggauuuaauacacuauuggaucuggauaaggaguaauugcucuuuucuggaguaaucuggaucuuuugcucugucucucuaacuuuucugaaauuaaauccuucaaggaaugaccaguagccaauuguuccauugaaaauuugaguucaccugucuuccugcuguauuugguuaauauaauuaaugucuagaaaaagcuccaccccccugccccagucagcuucuaaacuggaguguaagcuccaugacggcaggaauuuucucuucacucuaucccuaggccuuaaaguaagacagugcccaacacauggcaguugcuugacacauuuuuauuaaaccugugcuuugguccuuuucccccaauucuugaagcuucccuucuuuccuaggcucccucgacauugcauggaucaggaaguacuguaaaagagcauacucuuacuuuugauguguugaccugagaguccuccccaucugucuugccuacugacagcaccccugcccacacccaaaauaaaacaacaucaucaaaaauaagagucugucuugggauacauaaggcuuguaucaagagcaaggaucugcucaggguauguugagaaauuacugcuaaaauugaauaaggaugaucuuuuuaaauuuucugggagaaaacagucaaguucuccccacuuuaaguuuuuccucuuaaaauuuucauaaggccaggugcagugacucaugccuauaaucccaacacuuugggaggccgaggcagaaggaucacuugaagccaggaguucaagacaagccuggucaacguagcaagaccccaucucuauuaaaaaaagaaaaaaaaagauuuaaaaaguuauuuuaaaaaauaaauuaaaaauuuuuuuucuuaaaucuuggaugcuugcuauaauuuaucuuaugaaauuaauaaacauagugcuucgaagauaucaaaaccaccuuggaaacaacugaucauacuuaguuuuauuauuuuuugauacauaguucgagguugugauuuuuauauagcauacauaugguaaccguauuuguuauuuauuaccuuguuuuuucuuguuuauguaauuaaauauaucaauauuuuauuauguauugcaauaaaaagcacugugacucccaggcauauuguuaauugaacaagugaguuguggacuuagaugauuuucaguuccauuuacaaggaguauuugauuuggcauuuucccugucuuacacagaaugggaacugcuccaaccgcauagaugugcaugugcuugagcguggugcccgguguguaugaggcauccccugaguaacagaugcaugcugagagaguaauaauuuuuuuuuuuuuuuuuuaguuuaucagccauagguuggaggcaacagcuggaaauggcucuuccccuucaagguuguagggaacgugggcuugccugugacaggcccaagagagauaggaagaaguaacaucauuguccauucugucugccuuuguuacagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagguacuuugaguuccaaaagaguugagucauaccucauuuuguugcacuuugcuuuauugugcuuugcagguacagguugaguaucccuuaucugaaguguuggaaccagaaguguuucagauuuuggauuuuuuuguuuuuuuggauuuuggaauauuugcguuauacuuacuaguugaguaucccguauccaaauauucuaaauuuaaaacacucccaugagcaccuucuuugagcaucauauuggcacuuggaaaguuucagauuuugaagcauuucagauuuuuuggauuugggaugcucagcugcuuuuuacaaauugaagguuuguggcaauccuuugagcaucugucagcaccauuuuucuauuggcaugccucuguuagcauuuuucagcaauaaaguauguuuuaauuacagcauaugcauguuuuagacauaauguuguugcacacuuaauagacuguaggauaguaaccauaacuuccguauacacugggagaccugaaaauuuguaugacuugcuuuauugccauauucacuuucuuaagcuggucuggaaacagaccuacgguaucuccaaaguaugccaauaauccaaaagaguacccuccuagacuuagauucuucaugcuggguucucugacuagggagggugcaggugucauggccgagucuaguuugggaagugcagcugugugauggcauucacacugugauuaaugcccuuuugguugcagggacugccgccaugcggaacaccaaacgagguuccugguacaucgaggcucuugcucaaguguuuucugagcgggcuugugauaugcacguggccgacaugcugguuaaggugagccagcgggcuccgugaccccugugugucuccacagugcucuacuuuccuccucucuugaaugcucuuucauaguccgucuccccuucccguuugcugcucuccugaagcccgagauucucagacuugggccuauugguucugccccuccaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuacugau

SEQ ID NO: 14609 - RNA, 37733 nt, Homo sapiens
caagagcagaggcuuaaggagcuacacugggggaaggacaggggcaagcaggccaaggccuggccggggcucggggggagggaauauggagcaaucccggucacagcagcgugggggugaacaaagcuggugggguagugacccccaguaccaguauaugcccuuugaacacugcaccagcuacggacugcccucugagaaugggggccuccagcacaggcuccggaaggaugcaggcccccgccacaacguccaccccacacagguaaagugcucuaaggggagaggggagccauggaugaggggagacaguggugccagagacuggugaaaaugaggaauugggugaaaagagggagcaguguuacauuuuuuuaacuuaaaaaacaaguacguggugauguguucaaaauaugaaaaucuuugaaagucugggcucacuuaaguaugcacuuagagagauaugcaugcacuuucauacaaccuuuaccaacagaguacccaaaucauauggggaaacagcagagccucacaugcaugaauagcucgugcuuacauaaccuacguggaguggauugcguaggagcccacacugcagugugcugggagcugucucccacacccucacccacagguagacacugccagauuucugccucugggacccucugcagaauacacacaaacaugaaucuuucugcagaaggcagaagaaaggaauugggcaaguguagaaaacagacugaauugcuuaucagugaucaaagaucuaccaacgucaaaaugagcagagauguacaagcuuuuaggucgcaagaugaucaaguaagaaccuauuaaguguuaggcaccuggaaaagggcagagaugugaucccagcaacagaagcaugcaggcuaauuaggagugucuauggaugagcagccucccgcugugggauuggugggauaugaacaccuaggaaagggggaauggggaugggcacaacuaaaggaaagguugugaaauugucauggaaaaagauaggucaugguuaauaaguaagugugccucucccuccaaagaaugcagagaauaacagaggauagaauuugucuagagggcaguuggccagaacuuuuuuuuuuuuuuuuuuuuuugagauggagucucgcucugucucccaggcuggagugcaguggugcuaucuuggcucacugcgaccuccgccucccggguucaagcaauucucuuuccucagccuccugaguagcugggauuacaagcaccugccaccauaccuggcaaauuuuuguacuuucaguagagacgggguuuugccauguuggccaggcugucucgaacuccugaccucagguaauucacccgccuuggccucccaaagugcuggaauuacagguguuaaccacugugcccagucuggucagaacuuaaaaggcuuuuuuuucuuucuuuuuuuuuuuuuuaacagggagccuucaguuccuuuagguuuaaggcugggaagcugaggcaugagcuaugcaggggaucucagcacugggggucaaaaggaucugcucucagucccugaccaacccccaggaguauuugcaaaggcagcgcuagggacccaguagggaagagggacauacaggucaguguaggcuggaaucgagcauugggaagguuucuuggagacagcggggucugacuaggccuuugaacacugugugggaucagcaggagggaagaccccucccccuggcccuguguucucacucguguacaugguuguaucugggugggauggcaacuugaguaacagugccauuauggcacuuccugaugacaguucucguguugggaagcuaugguuaguuuggggaguagaauuggccuguuuucuacaggucucaaaaguaaacaagaguuuggauuaguuuuucuuuguuuaauuuuuauuauggaagacuuacacaaaaauggaaugguauagugaagccccaaguacccaccaguugucaauauuuugucacuauuguuccaucuauucuucccuuccccacccucaccacucuacacaccauggaauacuuuuuuuuuguuuuuuguuuuuuguuuuuuguuuuugagauggaguuucgcucuuguugcccaggcuggaaugcaauggcgcgaucucagcucaccgcaaucuccgccucccugguucaagcaauucuccugccuccgccucccagguagcugagauuacaggcaugcgccaccaugccuggcuaauuuuuguauuuuuaguagagacgagguuucuccauguuggucaggcuggucuugaucuccugaccucagguaaccugcccaucucaggcuccuaaagugcugggguuacaggggugagccacugagccuugcuuccaccuuggaauacuuuuuaacaaaucccagacauuguaucacuuguagacuugaguuuugacuucucccuugcccuccccucacccugcccugcaugggaccagccagaacagaucuggcccuuuaaguguuuucccagcccagguaugaugauaugaagcaacccccuuccuugucuccacuggccuggggccuugaggagcugagacagccucagcugucugacuuccacugggaaguauguucucucucugggucccacgcaggguuuggaaggaaacacugccucccucggucacugacccagaagacaaacagccaugagcagggcaauucaugugcgugcuuguucaggacugcgguguaaaaugcugcucauauugugaaaucagaucucuucuacucaggcucucccagaauccagcaacauggccuggccugacccuggccccagaggacaguuaguguagugggaguggggcaggcuaaaagugguuggagcucuuguauaccccacacagacacacgugcucugccucaggauggaagcggagggccaccagaccugggggagcugcucuguccucuucacauguggggcagguaggggucuaauuaucuagcugugggaagaaguagauggaccugccuuuucgggcuaguucuugugugugcauacaagcacugggagaugaaguggauggucuugaagcuugauagaggaccugaggugccucagguaaggcuagacacaccaaggcaaagugcaaccaagacugcccugcuaguuagcccagucuguccucacccuguucauguuaggagaaaagucaaugcaaguggucuggggaaauugugggacauacagaaagcgcagugacacaaaacaccugauugauauggccaccuggguucagcacaguucuguaccucugcuucaaagcaaaaacuggccuccuugauaaaggcuacccuggaucaaggugaguacagguuggagaauggguguagagaagguaggaugaaugaacaagggaaagggugggaagugugggaauggaggguggagaguagagggcagggaugaccacaaagucacccugcaugcagucaacacccagaauucaaaaagcuguuguucuuuucuucugugagucugucugcuggccucugucuauuauuuuuuuagucuuccacaaggcagacacugaucauucucucucuguccagauuuauggccaucacaaagaacaauucucagacagggagcaggacauagggaugcccaagaagacaggcuccaguucuaccguggacagcaaggaugaggaucacuauucuaaaugucaaggugauggggacugaggaauaaagaaaucuggaguagaaacagguacagggauuaggagaauaacuugggcaucccauugcacguacguacucccugcccugcuacaaaaacucuccucuaauuguuuuuaagagacagggucucacucugucauucagacugaagugcaguggagugaucauagcucacugcagccuagaacuccugggcucaagugauccuccugccucagccucuccaguagcugagacuauaggcacaugccaccaugcccagcuaauuuuaaaacuuuuuuuguaaggaugcugaggcuggucuugaacuccuggcaucaagcaauccucccgccuuagccucccaaauuccugggauuagaggcgugagccaccaugcuuggccccucuaaguauuaaggaaaaggcaccucucuucaccuccuucgcacuuugccuauucccuguuauuccucccacaacuccaagaaaugaguuuuaggaaggaauucaaguauucauggggaacugggcuuuggugccuuuugcaggggccggagcagcaaucagcagagggguaaugagaaacucagugcauaagacauacggacccugggggcccaaggcuuccccucccaucuuggguauagcacccaaaguaaaguagugacucguuagcugcuuuucucucucucucucucucucucucucucucucugucucuacauauauauauuuuuguuuguuuguuuguuuguuguuuguuuguuuguuuuuucccucaucucuuccuagauuguauccaccgccugggacagguggugagaagaaaauuaggggaagacgggaucuuucuggugcuucugggacugcugauggcucuggucagcuggagcauggacuacgucagugccaaaagccuucaggguagguuuaaccuggaccuuugcccacagccguuucuggaguuucuaccuaggguaagcaggguguguuaucggaagcgaauguuaagcaggguguguuaugggaagcgaauauugcgcagagagggaucaggugggacuccaggcccagaaaagaccagacccaggccugcuccacuucucacgccccuccacucacugccacccaagcaguggaugccccucuaauaggguggccaacuugccccaguuccccagggacuuucccaguuucagcacugaacaucccgaaucccaggaagccccuugguucugggcacaccgggugguuggucacacccaggccuccagacccuguacuccagugggauucgugacacagccaccaacuggaacaggccaugucgccuccauaacucaggcuucccaugugucaaaugagagcagcaccaucucagaaggggcacacagaaggagcacggccugagaacaugccggguacacguccuggugccguggacacggcugcucagccauguucugccuaaccccaggcaugugucuccgcagccuacaagugguccuacgcgcagaugcagcccagccuuccucugcaguuccuggucugggucaccuucccacuaguccucauccucuucagcgcccucuucugccaccucaucucuccccaggcuguuggugagaacuugccaccagacucggccugagcuggguggccugagaggggcccugucugucucccccaucauccagccccacccacagcccugugcugccuugccccauccuccccaccacugccucuucagcccucuccaauucccauucccauauucuggacauucaucucccuuuucaccuucaccuugacccugcacauaaucuuucaacgcuuuuaggcucuggaauccccgaaaugaagacaauacuucgugggguuguccugaaggaauaccucacaaugaaagccuuuguggccaagguugucgcccugacugcgggccugggcaguggcauccccguggggaaagagguaggccuggcaugacugaagccagagcugggaggggcccucaggagccaggguggcaccaacucuagagggagcucugggaguggaaguggaucaggggacaggaccaaggccagggccaggggacacuaggaaggggaaaugcuuuggaaguuccuccaacugagguccaaugacaaaaaccacacagcuuggggagcuuggagcaggcucuuagccuggacaccccugacauuuggggcuggaaaacucugugcuguggggaggcuguucugugcaguggaggggacuuagcagcauugcuggccucugacccuuccuagaugcccagcugcaucgcccaguugugacaccagcauguccucagacauugccauauggacccuggaggacaaaaucuccccugguugagaacacugucuuagagaucauccagaccaauucucuugcuugaaucugagaaaacuaggacugagaaagaggcugugcuauuuucaagguugcucgguggguugcagccuccuuccguucucugcugguguucaucuuugcccccuacugccauauuccacccagcagccagaggcaucuuuuaaaaaugggaucagucucaucugaccccuggucaaaaacuucuuaaggcuuuccaugccucuuaaaacaaaauugaaaguuuuguuguuguuguuguugagacagugucuagcucgcuugcccaagcuggagugcaguggugcgaucuuggcucacugcaaccuccaccucccagguucaagcgauucucccaccucagcuucccgaguagcugggacugcaggcacacgccaccacaucugguaauuuuuguauuuuuaguggagauaggguuucaccauauuggucaggcuggucucaaacuccugaccucgggugaucaccugccuuggccuugcaaagugcugggauuacaggcgugcgccaccgcgcccggccuuaucagaacuucuugcguggccuucgagaccguggacucugguuccuccucucugcaggccugugccccugcuuuccuguguuuggcucacaaguuuccuuucugucccucagucacucugcccugggccccucagggcgccugugugcuguuuucucagccuggaacauucuuccuccugacaucugcgcggcucccucccucccaucauucaaagcucuacuuuaggcaggcuccucaggcccuuuccucuaaacacgugcccucccacccuccuccacccuggcucucuggagaggagaaacacacugguuucuccucuucuuccucucugggaugaggccucgugagggcaggaccucuguguaacucccguauuuccagccccuggcacagugccuggaguaaggaauauuauuaguccagugagugcugcagagccuccaucuggccucugacccccgcccccucgcucccccucucccagggccccuucguccacauugccagcaucugugcugcuguccucagcaaauucaugucuguguucugcgggguauaugagguaagguugagacagugaaaugagcuggggccaggugguagaaggaguccggcuguguguccaggguguugggagggcugccucugcucugggcuggcuguggugcugaagcagcaucgcacuaauccacgcucccuuccucgucucccugucugccuacccuggccacgugaugccucuguuuagccugugccuguccuccaaauguccaccccucuuucaccuguggccccacauggaggucuggucugucgucugcucccaugcucucccugcuaguccauaccacccccucuguguuaguuucccuccacguuucccucgugugcucccccaucccuuuguagcucccaaucccucacccuaccucuuacauacgucccgccugccccaccccuccacccccuugucccgcgugcuucucuguugcagaccgugccugggcagcuugaccuccuggugucggccugugcagugggcgugggaugcugcuuugcagccccugucggaggcaaguugcacuuccucccuaucccgguugccuaagcaagacuuagaaggggguuuuggguggcugccacaagcuuuggagugggcauccagggaaugacuguggaucacagccccugcgguccagauaccuauauuuuuucagcaaagggcuguguauuauuuugagacugcuugcuguuuggugcaggauuuauuaguacugcuuucuggaguucuugcugucucuuuucugcuuaucauuuauugauuuacgugccuggcauauauuugccuaacuuuuauuucauuuucuaccuucuauuucauuuugacacugugcuaugagguuaauuccuuuuugccaaacucacugaguuucucuuggccugggaaucacaggggacaugggaccacaaggacuccuuuugacuuaggccucucauucugccuuauuccccaucccugcuuguucuguccucugccugcccaccucccucucuuccaccuguuucucugucugucucuccccuaguagcagccauacuacuacucugauauccugacggugggcugugcugugggagucggcuguuguuuugggacaccacuuggaggcaagugauugacccccucccccaucaaucggcuugccuggccuggcucccaaaacaguuuuaaucaguauccacaagugcugguauuaccagguuacuuacgagaauagcugacuuuuaguaagccuuugcuaugugccaggcaauguuuaaagcacuuacuuuuauuccuggccaaagccauaugagacagauauuacagaggaggaagaggagagaacugaguuacagagagggacagugacuugagcaaguucauucuguuaguaagguacaagccaggaauuaaaaccaaggcagucuccguggcuccccuacuuauuuucaaaccuguuuguauuguuggauguuuuugcccuacaccgaugacaucucuaacaggggacucuaugaacuuccuccuucaagggaaaaauccacauuuuguugugcuuuauuaauugcaugggaauucagguagaccuuauuuagauuaaugguaagcuuuuaguguggaauaguuaggagaguuucaaaggauaaaugucccuugauagcaauuuaaaguuaaguuuagcucuuucuccaaguauaaggcaaauagcgaucucucagauuauuuuccuuaucauggaugauuaacaaauggauguagucggagaaagcagucguaucuguuuauugacucaucaaaaucaauuauagcuagauuagcagggcaggauuauauagaucauucacuggauucauugaugauaaaaaggacaccaaguugauaugugaagaaacaaaauugcaggaagggcauaugcuucuuaaaugacccacuguuagagguuucuuuucaguuauggaaauguuaagcaaucuuuucauagaaucuuccagggaacuaaaaugacuuggugcaggaaugauaaguggagaagaguuuaaaguuaaugcaaaugcaugaucuaacuuaugcaaacacuguggcaaagcacacagacuaaggaacccaaguuagcaagcacaucagcuagcauccuguuuacauuucuguccucagcucuacucauuaaaaucacuaauccuugucaguggaggauaguguauuuggauuuuugcacauguuaaacguucacacuuacauuuauacccacuuuugccuuuauuuacucguuagccuuucaaauccaggagguuuaaauaauauuuuuagacugggagacuucuguuguuuuguuuuaaucagccagauucucuuaacaugaagagaauuugcauuuuccucguaaaauuggaauuucugagaagaaucagaaaaguucuucuugguccugugucaaguaugggagagguaaagaucacagagaaguuacaggcaacaguucugaaaccacugugguagaaaaaggaagaaaaaauucacagauaaaacauugcuguugacacaagaaauuguuaaguacuuaaaaauuaaggugccauguuuacgcuguuuguauuaugugguaaaugacaaagguauuugcagguggcauuacuuguuuuuuuuguuuguuuguuuguuuguuuguuuagauggagucuugcucugucacccaggcuggagugcaguggcaccaucuuggcucacugcaaccucugucuccuggguucaagcaauucucaugccucagucucccaaguagcugggauuacaggccugcgccaucacgccuggcuaauuuuuuguauuuuuaguagagacaggguuuaaccauguuggccaggcugcucucaaccuccugaccucaagugauccgcccaccuuggccuauuacuugauuuuuaaaaaagaauaccgaauaauucugaaaggaaaauuaguaucaaaaugagguauucauuauggagucagcucuuaauuucuuacacuaaugaaauaaauggaauucagcauucuacugaaaugacaagcaucuugcucccauucuguaccaggcccuguguuggaucuugcacacucagggugcuccuaguugagaggcuggacaggcaggcaaaccuauugucauagcucacucgaaaaaguggcccaauggcagcugggguaaagugcaguggggaccuuaugcuaaccugccuacaagagcccaugaagcuucacaaaagaggugguguuugacaugaggcuugaauaauaaguaggacuggcaaggaggauggugggcaagguauucuggacagaggaaacagcauugcaaagucaagaugggggcaguagcugaguauuaccaggggauacagaggaaggaauaauagcaaaugaggcuggacaaguaaaggggggcugaauuaugaagacucucauggcuauguauaagaauauggaauuuauucucuagacuaggauuugcacgaauguguuucaugguuuacuagaucuaauguguaaaaaugguucuauaaaccaguuggaaaaugcuugguuaaagagaguuuuuuuuaaacuaaaaaaguuaucaguggccaggcacaguggcucaugcccauaaucccagcacuuugggaggccaaggcaggcggaucaugaggucaggaguucaagaacagccuggccaauauggugaaaccccaucucuauuaagaauacaaaaauuagcugggugugguggcaggcacuuguagucccagcuacuugggaggcuaagguggaagaaucacuugaaccugggagguggagguuguagcaagcugagaucgcgcgucacugcacuccaguccgggcaacagagugagacuccaucuuaaaaaaaaaaaaaaagaaaaguuaccagaacauuugauaugcugacacacauugggaauauccaaaaugugucucuaaugcagcauuucccacagaacccugucucgugggcaugggauuuguaguaucucacagaccugacuucgggaaauacugucggggugaauuaaagucaugaaauacuugugcacaaggaagugauauggccagcuuugaguguccacccaaucccuuugucagaugugugcaggacaaaauuggucuggggauuaacaggauuaauccaagauuaacaagaagacgauugucauaguccugaugcuagguaguaagagacugcacuggacagaggcagaagagaaagagaagaaugguagaaaguaaaauugauauaaccuggugauuaauuuuauuuuuuucuuuuugagagagggccuugcucuguggcccaggcuggagugcaguggcgcaauuuuggcucacugcaaccucugucuccuggguucaagcaauucucccaccucagccucccagcagcugggacuacaugcgcacgccacuaugccuggcuaauuuuuguauuuuuuaguagaagugagguuuuuccauguuggccaggcuggucucaaacucccggccucaagugaucuacccaccucggccucccaaagugcugggguuacaggcaugggccaccugccuagcaucccggugauuaauuuugugugggguaaaagagaggagggaucuaggcuaacacccagauuuccuacaagggcaauugggucgauagugguguuaguaaccaagacuggguauaugggaagugaaacagaucugguggggggagcuagcugauacauuucacuuugaguguauugaauuugauguuccugugacauaucuaggugagaccauuuuugcagcgggguugacgagucugaagcucaggaacauggcuuugcuaaucagcagcauauagguguaguuguggcaugagcauacaugaaauugagagagaaagugugucuaugaguaggaggagcaggagaccaaggacaaaggcugggguugggcagagggacaggagcagcagagaagguagagagggaauccagggugggagaagagagcaauguuccagaaccugagcagagagcuuccgaaagcuguuuuuguuuuuaaugcuuuguuuccucuuagcugcacauuuuaugucuggcucaggcuaauauuaaaauuagcucucauuccggagcauacagugacagacugcuagggaaagugucccagaaccacgucguaggaaagaaaaccuagcccaggauuucaaaaaauuguuguaaaauauucaucaguuggauaguuuacacccaggcaaaucaaagcugacugcuuuuguuacugguauagaaaaggagagagacucacucuaccugguuccugcugugucaaauccuccuuuuaggccccagaggcagcugcuuaccugaugugaugugaagagcagggcagaaggggugauuggccaagcaagcucugucugccccacauugcccauugccuuucucuguuuccugaaauucuguucucuucuguucucuucuuuccucauccuguccuuuccucuccuccccugcucauccagagaauagacauucagcccugauuauucaccaggcacuguacuaggugcugguuuucaaggaauuuucuuucuuucuuuuuuuuuuuuuucaagauggagucuugcucugucacccaggcuggaguauagaggugcgaucucggcucacugcaaccugcgucucccggguucaagcaauucuccugccuuagccucccaaguagcugggauuacaggcgccugccacagcgccugacuaauuuuuguauuuuuaguagaguuaggguuucaccauguuggccaggcuggccucgaacuccugacuucaugaucccccugccucggccucccaaagugcugggauuacaagcgugagccaccacgccuggccucccaggaauuuucaauccuaggggaucucugaaauguaaagaaauaucuggaucugaaagugguagugcuauaauaacccaaaauucugagagcgcaggcugaaggacggaugguuucgaccugaagaggaggauuggggauggcuucccagggaaggggacuugggacugaccacuggaaauccucugccaaacuguagcagcugcugcauuugggaguaaccauuaggccacccucccccuggugcaaaugaccugauguaacuagucgacugucaccuguagaagagaagguggugguccugggggauucaagagauguggccuuugaauauagcacagggagaagaaaauuacuaggaugcgaggugcugccugaagagggcguucacccuguucacauggagagaaaggggacaaaccugccuaguucaagguuuccugaggccaggccucaucuccauucauccaauuaugugcgugguugcauuucccugguuccuuuuccucguuuuugauaaagaugaggcuuagccagguuuuagguaauuuugucaucaauuuuuacuuugcaucagauuaaaguccacccccccuuauucuuaauauguugaaauauuuuuuucuuugccucucuugaguguugcuuuuuacgcccucacucgcauuccuuacuuugucccuaccaacccuugcucuuuuucuguagaucuacccccucaauuucugcuccagcaccuacgcucagaaacaguacuacuuagaacuacuacuuagcuuuccuuuugccucacccaccuuucuuaagcaugauuguuuuucucuucuucuagccucuugguuuuuccccuugcguugguccuuuuaagucggguuuuuaguauuaguuuauuauuauuauuauuuguaugacuccucuaccuucuuuucuugaacuaucgaggauggucagcuccugcaaagcccccuccuauuuuuguucugucuuccuuauaagguugccccaggguacaugguauauguagaacgguaggaaaguccagaggaggguguuaaggagagucccuguaaauccugagcucugcuuggcaacucuacugaggaacugcucuggaacuuucucucucuuaacuucucugcagauuuuuuucaacuaccuuuuagucccuguggguaucugacaguugugaaccccauucaacccuacauucuaagggaugcagagggcacggacacuugguccucauguuuuggagguugaaggcccauucguuuucaaucuucucuguguuggacccaucccuugucugaaauaaaaauaaaaaacuccuagccugagcaguugugugguuuugagcaugggaauccaagagaucauuacuuuccacuacugcuuccacccagauucauguuucagcaaaagcuccuuagguccaagcaguggggagugugggggagcacuuucacugcuggcugcccccaaccacacuucugugccccugcaggagugcuauuuagcaucgaggucaccuccaccuacuuugcuguucggaacuacuggagaggauucuuugcagccacguucagcgccuuuguguuucgagugcuggcaguguggaacaaggaugcugguaaccaaggaggccuuggguggaggccaugugaaauagaaaagcugggaauggggugcagaggaaaacucuguggggcaguucagaaaaggaauaaugggcggcaucauuuguggggugggaccaaggcccaaggguguaugacaaagauauaggucauggagugggagaguauauccauggaggagugugcguagaaaaaaggaaaauacauucaagaggagaaacugggauuggaggaaggaaggaauuaauccugaaaacugcccaccucuguuucccuguuggguuucuacgaagcucccaucguaauacuggccuuuccauccuacagucaccaucacugcucuguucagaaccaauuuccgaauggauuuccccuuugaccugaaggaacuaccagcuuuugcugccaucgggucagugggguuaccugcucuguguguggugagcaggguguggagugaggcuguagauuggaagggacccaagcuagaaagaaggugcgguuggcacagauagaguacauugcuggggggaugugggcagauaggaaaggcagaagccugguauuuguuucccugcaguaguuauguccaagagaugaggauuucaugucuguaagauuccaacucuauaaauuacacccucaggauuugcugugggcuccugggagcuguauuuguguaucugcaucgccaagucaugcucgguguccgaaagcacaaggcccucagccaguuucuugcuaagcagugagucacugcccuucuuuugcccuacccauuuacuuucugguuucuccaagaguuccucccuuuuugucuuuggggaaggcauuaaaugccucuggguggcuugcauuaaaauauaaggaagcucugauauugugguuagggggugaauuguguggucucccauuuaaagauuauuuuuguuuuuguuuuuugagacagagucucacuccaucacccaggcuggagugcaguggugcgaucucagcucacuguaaccucugccuccuggguucaagcgauucucaugccucagccuccugaguaguugggauuacagacaugcaccaacacgaccagcuaauuuuuguauuuuuaguagagauggaguuucaccauguugcccaggcuggucucgaacuugugaccucaggggaucuacccuccuuggccucccaaagugcugggauuacaggcaugcaccaccgugccuggcuaauuuuuguauuuuuaguagagaugggguuucaccauguuggccaggcuggucuugaacuugugaccuaaggugaucugcccaccuuggccucccaaagugccccaugggauuagaggcaugagccaccgcacucggccucaaauauugguuuuuugugugaagagaaucuuuuucauuuaaagaaaugagacuacgguggacuaaaggaaacuucagcuugccaucguucaguaugguauuuacugugaguuggcugaauuguggcgguuaacucuguuucuuuuucagccgccugcuguauccuggaauuguuaccuuugucauugccucauucaccuucccaccaggaaugggucaauucauggcuggagaggucagcuguugguggggccacaugguaaagaggaaacagcacagauauaccucaggcuucagagcauaaguaguuuuguccaaggauagacuuucuagauucucccugagaaaagggcaaaagagacccuugaauaaugaggcuggggaauaaguucucuaaaaaaggaagcacaggaguucccuggagaacccacccuuucugcuucuuccucucccaguugaugccccgcgaagccaucaguacuuuguuugacaacaauacaugggugaaacacgcgggugauccugagagccugggccagucagcuguguggauucacccccgggucaacguugucaucaucaucuuucucuucuucgucaugaagguacugcuccugacacuagcaacacccuaaaccuccaucuguuuucaaucuaugaacccaggguuugcauaggguaggaagggguagaacuucauuuggucuucauccaaccuaaaaauaagucauuugaaaaccauagaguuggccaggcaugguggcucacaccuguaaucccaccacuuuggcaggcugaggcagguggaucacuugaugccaggaguuggagaccaacauagccaacauagcgaaaccccaucucuaccaaaaauucaaaaaacuuagccaggcaugguggcgcaugccuguaaucccagcuacuggggaggcugacgcaggagaaucacuugaaccugggaaguggagguuguagugagccaagaucgugccauugcacuccagccugggugacagagugugauucugucucaaaaaaaaaaaaaaaaauuauagaguuguaaguugcuauagaaguaaacuaguaucugaguuaauugcuguauucacgucaacuuaguguugucuggcauaguuaucuaacccuucuaauuguucuucuuguuaaauuacuaagcugucacaguagccaaguaaaaaaguacaagauagaguuaagcauuauaaauaacuguaaaagccuuggauuaauuaaccaaauucccccacuuaguagauaauuaaguauuucauucuccauguaucugaugauccauuuuuuaggugauuugagcaucuuuuuucccccgguuuuguagauaaucucuuuuuuagaucuucaaaagggauaaaauauuuaaauuaauuguauuagugacuacacauaauuuuuauacauguuauuauucucuauuuaggugaugaagcugugaggauuuugccauucccaaaccauauucuucuagcuucaacuaggcaauaaaagaugaucucuuucacaucacuucuuuuucauaucugcccaucaaggauuauguauuuauagacuucucaauuacugccuuguaauaagauauuuuuauuucuaccccugguugugacaucuauuacaauugcugauugcuggccaggugcaguggcugaugccuauauucccagcacuuugggaagccgagagaggugggucaucugaggucaggaguuggagacuagccugaccaacauggugaaacccugucucuacuaaaaacacaaaauuaaccaggugugguggcacaugccuguaaucccaguuacuugggaggcugaggcaggagaauugcuugaaccuaggaggcggagguugcagugagccaagauugugccauugcacuccagccugggcgacaagggcaacacuccucaagaaaaaaaaaaaaauuauugauugcccuuuuuuuucuuuugugaugauuaucuuuuuuacuaauaguaugucuugccuaaauaacacaacacuuuccucuguauauuagaguucucauuuauaagucuguucauacugaacuuucaagcuuuugaauaccuugcuauuaacuuauuuaugauaccuuuuauaaaucuauguuuucccaggauaugagucaccaaguuauauuuauauugcaauagcuacaguggguucaugaguucauuuguucaauaaauguuauuaagcauuuacuaugugccaaguacauaauauuucaucauuaaccuuuagcuauaucuuaugcuugcaacagaaaaaaaauuuuuaaauauuuuaaaacguucuauuuuuugcuguuuauuuaauuuaauuuuuuagugauguuaagacuagagacagcagauacgugaaacaccagauuucaacucuguaacauauucccagggugucuagaaacuguauuugcaaaugaucuuccccauuccacuuuaggugguuuaguugaaucuacagcauucauauuuugcacauucacuuuauuaauuuaaucccuuuaaaaugucuuucuucaaaagauuuuacauuuuuaucaugaaagaaguuuucagugucuuguuagggauuugauuuuuagacuuucauuauagaguucaucuucucuaauuuauaaaucccaaccuccuauaauuaguuguugaguacacaaacccaucuacaguaaccaaguacaaauuuugguggaucucagaauuggacgguaguccaaugaugauaacuguauuuuucugagauuccucuagacugagcuauacggcaacauuggcaucguauguaccuuuaaaauaucaagauuuugaaaaguccuguagaaacgaaauacuguauauuuuucaacauuucugccaaaccucaucccagcucuccagauucccaaguauaugucuggauuccacuucgcaaauucaagcuuauuuugagaaaccuacuuagaugauauagaggacucaccuguaugccacaauuauuaauuucucacuagauuauauccuugauaauguuacaucauacuguaucaggaaaagaaacauauacuuccugggcuauauuucaagccuaacaguuugcagcaggccuauaauauccuauaauauuuacgaacauaaaaccauucacugcuacaaaucuaugauauucccugguuaucaccacuucccagcauuuucacugucuaaucauuggacacaauaaccauacucuuauuuuuuagcuagguaggauacauagcuaaacuaaaauauaaacaugacugaaacaauuuuuccagugccuaauuugaaauguagucuauguggucuucuagcagcaucuguacaggcagguaagauucucaauucagcuguuuuguuuuuuuuuuuuuuuugauucggaaucucacucuguagcccaggcuggagugcaguggcacaaucucggcucacugcaagcuccggcucccagguucacgccauucuccugccucagccuuaccuguagcugggacuacaggugcccgccaccacgcccagcuaauuuuuuuguauuuuuaguagagacgguguuucaccuuguuagccaggauggucucgaucuccuugccucaugaucugcccgccucagccucccaaagugcugggauuacaggcgugagccaccgcaccuggccaauucagcuguuuuauaauauuaaugaagagaacuuccaucuuccuuaaucucaugacguggaaagugucauuacauuauacaucaagagaagagcuuuuacaaugaguaugaauaccauuccaaauucucaguuugcuuuuaauaagucuaacauuguuaccuaguaucacuaaguucucugcacagccugaggcucuguugaauuuuuuuucacuccuuucacuucauucucccgaagugaauucuucauuuuacuccuucuaaugaagggucuaaauaugguggaaacccauaauggguuuccaguuuuccaguucccugaaauugaguguuuaaaaucgugguaguucuguaggucuagaucugaagaaaaaaaaaaaaaagcuggguguaaucccagcacuuugggaggccaaagcaggcggaucaccugaggucaagaguuugagaccagccuggccaacauggcaaaacccugucucaacuaaaaauacaaaaauuaccugggcgugguggcaggcgccuguaaucccagcuccucgggaggcugaggcaggagaauugcuugaacgcgggagccagagguggcagugagcugacacaccauugcacuccagccugggugacagaacaagacucugucaaaaaaaaaaaaaaaaaaaaagaagaagaagaaaaaaaaaggaaggaaggaagggaaagaaagaaagaaagagaaagaagaaagucuugggaguuauuuguguuucacauuacuucuggaucuuuucuuucacgugccaauagcuaaaaaaguuuguuaaucucaugugucaaccuuugugcuauaggaguugauaacuucaaugucuucugauuguaauacuguucuuacacauaucuuggaggauaaucuaaaauacaucuucugaaaucagaccuauugguuaccuguuauaugaauugcuagagcuuucagauuaaccugagccuacaaaaucucuuauggcuuuuauguacuuauuucaaagagaugguacaggauaguucaguccaacuguuaaaugucagaaucacuuaagaagcuuaaauuacaagugccuauagcccuaucugcagacaaucugaugugguagcuuccaguggggucuggucaucugcauuuuaaagcaaguuccccuggaugagcauuacucuuuaguguuuuagcaaauauuagcucugagaagcuuuuccuccuuugcaugaauacuauuuguucagcccaucuucguucuuuccuuccuuccuuucuaccuacucaccuagcuacacccuuccuacauuuacugagcacugugccagugcagagagaaggcagaaaggacaagaugcacucucuguccucaggggauucucagucucuauucucuucauuuugcccauucauuuuuauaguucucaacuguuuuugaauagucauauucugacaugaaggaguguguguuuugccucaucucagaucuucugggaugagacuuucuuagagucuuugucacugucuccugaggucagcccuggaugaggggaguucuuucuuucuacgguucugaaaauuaagaaauauauuucucguuagcuuacagugcaauugcgcacagcucuaaaauugugaauacuuucaucuuggcaguuuguccugagcuuuagcugcuaccuucuuacaccuaauaaguuugagauccauuucugaaauugguuuacuuauuuuggaagggauauauaaaccuguugcuuugcuuacauaugacaucucauacuucuauuucuuuuacagauauuuaaaaaguuccacaacuagccuuuuuuccauucuauuucucaauucuuuuuuuuuuuuuuuuuuuuuuuuuuuuuuuuuuuuugcgacagagucucgcucugucgcccaggcuggagggcaguggcaugaucucagcucacugcaagcuccaacucccggguucacgccauucuccugccucagccucccaaguagcugggacuacaggugcccaccaccaugccuggcuaauuuauuuuuuauuuuuuauuuuuuuauuuuuuaguggagacaggguuucaccauguuagccagaauggucuugaucuccugaccucgugaucugcccaccucugccuuccaaagugcugggauuacaggcgugagccucugcacccggacaauucuuuuguacucuuugccucaaaaugcacauauugcuuuuuguaaaauggucucaauuucuauuggaguucuagcuuacaaaauuggccuuagagauuuuuuuucuaucacauuggcugacuuaucaggcuuucucaauuuacccuuccaguagcuagccaggacagaucuaaauuuugauccuuguuuaaggugaucugaucauuaaagcaaguggcucaggcagguaagucuucucuccagguucuacugugaguuucaccauauagaugguucuaugaccccauugaagcucaauuaaucacacaauaagucacucagacuuuaaaugucugacacuuagaacuggagcuccuuggccgggcgcaucggcucacaccuguaaucccggcacuuugggagguagaggcaggcagauugccugaggucaggaguucaagaccagccggggcaacauggcaaaaccccgucucuacuaaaaauacaaaaaauuagcugggcaugguggcgugcgccuauagucccagcuacucaggaggcugagacaggaaaauagcuuggacuucagaggcggagguugcagugagccaagaucaugguacugcacuccagcuugggugcuggguggcagagagagacccugucucaaaaaaaaaaaaaaagaaaaaaaaaaaaccggagcgccuuuucagaaauauaaccugaguaggaaaagucuucaagaguuucaggcuacuuugcugaggcaaacuuucuggacuaaauggguacaaugggcuggggcucuuuuggggcagagaaagauaaguacuccggggcuccauuccuuguucuagauugcugaaaggcaaauacaggcacucaaaguagaagggauuuggucuagccaucuagaggaaccuucugauaguauugucuuuggugaucucuuagccugagagcucuauggcuuuuguuucuggaagaagggugacagacaaagugacuuucagaaggaucagcuaucccaggauuucugcagaaaggaggauagugggaagggaauugugugugcaugucuauugggcagaguugaaaggguauuccaacgcuucuuucuacuccaguucuggauguccaucguggccaccacuaugcccauacccugcggaggcuucaugccuguguuugugcuagguaaguucugaugggaagccuggggucugacugagaguugcaaucuaggauacaggaaacauaaggaaaggcccgggaugcugggaguuuauauuuguucuuaaugcccaaggagagauugguucugaaaacugagagcaaggaacuuggaucucguaacaccuuccuuccuuuuaucuucccucuaggagcugcauuuggaaggcugguaggagaaaucauggccaugcucuuuccugaugguauuuuguuugaugacaucaucuacaagauccuaccugggggcuaugcaguaauuggugagaaacauucccacuucccuguaaucaaacauugaguacuucagauccccacacuuaaacucucccauuggaucuucauucuaggcuacacaauacgguuuuaauuuagugcuacuuaacucaacuuuuacucagauaacauacccauggcucugacucucauuauuucuuacugaacuuccgugagccuuaguuuccucauguagaaaaggaucauagggaucaaaugagaucauaagauucuaggauugugucuggauguuugauaaggguucugucuuuccuucccaagaaucauggaaccaacaaugcaggugauuggcucagguugcaggugauugacucaaccugagacguguugauauugauggguaguuaagagcacaggacuaagagcuaagaaacauggcucuagacuucuccugccacuuguuaccagucaccaugaagcaagauagcugcuucugagcccuaguuucuuuauucuaaaaugacuucugagauagagcuaugccuaacaccaauagaauccugggauuauuaugcuuccucccuuccucagcaaaaucccauagcaucuaaggccaugccuucccuacauagagaagugcugaccagcuuucuagcucacuugguacgcugcuccccugacauaguuucuuucuaaaagccucuuucaucaaugagggucauagacucuuguucuccaucuucaugacucccugguacacaugccucccuugugaacauuuccuuguaugcacguccugugauuguuuauguucugaaguauguuauaugcaauauccaauagugucauuccucccuauauuucccuucugugaugcuuucuugguugcucucucccuuucuuucucccuuccuuccuucuuuucucucuucuccuucuccuucucuucucuucuuuuauuuccagagucuugcucuguugcccaggagugcaguggcgcaaucuggguucacugcaaccucugccuccugggcucaagugauucuccugccucagccucccaaguagcugggauuacaggcacaugccaucaugucuggcuaauuuuuguaauuuuaguagagaugggguuucaccauauuggccaggcuggucucaaacuccuggccucaagucauccaccugucucggccucccagagugcuaggauuacaggcauaagccaccaugcccggcugacuuuuucuuguuacauuuucauaugugccuuccucuacauuuuccccauaggauaccucuuccauauuuaaauaagaaauauaauuaaagcacaaaggacuauuuugguuaguggagaaacaaccaaaaauuaacaagauagauucuaucuucagggagcuuauagaauuauaaaguuucagaucuacaagcgccuuagaaaucaucuaaaugaccccuuucgcuuuauaauugagagcaugggauuccagaggaauuaagcucuacucauuccauugagaaauaguaagagcaggaucugacacaggucucauugcugcauguccacaguaugauucucggguuuucauucuauuuacucacuaauuguuggcauuaauaccuaaagcccaagguaaaaaaaaaaaauguuauaacugaguuguaaaaugcucagugaagaggccugauacaguggcucaugccugugaucucagcacuuugggaggccgaggcaggcagaucacuugaggccaggaauucgagaccagccuggccaacaugacaaaacccuguuucuacuaaaaauacaaaaauuagacauguguguuggugcaugccuguaguccuggcuacucggaagacugaggcaggagaaucacuugaaccugggagguggagguucccaugaaccgagauuguaccacugcacuccagccuaggugacagagugagacucugccucaaauaauaauaauuaauaauaauaauaauaauaauaauuuuaaaaaauaauaaaauaaaaugcucagugaauaaucauccaaacuuuuaaaagcaaggaauggauaggacaucacuaucuucauauuauaaaugaaaauuuuggcacacacaaagauuuuguaacuuggugaaguuuauagaaugagaucaaaaugaugauuuuucuaagaguucaguauucuauucccuacucuugacaagucauuaugaguauuggcacugaccagggucaugucucucauuccguguuauucccaucccauccccauauguccuucaugcuaagaacgguagcccuaaccuacaggcguauuccugugucauucuaggagcagcagcgcugacuggugccguuucccacacagucuccacagcugugauuugcuucgaauuaacgggucagauugcucacauccugcccaugaugguggcuguuaucuuggccaacaugguggcccagagccugcagcccucucucuaugacagcaucauccaggucaagaagcuacccuacuugccugaccuuggcuggaaccagcucaggucaggggcacuagacggaauuaguucagaucugauggggagagugggagguucugaggcugagacugagcuuagaguuaaaguuuggaaacacuguuuuaaauuauuauuauauucucaugcaccuaguagauauugugagugacugaaaguauggcaaaucuuaugggaggaauggaagggauagguauacgguggggcuaacccaccaugcuuucucccuccauagcaaauauaccaucuuuguugaggacaucaugguacgugaugugaaguuuguuucagcuucuuacacauauggggaguugcgaacccugcuccagaccaccacagucaagacuuuaccacugguugacucaaaaggucaguggggaggaagaagucgacuccagagcuagugaccugaauaagggucacauagagguagaggaggccccauggugggggcuuugucuuuaggggccauccaaugugcuauguacaaggaaggaaaaauuaagccauaacacaagcacacaaagacaguuaaaaaugcaauuaaaagguccuggcaugguggcucaugccuguaaucccagcacuuugggaggccgaggugggcagaucaccugaggucaggaguucgagaccagccugaccaacauggagaaacccugucucuacuaaaaauacaaaauuagcuaggugugguggugcaugccuguaauuagaacccgggagacggagguugcgaugagccgagaacgugucauugcacugcagccugggcaacaagaaugaaacucuguuaaaaaaaaaaaaauuucccacuaaauacagucaauucucauaauucaugguaguuauguucaauuaaguaugaaguucaaauacuauacugaauaauugcuccuaggaaaaauacagggcuguguuccugugagucucuggucacauuuccaucaaccaaucaauauaugaccuuguuguauguguguuucugguaaagacaccuuauuucacagauauuguggauuaauuaauauugaacuugugccaacagcacuauaacccuugccugaauuaagcuuacuuaacacacauauuuucucaauaaggcucaucacagccuucuugcacuaggaacaguaaacagcacuuugacauuauauuugguggucauuuuuagcagcaaaaucaccaacacaaagcacaaaaaugcaaaaaggauggcacuaaauagacuacaaaaugaacaccuguuuacaaugugaaagcugaaacaagaagguacagcacugcuuuguucaacuucagcugggaacagggacaugggacaacuaaaaaucuuuguugcucuuugcauguuugugaauuacagugaaagcaccucuaguauugguuuuguguuacaaauauauuuuagugacuagcugaauucacaaauagggaauccaugaauaaugacaauuaauguaaaucccauagcuucuuacguuguuccauuuugaugcuuacauaagucaugcuuguucuuuaaugcccaacuuauggaagaguuggaacuguuuucuuucuuccuuccuuucuuucucuuucuuucuuuccuucuuuuucuuucuuucucuuucucucucucucccucccucuuucccucucucucucuuucucucucccucccucuuucccucucucuuucucucucucucuuuucuuuucuuuucucuucuuucuuuucgacagagccucacucuguugcccaggcaggagugcaauggcgccaucuuggcucacugcaaccucugucuccuggguucuaagugauucuccugccuuaggcuccugaguagcugggauuacaggaaugcaccaccaugcccagcuaauuuuguauuuuuaguagagacgggguuucaccauguuggccaggcuggucucgaacuccugaccucaggcgauccaccagccuuggccucccaaagugcugggauuacaggcaugagccacugugcccggcuggaacuguuucacauggaggagugaaugguuguuaguaaacgauaauuucacauuucucugccuucaccaucauuugacacuucauccugcuuuguaugauuucuuauugugguuuauauaucuauaucuugucuuccuaacuaggugggcauuccuugagaauagaggcuaugaauucuauauacccagagugccuuguuauagguaucuacuagauauuaaaugaauaauuuccuaguguuugaauuaguguaauaaagaaaaaucauguagggccauuuggagucauuaagauuguuaguucugauuuccaauaaucagaauauccaaauuucucaaauuaaauuaauucaaauauuuucccaaaucucauauacauuccacguucuacagcagaggcucuuuauuagaggagggguacagccaacaaaugaggggcaagguuuucauaauaaugacugagaccuaacaguaaaauucaucuccagagcacugcugcaaugucuuggccuuaaaacuuaauaaaaauguuaacuauaguagcaaaauuucuauaaucauauaaaagaccuucucaggaaaaguaggcauuuugauuuauccuagcaggguuuuuuuuuuuuuuuuuuaaugaaaucucgcucuugucgcccagguuggagugcaguggugcgaucucagcucacugcaaccucugccucccggguucaagcgauucuccugccucagccucccaaguagcugggauuacaggcgccugccaccacgcccagcuaauuuuuuuauuuuugguagagacgggguuucaccauguuggccaaggcuggucucgaacuccugaccucaggcgacccgccugccucggccuuccaaaguagugggauuacaggcgugagccaccgccuggcccagguuuuuuaaaugaugaaaugucagauacaaaagaaagaguucccuuguuucccuuuuuccagggagagauauaauguuuguauugcuuauagacuucuuucaaagcguguucacgucucagcuuauuugaauggcuucucauguuucuuuuuauuuggacagcauugauuagccuccuuaauuaucagcucaccuaucugaagucuauauaaggccucaucaaaauaaguacaaauuagcccaauuagugcucuaccaauuggccccguaccugcuaaauggaugaaauaaaagggauugagugagguuaaucuuggaggauucuuaaaaugaguuuccaggaagcugagaaagauguggggacgccgggcaggguggcgccucuccuguuccuucucaggagugcggagcgcgguggugcgagagggcuuggagggggcgcucaggcagggcguggguuucccucagauucaaugauccugcugggcucgguggagcggucggaacugcaggcccuccugcagcgccaccuguguccugagcgcaggcugcgcgcagcccaagagauggcgcggaaguugucggagcugccuuacgacgggaaggcgcggcuggcuggggaggggcuccccggcgcgccuccaggccggcccgaguccuucgccuuuguggaugaggaugaggacgaagaccucucuggcaagagcgaggugaccgcgccgggaagggcuagggagugggauagaucaggagcaaagggaaaagcgucgucugggcugggcugggcugggcugggacaggcguaguuucccugaaaguagugggaagagggaggggagagucugguaacugagaaagccagaaauucuggaucagguaccauagagaccagugccucuggguccagggacuaaagaagauaagguugcagaugaugguauccucgacaauucaaagggauauaggaauuucugaacuggggggaagaauagaguucgcuuucccagaacauccaccaacugguaaaggcagugaaggcccaggcagucucugcucccaggcugagacuucuuacucuuccuuacagcuuccuccuucccuugcucuccaccccucuacuacugccccucuguccccagaagagcccaaugggccucugccuggccacaaacagcagccggaagcaccagagccugcaggugacgcucuucccucaugcaccccaacucaccccuuguggguucucucuggucacuaggaccugaccuugaccugcaugcaauuccuaugcggggugggguggggggugaggcugggggauugagggaggacaggguucuuauucaucaauucuccuuguuacugucccagggagugggagcagagggugauuuaggaggguagaagagagggugagguaccugggaagugcagcucuuuggaggcaaauguuaggcacuggguggggccccuggccguuuccuguugcuuuguguccauuuccauccacucaccuguccucucaggucaaagacccuccaucuuccagucccugcuucacugcuugcugggcagagcucgccccacaaagaagaaaacaacccaggugagaggagauguguuuggggauacaggggaaagggagccugcccuugaagagugagaaacccacgguucuuaaaucaggaaggcagagaccccaccaaggaggaggaguuuaaucauauggaagggaugaugaaugaaaaggaggcaucggugguccuggccagggagggauggcuauuguuucauugggagccauagcuaccaugggaagaaaagggaaagaacuuggaccuaugucuuucuucucuaggauuccacagauuuaguggauaacaugucaccugaagaggugaguaagggaaauggaaaccugggguggauuguucuaucaaaugaagauauugcuaauuuguuucuaccuucuuuauuguguugucaugaaauagaauguggucuggaugggaaguguuuugagaggauggaaauaaggaugauuauggagagaguaaugagugugugaugggacauggagguguucucagaaggacacgucauuucagaagagaaaaacuuugagccuccaugaguaaauggggccauggugcuaagaugagccccagaucuuuuagagauuaugggcuuucuggaucaggcaaagcuuuaauggagguaaaauggcaccaggaggcuggcacuaaaacagcaacauagaagaagaacaucaaaacuaaaaugggaggccgggcaugguggcucaugccuguaauuccagcacuuugggaggccaaggcaggcagaucaccugaggucaggaguuugagaccagccuggccaacguggugaaacuccauuucuacuaaaaauacaaaaauaagccgggcaugguggcacgcaccuguaaucccagauauuugggaggcugaggcacgaaaaucacuugaacccgggagguggggguugcagugagcagagacugcaccacugcacuccagccugggugacagauccagacuuugccucaaaaaaaaaaaaaaaaaaaaaaacuaaaauggagaaaucugcuccugguggagauuacugugcuggauugaucagggcccugagacagugaacaacuggaaaaugcuaggcauugcuacugggaagaacugaaaaaggaagaaaauaaugaccacggugccuccuggggacaaacaaaugccuauuuuccuaaacgaggugguuaucaaaucuucaagagagaaaaaucaagcauucugaaugugcuugguugucaggagggaacagaauguggacuagugauuggaagcaggcgguaucagaacauaccgagggguuguggaggaacaucaacagaaaaauccauuggcaacuauuccauaugguaaaagaaugcagaguuugcugcaaacgccgaaaacguaaagcuuguaaaguaugaagcugacaaaaaaaacacggcagauauuauuuuuaaaugaacaucuuauuggauauccagaauaaauaugugcugacaaugaaaagcauuacaggauuggaggaggauguugugagugacaagacagaagagaaaccuuccccacccccucaaaacacacacacuucugauaaaugacuugugaaaaagucaaaucgaugaucacagagggaaaggaagaacuauuccuucugcccacaagcaggaaucagaaaggccauaauugcaguuaaggaguacuuuguuagguugcuaaaaccaauaacaauaaguuuugcuuuuuuucuuuuuuuuaauuuaaugcaccaaagagagaaaaccagcuaguugaucaguguggcuauugaaugaccacuggaaauaaagugaagccagggauuaaaaauaagauagacuaucauuucuagcuuaugucuuucccagggaagacuuuaaggagcuaccaacucccaugugacccacugagacauuuuagagggauaagaucuaacaggaguugaaauucaggauguuuugaacacaauuuucagaccagaugauacccuugacaauaucaagauguugauauugaccaaaaaaacaguaugggggcaguaugggaauauugaaagauucaauuauauguugccagaagucccuacuaggauuuguuuaauucugcauacucuggaguacacacagagcucuguuucuaaccgguaccgagcuuauucaaguaguggaacacaccagccucaacagcaacguccugcaucccuugcgcaaaagcuggagauguaccuggaauacaaacagcagucaagguuagaagcccagcuccaccaauuacugacuguguaauccugggcaaaugacuucaacaugcugugccucuguuuccucaucuauaaagugaagauaaugauagaguuauuagagaagauuaaaugagcuaagacggguaagucaauuagaauaaugcuuggcaaagaggauguacuugauaaucauucacugaaaauguugccgcguuauuguuaaggaaaggcaaaaacggaacauaaggccacagaugaucauagaaaagaccaagaggacgggauggaccaaaccaugguuggcaaggucuagcccccguccuauaccuaaaucuucucuacaacacaccugcuaaguggucauccauccuaugcuauguaaccucuguaauccauuaguccggaagaugagaguauagaggagucaugauuguaauccagaaauaucaggacaggacagguggagugagcaucacuacgggcuacacaccagauccuaaaccuauauaaugcccuuuggugauauucucugaaguuugagagguguagauuuggacaaauaggaaaauagaguucuagaucauucagaggauacugacugaaaagagauuuuagaaauuuuagaaaaauguaagagagccagagauguaauggauuauuuggacucuugggaauuuuggugugcguaucuaaagucaagaggaugguuggccuuugugccuuaaugcuucugucauagacaaaaacaaacaaacaaaaacuggcuuugcucaagucagcuaagugccaugagguccaguauagcucuucaauuucaacaaguacccacuacaguucccugcaugagaggugaugugcuaguuucuucacaauauacagcagccgauaccacauaacacucaagacaaaugcagagguaagacagaugccaauacagcaggaaguauggccaaugucauuucugaaaaggugagaccagcuaauacuaugggaauaaaaaaggggagaagcacaucugauugggagagucaggaaauacguacacugcagggagaggguagggcagguaaaggaacuccagauggucagaauagcaaagacaaaggggaaggcauguuugaagagcagaaagcagucugguuugauuggagccccacgucuuauaguaguaguggaaaauagaugggaaagauagguugggaauaacaaauguuugggacgccaggggauaggagaguuggagccuagaagagggagggguguucuggguaccuggggguugcaggguagguugggggccugaugaggaagggcagagaggcucuguccccugggaagaaggaggagguccucugaucugggggaucuaugaucaguucuugcauguucccagauucugggcagcggcuaggagggccguuuggggucaaaaucagguaucuggggugaaaggaggcucugugauuuucgugacuuuccuccucuggcugacagauugaggccugggagcaggagcagcugagccagccugucuguuuugauuccugcuguauugaccagucucccuuccagcugguggagcagacaacccugcacaaggugagucuuuugcugacugcucagggcuguggggaaggcaggagagcuguggggcaaggaacaugcacugaccugugcucuucauccucagacucauacccuguuuucacuccuuggccuccaccucgcuuacgugaccagcauggggaagcucaggggcguccuggcccuggaggagguaaucacgaugugucccauuugagcagcaggagggaggcugggcauaggauaaggggaugcaguggggacagaaggaauauuagcaucucagaaguccccucagauucccuucucuauuucuuucuuuuuuuuuuuuuugagacagaguuucacucuugucgcccaggcuggagugcaguggcgugaucucagcucacugcaaccuccgccucccggguucaagugauucuccugccucagccucccaaguagcugggauuacaggcgcccgcuaccacacccgcuaauuuuuuguauuuuuaguagagacgggguuuugccauguugggcaggcuagucucaaacuccugaccucaggugauccgcccgccucggcuucccaaaaugcugcgauucuaggcaugagccaccaugccuggcaccccucuguauuucuuaugcagagauuggaggggguagagcaagcagccagcugagguagaggagacuacgaagccuguuauggccacagcccugaagggaauggaauucuccaccccagauggggcccacgugaucuucuguagauaguguggguuugagauggggguuccaggcaugagucacaguuucucggggaugcgcuuugaggaaagcugcggaaaaaaggcaguggggggauguggcugcagguggucacuaggaaggaagaggucacccaagggucugagucugggcagguggaucuuuugucaugccccuuuucuuguccuuuuucuguuuucuuucucugauuguuccuuguuuucuguuucucuuucuccccguuuugccacucuauaucuuuccuguucuuuuuuccuuucauuguaccuguucuuuucugugucucucacugcccccgucuuuuuucuuuuuccaacuuuuuacccucuuuuccuuucccacugcucuucagcuacagaaggccauugaggggcacaccaagucuggggugcagcuccgcccuccccuugccagcuuccggaacacgacuucaacucgaaagaguaccggggcaccuccaucuucugcagagaacuggaaccugccugaggacaggccuggggccacuggaacaggggaugugauugcugccuccccagagaccccugugccaucuccuuccccagagcccccucucucccuggccccaggcaagguagagggcgaguuggaggagcuggagcugguggagaguccagggcuggaagaggagcuggccgacaucuugcagggccccagccugcgauccacagacgaggaggaugaggaugaacugauccuuugacccccucccacgaccuccucauaaagaccguggagaggcccagccugagggugaacuuguguggggcagggugcguccugaauguggcgaggucaugccaaugucguggccucuuccaggaauuuuuuaaugugauagucuuaaaggaggaaucagcauuuaggcagggaggagccuuggucaauuauuuugacuguucuccccauucccagccaggcagguggcccuaacccuagcgaagggccccugauauuccguggggcuucccgaguguuccuggugugcaggaagggaauccccugccucucucugccucccccuccccacccaacaauuccccaguacucuugucccagcacugugcuaucugugccucagugucuacaagagguggggugaggggaggcccagaaugacuguggcccugcaagugccaugucggaggaggggaugggaccauccuauggccucgggcacugacuaccccagaaugugccuccagaccagccacagccgcuucucuuggagcccugcgcuggcccacgucugcuccugcagucugccucugagcccacugccugugucgaggccagccacagccacuucucuuggagccccgcacuggcccaugugcacuccugcaaucugccucugaccccacugccugucuccaggccaggccgugacuagcgcagugagaggccgcccacauucccccuccguuguccccugcuucaagcagugagaugcagagaaaaagacugucaggggcagcggccuggaagaaaaggucgccaaaggcucugugcaaaagacacaagugcccuguugcucaacaaucacgcccccaugguguccgccgacucccucuggcagaaaacuuucuauuccacagcacagcuuccuuguccuccaguguccagguuacucccuaggaaacacauccucccucuuguuauugacuuguccugccaaaggucagcucuacccuggagcugcucuagccagggccucuccugccaagaaucagggcucagagcagcuaggucacugggucacucagacaccagcccccucuuagacugguucuucagaugccucuccuagggguggagaguuaggagcugagcgucaagauggcagggcucuugagugcugccccgcacuugggagagucacaucuucacccuccccaaaucagcagcaggaagccuggcuaugcacuccauuagcgugcuuucucuacaaagagaggccaggugcugugagcauccccaaacccuugcuccguacccaagguuuuucuccccagccugccaucccguaugccguucuuaauucuaccauugugcccccgcuccgacauucuccuccuuugccuccccuguucccagucuccuccaucccccaaauaagacacucacagucagaggaugccaccacauucuguuuagugucauugaacacagccuguagccuucuccagcaucacaucccucccacuuccccaggccaagagagaugcugaagccugggugggggacuggcagugggcauuugagcccaugcccuuguguacauaaucucuaauauuuauauauauugauauagaauucucucuauaauauaugucauagaaucucucuugggccuggcgugggaaugugacauuaagaaaacaugcuaagacuggccagaaaaauggauauuucccagaccuggaggauggugugugggauguauaggugaggucguggagaagauaauaaacucauuccccaagauacccucuucaacacaaggacaagaaggaagguguguggugggggaggggacaauggagggggaggaguggaagauuuggauuuucauuuaauaaagucaauugaaaauga

SEQ ID NO: 14610 - RNA, 10812 nt, Homo sapiens
acccccucccacgaccuccucauaaagaccguggagaggcccagccugagggugaacuuguguggggcagggugcguccugaauguggcgaggucaugccaaugucguggccucuuccaggaauuuuuuaaugugauagucuuaaaggaggaaucagcauuuaggcagggaggagccuuggucaauuauuuugacuguucuccccauucccagccaggcagguggcccuaacccuagcgaagggccccugauauuccguggggcuucccgaguguuccuggugugcaggaagggaauccccugccucucucugccucccccuccccacccaacaauuccccaguacucuugucccagcacugugcuaucugugccucagugucuacaagagguggggugaggggaggcccagaaugacuguggcccugcaagugccaugucggaggaggggaugggaccauccuauggccucgggcacugacuaccccagaaugugccuccagaccagccacagccgcuucucuuggagcccugcgcuggcccacgucugcuccugcagucugccucugagcccacugccugugucgaggccagccacagccacuucucuuggagccccgcacuggcccaugugcacuccugcaaucugccucugaccccacugccugucuccaggccaggccgugacuagcgcagugagaggccgcccacauucccccuccguuguccccugcuucaagcagugagaugcagagaaaaagacugucaggggcagcggccuggaagaaaaggucgccaaaggcucugugcaaaagacacaagugcccuguugcucaacaaucacgcccccaugguguccgccgacucccucuggcagaaaacuuucuauuccacagcacagcuuccuuguccuccaguguccagguuacucccuaggaaacacauccucccucuuguuauugacuuguccugccaaaggucagcucuacccuggagcugcucuagccagggccucuccugccaagaaucagggcucagagcagcuaggucacugggucacucagacaccagcccccucuuagacugguucuucagaugccucuccuagggguggagaguuaggagcugagcgucaagauggcagggcucuugagugcugccccgcacuugggagagucacaucuucacccuccccaaaucagcagcaggaagccuggcuaugcacuccauuagcgugcuuucucuacaaagagaggccaggugcugugagcauccccaaacccuugcuccguacccaagguuuuucuccccagccugccaucccguaugccguucuuaauucuaccauugugcccccgcuccgacauucuccuccuuugccuccccuguucccagucuccuccaucccccaaauaagacacucacagucagaggaugccaccacauucuguuuagugucauugaacacagccuguagccuucuccagcaucacaucccucccacuuccccaggccaagagagaugcugaagccugggugggggacuggcagugggcauuugagcccaugcccuuguguacauaaucucuaauauuuauauauauugauauagaauucucucuauaauauaugucauagaaucucucuugggccuggcgugggaaugugacauuaagaaaacaugcuaagacuggccagaaaaauggauauuucccagaccuggaggauggugugugggauguauaggugaggucguggagaagauaauaaacucauuccccaagauacccucuucaacacaaggacaagaaggaagguguguggugggggaggggacaauggagggggaggaguggaagauuuggauuuucauuuaauaaagucaauugaaaaugaaagugcacccccccuccaaaaaaagaaaaucauuuagcaagagcaguuucauucacaagaauauaaaaacagcccuguuccaggacugcuguaaaacgugcugcacagccuuaaccccaaaggaaaagcaacccuuucccaccccgaaacagccucuuccugcacaugccccuccccacccccugaaauagacgauaagcaacccccaugcacccugcccccagcaccagaagaguccuaagauggucccaggccagcuccucagucucccucuucagagcgaguaggagcuccuugcagaagacagacccccaccugacuuccaucugcagcaauaugccagcacccuggggaaagcagguucauguaugaacccugcuagaguccuucagaucuuuagucaucuuuugucagggaccauuuggcuuccuugggaaagggaaggaggaacgaaagcugcuguggucuaccuuuccuaacucccccgggccugagcaaaaacgaacuguaaugaaugaacgcacucacuaggugagcuguccaccguggucuggggguaugauaugggcacugagaggaugagacgacaggaagaggugaugugggaauagcacacauuggagaaggugaggaaccagggaccccauggaaggaaggucacaugaacaugcaaaaccccagagccugcagcaggagacggguggggaauagcugccagggcgggcaugcuagaccaccucucagagcuccuggaaaugagguccugggacauggagucagcacacguuagcaagcacaagaggacucuuccccuguacaggcagcauucgguuaggugacugcaccugccuugguucaccuugccuacgcccauguuuccuccaaaaaccaaccucaggauaaccauugucccccuuccauggaagacacagaacccccugcccugcuugcaucccagaagugugaguaagagaguaugaacuugauggcgggacaggaccauagauggacagaaacaccccaacucucaaccuucucacuccaaaauaauaaguucuggggccugggggugagggcaaaguuugugcccagggccaggagaggacaacagugcucccuuccagcagaggaugcaagugguaggacuccugacagaguguggguaggacacaggccugggagccggagccuuggaagggcgugaggaaagaaggagauagggcagugagccucuuaggccucucucuccuacccgaacucugccugugccaagggcuggggaggggcuaccugggcaguggcagggccaagugcucuccaaccccacagcaccgcugcuuugcuccgcccauccucugccugugcucucacgguagugcuggggcgcauaugcugcucaguccccaccagcauggaugccaagugugggagggcaagcuugugccucaccauacaccauccuggaaggaagaauccgcugauuuuccucucuuccucugguaggaggccuggggaggcagggaggacagcugugaggcuguuugggaguccugggaggagcugaagaaggggcagaaagugccgagugcccacccuggcccucagcugcaacccugccuggcugagggagugacagcaccggacuccucccuccacuccacucaacccugagugcccaagaaguuauaaaaauguagaaaaggcaaagagaaaaguguaaacagcuucagaggacaggggugaauaaggggagacagcccucaugcucccccugcuguuggcgacaccugcauccugcguugguguauccaagauggguguccccacacccuccucaggcucccggagcagggauggaagaaagcugaaagggaagcaagagcuggagcagccagcccuggcugggucuuuucccagauccuuaggaucuuccuuuuagccaugggauauuaaagaucccagagcaaggggcuguguuuguucuuagucuccucagugacucucuugucuccgggcaggccuugauagaaagaaccacauccgugcccccuguagaucucagcugccacauccaccuccuccucgacuccugaucucagaagccaaaugaccugcugaggcagccucuccacccuccccauggacgugcccuucaggcagccuccccugcgccuguccagccauguccaacagccccugaggucuguucucucaguagggaugagcuggggccacagccagagaaaacagaguugggaaaagcaagagugaaauggagaaaggaggcauucagacagcagaguuacagcuccuggaagacgaaaucggggcgugaagaacugagauccagucuugagcacagcugcgcugcccccguccucagggugcacacacuggaggcuuugucggcacagacccagaagcccacagcccagguccuucuccacagccacaccaagcucacggccaucuaguugcccaggucucaguucccaggccuguggguuucuagaguguaagccuggauaaaaucccauccugguccuccauuuccaggagaggacuggaagcuccuggguuccccaauguugucugcccaguuucagcuguacugcuggggggagggaggguaugggucacagccauggcccucaggugggaguggaaggcagggcauugggggaggaaacuaguuguuggccucgccuuccuccucaucaaaggacugcacaccugaggaugugacgucagacaccuuccggcugagagcgguagacaucucagggucuucucguggggaaagugacuccaggucccggcaucccgcauccucuuccuccucaggugccaauggccucuucuccuccucagcagggccccuugccagguccacugcgccuacccccggagcccagucagugucuccccccagcaaagguggaggcuccagagcagaguauccugaagcugguugggaaggucccauuucaugcaagcuggguugugagucaucaaaugcaggcccaagauaggauccuguggccggagaggcaaugagggacugaucgcuggcuucccaggcaucugacgaccccagacaguacauacccugggacacguaagagugaggccauccauccaugggugcuugagccagggcaucuggaaaaagaaucauggaggucaguggggccacagaaugucaagggcaggaaugacagcacagacagcacaagagacagcuaagagacagcacagagaacuggcaguaagacacagagugcacagugaguagggaggacaaugggaaagcugagauggacaaggaagucuuaaaagaacggagcugaguggaggcagcugagauaguuggggaggccucauaggcuccagaguuuggauucuggaacaucucucacccugacuguccaucaguuccugguaguugucacuguaguugcagcccaauggcuccuggguggaguucacacucauguccucaccauccauggaagaccaggccaugaguguggccucagagauagcaaacugcuccaugacgccugggggaagaaaugcaacaaccacaaaauaccucagggaauccuuagacaugugcgugggguaggaaaacaucuuagugcagcacuguucaguagaaauauaaugcaagccacuuauaucauuuuaaauuuuccaguagccacauuuaaaauuaaaaagaaacagguuaaaucaauugaaauaauagaucuuauuuaauucgauauauaaaaagauuuucaucucaacauauaaucaaaauaaaaguuauuaaugagauauuuuacauucuuuuauuuauaugaagccuuugagauccagcugguauuuuauacuuauaagcacaucuccauucagaagagccacauuucaaguucucaauaaccacaugaggccaguggcuaauguauuggacagcacagccuuuguguauguccccagagaagggagaauuguaggggacuuccuaaaaaaucagauuuaggauuccuaggggaaagaguuaggggucuucugaugagauauccuaagagauucaaauucgagauuuccagauauuuaucuuuggagguuuuuaggaauugcagucuagagaguagauuucaagaucaacagagaacccccaagagagcaucgugggcuuguggguccaccauaauauaaaacugaaauucaagggauuggaaggaaaaggggauggguagaccuggggaucccuauucuagucaaauccaugagcguguugaagcugguacugcuccugccccccacccuacauguuugucacccuguucacugauauuucuccucccacccauaccaccaacucaauacuuccuuucucuuccagaccuaucccuuucuaggcaucuuauuuagaccugcacuacagcuuggccacucuuguaggcacacugcaugccuguuaucagaccuacacuacuuuccuggaacuaaaccucuucuguaggccucccgucucucacacaguucccuuaaucuucuagugguugucacaaguaaugagucuaguaggcaaauucaugacucgaaaugcuaaagggcaaaggcuaaaagagauccccaaggccuuucuuucuuucaaagaccaaggucuccccauuuuuuucccugcacuugagggaguucagguuuggauagucccgugaugaggagagaaggcaucugggauggguggacccacaaaucccaucuaauuacacgcauuuucugagaugauuauaaaaauauguuugagggcacuuauuugaauuaccacaucaaaauacuuagagcuguuugggaaaugugaaucuacggucaaaguauggauggagcuaauccugccacaggggaucagguuggagggucggucccuggccauccugcaaaugugucucuugaggcuuuaggguaccuguaccugcuagaaaacgugccuccuucucgccaucgcugaggucggaguaggcauccguaucccugcgcacggacucauggcuguguuguggcugaacagcuggugucuucccccagcccugccacucaaucaugugggccacccggccuugccccauggcugugggcuuugucacaugguccuucaugcuccgugagaucccuauggggccagacauuucccacauccuccagaauaucacacaauacccauaaccagacccucccaguuccucccaccccagccccaugaggcuccaucccacugggccaggcuccccuaaggacuccauagaugggguaguggagggaauggccuggaggaugggaggcuugacagaagggugaauaggucaggggguggggaugagggucuucaucaaccucgaaggagcagggagacugagccaaggagucugucagcauuauuuugucugaaggcauucuuacaucaggagucucaccugagaaugaugacuuggccagggccccaaugccauaggcguuagaguuucgcuuaagcuucggaagaauggaagugguguccuccauggagagcugggaugggaaugugggaggaagggcagaggaauaagaagguacgggcgugcuuuauacauggaggagguucaugguuuccaggaaaaagcauucgagcuagggcagaugauaagaaaagcuacuauacccaagagucccaaggagggauauauccccagugcucuggaaaacuggggcacagguugagaacgugagugcucacagugccuauuggagccagggaauaccgugcugguuggaaggugcaagggagaagaugaggaggaggaguucgggaggauggggaggucugggggcagcugcacucacguugaugccgucccaggagaaaucaguucgaguuugcugugaggagagaggaaagggaaugggcaucccagucacucgcaggaaugcaaggaagcccccuuccucagagggccuuccaggagugcgggauguggggagggcuuuccugagguugaugccgcuaacuggguucuccauguggacugcuuggcauguguugugagaaauguucuguagaagugucagucugaaggaguguuuggguuguugccuuggaauugaggaagugcaggcagccagagacuugggguggcugagugaggucucaccucagucgauggccgauggaggcugcucccgugcagugagcuggugcuguccauguugauuugaucgacauccuucaggcccuuccaauccacugcaaucaccucauucccugagggggccagaagguuagccgccggcccucaccucccugugcagccgaggcgacacccuggggccagcccuucacaccccuuccuuaccccagcugcccauuuccucuuauaucccugcacucuccaaauucuaggggagacaaguaguaaugcugagcccaaauauucaguuuuagcucaacccagaauagugcacucagaaaaagugauguauggccuuauuuguuguuguuuauguggaggggucagagguuggguuuuaucagaaaaccaauuauuccguccugaggacucuuggaggguuucuguaugggagcugggcuuuuucucuauuacaagucuacagauaagggcagagcugcucuaugaggaacuuuucucuaugcuuaggguggaagggaugugucucccccggugggcccuuccuaagaguccaugagucugacugacuggaagaggacuuccugggaaucgaggcaggaguuggauagcaaggaguuggguguguccucccaaaaacagugagcagagaaaccaagggugagcuggaggcauuucaccugacuguggggagagaagugauggauuaaaguggagggaagcuggugagcaggaggagaaaagagaacuuuuuaaaauaggaauuaagaaaauaggaauucaagucagagagaagacagaagauggugggagggguggacagggucugagggcugagugggaaacugcaggacucaggggaaggaggguccuuguuacagccgggccagagcuccugguggagggagacuccuggacugagggcaggauggugccgcggagagucuugcggaagaacugcuugggucuucauaaagggacuauucaagcagcagauggcugccugaaccaucugaccguacaggcccuuuauacucaugagguuuuacaauugugaguuuaggggucggcuccauuuuugggaaggggagcauugaauggggcugggcacgaggaggcauucagcacaucagcagggcugggggaaaggaaggggcuuguggugaaccggacugaggagggaggacccuccaaaguuggccugcuguccccuggggcuccgcgggguggugacugggggaaaagaggaaagauggcccuccggacacagcaggaauggggcagguggagaagagccugaggagaagggagacaggggagggcggggugcggggggagaggggagcgggagguggccuuugugagagacggagagcugagucagagcuguggggggcagcggggagggagagagccgcggagaaggggugaaagcagaggaggaggggguauccauggaaauaaaccgggucucagggaaaucaggcuucuggagagugaguuuguuuguaauaauaauacgaauuauucucucagccugaggucaccgggagguguaggcgggagaaauugggaguuggaaaggggaagaaugggggagggggugggagagggccggaugaauucgcugagcggcgagaguggagugggugccugggugggggucaggggcgguagccaggcagaagcuggagggagaagauggauuaggaggcgccucucuucccuccccgcgucaaagguaaauaaagagccggccccgccccgccggcccccgcugacaggugcaggcggguccccggccgccgaggcagggccggccccacccucccgggccgcgggcucccgaccccucccagcgccucgaagcccccaucuccuccccgcgucccccagccccuucccuccacccggcccuggcccugucccuccgggcguggaacccgggcucaucccgcccccgccccagagggaaaacgcacgugaacaaagcgaaucggaggaggcaggaacgacaguaaaaggcaacggagagggagagagagauggggcaaagcacccgagccagauggaggcggcggcgggggguggcguggggggcgugcgaaagaaacucggggcuggcgcggaggccgaggguccuucgcggggggcugcuccggagugggggaugcgaggaggcgcuggggacggcggagcagaggcggauggccuggaggggcagggaugaggggaccgagcgucgggccgagaggcagaggagaggagggcgauggagaggauggagaggaccgcgccugcgggagggcgacggggagaaggaagcgagccgagcgggauggcagccccggaggcgcaagacgagagcgggcaggaaggagggacagagggaccgcgggcggacggaaggaaagugaaggagcuagcagggcaaggcgggugcggagcggggcgcccggaggcgcgaggagagggaugggggagggggucggagggcggcccggggggcccagcccugcccccgcccggccgcgguacccacccacaguccgggagccgaugcagcccauggcuccgggggccgcagagccgggcccucaccgacucggggcgcgcgccggggggagcaccgggagccgcgccgccgccccagccgcucugcagcgccgcggcugucuccgcucggcuccgcuccccccuccccucuccaucccuccccacggcagcuccgucgccgccgccg

SEQ ID NO: 14611 - RNA, 10812 nt, Homo sapiens
cggcggcggcgacggagcugccguggggagggauggagaggggaggggggagcggagccgagcggagacagccgcggcgcugcagagcggcuggggcggcggcgcggcucccggugcuccccccggcgcgcgccccgagucggugagggcccggcucugcggcccccggagccaugggcugcaucggcucccggacuguggguggguaccgcggccgggcgggggcagggcugggccccccgggccgcccuccgacccccucccccaucccucuccucgcgccuccgggcgccccgcuccgcacccgccuugcccugcuagcuccuucacuuuccuuccguccgcccgcggucccucugucccuccuuccugcccgcucucgucuugcgccuccggggcugccaucccgcucggcucgcuuccuucuccccgucgcccucccgcaggcgcgguccucuccauccucuccaucgcccuccucuccucugccucucggcccgacgcucgguccccucaucccugccccuccaggccauccgccucugcuccgccguccccagcgccuccucgcaucccccacuccggagcagccccccgcgaaggacccucggccuccgcgccagccccgaguuucuuucgcacgccccccacgccaccccccgccgccgccuccaucuggcucgggugcuuugccccaucucucucucccucuccguugccuuuuacugucguuccugccuccuccgauucgcuuuguucacgugcguuuucccucuggggcgggggcgggaugagcccggguuccacgcccggagggacagggccagggccggguggagggaaggggcugggggacgcggggaggagaugggggcuucgaggcgcugggaggggucgggagcccgcggcccgggaggguggggccggcccugccucggcggccggggacccgccugcaccugucagcgggggccggcggggcggggccggcucuuuauuuaccuuugacgcggggagggaagagaggcgccuccuaauccaucuucucccuccagcuucugccuggcuaccgccccugacccccacccaggcacccacuccacucucgccgcucagcgaauucauccggcccucucccacccccucccccauucuuccccuuuccaacucccaauuucucccgccuacaccucccggugaccucaggcugagagaauaauucguauuauuauuacaaacaaacucacucuccagaagccugauuucccugagacccgguuuauuuccauggauacccccuccuccucugcuuucaccccuucuccgcggcucucucccuccccgcugccccccacagcucugacucagcucuccgucucucacaaaggccaccucccgcuccccucuccccccgcaccccgcccuccccugucucccuucuccucaggcucuucuccaccugccccauuccugcuguguccggagggccaucuuuccucuuuucccccagucaccaccccgcggagccccaggggacagcaggccaacuuuggaggguccucccuccucaguccgguucaccacaagccccuuccuuucccccagcccugcugaugugcugaaugccuccucgugcccagccccauucaaugcuccccuucccaaaaauggagccgaccccuaaacucacaauuguaaaaccucaugaguauaaagggccuguacggucagaugguucaggcagccaucugcugcuugaauagucccuuuaugaagacccaagcaguucuuccgcaagacucuccgcggcaccauccugcccucaguccaggagucucccuccaccaggagcucuggcccggcuguaacaaggacccuccuuccccugaguccugcaguuucccacucagcccucagacccuguccaccccucccaccaucuucugucuucucucugacuugaauuccuauuuucuuaauuccuauuuuaaaaaguucucuuuucuccuccugcucaccagcuucccuccacuuuaauccaucacuucucuccccacagucaggugaaaugccuccagcucacccuugguuucucugcucacuguuuuugggaggacacacccaacuccuugcuauccaacuccugccucgauucccaggaaguccucuuccagucagucagacucauggacucuuaggaagggcccaccgggggagacacaucccuuccacccuaagcauagagaaaaguuccucauagagcagcucugcccuuaucuguagacuuguaauagagaaaaagcccagcucccauacagaaacccuccaagaguccucaggacggaauaauugguuuucugauaaaacccaaccucugaccccuccacauaaacaacaacaaauaaggccauacaucacuuuuucugagugcacuauucuggguugagcuaaaacugaauauuugggcucagcauuacuacuugucuccccuagaauuuggagagugcagggauauaagaggaaaugggcagcugggguaaggaaggggugugaagggcuggccccagggugucgccucggcugcacagggaggugagggccggcggcuaaccuucuggcccccucagggaaugaggugauugcaguggauuggaagggccugaaggaugucgaucaaaucaacauggacagcaccagcucacugcacgggagcagccuccaucggccaucgacugaggugagaccucacucagccaccccaagucucuggcugccugcacuuccucaauuccaaggcaacaacccaaacacuccuucagacugacacuucuacagaacauuucucacaacacaugccaagcaguccacauggagaacccaguuagcggcaucaaccucaggaaagcccuccccacaucccgcacuccuggaaggcccucugaggaagggggcuuccuugcauuccugcgagugacugggaugcccauucccuuuccucucuccucacagcaaacucgaacugauuucuccugggacggcaucaacgugagugcagcugcccccagaccuccccauccucccgaacuccuccuccucaucuucucccuugcaccuuccaaccagcacgguauucccuggcuccaauaggcacugugagcacucacguucucaaccugugccccaguuuuccagagcacuggggauauaucccuccuugggacucuuggguauaguagcuuuucuuaucaucugcccuagcucgaaugcuuuuuccuggaaaccaugaaccuccuccauguauaaagcacgcccguaccuucuuauuccucugcccuuccucccacauucccaucccagcucuccauggaggacaccacuuccauucuuccgaagcuuaagcgaaacucuaacgccuauggcauuggggcccuggccaagucaucauucucaggugagacuccugauguaagaaugccuucagacaaaauaaugcugacagacuccuuggcucagucucccugcuccuucgagguugaugaagacccucauccccacccccugaccuauucacccuucugucaagccucccauccuccaggccauucccuccacuaccccaucuauggaguccuuaggggagccuggcccagugggauggagccucauggggcuggggugggaggaacugggagggucugguuauggguauugugugauauucuggaggaugugggaaaugucuggccccauagggaucucacggagcaugaaggaccaugugacaaagcccacagccauggggcaaggccggguggcccacaugauugaguggcagggcugggggaagacaccagcuguucagccacaacacagccaugaguccgugcgcagggauacggaugccuacuccgaccucagcgauggcgagaaggaggcacguuuucuagcagguacagguacccuaaagccucaagagacacauuugcaggauggccagggaccgacccuccaaccugauccccuguggcaggauuagcuccauccauacuuugaccguagauucacauuucccaaacagcucuaaguauuuugaugugguaauucaaauaagugcccucaaacauauuuuuauaaucaucucagaaaaugcguguaauuagaugggauuuguggguccacccaucccagaugccuucucuccucaucacgggacuauccaaaccugaacucccucaagugcagggaaaaaaauggggagaccuuggucuuugaaagaaagaaaggccuuggggaucucuuuuagccuuugcccuuuagcauuucgagucaugaauuugccuacuagacucauuacuugugacaaccacuagaagauuaagggaacugugugagagacgggaggccuacagaagagguuuaguuccaggaaaguaguguaggucugauaacaggcaugcagugugccuacaagaguggccaagcuguagugcaggucuaaauaagaugccuagaaagggauaggucuggaagagaaaggaaguauugaguuggugguaugggugggaggagaaauaucagugaacagggugacaaacauguaggguggggggcaggagcaguaccagcuucaacacgcucauggauuugacuagaauagggauccccaggucuacccauccccuuuuccuuccaaucccuugaauuucaguuuuauauuaugguggacccacaagcccacgaugcucucuuggggguucucuguugaucuugaaaucuacucucuagacugcaauuccuaaaaaccuccaaagauaaauaucuggaaaucucgaauuugaaucucuuaggauaucucaucagaagaccccuaacucuuuccccuaggaauccuaaaucugauuuuuuaggaaguccccuacaauucucccuucucuggggacauacacaaaggcugugcuguccaauacauuagccacuggccucaugugguuauugagaacuugaaauguggcucuucugaauggagaugugcuuauaaguauaaaauaccagcuggaucucaaaggcuucauauaaauaaaagaauguaaaauaucucauuaauaacuuuuauuuugauuauauguugagaugaaaaucuuuuuauauaucgaauuaaauaagaucuauuauuucaauugauuuaaccuguuucuuuuuaauuuuaaauguggcuacuggaaaauuuaaaaugauauaaguggcuugcauuauauuucuacugaacagugcugcacuaagauguuuuccuaccccacgcacaugucuaaggauucccugagguauuuugugguuguugcauuucuucccccaggcgucauggagcaguuugcuaucucugaggccacacucauggccuggucuuccauggauggugaggacaugagugugaacuccacccaggagccauugggcugcaacuacagugacaacuaccaggaacugauggacagucagggugagagauguuccagaauccaaacucuggagccuaugaggccuccccaacuaucucagcugccuccacucagcuccguucuuuuaagacuuccuuguccaucucagcuuucccauuguccucccuacucacugugcacucugugucuuacugccaguucucugugcugucucuuagcugucucuugugcugucugugcugucauuccugcccuugacauucuguggccccacugaccuccaugauucuuuuuccagaugcccuggcucaagcacccauggauggauggccucacucuuacgugucccaggguauguacugucuggggucgucagaugccugggaagccagcgaucagucccucauugccucuccggccacaggauccuaucuugggccugcauuugaugacucacaacccagcuugcaugaaaugggaccuucccaaccagcuucaggauacucugcucuggagccuccaccuuugcuggggggagacacugacugggcuccggggguaggcgcaguggaccuggcaaggggcccugcugaggaggagaagaggccauuggcaccugaggaggaagaggaugcgggaugccgggaccuggagucacuuuccccacgagaagacccugagaugucuaccgcucucagccggaaggugucugacgucacauccucaggugugcaguccuuugaugaggaggaaggcgaggccaacaacuaguuuccucccccaaugcccugccuuccacucccaccugagggccauggcugugacccauacccucccuccccccagcaguacagcugaaacugggcagacaacauuggggaacccaggagcuuccaguccucuccuggaaauggaggaccaggaugggauuuuauccaggcuuacacucuagaaacccacaggccugggaacugagaccugggcaacuagauggccgugagcuugguguggcuguggagaaggaccugggcugugggcuucugggucugugccgacaaagccuccagugugugcacccugaggacgggggcagcgcagcugugcucaagacuggaucucaguucuucacgccccgauuucgucuuccaggagcuguaacucugcugucugaaugccuccuuucuccauuucacucuugcuuuucccaacucuguuuucucuggcuguggccccagcucaucccuacugagagaacagaccucaggggcuguuggacauggcuggacaggcgcaggggaggcugccugaagggcacguccauggggaggguggagaggcugccucagcaggucauuuggcuucugagaucaggagucgaggaggagguggauguggcagcugagaucuacagggggcacggaugugguucuuucuaucaaggccugcccggagacaagagagucacugaggagacuaagaacaaacacagccccuugcucugggaucuuuaauaucccauggcuaaaaggaagauccuaaggaucugggaaaagacccagccagggcuggcugcuccagcucuugcuucccuuucagcuuucuuccaucccugcuccgggagccugaggaggguguggggacacccaucuuggauacaccaacgcaggaugcaggugucgccaacagcagggggagcaugagggcugucuccccuuauucaccccuguccucugaagcuguuuacacuuuucucuuugccuuuucuacauuuuuauaacuucuugggcacucaggguugaguggaguggagggaggaguccggugcugucacucccucagccaggcaggguugcagcugagggccagggugggcacucggcacuuucugccccuucuucagcuccucccaggacucccaaacagccucacagcuguccucccugccuccccaggccuccuaccagaggaagagaggaaaaucagcggauucuuccuuccaggaugguguauggugaggcacaagcuugcccucccacacuuggcauccaugcugguggggacugagcagcauaugcgccccagcacuaccgugagagcacaggcagaggaugggcggagcaaagcagcggugcugugggguuggagagcacuuggcccugccacugcccagguagccccuccccagcccuuggcacaggcagaguucggguaggagagagaggccuaagaggcucacugcccuaucuccuucuuuccucacgcccuuccaaggcuccggcucccaggccuguguccuacccacacucugucaggaguccuaccacuugcauccucugcuggaagggagcacuguuguccucuccuggcccugggcacaaacuuugcccucacccccaggccccagaacuuauuauuuuggagugagaagguugagaguugggguguuucuguccaucuaugguccugucccgccaucaaguucauacucucuuacucacacuucugggaugcaagcagggcaggggguucugugucuuccauggaagggggacaaugguuauccugagguugguuuuuggaggaaacaugggcguaggcaaggugaaccaaggcaggugcagucaccuaaccgaaugcugccuguacaggggaagaguccucuugugcuugcuaacgugugcugacuccaugucccaggaccucauuuccaggagcucugagagguggucuagcaugcccgcccuggcagcuauuccccacccgucuccugcugcaggcucugggguuuugcauguucaugugaccuuccuuccauggggucccugguuccucaccuucuccaaugugugcuauucccacaucaccucuuccugucgucucauccucucagugcccauaucauacccccagaccacgguggacagcucaccuagugagugcguucauucauuacaguucguuuuugcucaggcccgggggaguuaggaaagguagaccacagcagcuuucguuccuccuucccuuucccaaggaagccaaauggucccugacaaaagaugacuaaagaucugaaggacucuagcaggguucauacaugaaccugcuuuccccagggugcuggcauauugcugcagauggaagucaggugggggucugucuucugcaaggagcuccuacucgcucugaagagggagacugaggagcuggccugggaccaucuuaggacucuucuggugcugggggcagggugcauggggguugcuuaucgucuauuucaggggguggggaggggcaugugcaggaagaggcuguuucggggugggaaaggguugcuuuuccuuugggguuaaggcugugcagcacguuuuacagcaguccuggaacagggcuguuuuuauauucuugugaaugaaacugcucuugcuaaaugauuuucuuuuuuuggagggggggugcacuuucauuuucaauugacuuuauuaaaugaaaauccaaaucuuccacuccucccccuccauuguccccucccccaccacacaccuuccuucuuguccuuguguugaagaggguaucuuggggaaugaguuuauuaucuucuccacgaccucaccuauacaucccacacaccauccuccaggucugggaaauauccauuuuucuggccagucuuagcauguuuucuuaaugucacauucccacgccaggcccaagagagauucuaugacauauauuauagagagaauucuauaucaauauauauaaauauuagagauuauguacacaagggcaugggcucaaaugcccacugccagucccccacccaggcuucagcaucucucuuggccuggggaagugggagggaugugaugcuggagaaggcuacaggcuguguucaaugacacuaaacagaaugugguggcauccucugacugugagugucuuauuugggggauggaggagacugggaacaggggaggcaaaggaggagaaugucggagcgggggcacaaugguagaauuaagaacggcauacgggauggcaggcuggggagaaaaaccuuggguacggagcaaggguuuggggaugcucacagcaccuggccucucuuuguagagaaagcacgcuaauggagugcauagccaggcuuccugcugcugauuuggggagggugaagaugugacucucccaagugcggggcagcacucaagagcccugccaucuugacgcucagcuccuaacucuccaccccuaggagaggcaucugaagaaccagucuaagagggggcuggugucugagugacccagugaccuagcugcucugagcccugauucuuggcaggagaggcccuggcuagagcagcuccaggguagagcugaccuuuggcaggacaagucaauaacaagagggaggauguguuuccuagggaguaaccuggacacuggaggacaaggaagcugugcuguggaauagaaaguuuucugccagagggagucggcggacaccaugggggcgugauuguugagcaacagggcacuugugucuuuugcacagagccuuuggcgaccuuuucuuccaggccgcugccccugacagucuuuuucucugcaucucacugcuugaagcaggggacaacggagggggaaugugggcggccucucacugcgcuagucacggccuggccuggagacaggcaguggggucagaggcagauugcaggagugcacaugggccagugcggggcuccaagagaaguggcuguggcuggccucgacacaggcagugggcucagaggcagacugcaggagcagacgugggccagcgcagggcuccaagagaagcggcuguggcuggucuggaggcacauucugggguagucagugcccgaggccauaggauggucccauccccuccuccgacauggcacuugcagggccacagucauucugggccuccccucaccccaccucuuguagacacugaggcacagauagcacagugcugggacaagaguacuggggaauuguuggguggggagggggaggcagagagaggcaggggauucccuuccugcacaccaggaacacucgggaagccccacggaauaucaggggcccuucgcuaggguuagggccaccugccuggcugggaauggggagaacagucaaaauaauugaccaaggcuccucccugccuaaaugcugauuccuccuuuaagacuaucacauuaaaaaauuccuggaagaggccacgacauuggcaugaccucgccacauucaggacgcacccugccccacacaaguucacccucaggcugggccucuccacggucuuuaugaggaggucgugggagggggu

SEQ ID NO: 14612 - RNA, 887 nt, Homo sapiens
gcugaggccaugucuucaggcccuuuuucaguuuggggcuccucagcaccaggacgguagagugcagacagauguuggcauagauuagcacuuaccaggcccagugccagugauucugaaaguuuaugauuuucaaagcagaagcaaacaaggacaggaaguacaauguacagaagaugagggaaaaggugagugacuuuaaagccauaguguaagccugggugcugggaucacaggggccgggccugaggucccucaucuaccccaacugccagcacagugagacuaugagcaagacaguggacacuaggaacaggaggaacagaaucgaccacacaaacccuucauaaaggaaaaaguagagcugaaaugaagccugcacucuauaaacuagaguuucguuucuguaggaacucagggagaccuuccucugaccaaacaggauguucccaguggcugaugagaugacuuccaggccacagaugaucagggagcccuugaucagcuugggcacuaaccgagaguuccuccacuucagccaggcgaagguggggugggagaaagaugagaucuucacacaguagaaagcagcaagcaaggcaguaaaccacaaagugagggcauugaaaaggucccagaagauguucauauagggaacugcacgcgaaaaaucuaaggaggccaggagguuguucaccauggcuaccccaugcaggcagaaacgggaggcagcgagacaggccacaaucaugucacuuguggacagcauccggcaccuuacccacucccugcccagcauugugaccaagaauccauucugcagcauugcagccaaugacuccaggcaaaagauggcuaugaagaucaacgugggcaaggagggcauc

SEQ ID NO: 14613 - RNA, 50844 nt, Homo sapiens
ccuccucaccaccccccacccccgcagucuccgccuaagacuuuccaaguccuguaguuucgagcccgcugcccuuugccuccugggcggagaagcugcuuccuccugggaacaaccgccucccgcuccuagcagguugcuacugccccgaacccgcgcugcagggaacagcggggcaaacagugagugggguucagcguagacucuggaccaggagaggcccgcggugaccgaggccugggccccggguuaguguccggggcggggagcggugggcggggugcgacguuuagcgucuggggagggccgggcguggauugcggccucugcgcgcgcccccaggugauagagccguuccaccgaggaucccuuccuucgucucuaccccguugaugauuuuucucugcagcucggugccuauuucauucucgccgcauuguuaugcccucugcugggcaggaggcgaugacccccccuauuuucguaggauuuguuuuuugcuccgcaaggagccauuaagaucugagcuagcaggaacccucgaggcgauuugaucucgccagcugggggcuugcauucuucuaggcuagcuugucuccguuaagcccagguggaaguucucauccaccccagugcucuaggcgcccacgggcgcaguguggguuuguggugggggaagggaccuggggagggguggcggugagagcggcgcggggauucaggcugaauguuagucuggaaugcauuuggccugaagcagcaagugcugggugauacaguucccugguaaacagccgagagcuggccgcuaguuuggcccaaccugcaacggaagaaggccuuaaguacaggagaaaaagaucuuugccaauuggauaaucauggaaauuuagaagaaguacagcucgaacuagacguaaaggacagaaugugucugucuagcugaccagccaaccaucgguccaucacuuucauccuccaaacuagugauuuguugaugaauugguuucaauacuuuguuuuaaaauguugaauaaaaaguaaaugaaauaucucagaauggucuaaaaaauaaugaaacgaaugccugaccaucuccuugggucaagaaauagggcgucacaguaccuuagaagcccaugagucccaacugaugcccaugguccauucuccuccauucucugagaugugacaucuuucgugauuuuugucuuaauuuaaugaaucccuugcuuuucuuuuuaguuuuaccauauuuguguguguauuccuaaaacauauguauuggcuuucucauuauaaugacauuauauuaaugacauuauccuguacguauucuuaaguuuuauagauucaucuuucaugcuuccuuccauuuucguuuucgucauuuaagguguaaauguacauaauuuauccauucuacugcugauggacauuggauuguuucuacuuuuggagguguaugauuuaucuauaagcuauguaacaaauuaccccaacaccuagcagcuucaaaccaaagcgaacaaacaaaacaaguccuguuaccuccuaucuuacaguuucugugaucaggaauccaggaggggcuuagcugggagucucugacucagggucucucacaagcuguaucaacaaucaagguauugacugggccucagucaucucaaggcuaggcguagggucgaggaccucucccaggcuuacucacaugacugcuggcaggccgauuggccucacugacccuggcuguacacaucaguucuuugccacaugggccucuguauaaagaaugguugcaacauggcagcuuacuccccccagagagaaggcucccacagagaaaaagagaaagacagaagucagauucuuucuguaaccucagaagcgacaucccauuauuuuugccauuuuauauucauuagaagugagucccuaggcccaacucacacugaagggaagggggugacacaaggacaugaacaccuggaggcagggauuaucggggccacuuuaaagccugcccauguccucuaauauucaaguacacuugugugggagcuucccuagaguauauagcugggaguagaauugcggaguuauaagauuuauguguauucaauuuuauugggucauuucuaaacuuuccaaaguguuaaaccaguuugcacucccuccagcaguggaugagcauucuuguugcucuacaugcuugccacagcuuagucuuguaaaauuacauuuuuugucagucuggcagguaugaaauagcauuuaacugugauuuuaacuagcauuuuccauaacuaaugagauugacuuuuuauauguugaucagugcuuucucuuugugaaauucugauuccugucucuuucauuuuuguauuggauuguuuguuuaccuuuuuuauugacucauuggaaugcuuucuuuauauaaucuggguacgaagcaguaauuguuagcuauauaugccacagacaucuuuccaauuugcuuuugagguuuucuuucucucuaugucuuuauaucuguuucuuucucuguuucuaucaaugaaucuaaguuuugaauuuaauuucaaguuaguaguacuuucuuuuauagcuuuucuuguuugauaauuguuuucucaagaucauagauuaauuuuaguguaucguuuucuaaaaguguuauaguuuugccuuuggcaauuagucuuaauccacauggaaacugauuuuuauguuguuuauuccauauggauaaucuguugccccagcaccagugauuugcaugaaucaggauuuccauauaagcaugaauucguuuuaagcccccauucuuauuuucuauuugucuaacucugccucaauacuaaauaauuuuuaaccacuauaguuuuauuaaaagccuugaaauuugguaggaaaaguccuaucaccuguuucuucuucuuuaagaguguuuuagcuuuacuuggaccuuugaccuuccauauaaauauuuaaauaaacuuaucaaguucuccaaaacaagaaacaaacaagcaaauaaaccuguuggaauucugauugauaauggaucaacucugugucuuagucuguuuugugcuaccauagcagaauaccugagacugaguaauguauaaggaacaaaaauuuaucagcucacaguucuggaggcugggaaguccaagauugaguggcuggcaucuggcaagaaagagccuucuuacugugucauuccauggcauaaaggcagagaaaggcugaaagagaguguaaaaggagggugaaugccgccuuuuauaaugaacucacuccuacagugauggcauuaauucauucacucugcugucaugaccugauggccucucauuaagcccaccucuuaacaccauugcauuggggauuaaguuuccaacaccugcuuuuugagggacacauucaaaccauugcacucuauaaauuauuuugggcagaaauuauuucuaagacauuggcccuuuuccucaaugaacaugguauaugacacuauuuaagucaucuucaauguuuuguacuauuuuuuauuguuuucuuuuggcucaguuuuuguuaaauuucuaggcacgucauauuuuuacugcuauuguaagcauuuucuuuuguaaaaguuauauuuuguaguuuauuguugcuggcauacagaaauucaguugccuuuuauauauuaauuauauaucaaucaaacuugagaaaauuaauaauucuaaauuuaccuguagcuucuuucagauuugcuacauaggcaaucauaucauccgaaaauaaugauaauuuuguuuauucguuucuaauucucauaccuucaauuuauuuuuucugucuuaugacaaugacuaggagcuccaguacacuguugaauaaaaguaauaaagggcaucuuguuuuguccuuaagauaauaaugagaaauauuucauuaugucaacuuaaaaaugacauuugcuauaguuacuuuguaaaugucuuccccaucauaagaaaauucuguucuucuuuugguaagcacuuuuauuauaaauggauguuuuuucaaaugcuuuuccuguagcuguugagaauauauauacuuuuuuuccuuuaacuauauuaacaacauaguaaaguauaguauuuaauuucugauauuaaaccaauuuuguauucuuggaauaaaccuuuugugguaaauauguaguaauuucuguauguggauauagauacaaaagguaaacauuggauauuuauauuuauacgugugauuuaagauuggcauguaauuauacuuuucuguacuauccuuuucugaugcugguauuaucauaaaauaauaugaauaguauucucccuuaugcuauucuuuggaagaauuugugcaagauugggauuaucugguccuugaauauuuccuugaaucaccuguaaaaucaucuguguuuggaguguauuuuuucagaagauuuuaaugauuauaguacuauuuagguuuuccuauggagucaguuguaguaaauuguauuuuccaagauauuuaacaauuucacauauacaugaauguaucaguauacguacauguauauguuuauucaauauauauaaauacauuugaccauugaacaauggagcagucgggauacugaccccccucagaauugaaaauuuguauauaacauuugaguccuacaaaacucaauacuaauagccuacuaaugaguggaagucuuaccaguaacauaagcaguugauuaacacauguuuuauauaugcauuauauucuuaacuagagaaaaagaaaauguuauuaagaaagucauaaggaagagaaaacauauuuaccauucauuaaguaaaagugaaucaucaugaaggucuuccuugucaucuucacauugaguaggcuaaggaugaggaggaagggaggaguugguguugcugucuuuggggguggcagagacagaagaaaauccagaccaacgcgguucaaaccuggauuauucaaggaugaaguguuuauauaugaauauauauauauauauauauauauauauauauauauauauauauauucaagauuaacaaaauaaaacuguuuauaaaauccucucauucuguuuauaaaucuuuccauuaucuauugauauggccacuuuuucauuguuaauauguguacauuuucucuuuuuguuuuaauuuuuccagaacauggucuacauuauuaguuuuucaaacaccaacauaaaagcuuuaugucuuuuucuaauuuuuaccuauuuuauuacuuucuucuuucuuugaauuuuuucugugauuuauuuucuaagcuuuuaaauuauaugcuuagcucauuaauuuugagcuuuucuuccuauguaagcuuuuaaagcuauacauuucuaucacuacuuuuuagcuacaucugacaaguuuugauaugauuauuuuugaccauguagcuuuaauuauuuauaauuuuccuuauagucuguucuuugagacaugaauuuuuuauaaauguaccuuuuaaauuccauuuggccauaugaaguuucuuuuguuaucuuguaguuguaguugccuaauuuauauuguagucagagauugcauagugccaauucuuuuaaauucgcugaagcuagcuuuaaaacccaguaaguuuucuuugugugcguaaaaagaauguguagucuguaauuacaugauguucuguguaucaacuguuuuaauuauacaacccaaucuuacauaucuuuaacuuuuuauuugcuugaguugccaauuacagaaauagguauguuaaauauucucaccaugaugguggauuugauaauuucucauaaauguauauauuuuugcuucauauaucuugaggcuauguuaucagugaauuguuguaaauugaacauuuuaucauaauguagggaccuuacauuaugauaccuauuaauguuuucuguuuuaaaaucguauuuuuuucaaagaucaaaucaagguuucuuugguuuuugccucauuuaucucucuuuuaucguuugacucuaacucuucagaaucuguuuuaaauauauauguaguaaacuuauuuggauuuuuuaaaagucuggauuuuuaaaauauuguuugacaauuuauaacuugucauugaauaaucuguguauauuuauugugauuaguaauacaaaguuagauuuauuucuaccaucuuauuauuugcuuuuuauuuuuccugccuuuuauguuucuuucccugccccuccccccacccauuuuuuuccuucuuucuuucuuugcccauuuuuuucuuucuuuuauuuggaaguuacaugucuuaguucugauguuuuaauuuuauaauagguuuaacgcauauaauuccuaauuuuuaagauguuuaacuaguuuuauaacagauuuaauuuagcauacuuaaguuaaauugauccuuaguaccuugucucuuaccccgcaaguaucaaaugauuauuguuauuuaauaccaucaguguauuaaauauauguuuaccaacauguguuuacagauuuuucuuuuuacaaaaaaaaacccugaguuauaaugugcguagaguuagguucacaaauaauaaguguacagaucagugaauuuuauauauguauaugguccuaucaggauauagauuuacaacaccucagaagacuuuguuuuucccuacucuagguaauuuucacucucaaaaauaaccacuauucagaccucugucaugauauauugguccaaucuugaucuucacauaaauugagucauaaacagguauccuuuuguguuuguuuuaugcaguuuuaggucgaugagauucuuccauauaguggcauauagcaguacuuuuuuuucuauaguauuguauaaguauaucacaaauuauccauucuacuguugauggacauuuauuuuuuccaguguuucugacuauuacaaauaaaucucauuugaacauaucuuugguagacauaaaaacuuacuucucaugaacauacaucuggucagccuaaauaaugucagacaguuuugccacauagcuguaucgauuuauguucccaucagaaauauauauaaguucaucagcuccagauccucaucacaauuugauauugucacuauaguuaauuuuagccacgugaaauggauauagguaucuuauuaugguuuuaauuuguauuacuuugaugacuaauuauauuaagcaucuuuuuguaugcuuauuggccauuugaauaccauauuuugugaugcaccugcacauguauuuugucuauuuggggguaaaggggugguuucuuuuuuuaauuaauuuugugaguguguuaaauuauauuccgaauaugcauauauauuuuuucuuguaucagcgauuugcaaauauccucuuccaaucuuuggcuugcuuuuucccauugguaauuaugucuuuuaauaaaaagaaccucuuuauuuaauuuuuauaauaucuaauuuuuauuguuaauaaauccaaacauuuaugcuuaggacuugaguuguauugacgagaauuuugccuaccucuaggucacaaaaagauuccuuaugcuuaauaguucuaccauucacauuuaguuuuauaauuuaucucagaguauuuuuuguauaugauaugagguauggguuaaggguucauugguuuuuauauagacaucuaaucaaucaagaacuacuuauugaaaaggcauuucacaccauuagacuuuuugaaucuauguucauugaguaauauucgucucuagguuuuuguucuuauaauguacuuacgagauuuugcuaucaaaguuaugcuggguguaauaaaaaugaguugggaagaguuucuucauuuacuagucucuggaagaaguuuuaugauauuaguauuauauuuuucucaaguguuuagaaaaauucaccauaaaaauccuuuugggacuaaacuuuuuugcagaauguuuuugauuuuggacugcauuuuuuuuauguauaggauuauuuauauuuucugcuucuucuugcuguuuuggauaaauuauguuguuuaaacaauuugcaaauucaucugaguuuguuaaauuuauuggcauaugauuacuuguaauaucacuuuguuauauuuuuaaugucuuuugggacugcaauaauguccccugauaauuauaauggauucucucucugugucucuuuauugaucauucuuaguuugguucauuaaaaccaacuuuugguuuuacugaauuucuaaauuuuuuaaaauuugauucuugcuuuuauguuuauuauauucucugauuuacuuuaaauuuguuauucuuuuucuaauguuuugaaauaguuuacuuucagucuuucccuuuuauuaauguaugcauuuagagcuauagaguuuuccuuuauuaaguaauuccuuuauuaaguaauugcuuuugcugccuccugcaaauuuugauaaauuguauuuuaauuauuauuuaguuaagauauuuucuaauuuccauugugauuucuucucugaccuaagggguguucagaagugugauccuuaauuuccaaacgugggaauuuucuaauuaaauaaauaaaaauuauuuauuucugguuuaauuccauuaagaucagagaauauauucuacaucuuuuugaguuucuugagacuugcuucauacccaguauauguuuuauuugagaaaauguuugacacgcacuaaaaaucauguauauucuguuguugguagguguauauguaccauaugugucaacagggucaaauuuguuaauuauguuauucaaaucauguauauccuuacugauuuuuaugcacuuguuuauucagauuacugagaaaaauguacuuaaaucuucaacuaugcuuguggacuugucuuuucuucuuuuauuauugucaacuuugcuuuauaaauuuugaaguuauuaaggauacaaauuuaaaauuuuuguauugcuguacugaauugauccuuuuaucauuaugaaauuuguuuuauaucuacaguaacacuugcugacaguaauguuuacuuugcccauuguacauaagccauacuagcuuucuuuugguuaauguuugcuugguguaccuuuuuccauccuuucacuuucaauauuucucuucuaaaugaacucuuuuucuaauuggauuuuuaauccauuuauauuuaguauaauuauuuauauaguugguaucuuaguuguuuugggcugcugugacacaaaugugauagacuggugguuaaacaacaaacauuuaaagauaaaccagcagauuuaaugucuggugagggcuggccuccuagcuuauagacagcuaccuuucucacuguauuuucacauggccaagagagggagcucuagucucguucucgucuuauaaagauacuaaucccauuaugaguguuucacacucaugacaucaucuacaucuaauuaccucccaaaggcccacuuccuaauaccauuccauuggggguuagaauuucaacauacaaauuuuggagggacacaaacaugcaaucuauaaauauuggguuuaagcaagguugcagugagccgaggcagcagugagccaagaucgcaccacugcaaucuagccuggcaacggugacacuccuucuccaaaaaaaaaaaaaaaaaaauuggguuaaagucuaccaauuugcacaguuuucucuuuguuccauuucuucuuuguuauuuucucuuuucuugauuucuuucgaauucaacacuuucuauuaauuuuucuucaauauuuugaauuauaauuuuuuaaauuauuuuaaugguuacuuuagauauuacaguucaccuuauugauuuauuaugaccuaccuuaaauuauuacuucuauguauucucaaugcaaaauuuuaaguuuaucuccaucuugcagcuguacuauugucuguuuuauuuuuuauaugcuucuguauuccauaaggcauuuuguuuauuuaaacagucaauauucauuuauauuugccuauguauuuacucuuuucaguguucucuauuaauuccuacagcacuguacuucuaugaggaauaauuuucauaaaaaauuaguuuuaguaguuauauucuaguggaaaaugcuuucagcuuuaguguaucuaaaauuacauugccuuuauuuuugaggaauauuuuucuuguguauagaauuuuagguuggcagauuuuucuuuuucuuucaucuuuuaggaauucuguuguguucuuauuuucaucacucuuuugaaaaauuagcuguauuuuuuguucauuuaaaugaaaaguauccuuuaucucuggcugcuuuucagauuuucucuaugaauuugguuuucagcaguuugaaugugaugugucucaauguaguuuucuuucuguguauucugcucggggaacauaaaguuucuucagcuugugguuugauguuuuucaaaucauuaauugauaacauuuugcuuguuuuauuaucuccuuccuuuccgucugggacugugauuacucaugugucacaacuuuucacccuaucucauaauccuguuacacucuuucuguaucuuuugaucucuuuguguaucauguuuucuuuccucuuauguuauguauggauacuuucuacuuaccuuugcuauacuucaccaauucucuggucuuuugugucuaauaugcuauuaaagcaaucuauuaaguaccaauuuuaauuauuauuauuuuucuuuuuuaauuuuucauuuuacuuuuuuaugaguuuuauuucuaugcugaaauuccacagccuuguuucuaauuucuuaacguaugaaucacaguuaaguucucuaagaacucaaguaucugaaccacuugugccuguguuuauuuucuguuauuucucuugaguuauuggcaacuuauucuguuuuuuuaacugcuuuccuaauuuuugauucaaugcagaauauuguggaugaaaaaauauaaagguuuugauugauguuauuuucuuucaagaggauuuuuuggggaagugggcagauaaaguaccagcagauuacuuugaugcuaucaaauauuaguuuuaggcuuuguuaggacuagcccauuuaagguuugaucuuucuccaagaacauagucuuuaaaccauaagauaugcuucuucauaugucagggauuuucuuaugugucaacugaaaucauggaguguuuauuagaauguuucuuuuuguuggggcauaaacuccauugcuuuucucagaacaauauaaccacugaaaugacugcucaacuguuuagcucuuuggccacuauuuccuacaaguuuccuugaggucucuccuauugcaugcauagcuuaggaaucagccagugacauuaggggaauucauauauaaaauuuuagauuaacuugucugguuucuucaugucugaaacuuugcccuuugagcuccaccugguuugauagucuugaaccaguaagacugacacuuccuuuucagccucaguaacccugcacuguaaaaugaaaaaugcccgaaaguaaaaagcaauagcgaauauacaacucauguccuguguuuucuguucaucaaggauuauaguccuuuuguccuguuuauguuguuuacuuuucugagucuucaguugguuuccuauauuuuguugagcuuuuauuauuguuuccaaugggaggauuauuccaaagauaugagggaauuucaagaaguuugugggaauaauggaauuaaaaauuuuuugaaaaauaaauguugccucaacauaagccccuucaaguucaagacacuuuuguaagcagugauaacagcaauuuaguccaucacuaagaaacugaagguccuaggaauuuagccauguagauacaguauuuuuacauuauuaaccaaacaaaaaugggugcccuucucccagcacuuugggaggccgaggcgggcggaucacaaggucaggaaaucgagaccauccuggcuaacauggugaaacccugucucuacuaaaaauacaaaaaauaaaauaaaauaaaauaacugggugugguggcgggugccuguagucccagcuacucgggaggcugaggcaggagaauggcgugaaccugggaggcggaacuugcagugagccgagaucgagccacugcacuccagccugggcaacagagcgagacuccgucucaaaaaaaaaagaaaaaugggugcccuucacagauuuuuugagauuaggaaacgaagucagaaggagccaaaucaggacucuaagguggaugccuaaugauuccccauugaaacucaaaauugcccuuaguugaugagaggaaugggcaaagucauugccaucguggaggaggacugucuggugaagcuuuccuggguguuuuccugcuaaagcuauggcugacuuucucagagcacuacaguaauaagcaaauguuaucauucuuuggucuuccagaaagucaacaagcaaaacaccuugagcaucucaaaaaacugucaccauggccuuugcuuuugacccaucugcuuuugcuuugacuggaccacuucugccucuugguagccauugcuuugauucugcuuugucuucaggaucauacugguaaagccauguuuccucuccuguuacaguucuuugaggauaugcuucagaaucuugaucucacuuguuuaaaaucuccauugaaaguucuucucuuuucugcagcugaucuugaugcaucccaucaaguggagaguuugcucaacuuucauuuuucagucagaauuguguaagcugaaccaauugagaugucuuuggugucuucucuucuuuaauucacuacagauauuuagaugaguauuucuuuuuaucauuuuaggauuuguuagacucccuggaucugaggauuggugucuuucaagaucucuggaaaauucaaucauuucuuucaauaauaacucucccacaaucuuucuauuauaucuauuugaaccucagaucagaugugucuuaggucuucucacuauaugcucuauaucgucuauccuuuuucauauuuuccaucauuuuuucgauuuuagacugaauuaugaauaauuuccucuacuccagauccaguucaguaauucuuucuucaacuuuguuuaaucuucuauuuagucucuucaauaaauuucuauuuugaacuauuuuauuucaauuauuuuuuaauuucuaguuuugauucuuuuuuauaaauacaauuauuuucuguucaaguuucuaguuucuauuuuauuuuucaaauguacaaaacauggcuauucuauguucugugacuaguaauucugauaucuaaauuuugccuguuucugauucucuuguuuguaauggcugucuuucauugugcuuuauuuccugaguguuaugugguuuuaaaaauuauuaaugugagcuucuccuuucaugugaauuuuuguccuagaaauuauuucuagauacauuaaaguuaaauuucucuagaaaagauaugcaugugcaucuuccaauugaauacauuagcaaauugggaccaccucaaauuauuugcuuaggguuuuugaauucacagauguagcaugaauuaauauugcaaaccuauauggaaaacugguuugugauuauucauucucauugaucuuuuuccccuucaucuuucagcagggucaagacaagcaaauugcauugauuucuucugugacaugaauuuacuuccuauuuaccuuuacccuguuggaauaccccuuuggugugugagcuuugugcugggaugucauuuuuaauuauauucuuuuugugagcuuggucuuaauauccuaggcuggaaaccccauagagucacuccccauacauucuccaggguuuuguggaagcauuguggugagagccagcuuucaugcuugcuuccuucaauguuuccugcuuuuaguuuguuucuggcuuuguguacucucuacuuuccuaucauuucauugaugaauuuauaauauuuuguguauauauguuguuugcaucaguaguauguuuugggacauuuaucuacauuccuagaacuaaaacauuauuuuuaacaccuuauuaaaguuagauauuugcaugugugauuauauaucaguauaucauaaauguacagcuugauacauuuuuacaaacugaacacaaccuugggccagcaccuaaauuaauuaagagaacauuaccaguaacccagaagucgccuuuguguuccucucuagucacuaccuggcccaagaguaaauauuauucuaagucuuaauaucaaauauuaguuucaccuguuuuuauauuuauguaaauauaacaauauaguauguacucucuuguuucuggcuuaguucacuacaguauguuggugagauucagcuauauugugaaaaaugcaaaucauucauucucauugcuguaccauauuucauugugaauaugccacaauuuauuuaaacauucuacuguugaugguacccagcugauagagagcaggguggauuagagcugagaaagcagggaggauaggauuugaguaguuuccaguuuuagacuaccuuggauggugacacuuugaggauuccaguacguguccuucagugaaaauguguauauuggguacacaccuaaaagugguauuacugaauaauagucuuauuuugcguugcaaaauaauacuuguaacauuuucaaaauccaaagugucuaaagaaaaaaauuacugcucaacccucccccacuuccugaaguagccaaauuuguccuuauguuuucugugcuuaaacauaaacacgcaauuauagaauuuuuucccugcaaaaaguaggaucauacuuuuauugcugaaaauauacauuaagacaauuucucaagguaugaauugagcucauuuuaaagaauugcguaauauuuuugauauggauuuuuaauuguucauuuauucacauguuucagaauauuuaccaaacuuaguaucucaaaaguuauuugaauacuuucaggauuucauagcagucuucguuacucagagcuacuccaggcagaacauuagaaaggaaaacaaacucaaggggaaguagaaauaagaaaggauccagcauuuaaaauuuagcuuauaauguggugucugagacugagaaagaggagauagaaccagcucaaaauuugaggaagcagccagacaggguggcuuaugccuguaaucccaguacuuugggagcggaagcaggaggaucacuugagcccaggacuucaagaccagucugggcaacaaagugagaccccaucucuacagaaaaaaaaaaaaaaaaaaauacaaaaacucccugggcaugauggcgcgcacaucuguagucccagcuacuggggaggcugaggugggcggaucgauugagcccaggaguucgagguugcagugagccucgcuccacugcacuccagcacaagacccugucucaaaaaaaaaaaaaaaaaaaaaaagguaaaauuugaggaagcauuaaaagagcaugaaggaaggagaaaacuuacuuacagcacaggagguguguaauuucauccauuuucugcuuuaggcugcuguuuguuuuuuugaggaaugauccuaaggauuuucuuucuuaccccauuucauccauccauccaguggacauuacagagcaccuguuugugaccuaguugaaguggggaauagaaagaauaaaauagaguucuuaaccuaugcuuccuguaguuggagcaguugaaaugaaacccuuaauuuauaugggaugucguacccugucccuuucaccacugaagccaccuuccccuggaagguccacucuggacacuacacuuuuguaguaagggagaaagcuuugugauggucucuuccagagaacaguuuggucccaggacaacccuuccuuagguacccagcaaacaggggccagggcagugaggggugaggaaucuggagacaggacaggggccaugcaaaucucccuggggcccuggggaccagccauaaaaagagaugagugguuccuccagguuuuacaguugagcucuccagguuagaugaguagaugcgagugcaggaccuggucaggcauaaagccaguuccugcuccauggucaagucucguguuccacucaaauaacauggaucagaacuagcaacaaaguucuccacagggagaaaucauauuuguagagaagccgcugccagcugcuugggugaggauauuuuauguaguuuuuuaguugauuaaauuuauuuuuauuacaaaauaaugcgugugacuauugaaacgcuaaugagguguaucaagaaaaaaauaacaaguaauccacuuuccugucugaaguaacugguucuaauaguuuaucuuccauacaauuucuguguuuauauaaguacauaugaacaguuuugaaguuuuuuuuacacaaaauggaacguuuuuuacuauguuagauguuuauuuuaaaaauaauauauaaauauauagauagaggcaauauauaaguagauuuauauaaguagauuuaacccauccuuggaaauaguuguauauuauuuuacacagagaucaucauuauuuauccaucgcucccuuguuaaugaacagucucaacgauuuacuuugaaacaaaucguccugcugcacucugagggcgggcgucugggucuccaucccggaucuggggcggcaucuugggguagaaacugacacaaagccgggccucugcgguccgggggcggcggccaagcuccgccuccacccgcggcagccaaucagcucccggggacgccccaacccccaaccgucugcacugcagcccaccuccccccacacgccuccuccuagccacuucacuaccaauuugcaaauucccaaggcgucugccccagcgccuucccacaucucuguggaagacuccccacuccaaaguagccugguguggaaauugcuggacgaaagggugagucucguccaaagcugguuucggggaccagaccaggcccgggcacacggaccaauucaggggcggcucccgaugcaguccgcugaggugcgggugggagaaggaggcacugggucgggguccuuggggagcgcggccgaggggggcgcacgcggggcugccaaaguggucgcguuuuuggccugggacccccuuggguuuuggguccagggagguagaugucuuucaaaaaggguugccugcgcuuucuccauugcuguuucuauuucagcuucuuucuaccagucucuuauuucuuucauacugcauuucuucuccaggaacauaaccagcaacauauuuuauuuuauuaugaaauauauuucaaagcuacgcgcaggagauaauaugacagauuuauuauaugcugacauuuuaucaccuuugcuucagcgcucccucucuuccuccaccccccuuucuuucuaagaaauaaaacacuuaaaaaccccuuccccccaccaaaucucaugcccccauccugagagguaaguuagcuugcaucccuuaccuuguauauuuuguccuuuauuauuaauguuuauuuuuagguaugcguuuuuguucugaauuuaaaauuuuugcacgagauucaguauuacaggguuuuaacuugcggugcuguuaguccugacauugcagacccggaagggacuuagugagugccagucacuagcccgcuucauuuagcugaaaaaucugaacacuggagaagauaaaagaugugcucacugucucucaggugggccuugacuuggcagaaucuugaauucagguucucuugauuucucucccugccauuuccuuuacauaaaaccugccgcggagcucaccuaucuacauggccuucugacuuguuccuaaugauccaauuuggagaaagggaguugaagggagauggggaaagggaguauggcuuggguugggacucaaaccccaguuaggauuaaaagguaugcauuuuccugaaauaugaaauauugaauuuuaggaugauuugaauauuuauuuaugaggcacucauccagucuuaccguauaccagacauugauucaagaacuuuacaagcauaaacucaccuaacuuaagccuuauaauaaggcuuaguauagguauuacuuuucucauccccguuguauagguaauaacacugaggcacagaggaauuagguaacuuccccaaagucacaccguugguaaaguguagcucugggauuugaauccaguccacuuagucugggucccugucaccacccugcauuucccaugcuggagccagcaccugugagaaaggugaaguggccacauacacaagagagaggagcagcucucagcugauaucauaaaggaaagaaauggggagcgggcacgaugguggcucacgccuguaaucccaacacuuugggaggccgaggcgggcggaucacuugaggucagugauuugagaucagccuggccaacauggugaaaucccgucucuacaaaaauaaaaaaauuagccaggcgugauggcgggcgccuguaaucccagcuauuugggaggcugaggcaggagaaucucuugaacucgggaggcggagguugcagugagccgagaucgcgccauugcacugcagccugggcgacagagcgagacuccgucucaaaaaaaaaaaaaaaaaaaaaaagaaaaaggaaagaaagaaaugcgauuugaacuguacaccgaaaaauacauuuugguuaacuauuguuugaacuguauauuauuuuuaauuuacaaaaguaagacacguaacugcaaacagugcagaguuauauaaaaaguugcaccucuccuauuucucaaguuaaacaauauuaauggguagaaauguagccuucccuucuccccaccauaauacaaauauauacgggguuuguuuuuccuauaaaaacaaaagcauauucaacaauuucuacaauuuguauuuuccccuuggcaauauaucacgguauauucaccgacuaaauggagauucaagcucuuccuaagaacugaauaauacuaagcagaauguuugucccacaauuugcucagccuuucccuuacuaauguagagucagagaaguuuguaucuuuaaugaaacagccguccacacugccaggauggggucuccaggcgucccuaagccacagcaaugccaagccaccagggccggcgacacaaagaagcgcugucccccgccaagcgccgcccccuggagcucccacuccagccugggaggaaguggggaggaggggacucccguggaaaccccuccucuccuccagcuccagccuccuccccgcucccaaaucccggcucggucgcccagucacugguacagggaagccucuucccugugcauuccucucugcgccaggcucugcccgcucccaccugcccccguggaaaucgcagggugaccuggugaguggcccucuccaaaagccuggcaggcuggagaaggggccagcaacgguggacucggccugggugcugcgggggggagggcagggcgggaggccggggcgggggugcggggcgcgaugggugcgccgugggucugggugugccgaaaucagaaaucaucggggacagagaauccccuuuguguccguauuucugcuggugauuuuccucugcgcuugggucccgcaucccccugccgcauugcuccuccucuccagguucugacaucugauguuugugugugcuugcuuugugugguugaguuaccugagggccugaccuagagaaccgcgucuaauccgcugcuuugucggaugagaaggcccggggcuugagcagggucgcggguagcuggugacagagcauuacuuguggccuacuguccuacugcccuuugaucuuugugaacacuggcuuugggacugagcucuaucucccacuggcacuggccccuggagacuugagugagcguucguguguguguguguguguguguguguuuacgcgcauggaggagcuccccuccucccugccggcugccccccacuccccagcccccucccuucucagacgucaccguugugcucuuugcagacuggcuuugggccugggaggaaagaagagaguggagccccgccagacuccaagcugagugcugacagccucugggaguuuagaacaucccuucucacacacugugcauuugauagaauacucccugaggcacgcagaucaacagcugggggguaggcagcgcccacauuuaaaaagguaauaauacccaggucuucucacuccugggcuugugcuccucaauuaugucauccucuugagugaccuaggagagaagugagagaauaggaguaagagaaagacagagccucuggggaacuugagaauuaagaaggcaguucgguaagguagaaauagaggacuagaagaagcaaagacuccaacccugcuuacuccuauggggaugguagaggggcugaauggggaggaucacaggaggggcuucaaagauggugguaaaggucuauuuuuuaagcugaaugguagguauaugggaguuuguuuaauuuuucagauuguuuuauuauuaccaucuauaucccuccacauguauuccauauucuuacagguguaugaauuaaacaaucuuaagugaaaaauaagacugagcugggaaugucuaggacagaauucaaaaaagggguugaacuagcccgaugucuuggaaaagacacuggauauagaaaggaaaagaaacagaagguucaugagaaaaaaacagcaugaaggagagaagaccuauggaauugaauguguguaauauaaaccaguuuucgaggucaggcuagcuaguugcugaaaaaaugauccuggguuuacccuuauacccucaucugucauuuaaucauccagacauggaaugucuauucauccaaagaauaaaauguauacucuggccucagacacuuacucuaguuucaggauuugaaaucacacuaccauacgggauauggguggugcagcauccagcauggcccuccauccaccugcccuuccacgcaucucucaaagggaaaaccagguuuacgagccauggcgcugcucuguggugggaguggaagcucugcucucucccugaguuacagguugugccuucaauacuuucugcuuuggaguuggcuuugguuccagcaagcuaaaaggggccagaggugggcccaggagaaagaaagcaggaagcaugggagggguuagggagagaaaugaaaggacauuucccccagguuuuauucauuugagcucaccaagcuuggaggacaaacauggauucgggcauagagagggagcauuugguucaaaagucaagugauggagucacugauagcugguuaaaguggggacacaaccagcugcagaguucaagggacccccauagaggaggaaaucaaauuuauagaugggcagaugcacaaccugaucagagauggaggaagaccuuuuagguccagugagccaggaucaguugaucagucuaccucaucauguaaaaacuguaccuaaucuuuuaauguguguuuacaugcuuaacugaauuuguauuaacucgguguuguuucucauuguaguagcaauacauacaacaauucaaaggaugcagauuuguauaaagacagagaaaaugguucaccucuuuccuuccuaauguaaucaaugugauuauguugaaauguggccuccauagauuuucaaugcauauaaaagccugguauguaacagguacuuauguauuccuggugcuuaagaguauggacuccagcacuggguuuccuggauuugaauccuagauccaccaccacuuagcaccugugugauuuugagcaaauaauuaauucucugggcauuaugauuuuggaguuuuuguuuugcccauccauaaaauggggauagugauaguaaauaucucauagguuuauugucagcauuaaauaaguuacagaaaucacguguaguaaugccaggaaccugguaagcauuguguuguuacuacuacuaauaauaauuacuaccacuacuaauuacaacuauuacuauuaucuuugcccauacaaaaaugacuucauguucugcauaucauagugacuugaaauuuucacuugaaauguaucuaggacauucuucuagguggauguaaaauauauucaacucauccuugaacuagcucagaaaacaacuagugagacagauaugugaggucccuguucugcuuguacucgugccagcguuagaggcagcagaggcugagggagaaggguucugaugggcaacucuuuaguggguguguguggauagauggcuggggacagugcuacagggucuuaugcuggguacaaugggguaucugggggcuauguggaaguuggauagguguggguuuggguuagagauccugcacccacaagaaucaaaaaugguucuaggaaacauucuuugucauuagucuaucugucuguacuucuagguuuucauuuaucucccuuuguaauuuuguguggcaguaagcauccuguacguauaucuuugauacugcccuucuuaguucuguaagaacgguuauuagaagaaagguuguugggucuaaagauaggcacaccuuugaagccaaguaggcaccauaaaauuguuuuugaaaaagagcgcagacauucuccgucauuccugccgauugugauggucuuuuaaguauuaaacauuauuagccuuucaaauauuaaacuuuacuagccaccuuugucuucuucaucuucaucuccuuccccuucuucuccuccuccacuuucuccuagaaagaaguaucaucuuuuuuaacaauauuaugagcaacacaugauauauuuuccauuacuugacuacuagugagauugagcauuuuuuccacacaaguggccauuuauauuuucuuuucugugccauaucuucucuuagaaggacaggauuuccguagauagaaagauuugggagagggaacagaauggaaagagauuaggaagauaaucuaaaaugaaaacagggcauguccaagggcgccuggcagacgggaugcugcagggagaaaggcagcaggagaaaaggcaggaaaagccagggagcagccagcucugcaggcaguccacaccaggaggcaguagaugguccccagagaccaagguggagcuuugagauuaaauaacaugauuagagugguuuuagaaaaguaaaggugggaagaggucuugguaacuuagaaauugggucgguugaguccaggcaugaauuacuaaggaccuaaacuagguuaauggcagugugauuggaaaccaugaacaaggacauuaauaggacuugugaccagcuggauauggcagcagcagggagaagagacauacugugacacugugcacuuugcuauccugauuauuugugggcaucaggaggagcagggaagagacaagcuucuugcuuaccaaauguucauaucaguaucuucucaauaguccccugagguagguaggucauuaaugcuucuguuuaacuacuagaaacguugagcuuauguaauuugccuuaaaagagcucacuuagagggaaauuaauaaauucaagacuuuuuuaguuuagagacuggcuauaaauggccaguauggucuugaacuuguuaccucaagacuggggcuauuuuauccuggcuuguggaaggcccacagccugugugaagggcuuucucaaggguacacagagauauaugagaaaugaauguaauaguaauuagcauuaguguuaguguuaguauuaguaugguaccaaaauaugaaaacuauuaaaucagaaucaauacaugcucaauucagugcuuguaaaaucuauguuagguuaaauuguuuuuccacugcaagaauucucuauuauucacaugcuuaaauuaaaugguuuauucuuaaccaaauaauuauaaacauauacguuuaugcauauaaauaauacuuaugaaaaggcauuuaaccuauguuauuucccuuaauccucaggacaagcguauauggcagauauuauuauuccuauuuaauuaauaaugaaacuaaaucugagauguguuguccgcgucucacaauuguuaagcaacagagcugaaauucaaacucagacugccauaacuccagagcccaaguuuauaaucagguugcguauuauguugggagugagcauauuaucugacaagggagauagacaaguaguaagggccagugauuaaauuguaagggcugucugcauauuccaagaggaggucagaaaaggacagaaaguaagugguucuagagguuggauauaaagagguuaccucgggccgcacugacagaggugguucagccucauggacugaagagcagugauguccugugcugcugaguggucacugaggaugagacaaccugcaugaccugaccaugaaaacacaucuguccuuggaggaaguguuucaguacagugcucauagcagaggucagacuauagagcaucauuaguggggaucucauugugaagaagccgaggauauuugugaauucaccuccacacuuuugucagcugcaucccaggugcaauuaggaugcugcaguaauugcauaucuuguuaccuucugcuccugguuaugugagacuugcauuuaaaccacagaggacuuccacuuuccucuuaccuagccuguggcuuugaccaaagaaccuuuucugaaagcccaggcauuucagauggaaguucugaguucuccaagcugggauuaaucugauuagugugggagccaagagggauggaaugggcugggagcacaacaugccgcaccacuguaugaauucccagcagcugcuguagcaaaugaccacaaaugggguggcuuaaaauaacaggaagacaucaucucacaguucugaaggcuuagaaguuugaaguccaggugucagcaauguggcgauucugaggcagaaucuguucccggccucucacuuagcuccugguguuugccagcaauucuuggucuuccuuggcuuguagacucaucgcuccaaucucugcccccauuuucugauagcauucuccccuguguuuccaaauguccucuuacaaggacaucagucauuggacuaugacccauuugaaucacauaugaccucaucuuagcuugauuacaucugugaagaccucuuuccaaauaaguccuauggguuaggacuucaaaauaucucuuugggggacacaauuccuugcucauucuuucauucuguuuguuuccuucugugauggaaaaguaucaagcucucuaaguuugacugcagaauuuaagaggagagggcccauuggggucuccuggacuucagacacuaacaccgagugcuuaaaucauuucccagugucagccucaucugcauagugggaagaauagcccagcuacuggaagagugaacugcucuauuuguuucuuuguuuauccauucuucgcuaagcugagccuuugcuuucuucucugcagaaaccaauagagccauggcgacucccucugcugccuucgaggcccuuaugaauggugugacaagcugggauguacccgaagaugcuguuccaugugaacugcuucuuauuggagaggcuucauuuccugugauggugaaugacaugggccagguccucauugcugccuccuccuauggccguggccgccugguggucgugucccaugaggacuacuugguggaagcccagcucacgcccuuucuccugaacgcagugggguggcuuugcucuuccccuggggcucccauugguguacacccaucccuggcaccuuuggccaaaauccucgagggcucuggaguggaugcaaagguugagccagaagugaaagacucccuggggguuuacuguauugaugccuacaaugaaaccaugacagaaaagcuggucaaguucaugaaaugugguggcggcuugcucauaggaggacaagccugggauugggccaaccagggggaggaugaaaggguucuguucacguucccugggaaccucgugaccaguguggcuggcauuuacuuuacugacaacaaaggggacacgaguuucuuuaaagucuccaagaagaugcccaagaucccaguguugguuaggugaguauguuaccccacuggggaguuggcuccaggguugaaaagcagacccaguucuuaucuucagguugcuccaaggcuaacagaagagugcucccaggcacucagauauggaaucacuacauaucaacuagauuuuuuaaaugcccugagacauaggaggggcaagguccucacugccccugucuucccaaaccagaccauuuagcucuuugauaauuugaacuuaaugguggcuauggucccagugucuugcuuaaucaaaacugugcuguuggccccaacaguuggcauaguuaauccagaugguuuauaggagagguugcuuucaacaggaaugugaagaaaaggaaaacaggcaugaaggaccccaugagccaaagccuagagagguguggggaagguuuugaaaugucuauccagaugagguuaggaugcaauaggaaguagaagccuucagaaguuaagauaucagaaaagaugguucaaguuauaugugcuaaaucuaggauuuaggaggggcaaaagguugaugaucaguaaugaaggagucaggugaugggugcaggagagccugcacugaaaguuuuuggaguguacugcccugccugcuuugcucucacugcacuccagcaccacauauagugccuaacagauagcaggucaguaggugcucaguaaacaucucuugcaugcaugacugcaugaaugaaugagagggauuauaagcuggauuagucccgggagcagaaaaaguacauuaggccacucucuauguuguauauuaaaacucucagcauucucagaacaaacaacacugauauuucugacugaugggaauggagcaagguaggauugggugaggacgacacaccaaggguacuacgaagguauggggaaugagcuaugacuucuccuuggcaugggacuuuuagggaaguuuuaggaagaucaaccagaauaguuagucuacuauguuuuuggacaaaaagaugacucguaucauuuuagcccaaauauugggcuucugcaaaggaguucaaacucucuguucauucauccauuuauuuagccaggguuuauuaaacauauuauauaucccaggcauuauuucuuauuucaagaaccugauuugcaaagaucugagaauuaggggcacaggaacaucuccaauuacaagacuuggaaacaaaagucaaaaaccaaguaacuguuguaggaagaggguuaugcuaucauuguucauaaaaccuggaaaccugggaucuauaaccaguaauggcacaguguggcacuagcauguccuuucaauucucuuuuucucucuaaaggaaagugguggcauagaagcuccuacugucccuuguaggacauuuuucagucuacagugaucucuguauguucacaaagucaucagagaugcauagaaaagaacgccguacaaauggucauacucuaaaugcccaaaugcucccauaaauuugguuugaaaauacccucacgaaaccugaauugaccagccuuauaaauugaugcuauccaugcccccuucaguuugaaaaauggugaagggauauuagacacaaaagagacuugguuguaaguuuauuuauaauaaggaucuugcacauccuuggaggucguugcugguuauugcugguuauauguuaggcauauauagaauccuaauuauagguuuuaggucagaaucaaugcccaggcaugguggggugaauguauuuaccuaacuccugcuuuguacuucuuacuauaugcuuagccauauauacuaaaauuguuuuaacugauuuucacaaaauagaacuuuuuagagagugaguacaaguggcaaaauaugcuguuuuauaagagagauugccaaaucacaauuguuuucuuuuccuuuuaaugaacauuuuuccuuuuuaauuuuaaaauaugugcuucuugggaaaaaaguaaaauaauucagaagcauacaaaguaaaaagugaaagaucuuuguccuccaccucauccucugccucucgcuaauucuuuucuuccccccuuccaaagaaaugaucacugcuaaugguuuggaugguaucuugucugauguuuuuccuacauuuauguauugggguuagaguugggagagcuggacugguagaaagagacacagagaaaaagagagagaucugcaacuugcucuuucacugacuauauccugagcguuuuuuucauaucccuguaaaaagaugggcaucauccuuuugaagagcaucuugcauucaguuggauuguccugaaauucauuuaaccauuugccuauuagcacauuaauguuauuucuauuuuuucuuauaaauaauaauacaaugacuaucuuuucgcuaccaccccuaagcuugacauacaccucuucauuuuaaagacuugguaauuuccguuuagaaacaucuuauuuuggaaauuuucaaacacguaacagaaauagaaauagaacaaugagcacauguacucaucacccagguaaugguaucaaaucacaccccacccacuccuuaaccuuucccguuuguuuugaagccaaucuccaacagugugucauuucacccauaaaauaguauaucuccaaaagauaaagacaaaauuuuaaauguagucacaauacuguuaucccauuuuuaaaauuaucacuauuuuucuguccuaacaaaaugucaaaaaccauaucauuuucaagaggauuccauaagugucaucuguuauguaccuauaucuguacuuacccuuuagaucaacugauuauauaaucaguuaagucauggaaauauaaauaauauauuuauauuauauauuggucuaaaggauaaguauagagauguauaucacaauuguuucauacucucagugugauuuuagaauugaauuuggcuuuugcuuuauauauuucaaagcuauauuuuagguuuauaaaaacucaugacuuuuuuauggcucauacauuuuugucaucuaaaauauuauuucuugcauuuaguauuuuucaccuuuauuuugucuaauauuaauucugacuccuacuuuguuuuacuuguugaucuuuuuauucuuucuuuugcuuuuaaagauacaucucuuaguacaaaucugauuuuuuaacccaauugaggguuaaaaauuuauauaauuaaggacauugauguuuuuauauaauuaaggacauugguguuuuucuucuaguuccaucaucuuauuugauguucuuuguuaaacagucucguugcuucuuuucaaauuuuccuuugcugccuuuagcuugauugauggaguuucuuuuccccuucucucuguuuagaaguuauacacaauuuuuguaucauuauuauagcuaccuuuaauuuuucccagcucuuucuuucaaauuuuucacacuuaaggaaaaguugucagaauaacauaauaaucaccgcacccuuuaccuagauucaccagugguuacauuuugccacauaugcugcauaaguauacauacgaagagauuauuuggccuagccauuugagaguaaccuacagaucucaagaaugaaggaggcaggugauggauaugacacuucauaccugaauacuucagccuguaucuccuaacaaggacauuuucccauauaaccacaauacaguuaucucacucaaaacauguaacauugauagaauguuguuaucuaauguccauguucaaacgucucuaauuguucaaaaaaaucccuuuuuuagauuuuuuaagauauaggaucuaaucaaguuuccauaucauauuucuuuagucuccuuuaaucaaaauaguucccuagcuuuuuuuuaaaucuuucaggacauuaguauuuuugaaguaugcagucccguuguuuuauggaaugcccuucaguuuggcuuugucuaauuguuuuuuuuuuucaugauuacacucaguucacacauuuuuggcaagaaaauaauuuauguuguuuucaucacagugucacaaauuaaaggugcaugaggucaguuuguccaauuacuggugauguuaaaauuggucauuuaauuaaacuggaguuugccagauuuuccuauuuuacugauuuuauuuauuauauuuuauuucuacuuauuuuauuccuuucccccuuuuuuaaaacuaauuuagugugugacaauuugagaucuguaugaauauccuguuugccaacaaccuuucacccagugguuuuagcuuucauuggugaucugugccugaguaaauauuuaugaaaguggcuacuucuaccacuucagccacuucugaaccuuucuucaaaauucaucucagguaucacaucuuuagaaagcugucccuuacuccucuccucucauucugauauagaugagucuuuugugcucccauacuaaccuaacaucuuagcacuuaccucaggcuaaguguugguuuacuuguagauuucuauaagaacugauugacauccuuugguaaauaagaccuucgcuuccccaccuucacauuuacuguuaggguuguucuucuuuuuaaacguuuguuuuaguaucacccuauacucauggauccuuuucuuuuaagaucgaauacauuacaauccauuuauagucaguauuuuuugaaggcuaaguugucccaaauuuggcaaguuaaagccucguuaagcugucuccugagcccaucaguuuuuuuuuaguauuuacuuaguuucugacauaaaaagauguugcaagguuaccuuuuacuuuucugguucaaaaccuggauucagccauuuccucaaggaaugcuaguuccuucuaguggugaacgguauuuagaaaccaagaucuaaagcaugcucagugcuauggugucaucauuucuggguucugagagagccauaucuuuuaaucauacauucacacugauacccccaauuuuacuucaaaaccacaggauucuucuucucuuucacucauuccauauuaguauuuuucuucugccauagugagaauccugguuucaacagcuucaacauuuaccuauuugcucaguccaauaauacacacaaacgaguuucaugauuccuauacccauacuauugccaauaacaaacuugauaaguuauuuuugccuucugaauacaccacacugagcauauagaguccagcaaguacuauauucaaaaguauucaaauugcuuuuuacauuugggccuguuuuuauuccaugugggguuuucuccauauuuguuuauuuaauuuuauuuuaugaaugcuaacagcauggcuacaauagcagaauacacauucuuuuaugugcacaugagauagucaugaagauagaccgugaagauagaccaucugcugugcuauaaaauaagccuuagcaagaguaaaagaauugaaaucauaccauauauguccucaucacaguggaauuaaauuagaauucaauaacauaucugaaaaauuccuaaauauuuguaaauuuaaaaauguuucuaaauacuccuuaagucaaagcagaaauuacaaaggaaauuagaauauauuuagaacugaauaaaaaugaaagcauaacaugucaaaaauugugcaauucuauuaaaacagugcuaagaaagauaugccuuuaaauacuuuuauuaggaaggaagaaaauuugaaacucagugaacuauguuuccauauuaagaaucuaaaaaaggaaauugaauuaaacccaaaaucuguagaagaaacgaggaaauaauagagcagaaaucugugaaacaacuuuaaaaaaaaaaguaaacaguaaaaccaaaagcugauuaguugaaaaaaaaucauuaaaagugauuaaccucuagauaagcuaugaaaauaggagagauaacacaaauuauggauuucaggaauagaagaaggaauauuaguacagauccuacagacauuaaaaggauaguaagggaauauuacaacuuuaugccaauaaauuugacaauuuagaugagauagauaaauuuccugacagccaaaaauuaccaaaauggauacaaaaagaaacaugaaauauaugcuaaauaaauugaauuguaauuuuaaacauuccaacacuaaaugcaaugugguauccuggauuggauccuaaaagacauuggugugaagagugaugauauuuauauaaaaucuggaguuuaguuaguaguguuugaucacuguugacuucuuaguuuugacaaauguauaauggauguuuuacuauauugcaaguuuucgauuuucuuacauuuuaaaauagaaauuguauuuaaaaucaacaacgcaaagaaaauuccaggcccagacagcuucauugaugaauuuuaucaaacauucaaggaacaaauaauacaaauccuacauaaacucuuuuuaaaaauagaaaaggaagaucuuccaacuugauuuauuaaaacagcauuucucuaauacugaaaccagaaaaggacaucguaagaaaacuacaaaacaauauccuucaugaauauagaugaaaaauuauuaauaaaauauuaauagaauacggaaauauauaaaaagaagaauacuucaugaccaaguaaggcuauccuaggaugaaugacuggucuaacauucaguaaucagauuaacucaccauauuaauagaaugaaugagaaaaaccauguaauucaaggcugggcaugguggcucaugccugugaucccagcacuuugggaggccaaggugaguggaucauuugagaucaggaguuugauuugagaccagccugaccaccauagugaaacgcuaucucuauuaaaauacaaaaguuagcugggcaugguguugugugccuguaguccgagcuacuggggaggcugaggcaugagaaucauuugaaccugggaggcagagguugcagugagcugagaccgugccucuguacucagccugggcaacagagugagacugucucaaaaaaaaaaaaaaaaaaaaccaaaagaaaaauaaaaaccauauaauucaauaauacacauacaaaauauugaccaaauucaauaccaaaucauaccaaauuaugauaaaauuucagcaaaugagaaauaaaaaggaacugcuucaaccugauaaaaaugucuacgaaaaauauauaguuaaaaauauucuuaaaggugaauacugaacauuuuccccuaagacugagaacaugacaaggaauaauaccugcucucaccucuucuauucaacauugugcuacagguccuacccaguguaauaaggcaaggaaaauaaggcauagagauuggaaauuuaaaaaaauauauauauauguguuuuguuuuucuagaacacugagccaaaagacaggaaauguuugaaucuugguguuggaaaacaaauuuaaaagaaaaaaguauuuuacacauuuagaagauuuuuaaaugacaagauccauuuaaacauaaaguuagagcauuuccuagaauggaauuauuuuauuuuuagaaguauuugcaaaaagcaugaucaucuauguaaaaaaaaauccuaaaauaucuacaguaaagcuauaauaauuaauuuuaacaagguuguaagauacaaaauucaauuuacaaaacccaauuacuuuuuuaauauauuagcaaccagcaauugguaauuacaauuuuaaaauacaacauuuaaaauagaacccaaauuaugaaguaguaaguguuaaauuuaacaaaauaugucaugagaccuguauggugaaaacuacaaaacaucucugagagaaauuaaauaaaaccuaaagaaauggagaaauauaccauguugauggaucagaacacuugauauuuuaagaugucaguuuccccauuaaccuacagauuuaaugcaguccauaguucaaaccgauucuaaaaauauacaaaugaaauggaacuaacauaggcuaguuuuaagacuuuuuacagaaaugaaguagucaaaacacuuugauauuggcauaaagauagacaugcagaucaaugaaacagaccagauaguuuagagauagacccacagauuuaugguaaauuguuuuuugacagaguugcucagguaauucuaugaggaaauuacagucuuuccaacauaugguucuggaacaacuggauacccuuauggaaaaaaggugaauugugacccucacccuacuccauaaaagcaaauauuuaaaaauagaucuagaccuaaaugcaaaagcuaaauuuuaaaaacuucuaaaugaaagcauaggagaaaauaucugaccuugaccuuugcaauuuuugccuacauaggacacaaaaaguacaugaaccauaaaaggaaaagauuaauaaauugagcuuuauuuuuaaaaaguaaauagcucugcaguucaauagacaguauuaaggaaacaaaaaggcaagccauagacuggaaaaaaaaauauuugcaauacuuauaucugacaauggacuugcauucagaauacauggagaacucuuauauuccaauaaugagaccaccuauguuucuuuguuuuuguuuuguuuuuugagacagggucucccuuucugucucaggcugaaguacaguggcacgaacauggcacucaagcaauccuuccuccucagccuccugaguagccaggacuacaggugcacgccaccacaccuggccauuuuuaaaauuuuuuguagagauggagucuugccauguugcccaggcuguucucagacuccugggcucaagcaguccugccuuggccucccgaagugcugggauuauaggcaugagauaccacacccugcaaguuuuuuuuuuuuaagccaaaauaguuuaacacacuucacaaaagauaaaauauaaaaggccaaaaagcccaaaugauucucacuaucauuagucaucagagaaaugcaaaaaacuaaaaucacaaugaaaugcccuauggccccauaaaaauggcuaaaauuaaagacucgcuauaugaauugcugacaagaaugugguuuuauacauugccagugggaauauaaaaugacacaaccacuuuggaagacgguuuggcaauuucuuauaaaguuaacugacaauuaacauacaauuuugccauuucaucacccuuuauccaagagaaaggaaaacauguccacacaaaaacuuguacauuaauguuuagggcagcaagcccaaaccaaagacuacccaaauguccaucaacagaugacaggauaaacaaaguguagccuaucuccagaauggcauaauacacagcuguagaagacgaugcauuacggauagaugccacaguauggaugguucucacaaaguuauucugagugaaagaagccaaacucaaaggaguacauacuuuaugauuacauuauaugaagcuuuagaaaagacaaauguuuauggauagaaagcacaucaguaguugccugcgguugugugugggacagucucagcucacugccagcuccaccucccagguucaugccauucugcugccucagccucccgaguagcugggacuacaggcgcccaccaccacgccuggcuaauuuuuuguauuuuuaguagaugggguuucacagugucagccaggauggucucgaucuccugaccucgugauccgcccaccuuggccucccaaagugcugggauuacaggcgugagccaccacgcccagccuaaucaauaaucuuuuagaguagccugucccauuuuuucacgagagagguaauauaucuucuuagaacuuucugaugauaugcaauaccuacuuagaacguucuucuccauuuguugcuauuguucccuugggaguuuaguugggugcuucucuuucaugcuguuaauuuucgucagauauuuggugguucuugucuauuuaaauuuuaaauuacauuuaaauccuagguugaucauuauugguuacugcagagcauuuucuugggacaaaugauaaucuuugguccuuuguuccccugaucuucucuuucacauguacgcaguuagauucuucuguucucauggcuuuccaaucaaucagauaccauuugauuuauauuuuuuauaaauguccccacuaucucaguuuguugauggcacccuucucaaaauccaaugcuauuauggauuuacugaguuucacucugucgcccaggcuagagugcauuggcaugaucucagcucacugcaaccucugccucccagguucaagcaauucuccugccucagccuccugaauagcugggauuauaggcacccgccaucaugccccgcuaauuuuuguauuuuuguagagacaggguuucaccaggauuuauuuuuuuaaguaacuuuuguuucacuucagaagaggguaaggaagagaaguaaaauccaacucauuuuuucaacacaugaaagaauuacuuagccccuacuguauauaaaucguggcuguuggaacuaauagacagaugccuccgagggugcccccuggcuaagcacugagcaagaccucauguagucucauuguucagaugaaguucuaauaacucagugucugaaucucagcuuuguagguuuaauuucucucaucaguaggcucauguagaaauccugaagcugauguauucacuuagagcacaguagcccaccucuucacugauuuuacucuuaaaaaaaaauaauugcaugaacuucguaaacaaggccaggugccauggccuauaaucccagcacuuugggaggccgaggcaggaggauugcuugagcccaggaguucaagaccaaccugagcaacauagugagacccccccccuucuccauuaaauuaaaaaaucaaaaauaaaagagaaaaaaauuauaaacagaacucuaauuauaagaacuaaaacacauuuuucauuaaauuuuguauacauguuuaaaggacuacaauugaaaaugaauuuuaaaaaauuuuaagagucaccaaauuaaauacagacuauccaaaauguugcuugaauaaaauaaauaaauguuacaaaucuagaauauucugguuggccuagccagugacuucuuucucucauuaggcaggugaucauggaaagcaguauuacaaucacagaguuguuugguaagccucgaaucagagcaagaagagauaguugaaugauguuaaugauaguucuuuaccgaguuagagagucauccaccaauuaguauggugguagcuuuaucuuuaguaaagguucauacuugcuaagaggaccauagcuuucccaucaguagagcucugccagccauagagaguacagcacgaacacugcaaauuuguugucuaccugacccccauuuuuugguguuaucuuacagcugcauccuacuauacuauaguagcugcauccuacuauacuuuaccuaacaaaagugacagaaccaacucuggaaucucaagcucagagaggccacucuauuccuuaacuccaccuuauccaguguuccaucucauuuuggauuuaugggcaucuugagggcuucuagggcuggauuacccacagacaguaaacagauggugcugagcaaaaccuuacagcauggaugugcaucacuccuguugggcaggcagugaaaaaguggaguucuagaugcagacaguaaaguccucuugggcucagguaaccagagggucucacuagaguugaggccagucaguuccccuaccccaccuuuugagauaauaaugauucuucacuagcacuacugacuuguccuuccacagacuuuauuuguaggaaauuagcugcaauuuccugcaauuuauaaauaagacuccuuauaaggaaaaaaaaacaugauuucccauuuuuuuauauguauuguuuagaggguugaaauaaccaugaacuaaaaucuggaguauuuaagacaugguacuggauaaacacagcagggcucccuuugcaauuuccauuggagaauuugugcucuaagaaugagcagagcagaauuaaugcugagucccucugccaccccuccaacaagucuccauacccagugaggucagagcuguccauuuuguucucccaacuuuccccuaagaacuaaaaauaacaauauuagcaaagcuaacacaucuauagcgcucacuguaugccauccacuguucuaacagcuuuauauagaacuguaccucuaauaaagaaugcaugugucuuuugcaguugugaagaugaccucuccgacgacagagaagagcuucugcaugggauuucagagcuggacaucagcaacucggauuguuucccaucccagcugcuagugcauggggcuuuagccuuuccucuaggguuagauuccuaccauggcuguguuauagcggcugcccgcuauggccggggccgggugguugugacuggccauaagguauuauucacuguugguaaacugggccccuuucugcucaaugcuguccgcuggcuggaugggggccgcagaggcaagguuguggugcagacagagcugagaacccugaguggccuccucgcaguggggggcauagacaccagcaucgagcccaaucugaccagugaugcaagugucuacugcuuugaacccgugagugaagugggggucaaggaacugcaggaguuuguagcagaggguggcgggcuauuuguuggagcccaagccugguggugggccuucaagaaccccggaguguccccuuuggcucgauucccaggaaaccuccuccucaaccccuuuggcaucagcauuacaagccaaagccucaauccagggcccuuucguacuccuaaagcagggauaaggaccuaucacuuccgcuccaccuuggccgaguuccagguuauaaugggcaggaagagaggaaauguggaaaagggcugguuggcaaagcugggaccagauggugcagcuuuccugcagauucccgcagaagagaucccugccuacaugucugugcaucgacuccugaggaagcugcuaagucgauaucggcuuccaguagcaacccgagagaacccuguuaucaaugacugcugcagaggugcuaugcuuucccuggccacagggcuggcccacucuggaagcgaccucucucuguuagucccagaaauugaagauauguacagcagccccuaucugcgccccucagaaucuccuaucaccgucgaggucaacugcaccaauccagguaaggaacaaggguuggaagcucaguauuaugggaaugggggaauggggacaggcugacaucagcaguccauuucagggacccgaucauguccagaagguggucuccauuuuuuaccaugaacuuugaagaagauaaggguugggauuuuaaguacuguuuggaagaguugagucaaggcagcauguaggggaagauacgugcuuacgaagggucucuggugaugcuggguggagguggcaucauggaggagggauaaagucugccuaccccuccugcuuuuggcaggcaccagauauugcuggaugaguacugggcucuacauaccuggaaggcaaauuauagaagucucacugccugaagcugcugccucugccgaccugaagguaaggccaugccccaccucaccauguaacauggaagccaaaggcucuuccuagcacagucaguaucuuauuugauucucacaaagcccuguugguaauacagagcaggugauuuuacccuuguuuuaaggaugaaguaacuaaggugcagaaaagcugauugauugauugaucgauugaaauguauagagcuaauacaaauaagugcccaggacucaaaccuaacuaauuucuggcucuuaaguuuugugcuuuugaccuacauccuagaguagggaauaagagguaucaaauggaagguaaccuagcacagaguaggcauucaguaaaucugaguucacuguucaucuccguauccauucccaugguagcacaaggucuuucugacuucagcuucuuccccaugacauccaagaccauuccucaauugcccaguucaccuucccucugucacuuucacauagaacccauuugcaaaguuaguuugcuguccuucccuaucccccuugggggucacugugaugguuagcaucuauucugugccuguaccuauccuggaacuugauuagcauaaacccagggaaaagaauccuaggacucuaccaaguaccugcccaggaagagggcuuggagaaacccuccacuaucuuagccagaucacaccaccucccacugggcccucucucugaucagcaaaaggcaggguucccucugccccauuccaaaugccagaaucaccaccaugagauaggcgaucaaguguucuauuuguuagcaacaccaggagaccgggugugggagucagcccuccucagaauuggccuuacagguuacaccuggcacuucucacauuaaugucuaucuaacaugacccauuauggagcuguuugaaugcuuugggaaaauauuuauauauacuucaguccauaugccccaaggaaugcuacaguuucuugggguaucacacaugguucaucuguggugggaaggcugggcucgcuuggguucauggcugaaugacccauccugagucccuugcugggcucucuucuuccacccacucgugccccauggugacuccuugagggggggaucuuucugcuccagauacagauuggcugccacacagaugaccugaccagggccagcaagcuuuuccgaggcccacucguaauuaaccggugcugcuuggacaaacccacaaaaucgaucacgugccucugggguggacuccucuauauaauugugccucagaacagcaaacuggguucugugccugucaccgugaagggggcugugcaugcuccauacuacaagcugggugagugggagcucugggugccccugagggaaggggaagaacugagaugaggauuccagagagcaugggaguccaggaggugacuagagucuguuuggugcagaaggagagagacacgggcuaacagaggaauaagggucagcuuccuuagauucagcuuugggguuguacagauaaagaccaaaccacauccuuggagacuucauagaaggauagagaaaagggauauagccucagcaaacuaacacaggaacagaaaaccaaacaccacguguucucacuuguaagugggagcugaacaauaagaacacauggacacagggaggggaacaacacacauuggggccugucagugggguggguagcggggguggauggagggagaccaucaggauaaauagcuaaugcaugcugggcuuaauaccuaggugauggguugaugggugcagcaaaccaccaucacacauguuuaccuauggaacaaaccugcacguccugcacauguaucccggaacuuuacauuuuuuaaaaaagaggagggauauggcaguucaugauuuuguuguucucuuccuggagucuaaguuguauguuguaauuuaagggauuugggaaaggauuucaagcuccauggucucucuuccuaggggagaccacccuggaggaguggaagaggcguauccaggagaauccagggcccuggggagagcuggccacggacaacaucauucugaccgugccgaccgcaaaucuucguacucuggagaacccugagccgcugcuccgccucugggaugaggugaugcaggcuguggcgcgacugggagcugagcccuucccuuugcgccugccucagaggauuguugccgacgugcagaucucagugggugggugcuccaagcaaacccucugugcaugcugccucugagcgccuuccugucuuucaucagccaugcagugggcagccaguaggggaaacauauuuugcuagcaagacauauagauguauccuuguuauuuaaaugggaaggaaauauauauaauauauauuauauauuauauauauaauauauaauauauauuauauauauauuauauaauauauauuauauaauauauauuauauaauauauauuccguaauauauauuauauaauauauauuauauaauauauauuccguaauauauauuauauaauauauauuauauauauguauauauguauauguguauauaaaacaguuuaggucagcaugucaaggacaucaagaaaugccaccugagcuuucacagguauucaucagggacuucaagccgguaaaaauggcagagggccgugaccuaggucagaguuguuggguuggaaaagggaauuuuacaacuuuaagaacacacugaauaaagcgaucuuugccuauggucaaggaacaugaaaagugagggaaauauacagacauuaaagaaccaugggaauuucucuggacccucauuuucuuucuuauacggauguucacuguaaacuuguguugauauggcaacuccauaucugaacaaugagagaggagcuacccuuaaagagcucugaauuuugagaaaagguuauagugacacagauucacauggauaaggcauccucaucaaaauagaaaaauugaaugguaacaugaacagcuccuuauauauaagcugcaucuccuuccauagccacacuauucugggucagaguagagaugaaggaauucuuccagaaugaaaagaggagaaggaacaccuagcagggucuugguuuggguugcuuuucugaguauuauggugugcuggaauuuggcugggguuacugaguguuuuggaacacacacaaaacauagaagaauauuacgacuuaaauggggaggacccuaacucucucuucccuccuucugcauuuuccaggcuggaugcaugcaggguaccccaucaugugccaucuggagucagugcaggagcucaucaacgagaagcucaucagaaccaaggggcuguggggccccguccaugagcugggccgcaaccagcagcggcaggagugggaguucccaccacacaccaccgaggccaccugcaaccugugguguguguaugugcaugagacggucuugggcauuccucgaagccgugccaauauugcucuguggcccccaguucgggagaagagagucagaaucuaccugagcaagggucccaaugugaaaaacuggaaugcauggaccgcacuggaaacguauuuacagguacugggcaagaauggcgggugaugggggaccccuacugcggggaccaucagggcaacuaucggauaauguucuaguggcccagaagaccacccauggccccugucucccacacugggauaugggaggcccugacaaaguccaacugugacagucguauugaugaugucucuuagugcaucgccuugcaugacccucaaguggauuucauugccugagccucaccuuccaccccauagagauauaugauaguaaauagaaagcacugagaaagguuaaaaaugguagagacaaauaaaguacuauacauauauucacucucucuggcuuuaaagccagacauaccugagacugaagccaaacucuccuacuuaauagcuaucuaaaaccaguuccccccaaccauacacauaauccauaggauaugacuuauuuuuuuuuuccuuagaugaauguaccaucuucucacuaugccuuggccgugccucagagcccccauuauguaggcaauccaagaguccucacugaccuggacaaggagguggccuugccuuugaccaguuguuuaaugccuaguucccucccugcaaugccuggaucaguuccuggcaugaaacuggagaguuucaucaccuugaauuucagaacucagucucaggccaagcaugcucuauucugguucuuccaccugcuggaggcucucuuauucauucccacugccgugagaauuaugggaaaaccaaggaggcuccacuuuaaccuuguuauggcugcuuugccccaggaacaccaaguuucucauuggugaaauaaaugugaaguuggucuggggaacugcucaagugccucauaauucaagcucuguaacucaacagccucaagauggcugccuuuuucaaaaauuacaacuuauucuuaauucuaguuacccagacaaucugcagucuucuacuucuauccaacucacuuuuuuuccccaaaagccauuuuaauacccuugcacauugacaaagaucuaugauuaaugaggauuucuuugugccaggaugagguggaaguuucccuauuguugagguuucacuuuucaacucuugagaagaggauuuuuccaauucugccaauuuuaaauccuuguguaauauccuaucucuauuugcgugaucuagugggauacguggguaaugauacugguagaaaauauugauauuaaucauugcaguuguuaccauggcccucacugauuuaguauccacuugguguugaacaccgugcuggucccaaggcccuuccuaagauuagaauguggaagagcagggcaugaggccaggaggcaaaauggaggagagcaggucggugauagacgugaagcugauggguaagggguuacauauacuaaguucacuuauuauagugguuguuguuggacccuuuuuuauuuccaaaucugaucuguauuuuucuuucucuucccagcuccaggaagccuuugguugggagccauucauccgucucuucaccgaguacaggaaccagaccaacuugcccacagaaaauguugacaaaaugaaucugugggucaagauguucucccaccaagugcagaagaaccuggcuccguucuuugaggccugggccuggcccauccagaaggaaguggcuaccagccuggccuaucugccugaauggaaggaaaauauuaugaaauuguaccuccucacacagauguaaggagugcccaucgagguggcagguagagagguuuggggagguaggcagagguggggauucacuccucuaccucugccucccagggucuggccuuguccucuuaguucauugcccuauaccuuauuaccgaccucugucucuaggaaguggguucagaacacagccaaaaguggaaucagaauuucucaggugcaagggcuucuguuucugcaucuuguucgucugcuuucagcugucacauucccuccugacccugcacuggcccaguuccaagagcuuuggcaccugcuucuauaucagcccuggauucaccaucauaggucauagcccagaggggguaguucucauguuggcauccugaagacucccuuugggcuuuuguuuuugaacaguuguuccaaaaacuugaccauaaaacucaacuggaacacaaauuuaccgugagacccagauagcucuuggauggacucauauauuuugugacuugaguaguuuucaaaguagacaagcauucugguauagugggaagagcccagaacuagguaggguuagcucucgggaaagucauuucaacuugguacucucauuuccuguguguaaaauggggauaaaaauucccaguucacaggguugucguggagguucagagugauaaauucugaagaggcuugugaggucugcagagcaugucaucuaaggggauuuucuauuuuaugcugguccacaggauaaugagcuuacuacuuuccauccugucuccagaauuuagagguuaggauaacucucucuacaaguagcuucccuguguucaaauccugguucuuucaccuacgaguuguauaacccuggcaauuuccuuaacuucucugugauuuaguuuucucaucuauaaaauaggaucuaucucauaggaucauugugaggauuacauuuuauaauaccuuuaaaaagcaaugagaaccgucccuggcagguaguagguguugagaaaaugucugcugccauuauuauuaucuaauugacucaauacucuuuaugagcuagacuuuauuuuuagaugacauuuacagaggcaguuguaguuaauccuagcccaucuugcacuuuauacagcaacuucugaaaggauucugcuauguugccuuaugaaucuaaaggaagaacucuaaauucacaauggguuuuuuuaaauagcuaaaaaauuuuguuucuuuuuaacuuagauuuguaaagcuauuuauaagaaccucauugugaauuuggagcucuuccuuggaucuccuuauccaauuguauuuuacagauccaauuccuucuuugauuaaaucaagaguagaugucuugaagaaaccagaucaauuccauaaugacauuuguccuuagcaaacagaggguaucugguuucaugacaguguuuuuauuucuguaacacagauucaagacauagugccugucaagaguuacucaacaguuuggcagacgaaguccacacacauagaggacuuuacucugaaacaagaugauuggauagaguugacccaaacuuauuucuuuuuaauuuuauucagaauccccuauuucuuuacaguuuuaacuaaaguuggguccuuuugguugaugucauauacauccagccaguuuuucuuuagcucacuuuuuauuuuaguuauuuuaauauaucauuuuauuugcuuaauugguaauuggguagauauguagacuguaagauuugaccuauagaguuuuuucuuuggauuuuuguuuguuuguuugagauagcguaucagucuugucacccaggcuggagugcaauggcaccgucucggcucauugcacccucuaccucccagguucaagcgauucuccugccucagcaucacaaguagcugggcuuacaggugcccaccaccacacccagcuaauuuuuuguauuuuuaguagagaugggguuuugccauguuggccaggcuggucucgaacuccuggccuaggugauccacccaccucggccucccaguagauuucuuugucauguuauuugucgguccuaggauuauuucuccugauugcacaaauauccauugccuaggugcuuuaaacaugagacauuggauauuuguucaacauuuaaaauaauuguuaucaauuauuggguguguaccaguuauuguagugauuccuuucuauagauuguuucauuuaaucuucacaauaaucucaugacauggcaaccauuaucacucccauuuuauuuuaugaacgagagaacugaaguuaaggaagauaagguaaauuaucuaaggcuauauugcuaauaagugguugaucugggauuugaauucaggcauucugauuacagaaugggcauucauaacuacagugcuuugaaugaccccaucaauggguaaauaaagaagccgaccagcaaaccaaaggaucauuauguuccuacuugccagagcuuuggcugcauauacuuaccuaucaucuacuuuuaucagaacaaaaaaucauuuuguuuaucccaaaugacaauucaaagaauuuaagguaggcuccugaagugcuucccaauagauagugcuggagugagcccuuuagcaucagccagaucuuuuagguucugcauuacucaaguuucaguuauucuuucuaggguaccaugaaaguguucucuaguuuguuggauuuugaaugauggacuauuucagugaagugccugacucccagagaucccaaacacugcauguucucagagaggaaauuagauccuccaucuuugagaauauguguauccauccuugcccucuuuaauauauuuuuagcaguacaucccggggauauauuuaaaauauaaaguuauccauguuacuuccgugucuaaaagccuccacuggaauuucuaauuugagauaauggaguaaacauaaguuuaccuucccucccuccccaggccccacugaaauugaagucaagaaaugcaaaaaggaacugacacaucucagcaaagaaaacugaagggauuugguuauaaguggagaggaucucagcauauuucuggaagauagaaaguggaugaagcaugauaaugaaagagugaagaaccuuucagauaaaauguaagcugaucugaacaacauaaccccaaagagacuugcgcaccugaaaagcuugucuacugaagaauuacuccaguuguaagauugagcccucuccuacucucccccaacucuuaugcacagaacacaggcagucuccacuauugauaccaguuaaaaauuucuuguuauuguugcuguuguuguuuguauaaaggaauugaacaggcugcuugcagagagauaagaguuggugcuccagaaaaaaauuucucuucuaguggaaauaagugccccuacccccagccggucagcuaauucucuacugacagcugagaccuccuacucaagugccuguugccuucagguauagaagagguuuccugaagaaacagaccuaacuguacaacagcagaggaaacccaugccaacuguuauacaaguuaacaguuauguugauuuuuaaaugggaauggugaguuagaaauucccagacaugggcgauggggagggaagaggaauaagaaaagucacgagguagaauuaggggccuugaaaauaugacaaacucugagggaaacaaagacaauguggaaagaauaacuuaauuuuaauuccaucuccagagagauuugagguguauuuaagaugaaaaacaggauacuacaaagaaacggaaaacucaggaguucgagaccagccuaggcaagauggcaacaucccgucucuacaaaauaauuuuuaaaaauuagccaagcaugguggcaugugccugugguccuagcuacuugggaggcugaagugggaagaucacuugagcccaggaguucaaggcuucagugagccaugauggugccacugcacuccagccugggggacagagugagacccugucucuuaaaaagcaagaaaagaaagagaagacugagaauaagaagaucucuuugaaaauaaaauaagacugcuaaaaguauuugguauacagucuggaaaauaaaguugagggaaucucuccagauaaagagcaaaaagaaauagauagaaaaauauaaagaaagaaaaaagacauagacaaucaauauguaauguuaggaguuccuggaagagagaacagagacaguguaggugaagaaauaaaaagaaaaagaauugaagaacagagcaagcuaagucuccagauugagagggcccaauacaaucuacaucuagacacaauauuguaaaauuuuggaauauuaaggauagaaggaagauauuaaaguggccagggagaaaacaaaugaggucaucacgauuagcucaacacaaaaauggaugagaaauagacugcuaacagauuugucaucagcaacacugaaugccagaagucaauggaucaacaucuucagagcuuaaggaaaauuuuuguaccuagaauuucauaguaaggcagacugucaagaagaacaucaaagugaagacauuuucugucaggcaaauuuucagaaagucuccuuugcacccuuacugaggaaguaucuugaggaaauucuccagcaaaaugaggaugaaaaccaggaaagaagaagaaaugggauccauaaaacaguggaccuuacuuaggaugucucauucuagagugacagccaaaaggguaucucacccuagagugacagcuauccagcagacuaauuucagaugagagcauacugucucgggcuuucugggaagaaugugcauucagugccauagauaguaucauugaagagcugggaugcuugagaagauuauuuagucaagaaaaaagaaagacaaaucaacaauaugucaaaaaauucagguccaauuauagagcaaaauaaaaugaggcaugauuuugaguuauucaugaagaauaagaagaggcuugauagguacauuuccuuuucuauggcacaggcaugaugauauuggguguguagggaagaaaauauccuagcuuauacuaggcucccaguaagaaguauuuaaauagccaaaauaauguggauaucauuuauuaguauucaauguucagaucagccuauuaacaaagugugaaagguuucauuuuuuauucagaacugaaguugaaaguaauuaaugcugacaaagggaaagaaagcagaaagagauugagaauuagaggaagagaaguggaaucaaagguagagauacuuauauauucaaaguggggaugaaaagaucuucaguuaauggaacaagaacuagaggauuaguguauuguucaaagcuauaaaaucaaaccaauagauguauuaaaaagugauguaacuaucagacauuuggagagagauggacaaaggaaaguggcgauaguguaaguuaaauccuuaucuuuuguaauggggaauuauuaaagauguuguaaagucaguaagucaagaaauuauugcucaaacauauuauuuaaaguuagaaaguuaccagacgaucuaaaauaaauauuguuaaaagcauuaccucuagggaaugggauuuagauuuaaaaagggugggaugggaaacuguguuuuucauuuuaaguccuucuguacuauuuaauuuuuuaccuugugcauguauuacuuugaaaaaauuuuuaauaaacccaaauaaaaaucuuccagugacuu

SEQ ID NO: 14614 - RNA, 935 nt, Homo sapiens
uucaugaaguucucuucuuuucaagcauccucuuuagaguaccuuggacuuccuuguuccuaagacuauaaauuaggggauuaagcaugggauugaagaggcugugaaacagcaggagauauuucuucugcuccuuggggcucucauacuggggcucaacauacaugaugauggcugugccauaaaagaguccaaccacacagaggugggaggagcagauggagaaggcuuucuggcaccccucuccugacuggaucuuuagaauggcacauagaauaugaacauaagauauuacaguggaaaagaaggcucccaccagcacagacacugccccugccaaaaccauuaccucauuaauguggguauccgcacaggcaaguuugagaacagccauaauuucacagaaaaagugauuaaguuucugggguccacagaaggacagugguagcaguaacacuagauggacaagggccaauaagacuccuaaaauccaggaagucaaugccaaagugaugcagacuuuccaggucaugaugguagaauaucggagaggguggcagauggccacguaccgaucauaggacaucaccaccaggaggagacauucuguaugugcaaaacucaaaaacagaaacaucugggucaugcagccagcaaaggagaugggcuuggcuggaugcaggagguucaccagcaucuggggcaccgugcugcaagcacaggcgaugucgacgaccgccaggugugagaggaagaaguacauggggguguggagucuggaguccagugagaugagccccaggauugucccguuccccaacagaaugaagauguagaacagggagaagagcccaaagaggagcaucugaauccuugggccaaugggaaaucccaguaggaggaacucugugauggaagucugauuuccccccauu

SEQ ID NO: 14615 - RNA, 1036 nt, Homo sapiens
ugaacuuaggugguauuugguaccaagauuccaggagaugacugaggagggagagucaaaugucacaccaguuaggaaugacuuuccuugcccagugcucuccucagggcacccuugaccucuccguuccucaggcuguaaaucaggggguuaaguguuggguugaaaaaacuguaaaauagaaaaaagaccuuuugcugcuccucaggauggcgggacuugggggccauguacaugaugauggcacugccaaagaagagucccaccacgcagaggugggaggagcagguggagaaggccuuucugcggcccuccccagacuggauccucaggauggccgccaggaugugcgaguaggagacaagcaccaggcuggguggccccaccaggaagaacacgcaggcugcaaagaugaccaccugguugagccaggugucagcacaggccagccugaggacagacaggauuucacagaagaagugguugauuucaugaggcccagagaagggcagucuuaggaugagaaccacaugggccagagccaggagggagccacacguccaggaagugacggccagggugaugcagacucuccaggucaugaugacggaguaucggagaggguggcagauggccacguaacgaucguaggacaucagcaccagcaggagacauucgcuguguccaaaacucaaacagagaaaggucugcgucaugcagccagcaaaggagaugggcuuggcuggaugcaggagguucgccagcaucuggggcaccguguugcggguguaggcgaugucgacgacagccaggugugagaggaagaaguacauggggguguggagucuggaguccagugagaugagccccaggauggccccguuccccagcagggugaagauauagaacagggagaagagcccaaagaggagcaucugaauccuugggcccaggagaaaucccaguaggaggaacucugugaccauugucugauuuucccccauuucccugugaaaaagaaaaagaucacuuagga

SEQ ID NO: 14616 - RNA, 1997 nt, Homo sapiens
gcagcuuagaguaggcugaaaacugcugaacuguuuaagacuuaauccuucagaguaacauggcagaaguagcacacuuuuuuaacauaaagcuguucaggacucuauuacagaagaggcuauacuuccuuaauuacauucuauucuacagccaccucaaaauaacuagugaacacguucaaccaggaucauuggcaacagccaaugggcacagugaucuggaaauggucuagccaagcuguuugggcuguagaccauggcauuccuaagagcaaaauaggcaaggaguccauuaauauuucacuugacuuaugucaccauggaaaccccuggaguagugaauggcuuuggggaguggucagauucaaccaaaaauaacagaaaucucugucccccagguaaaggauuccuacuuugugugugucugugugugcacacaggcacacucgagagacuuuuggcauucuuugaagucacuggaggggcacagagauaaacccacucagccuuggccuccaagacuaacagaacacaacguuucccugaaagaauaaaaaaaaaaauacaggcauaagaaaacacacaaacaugggcuuagagauuuaaauacacacacacacacacacacacacacacacacacaggcccuagaaggaacauacacccugagauacgcacucauucuaaaauaaacucgggaauacagaaggacacgggcauguccuuucagagaggcacacuucuaggcccuaaguaggagaaggaagaggggagaggaagaggcagggagagggacagggaggggggaggagggagggagagagagagagaaacgaagaagggggcggaggaggagauggaggagacacucuuuauucuauaggaggagacaucacggaagagaaaucaacacugaggccuuggccgggcgcgguggcucacgccuguaaucccagcacuuugggaggccgaggcgggugcaucaccugaggucaggaguuuccagaccagccuggccaacauggcgaaacccggccucuacuaaaaaauacaaaaauuagccgggcaugguggcgcggaccuguaaucccagcuacucgggaggcugaggcaggagaaucucuugaacccggagacggagguugcagugagccgagaucgcgccauugcacuccagccugggcaacagggcgagacuccgucucagaaacaacaacaacaacaacaacaacaacaacaucaacaacaacaacaacaacaacgaacaaaccaaaaaccaaugaggccugaagauaaagacacauguacaaccacggaugucagacuuccagaggcacggccaaggcaaaagacaaacacauacagacugcagcaggcagacaggccgguuccagagucaggcuccggugaagcuccgaagaaacaaacacgcagggagauuucggaggcguccgaggacaccguggggcccggcuggcucccucugucucugugcgcgccccuuccccgggucaccccgccugcgcccgaccugcgcccgcgcaccgcgcccucggggcucccugggacagcccgcggccuggcccgugcgcccgggcuccccuccccgccggcccggcacuucccagcucugacgcgggagcuucuuucacaccaauggggcucgcgcgcggaggggcccugccccuccuccgggaaggugugucccuguuuccucaccugaaacuuccuaggagaacccgaucccucccucccgucgggcggccaggggcgggccgcggguggggcggccgggccugcgcuggggacggcucuggggacugcggccggcgccgggaccuggaggggacgcuggggccgaagcagcaugugacaccgaccaggugggugcccuccucccgucucggcccugggcucccggcggcuguggagcccggcggagguggggcagggacaggaaggaagaggaagccaggccuuucccagggaucagcccc

SEQ ID NO: 14617 - RNA, 1997 nt, Homo sapiens
ggggcugaucccugggaaaggccuggcuuccucuuccuuccugucccugccccaccuccgccgggcuccacagccgccgggagcccagggccgagacgggaggagggcacccaccuggucggugucacaugcugcuucggccccagcguccccuccaggucccggcgccggccgcaguccccagagccguccccagcgcaggcccggccgccccacccgcggcccgccccuggccgcccgacgggagggagggaucggguucuccuaggaaguuucaggugaggaaacagggacacaccuucccggaggaggggcagggccccuccgcgcgcgagccccauuggugugaaagaagcucccgcgucagagcugggaagugccgggccggcggggaggggagcccgggcgcacgggccaggccgcgggcugucccagggagccccgagggcgcggugcgcgggcgcaggucgggcgcaggcggggugacccggggaaggggcgcgcacagagacagagggagccagccgggccccacgguguccucggacgccuccgaaaucucccugcguguuuguuucuucggagcuucaccggagccugacucuggaaccggccugucugccugcugcagucuguauguguuugucuuuugccuuggccgugccucuggaagucugacauccgugguuguacaugugucuuuaucuucaggccucauugguuuuugguuuguucguuguuguuguuguuguuguugauguuguuguuguuguuguuguuguuguuguuucugagacggagucucgcccuguugcccaggcuggagugcaauggcgcgaucucggcucacugcaaccuccgucuccggguucaagagauucuccugccucagccucccgaguagcugggauuacagguccgcgccaccaugcccggcuaauuuuuguauuuuuuaguagaggccggguuucgccauguuggccaggcuggucuggaaacuccugaccucaggugaugcacccgccucggccucccaaagugcugggauuacaggcgugagccaccgcgcccggccaaggccucaguguugauuucucuuccgugaugucuccuccuauagaauaaagagugucuccuccaucuccuccuccgcccccuucuucguuucucucucucucucccucccuccuccccccucccugucccucucccugccucuuccucuccccucuuccuucuccuacuuagggccuagaagugugccucucugaaaggacaugcccguguccuucuguauucccgaguuuauuuuagaaugagugcguaucucaggguguauguuccuucuagggccuguguguguguguguguguguguguguguguguguauuuaaaucucuaagcccauguuuguguguuuucuuaugccuguauuuuuuuuuuuauucuuucagggaaacguuguguucuguuagucuuggaggccaaggcugaguggguuuaucucugugccccuccagugacuucaaagaaugccaaaagucucucgagugugccugugugcacacacagacacacacaaaguaggaauccuuuaccugggggacagagauuucuguuauuuuugguugaaucugaccacuccccaaagccauucacuacuccagggguuuccauggugacauaagucaagugaaauauuaauggacuccuugccuauuuugcucuuaggaaugccauggucuacagcccaaacagcuuggcuagaccauuuccagaucacugugcccauuggcuguugccaaugauccugguugaacguguucacuaguuauuuugagguggcuguagaauagaauguaauuaaggaaguauagccucuucuguaauagaguccugaacagcuuuauguuaaaaaagugugcuacuucugccauguuacucugaaggauuaagucuuaaacaguucagcaguuuucagccuacucuaagcugc

SEQ ID NO: 14618 - RNA, 691 nt, Homo sapiens
uauccacacugcucaaggaaacagaagagaagggcuuaaaaauccacaaagcagcauauuuauuccaggcucuaguagacagcccccugauuucauucccauucaucaucaccaauaaaaugaggacggauccugggcuggcugaggcucugugguccuuggcuccuugcccugugccuucucagcuucaaggcaggcagucugugucagagguagagauggcacccacagaggguaccagagcugcgcagauacaugagcccagaggcagaaagagcagggagcaaagggugcacauccaugaguccagcuggggcuucacuugcugccugccaugaucuugagguacugcagggcacggcgggcagccucaccacgggcugccucccuggugguugcagagccaugacacacaguggccggcuggguggacaguuccaccaggcacuggcagaguccacucaggcucagcuccucuggagagcaagagagaggagggaggcaauguugggggagguagcccuggggaggggugcguucacguuaucaucacccccuucuacuugcuccgguccagcccccaccauccccuggcucgcuccccagcuagccauaccaauauccagguagcugacgugaaaggccugcuccucagagagcucacugaggacacggcagcaggcagggccca

SEQ ID NO: 14619 - RNA, 11253 nt, Homo sapiens
uauuaucaucccuaugucauagacgaagaaacugaggcacagagagguuaaguaacuugcucaaaguuccccagauaauaagcaacgaugccaggauauaaacucuggcaguuucauguucccucccggcugcuucccaccuacuuuugauucaguagaucuggaacagggcccucggaauuaguaaaguccccagcugauucugaagcaaagccagguuugagaaccauccugcuaauucacuuugcgcuggauggcuaguuacuuaccugugucuuagaaauaacaguucauaugguuaaucaaguaacaccuguacccuuucauuucaguaguaagcaaauuugcuuggaaucugcuucaguguucuuugggcacagugcugagggggcaggugaaccuuaggaaauugucucucaccccacagcacagaccaccuaguuuaaaggcacaugugaacaggcaaucagggagagaucacaaagcuuggguagaagguguaaggugggcuuccugggagggggugugagcuggaucuugaaaagugagcaugauuuggagauggaggaaagaagugggaaaugguaucuguuaagggaacaacugaaggaggcccucauaaauggcgacucacagcucaucugugggccagugaguacaaccaacaggaccggauggcauugagaguuccuucugggaaguggcaggaaauaaauuuggaaaugcaaguuuggacaagaucugguaaaccuuaagugccagguccaaauuuggauugaacacuauaaacaauauggaaccacugaagcuugaaaggacaaaauuauaaugaugaagguaucaguuuagaaggaauaaucugccaucagucaggacacaaguggaaggauaaagagauaagaaccaggaaaagcauuuagaaggcuaaaggaccaacauaagugugggagaauaucuuaguaaaggaguggauauacacagaaucaugagucacugggucagguuaugccacugaucaggcugagugauuuggagcaaauugccuaacaucucugagccuuagguuuuuucauugaaaaaauggguaugaugaugauaaugacugacccaaaagaggcaaacgauuucucuacgauggugacagcucugggauacaaggugaacgggccaggauuuugagucuguuuccaggucuguaugaauuaaagaauguguuaugaauggcaacagagacaaccacuuuguggacgaugaggaagggaggggaacuaaugguuggugaauguuccacgaauuacgugggaauuauaaauaaauuacucuucacacucuuaugaaguagguauuuuuaucucaaauuaacaguugaccuuacuagagcaaaagauaguaauuugaguuacuggauaugacucaaauuuggguaacuagauacaaaccaaggucuaaaaucuaaaacuugggcuuuuccagcuaguacaucauauuuagauuugaaaguuauauuuuauuucauugcuuuuggccuaauguuguagccuguugagacuguuuugaacuuugauucugacaucuaucaaauuaauuaucccuccaaacuuugggucauccgagagagacaucaauuuugcugaguugggggguaaagauggaggaaggauguuuuaaaguagaaagagagcagcagguggccuugacuugugagguaggcggcaagguuaucugcgcaaaguaaaugcaaucuggauguuaaguggacguaaaagucgauggaauaaauuugcugcuaagaaugaucguguaggcagguggagaguaaagaauagaaaggaguuaagaaccaggaauggaggcagugagaagagagagggugguguggguggaccaaauacugcuauuaaggaaaaagagaggguggaggaaacaaacaauacagggaagguugacccacucagcccuucuauucagcuggaggaagucacagaaaaggaggcuauauugaaugguaagauuggagaagacugguuagggaauaggaagauaagcuguugucuaaaaaacgcagucuccaguaaaaggaagaaauugggacauuuuuuuaaaaccccacauagguacacuggaaaacaugggccacagggauaaaccuuccauuuuuacuuccaaccuuaccaugugcucacaaaaaaagguguuaaauacauguaaguuuugacgagguuauuuaaaaguguaggauauaaaccaagaauuuuucacaccccaaaaccccgcacaaauuaagggauuacauaucugagugacaaguacauacaaacgcauuacuucuagagauacuuagauguagauaaaagaccacauuucaauagaaggaucacacagaccagugggauguuucuucugagauaacccacuuuaugcaggaaacaguguggacucuggggacggccucugcucuggcugaggauuucugucccagagcgguacaggaaucugcguaguguuuuaguuuggagaaaacaggaaguuacacucaucacaucuuuugcccagaugauagaauucgaaauccccccgggguuguucauggaaugagccgcucuguuauguugugagccgugguauuaaucagccaccccucacuagguguugggguuccaccacgcuuccuccaccccccgucaccacagcagcggguaguauuuagguugaauauuccaaauagucaauuaugacaguuaauuucaaaugagaugacuucgaaguacacgugaaaacaauacuauuuuauaucacgacucaugccauccguauguguaaucaaagccuucuaagucuugauauguccuuacaaagacgaaggauagagugaaugucaaaauuugccaaacaggaguuacugaaagucugaaggggaaagccuaguuagguuuuaucuuagaagugauuuuuaaaacgaaacacgcagauaagcucgagcuuucuggagccgauuccuaaggccuugcaggugguaagggggucgagaauuggcugagguuccucggaaguccgcgccgauucggagggccaccucugacuuucugaucuggggugcaacccccagucccugucccggucgacaaagguguggagucagguuccaggcaagcugggggugggggugcgcacaagggaggggcaggggacugggacccccucuucuucggggugcuucgggccguuucuccagaggcuggugguguccccgacccaagcagcucagccccgcucgcgagguccgaaguggcgggaacggguccuccgcggcggucccaaggcgagggaggcuguaaaaccuggcagagaauccggcgcgccgggucggggaugucucgggugccgggggcaggggccgcaggcucgcagguagaagcuuccccacgcgagcgggggccucggccgcggaaggggcgcccccggggccgccggcagcggcgagcgggcgggagggagcuuuccgggccccucccgcgccucgggcuggcggggcgauggcgacgacgguuucccggcucccccgccccggacgccgauggcggugcguuccggcccucccccaacagcuucucccccgcggucgccggagccggugaggccgagagggcggggagccgcgcagggaaggcgagagggcggagguugcguggugcaggcggcggcggcgggaggaggagggccgggcgggcaggggaggaggaggaggcgggcgccgugucgcacgcagcuccaggcggggcagccccgguagcugagggacgcagcuagaccuuggcgggacggggcuuucgccggggcccaggcccagggaccaggcggaggcgucgcgggagccuuuggggcaccacagagaugcgggugagugucggcagccgccggggccgagaggagguggcggcggcggcggcggcgcaggcccggccccgagccgcggugucgcagugacucgggccgcgacggccgaaaccaggcgccuggcgaggccugagccgccgaaacgcggccgggcagaauggcggccgggccgggggacucgugggcggaggacgccgaagguggcagaggagcgagcggggccgggcccugagucaccccggacgggccggggcggccaggccuggacuacgcacugggaaaaagcacgauucaucgcgccuggaggcggcggccugguggcgccggccccuuuccccgccgcgaccgggcuggguucucggagggugggccgacguguggcccggggcggcucgggcguccgcgccucgccuggugaggcgaccuccgcgggacgccgggacccgugcccuugcccccucgcgcccacgcuucuucccggcgcugcuuuccggccgacgcguguuccccugugagcucugggcucaagcgcaggagcagccgcggagccgggcucucucgcuuuccgguucccugcccgcggcucucggguuccccgccugcauuguugcgaacgugcagggcgcuauuauuggguaacagucgcccuuuugccccguucuccugggagagcgggccggggcaugcgcgcagggaugcuagcccggcggccgaaccggacagagccccccggcgcccgccuaucgcucgcuagucgggccgggcccugcgcugcggccucggcgcgcccccggucccaacgggagcgcgcgcccugacccugaggguagccgugcgcccgccaggccgcugggacuugggguccccagacucgggggucgucgcuuuuuuuucccuuaagaucugaaagacccccguuucugccacccgugcaguauuguguagcgcagacauaagauaagaaagagaggaaugcuuguagacauuccuugaaaugaauccccaaaguuaggguuuucucccuggcuggcuuugccaaaaagaggauucucuuuuccgauugggucacucuugguugcuucugguucguaguagggguuagugguaagugcgcaaauacugaauugcagucuacuuaaauauuuguuugcucuguguaauugcucuuuccuguaguagcauuaaaaucgucaaaaguucugaguggaguaaacgaucacacuuuuuggaaugcacuuaacgaagcggcagaagaggaacuagauuccuuuuuuacuucaagccaugagcuucuaggaccuaagcauagcuuaacgccucgcagaagugugugcaguuuuaaguuuaacacuucauuucauggugcacccgaaaauguacccgauuuucugaaauccuggagaguguauuacguaguaaaauauguaaugauguuuaaaauguaaaaccagucauucuguuugaaaaagauauuuggagaugagauuuuucuuuguuuaaagaagguuuguuuuuggauauugaaaaauguuuuacuugaagguucuauuuguuguuuuccauggugagucgaaauaguugcguuacauuucaaauuccaaagcaugcaaacacaagacuggcucgcuuuaacucuauuaaugcccauuuuuggagguuucaggagaguguuccuuaagcuugagagggauggcugaauugcuuucuaaauauguuaaacuuuuuuucucauuggcuucaucuuuuaaaaacgauuuugucaaaaaacaaaccaaauuuagauaugcuaggguuuuucaccaauuuauaaaagccucccucccugagagccacaugcucagguccuuauagccagccccaccccccacuccuaauguguguaccacaucagaagacagacacgcaugccugagcugauucugcaugguuuccuuagauauuacaguucauuagacucuugccacuuacugaauauuaucuucuagcuguaauuaacuacaugacagccuuauuucccauacauuuccgauugugaauuccuccagcgcaggagauauuccuuauuuguuuuugcguccccagaguaacagaacuugguugugguggugccucaguugcuuuuuuuuaaugaaugaguuuucuggaauaauucuaacuuaaacuuaacguuugaaaacaugcgcugauuuuuggcuacagaaaacacagucguugugcuuaagccgguuaagaauucaagcuuuauuauacacuucucgaguaaaauugaucgucucucucaucccuccuuuucuauucccccuucccucuucacuucccuucucccugaaacaccccaguaucuaguacagggcccuaacagaaaaaugcccagguuuucuauaccuauggaagucugggaaagugccaagaaaacagguugugaaacuuuaacuuuuuucccccuuaaaacuaguuuuaagguguggauguuuuuacuuuuuguguuugguguuuuuuuggaaacacgaucagguuuuuccccccagguugaguauccagccuugccuuugcaaugaagcaguuugguaguuaaggcuccuccuuguagaugaggcaagccccaugguucugcuggagugggauaggaaguugcuguaggaggaaccaucccuuggucucugagggccauucaucagaaugucauucccaguauacccaguggugucugucuuucagcauggaaaauuaaaaugaauguacuuuaaauugaggaguuguuacuugccauucuucaaauuaaaaauauuagggccuuaaaaacuuaggaacuugguuuuuuguuuguuuugcuguuucagccuuccguagguccuaaagccagugaccuugagucauucuggaauaaaaugucuuugggggacugucagcuucauuuugaacuugucuuuuagguaugucuggagaaaagaguguuaaccauuuuaagggccaauucuaagguugccuugcuuuuuaaaaacauuugguaguuuaucaguguguuuguuuugcuuccaaaugaagaaaugagcauuaaaugaaaaauagauccuauuuggauaaaagccuuauguuuacuacugaggacauaauuuccuguuuauaggagguuuccuguuuauaauaugaagauuuaguaaacacacuauaaacagaauuauuauaacauuuaaugacuuaaguuuuuuauucacucauggagguguuucauuucuaaaaauuccgugagggagagagauugaagucauuuauuuuugcuuagguauagaacaucuugcuugggagagaagacauggagucuaguucaagcuuaccuuugcagggcauauauuuccucguuuuuaaaaugagaugguuuuuaauugacacuguugauuuccuuaggccccgaaaguauguggauuccaugggaaugccacagcuuuuaacauuaacaggauuuuggaaaaacggucuuaaagaacauuaaguauuguauucauguuuaaaaagcaggguugugaagccuaaguuugauaguuaaauuuuuucccuugggaaacuuggaccaaguaagcacuggucugccuuuccuaguguugacuccaugcuucagcgcuauugcaguuccauucuggaucugacucuuugccuuuucuaucaccugacggcucacacaucaccaucucuggaaagcuggcccugauguccuggucuggguuaggagccuucucuggguucccauguuguccugccuaugucacuaucacaguauuuaaccuuuugauuguaguuggugguuucucccaccaaacugaccuccuuugggacagggacacugugauaugcaucuguccccagugccuagcauacugcaugcaucaacauucacauacauccuuccacuggaaaucuuuacagugcccucugaaguguggguacuaugguuuaacccacuuuacagaauauaggugaaggagcugagacuuugaguggugcagguaagggcuaggaagguagucaagcccgaguuaaacgggacaggauaacuccggagcucaggcuuuuaaccagauguucccugaguguuugacuaguuuaugugaagauggaagaagacuagaagagauuaaaaugaaaaugcuuuaaggacugauaucugaucauuauggcagaauucauuaugcagaacugugauccacuaccaagaaugagcuuauucuuccuggucuuuuaguaacauugugggagaguaauugggcacugauagcauagacacgaacaguucuggaacuuuggggcuauuguuaaauugggugugauguuaugacucauuggccuugcaaaaauuuauaaaaccauucaagacuguucaaauauaacaagcugcaauuuuuuuaaaggucuguguuagaaaauacuucggaaaauagauuguaugaaaugggugcagccauuuaaaauauguauaaaguguguauguacuagugaagguuuuuuuguuuuuuguuuuuuguuuuuuuugagacagagucucacucugucgcccccacuggagugcaguggcgugaucucggcucacugcaaccuccgccuccuggguucaagcgcuucuccugccucagccucccgaguagcugggauuacggugccugccacuacacccagcuaauuuuuuguauuuuuaguagggacgggguuucaccauguuggccaggcuggucucaaacuccugaccucgugauucaccugccuuagccugccaaagugcugggauuacaggcgugagccacugcgcccggccgugaggauauuuaaaguaguaaaaauggcugucauuuuagggggguaagcuugggugcuuuuaaaauauuuuuucaagaaaaaauuuaagaaccaaaaaguaacagcauggcgaucucaagauggagaagaccuagauauaacaccaagcacgggaacuguaaaggaaaagauuugaguacuuuagaauaauaaaacuucucuguguuaaaauuccauaaacagaauuaaaaggugacuggcaaacagaaaaauauuguaacuuacaagcaaauuuacuuuccuuacuguaaaaagagggcaugugaacaccaccaacaaaagcggcccccccccacccccguggaaaaaaaugggcaaacugguaauuuauaaaaagaggagcaggaaacaugaaaaaacuuucagcuuuacuagcaguacucccagaaaugcaaaucagugagauacuguuguuguuuuuuuaauuggcguagauuaaaaaaugaacuacuuauggugaagguauggagaaaugagcucacucauaccuugcuagaaagaguguaauuuaauaugauuuuuugagagcaaaguacguaacaaaagcuuguaaaauauguaugugcuuugaaauagcuauuccauuucuaagaauuuagucuaagaaaauacaaaaaaaaugacuacuagauuaauauucuguccagggugugcuguuauuuaacuaauacccucuuaagcauuuguuuucguuuuuuugcuguuguuaaggaugauuauuucagcauuuagaucaaucuuuaacuuccauaauacuguauuuaaugaacauuuaguuaguauuaaugauaaaaugcaacauaaaacaacauauguaaguaauagcuaaacuuuauuuuggugugugaguauaugcauuuuuuaaaaagaugaaaaccagaauguuagcauugauugucucugagcaguggaguuauuuuuaguuucucuuagcaguagguuauuauuuuuuuuuuccuccaacuuucuacagugcacauauauuuauaguacaguggauuaauuuauaaaaucaagaaaucccaaaacaggagaagcaggggagcuacuugcaaggaagacauuucugcuuaguuuaaugcugaaaucacuuaguguuugccguacuggcagccccuuuccagguguguugaugcacaggguuaaauaucugacuuccguugggcuguauuuccagcggucagguucuccuuugcuggacuaaucuucuucucauuuauuuccccauaucuuaauccuucagauacuuuaguccccucauuuaaugcccuccaugaaacuguccuaaucucaugaaacugauugauguuuugaugguuuauuguaacacuagauuagguacuaaugaauugucuucaguguggaaguuucuuuuuuuuaguaauagugugaacuuuuuuugcuuaguucacaacuccuagugauaguagauguguuuuaaauuaaucuuuaaacuuaaugucauuaugcuuaagauaagaauuugcuaaaaauuagaaaaaguauuuuggucuaguuucugcaguagcuuggaaaauucagaggcuaccaucaauuauuuaagaaguguaugcuaaauaguacaaaugaggaauacuguuguaauuaugagaaaaccguugcacagaaacgugucaccuaaugcugggagggggcaccuuugcuaugucgaaauuaauuaaaugcuaacuaaaauaguuacgugugccuaauaggcauccgaaagucagaacgggggaaaaaggcugacagcucagaccuccuuuucucaaggcaggaaggaggcuuuggugagacuggaaggaaagguuuggaauccuagaugaugucaauaaaccagacucuuugaucccaaguggaauucagggaauagacaugaagacuaggccauuucccccuccccaaacuucaagcuuaucuauaggaacuuggagacuuuggugugggggaugguggagaagaaaaauuccagacugauucuucugacuucucucauuuuaaauacguaaaaucuuuaaaacguuugcuugccauuuuaucuuacaugcaauaauaacccuuagucuagguugagcaucccuaauuugaaaauccuaaauccuccagaaucuaaaacuuccuuaguuaccaacacgaugugacaaguggaucauuucaccccgaccucaugugaugggccacggucaacaugcaggugcacaacaguuuauucaguguccccaaggggaaaguaaaauuaccuucaggcuguguguauaaggucuauaugaaacaugugaauuccccguuuagauuuggaucccauccgcaagauaccucaaauauuccaaaauaugaaacagucugaaauucaaaagacuucuggacccaagcauuucagauaaaggauacucaauuuguguucagugcuugguaugagccaaagacugugccgagcuugcuuugugacucccuagcugcuugcccucagcuuucugcugcuuggagauaccucaaaugggacagaaggcuguc

SEQ ID NO: 14620 - RNA, 11253 nt, Homo sapiens
gacagccuucugucccauuugagguaucuccaagcagcagaaagcugagggcaagcagcuagggagucacaaagcaagcucggcacagucuuuggcucauaccaagcacugaacacaaauugaguauccuuuaucugaaaugcuuggguccagaagucuuuugaauuucagacuguuucauauuuuggaauauuugagguaucuugcggaugggauccaaaucuaaacggggaauucacauguuucauauagaccuuauacacacagccugaagguaauuuuacuuuccccuuggggacacugaauaaacuguugugcaccugcauguugaccguggcccaucacaugaggucggggugaaaugauccacuugucacaucguguugguaacuaaggaaguuuuagauucuggaggauuuaggauuuucaaauuagggaugcucaaccuagacuaaggguuauuauugcauguaagauaaaauggcaagcaaacguuuuaaagauuuuacguauuuaaaaugagagaagucagaagaaucagucuggaauuuuucuucuccaccaucccccacaccaaagucuccaaguuccuauagauaagcuugaaguuuggggagggggaaauggccuagucuucaugucuauucccugaauuccacuugggaucaaagagucugguuuauugacaucaucuaggauuccaaaccuuuccuuccagucucaccaaagccuccuuccugccuugagaaaaggaggucugagcugucagccuuuuucccccguucugacuuucggaugccuauuaggcacacguaacuauuuuaguuagcauuuaauuaauuucgacauagcaaaggugcccccucccagcauuaggugacacguuucugugcaacgguuuucucauaauuacaacaguauuccucauuuguacuauuuagcauacacuucuuaaauaauugaugguagccucugaauuuuccaagcuacugcagaaacuagaccaaaauacuuuuucuaauuuuuagcaaauucuuaucuuaagcauaaugacauuaaguuuaaagauuaauuuaaaacacaucuacuaucacuaggaguugugaacuaagcaaaaaaaguucacacuauuacuaaaaaaaagaaacuuccacacugaagacaauucauuaguaccuaaucuaguguuacaauaaaccaucaaaacaucaaucaguuucaugagauuaggacaguuucauggagggcauuaaaugaggggacuaaaguaucugaaggauuaagauauggggaaauaaaugagaagaagauuaguccagcaaaggagaaccugaccgcuggaaauacagcccaacggaagucagauauuuaacccugugcaucaacacaccuggaaaggggcugccaguacggcaaacacuaagugauuucagcauuaaacuaagcagaaaugucuuccuugcaaguagcuccccugcuucuccuguuuugggauuucuugauuuuauaaauuaauccacuguacuauaaauauaugugcacuguagaaaguuggaggaaaaaaaaaauaauaaccuacugcuaagagaaacuaaaaauaacuccacugcucagagacaaucaaugcuaacauucugguuuucaucuuuuuaaaaaaugcauauacucacacaccaaaauaaaguuuagcuauuacuuacauauguuguuuuauguugcauuuuaucauuaauacuaacuaaauguucauuaaauacaguauuauggaaguuaaagauugaucuaaaugcugaaauaaucauccuuaacaacagcaaaaaaacgaaaacaaaugcuuaagaggguauuaguuaaauaacagcacacccuggacagaauauuaaucuaguagucauuuuuuuuguauuuucuuagacuaaauucuuagaaauggaauagcuauuucaaagcacauacauauuuuacaagcuuuuguuacguacuuugcucucaaaaaaucauauuaaauuacacucuuucuagcaagguaugagugagcucauuucuccauaccuucaccauaaguaguucauuuuuuaaucuacgccaauuaaaaaaacaacaacaguaucucacugauuugcauuucugggaguacugcuaguaaagcugaaaguuuuuucauguuuccugcuccucuuuuuauaaauuaccaguuugcccauuuuuuuccacgggggugggggggggccgcuuuuguuggugguguucacaugcccucuuuuuacaguaaggaaaguaaauuugcuuguaaguuacaauauuuuucuguuugccagucaccuuuuaauucuguuuauggaauuuuaacacagagaaguuuuauuauucuaaaguacucaaaucuuuuccuuuacaguucccgugcuugguguuauaucuaggucuucuccaucuugagaucgccaugcuguuacuuuuugguucuuaaauuuuuucuugaaaaaauauuuuaaaagcacccaagcuuaccccccuaaaaugacagccauuuuuacuacuuuaaauauccucacggccgggcgcaguggcucacgccuguaaucccagcacuuuggcaggcuaaggcaggugaaucacgaggucaggaguuugagaccagccuggccaacauggugaaaccccgucccuacuaaaaauacaaaaaauuagcuggguguaguggcaggcaccguaaucccagcuacucgggaggcugaggcaggagaagcgcuugaacccaggaggcggagguugcagugagccgagaucacgccacugcacuccagugggggcgacagagugagacucugucucaaaaaaaacaaaaaacaaaaaacaaaaaaaccuucacuaguacauacacacuuuauacauauuuuaaauggcugcacccauuucauacaaucuauuuuccgaaguauuuucuaacacagaccuuuaaaaaaauugcagcuuguuauauuugaacagucuugaaugguuuuauaaauuuuugcaaggccaaugagucauaacaucacacccaauuuaacaauagccccaaaguuccagaacuguucgugucuaugcuaucagugcccaauuacucucccacaauguuacuaaaagaccaggaagaauaagcucauucuugguaguggaucacaguucugcauaaugaauucugccauaaugaucagauaucaguccuuaaagcauuuucauuuuaaucucuucuagucuucuuccaucuucacauaaacuagucaaacacucagggaacaucugguuaaaagccugagcuccggaguuauccugucccguuuaacucgggcuugacuaccuuccuagcccuuaccugcaccacucaaagucucagcuccuucaccuauauucuguaaaguggguuaaaccauaguacccacacuucagagggcacuguaaagauuuccaguggaaggauguaugugaauguugaugcaugcaguaugcuaggcacuggggacagaugcauaucacagugucccugucccaaaggaggucaguuuggugggagaaaccaccaacuacaaucaaaagguuaaauacugugauagugacauaggcaggacaacaugggaacccagagaaggcuccuaacccagaccaggacaucagggccagcuuuccagagauggugaugugugagccgucaggugauagaaaaggcaaagagucagauccagaauggaacugcaauagcgcugaagcauggagucaacacuaggaaaggcagaccagugcuuacuugguccaaguuucccaagggaaaaaauuuaacuaucaaacuuaggcuucacaacccugcuuuuuaaacaugaauacaauacuuaauguucuuuaagaccguuuuuccaaaauccuguuaauguuaaaagcuguggcauucccauggaauccacauacuuucggggccuaaggaaaucaacagugucaauuaaaaaccaucucauuuuaaaaacgaggaaauauaugcccugcaaagguaagcuugaacuagacuccaugucuucucucccaagcaagauguucuauaccuaagcaaaaauaaaugacuucaaucucucucccucacggaauuuuuagaaaugaaacaccuccaugagugaauaaaaaacuuaagucauuaaauguuauaauaauucuguuuauaguguguuuacuaaaucuucauauuauaaacaggaaaccuccuauaaacaggaaauuauguccucaguaguaaacauaaggcuuuuauccaaauaggaucuauuuuucauuuaaugcucauuucuucauuuggaagcaaaacaaacacacugauaaacuaccaaauguuuuuaaaaagcaaggcaaccuuagaauuggcccuuaaaaugguuaacacucuuuucuccagacauaccuaaaagacaaguucaaaaugaagcugacagucccccaaagacauuuuauuccagaaugacucaaggucacuggcuuuaggaccuacggaaggcugaaacagcaaaacaaacaaaaaaccaaguuccuaaguuuuuaaggcccuaauauuuuuaauuugaagaauggcaaguaacaacuccucaauuuaaaguacauucauuuuaauuuuccaugcugaaagacagacaccacuggguauacugggaaugacauucugaugaauggcccucagagaccaagggaugguuccuccuacagcaacuuccuaucccacuccagcagaaccauggggcuugccucaucuacaaggaggagccuuaacuaccaaacugcuucauugcaaaggcaaggcuggauacucaaccuggggggaaaaaccugaucguguuuccaaaaaaacaccaaacacaaaaaguaaaaacauccacaccuuaaaacuaguuuuaagggggaaaaaaguuaaaguuucacaaccuguuuucuuggcacuuucccagacuuccauagguauagaaaaccugggcauuuuucuguuagggcccuguacuagauacugggguguuucagggagaagggaagugaagagggaagggggaauagaaaaggagggaugagagagacgaucaauuuuacucgagaaguguauaauaaagcuugaauucuuaaccggcuuaagcacaacgacuguguuuucuguagccaaaaaucagcgcauguuuucaaacguuaaguuuaaguuagaauuauuccagaaaacucauucauuaaaaaaaagcaacugaggcaccaccacaaccaaguucuguuacucuggggacgcaaaaacaaauaaggaauaucuccugcgcuggaggaauucacaaucggaaauguaugggaaauaaggcugucauguaguuaauuacagcuagaagauaauauucaguaaguggcaagagucuaaugaacuguaauaucuaaggaaaccaugcagaaucagcucaggcaugcgugucugucuucugaugugguacacacauuaggagugggggguggggcuggcuauaaggaccugagcauguggcucucagggagggaggcuuuuauaaauuggugaaaaacccuagcauaucuaaauuugguuuguuuuuugacaaaaucguuuuuaaaagaugaagccaaugagaaaaaaaguuuaacauauuuagaaagcaauucagccaucccucucaagcuuaaggaacacucuccugaaaccuccaaaaaugggcauuaauagaguuaaagcgagccagucuuguguuugcaugcuuuggaauuugaaauguaacgcaacuauuucgacucaccauggaaaacaacaaauagaaccuucaaguaaaacauuuuucaauauccaaaaacaaaccuucuuuaaacaaagaaaaaucucaucuccaaauaucuuuuucaaacagaaugacugguuuuacauuuuaaacaucauuacauauuuuacuacguaauacacucuccaggauuucagaaaaucggguacauuuucgggugcaccaugaaaugaaguguuaaacuuaaaacugcacacacuucugcgaggcguuaagcuaugcuuagguccuagaagcucauggcuugaaguaaaaaaggaaucuaguuccucuucugccgcuucguuaagugcauuccaaaaagugugaucguuuacuccacucagaacuuuugacgauuuuaaugcuacuacaggaaagagcaauuacacagagcaaacaaauauuuaaguagacugcaauucaguauuugcgcacuuaccacuaaccccuacuacgaaccagaagcaaccaagagugacccaaucggaaaagagaauccucuuuuuggcaaagccagccagggagaaaacccuaacuuuggggauucauuucaaggaaugucuacaagcauuccucucuuucuuaucuuaugucugcgcuacacaauacugcacggguggcagaaacgggggucuuucagaucuuaagggaaaaaaaagcgacgacccccgagucuggggaccccaagucccagcggccuggcgggcgcacggcuacccucagggucagggcgcgcgcucccguugggaccgggggcgcgccgaggccgcagcgcagggcccggcccgacuagcgagcgauaggcgggcgccggggggcucuguccgguucggccgccgggcuagcaucccugcgcgcaugccccggcccgcucucccaggagaacggggcaaaagggcgacuguuacccaauaauagcgcccugcacguucgcaacaaugcaggcggggaacccgagagccgcgggcagggaaccggaaagcgagagagcccggcuccgcggcugcuccugcgcuugagcccagagcucacaggggaacacgcgucggccggaaagcagcgccgggaagaagcgugggcgcgagggggcaagggcacgggucccggcgucccgcggaggucgccucaccaggcgaggcgcggacgcccgagccgccccgggccacacgucggcccacccuccgagaacccagcccggucgcggcggggaaaggggccggcgccaccaggccgccgccuccaggcgcgaugaaucgugcuuuuucccagugcguaguccaggccuggccgccccggcccguccggggugacucagggcccggccccgcucgcuccucugccaccuucggcguccuccgcccacgagucccccggcccggccgccauucugcccggccgcguuucggcggcucaggccucgccaggcgccugguuucggccgucgcggcccgagucacugcgacaccgcggcucggggccgggccugcgccgccgccgccgccgccaccuccucucggccccggcggcugccgacacucacccgcaucucuguggugccccaaaggcucccgcgacgccuccgccuggucccugggccugggccccggcgaaagccccgucccgccaaggucuagcugcgucccucagcuaccggggcugccccgccuggagcugcgugcgacacggcgcccgccuccuccuccuccccugcccgcccggcccuccuccucccgccgccgccgccugcaccacgcaaccuccgcccucucgccuucccugcgcggcuccccgcccucucggccucaccggcuccggcgaccgcgggggagaagcuguugggggagggccggaacgcaccgccaucggcguccggggcgggggagccgggaaaccgucgucgccaucgccccgccagcccgaggcgcgggaggggcccggaaagcucccucccgcccgcucgccgcugccggcggccccgggggcgccccuuccgcggccgaggcccccgcucgcguggggaagcuucuaccugcgagccugcggccccugcccccggcacccgagacauccccgacccggcgcgccggauucucugccagguuuuacagccucccucgccuugggaccgccgcggaggacccguucccgccacuucggaccucgcgagcggggcugagcugcuugggucggggacaccaccagccucuggagaaacggcccgaagcaccccgaagaagagggggucccaguccccugccccucccuugugcgcacccccacccccagcuugccuggaaccugacuccacaccuuugucgaccgggacagggacuggggguugcaccccagaucagaaagucagagguggcccuccgaaucggcgcggacuuccgaggaaccucagccaauucucgacccccuuaccaccugcaaggccuuaggaaucggcuccagaaagcucgagcuuaucugcguguuucguuuuaaaaaucacuucuaagauaaaaccuaacuaggcuuuccccuucagacuuucaguaacuccuguuuggcaaauuuugacauucacucuauccuucgucuuuguaaggacauaucaagacuuagaaggcuuugauuacacauacggauggcaugagucgugauauaaaauaguauuguuuucacguguacuucgaagucaucucauuugaaauuaacugucauaauugacuauuuggaauauucaaccuaaauacuacccgcugcuguggugacgggggguggaggaagcgugguggaaccccaacaccuagugagggguggcugauuaauaccacggcucacaacauaacagagcggcucauuccaugaacaaccccggggggauuucgaauucuaucaucugggcaaaagaugugaugaguguaacuuccuguuuucuccaaacuaaaacacuacgcagauuccuguaccgcucugggacagaaauccucagccagagcagaggccguccccagaguccacacuguuuccugcauaaaguggguuaucucagaagaaacaucccacuggucugugugauccuucuauugaaauguggucuuuuaucuacaucuaaguaucucuagaaguaaugcguuuguauguacuugucacucagauauguaaucccuuaauuugugcgggguuuuggggugugaaaaauucuugguuuauauccuacacuuuuaaauaaccucgucaaaacuuacauguauuuaacaccuuuuuuugugagcacaugguaagguuggaaguaaaaauggaagguuuaucccuguggcccauguuuuccaguguaccuaugugggguuuuaaaaaaaugucccaauuucuuccuuuuacuggagacugcguuuuuuagacaacagcuuaucuuccuauucccuaaccagucuucuccaaucuuaccauucaauauagccuccuuuucugugacuuccuccagcugaauagaagggcugagugggucaaccuucccuguauuguuuguuuccuccacccucucuuuuuccuuaauagcaguauuugguccacccacaccacccucucucuucucacugccuccauuccugguucuuaacuccuuucuauucuuuacucuccaccugccuacacgaucauucuuagcagcaaauuuauuccaucgacuuuuacguccacuuaacauccagauugcauuuacuuugcgcagauaaccuugccgccuaccucacaagucaaggccaccugcugcucucuuucuacuuuaaaacauccuuccuccaucuuuaccccccaacucagcaaaauugaugucucucucggaugacccaaaguuuggagggauaauuaauuugauagaugucagaaucaaaguucaaaacagucucaacaggcuacaacauuaggccaaaagcaaugaaauaaaauauaacuuucaaaucuaaauaugauguacuagcuggaaaagcccaaguuuuagauuuuagaccuugguuuguaucuaguuacccaaauuugagucauauccaguaacucaaauuacuaucuuuugcucuaguaaggucaacuguuaauuugagauaaaaauaccuacuucauaagagugugaagaguaauuuauuuauaauucccacguaauucguggaacauucaccaaccauuaguuccccucccuuccucaucguccacaaagugguugucucuguugccauucauaacacauucuuuaauucauacagaccuggaaacagacucaaaauccuggcccguucaccuuguaucccagagcugucaccaucguagagaaaucguuugccucuuuugggucagucauuaucaucaucauacccauuuuuucaaugaaaaaaccuaaggcucagagauguuaggcaauuugcuccaaaucacucagccugaucaguggcauaaccugacccagugacucaugauucuguguauauccacuccuuuacuaagauauucucccacacuuauguugguccuuuagccuucuaaaugcuuuuccugguucuuaucucuuuauccuuccacuuguguccugacugauggcagauuauuccuucuaaacugauaccuucaucauuauaauuuuguccuuucaagcuucagugguuccauauuguuuauaguguucaauccaaauuuggaccuggcacuuaagguuuaccagaucuuguccaaacuugcauuuccaaauuuauuuccugccacuucccagaaggaacucucaaugccauccgguccuguugguuguacucacuggcccacagaugagcugugagucgccauuuaugagggccuccuucaguuguucccuuaacagauaccauuucccacuucuuuccuccaucuccaaaucaugcucacuuuucaagauccagcucacacccccucccaggaagcccaccuuacaccuucuacccaagcuuugugaucucucccugauugccuguucacaugugccuuuaaacuagguggucugugcuguggggugagagacaauuuccuaagguucaccugcccccucagcacugugcccaaagaacacugaagcagauuccaagcaaauuugcuuacuacugaaaugaaaggguacagguguuacuugauuaaccauaugaacuguuauuucuaagacacagguaaguaacuagccauccagcgcaaagugaauuagcaggaugguucucaaaccuggcuuugcuucagaaucagcuggggacuuuacuaauuccgagggcccuguuccagaucuacugaaucaaaaguaggugggaagcagccgggagggaacaugaaacugccagaguuuauauccuggcaucguugcuuauuaucuggggaacuuugagcaaguuacuuaaccucucugugccucaguuucuucgucuaugacauagggaugauaaua

SEQ ID NO: 14621 - RNA, 3158 nt, Homo sapiens
cgugcgcgcgcgggcggcggcgggguucgcuguaagggacgccacuggccguguggaagcgccgccgccgucucuuuguucuuucgcugaacacacggcgccucucaggaaggcggugugcaggcacgcggggaccgggagacaucgcgggggcccggagcccgccgcggacgggaggcggggaggauagguggcgggaaccggccgaagggcgggacgaagcgccggcggcucuuggcgggaaccggcgccgcagaguucccgggcgggggaggggcggggcgggugcuggaagccaaguuugaaccaguucaaaacucgggggugguaacgguuuuaaccgccgcgcucguuuccccgcgcgcggagccgaggcccgggcuggccgcuccuaguggugcccggggaggggagggcgcgggccccggaggucggcucagcuguggcgccgcguuugccgggagacgcucgcccggcccgcgcgcugccgccggacccguuacuacuuuuuuuuuuuucuccugagacggaguuucgcucugguuguccaggcuggagugcaauggcgcgaucucgacucaccgcaaccuccgccuuccggguucaagcgauucucaugccucagccucccgaguagcuggauuacaggcaugcgccaccacgcccggcuaauuuucuauuuuuaguagagacgggucuuggucaggcuggucucgaacucccgacuucuggugauccgcccgccucggccucccaaagugcugggauuacaggcgugagccaccgccgccgacccgggcccuguuugauuaugucugcugcugccuuggccguuuuuucccccaccgcuggacuuuggcuggccgagcuugcagugcuuaucgcccuagaaaccugugaaagggcgacauugcugccauuucagacccuuccacuguucguaguucuaagcacgugucaguguuaaaaauccuuuaucaagaugagcacuguucacuugccgccucugcaaagugugaggauauuugcaaggcgcgguggcucacgccuguaaucccagcacuuugggaggccgaggcgggcggaucauaaggucaggagaucgagaccauccuggcuaauaacggugaaaccccgucucuacuaaaaauacaaaaaauuagccgggcgugguggcgggcgccuguagucccagcuacucgggaggcugaggcaggagaauggcgugaacccgggaggcggagcuugcagugagccgagaucacgccacugcacuccagccugggcgacagagcgagacuccaucucaaaaaaaaaaaaaaaauugaucuugguuauggggggucaagcuaccucaacccagaggaauuagagggauucugcuuaggauacagucucuccuauugcuucauguggcaaugcaguuaagaguauuccgaauuuauuuuuacuaggauguaucuaugggguaaaauaccauugucauguaaacugagauuccauauugagaguucauacuggaaacugaaaaaaggucaccuaugaacuguugggguaaaaaucugaagaaauauuuuuaaugaauuuaauaacuagccagaauuuuuuuuuuuuuuuuuuuuuuaagaaacggagucucacacugucgcccaggcuggagugcaguggcaccaucucagcucacugcaagccccgccucccggguucacaccauucuccugccucagccucccgaguagcuggggaccacaggugccugccaccacacccgacuaauuuuuuguguuuuuaguagagacgggguuucaccguguuagccaggauggucucgaucuccugacuuugugauccgcccgucucggccucccaaagugcugggauuacaggcgugagccacugcgcugggccagaauuuuucaucagaugauuuagcccauaauuuucccgccuuuccuaaaucaccaucccauuccucacauauauucugaaucacuccaauguuggaaaguauauauaaagggaagcuaaaagauaaggagaaacaagcaaucaugugcccagauaaaagcaaaauugucuugugaaucagugauaacacugcaaaaaguaaauagguuaugcagcugagaugugacuguaaaauaacguaacgaauuauagcugccauuacuuccagucacgaauacauucauucuccaagauaaaaugcaucugucuaggccaccaauuuacaauuuuuuaaaaccagcaauuuaaaccucagaaauuaacuacuuaucccuaaguugcuuaucaaauuacugaacuuaucaguccuguaauacuaaauauuaaaacaaggcauuuuuaagaggaagaucaacgaaauuagagacuaccauaaagcaaaucaaagcaguauauaacucugcaacauggugugaaaugucauguaaauugcuagacguuuagaaucaaggaauggauggaucaagauauuccaggccagacuuagugguucacaccuguaaccccaguacuuucagaagucgaggugggaagcuccgagaccagccugggcaacauagcaagacccuaucucuacaagaaauuuaaaaaauaacugagugugguggcacagaaguaccuauggucccaccugccccugaggcugaggugaggggucugcuugagcucaggaucccaagguuaccgugagcuaugaucacaucacugugcuccagccugagcaacagagugagacccuaucucuuuaaaaaaaaaaaaaagugauuggacaaaauauaauuauuggcaccaagugaauguuaggaaaaaaaaaaaacacguacaaagaacuuuauagagcagccauucccacugggaagaguguguagguuggacucuaaccauuaaagagcuaggugggaugauacuaaauauauauaacagacauuuaauauaaauaugauaugaaggcuaaggugaaaagggaugccaguggaucacaguauuuucuugauucaaugaugacauuguccauuuaagcaagguaguuuaggccacaguaauggcagaaaaaggggauaauuugaaaauauuccagaaggacuucauuguaugugggguucaugaugucucgcgacuccuuuccguauaugacaaauacagcaaaguua

SEQ ID NO: 14622 - RNA, 1193 nt, Homo sapiens
gguucgcagccacgcgggcuccgggcaauugcgcuuuagucuggguggacagcuucgccggagcugagagcccgcgaccugccggaccagggcugggccgcgggucaaugauccaggaaaucccgucacucgcgugccuguggcugaagcgcggcagcuugucuuguccguuucgugucaguuucagggcugaguggcagcgucuggacuuugcggacgccgagggcucagaugcugggcucuggggagggagagggcgccggccggccugucccucuccggggauuugcagguaccaccugucggcuuuguuucaucaucaggagccccuuugcccagaaaucccgaucgucuacacccaggucucuacugaucagagauugagagugagucaacaggaguccaacacgugacccccauaagucuacccucuuuucccccaauacuuguagauaccacccaguaacacccgugugugcuaaaaauccuauucugggaguucuucggcaguuuaaaucgcccaugaauuacucauauuuucucaauccaccgugagccuggcacauuucuuuucaguaauugauugggaaagugcaagccauuggugaccuuuagaaguuuuaaauguuuauaacgaaagggcuaaggacagaggagauuacccacacuuaaguauuuugcaccuuaaaaaugcuagcaaaaauaugaauuuauauuccuucagggagaagauuucgucugaggacguaggccgaaccuuguguuuuauaugucauaugaauuacgcucugaaacuaaaauaugaaauagauuccauaauuaagcccuuuggaauaucagccucaucugaauuauuucuaaggauauuuuugccuuuuuugguuuauuaaaaacuuccuuuuggggaaacuuguauagauuuucugcacuuaggcaaaauaaagcauuuuauucaaaauauuucuuaggguuuuccuagaacuuacucuucuuucuuccuguaaagacaaaccuaggaaauuguucagaaaaaggcccaaggugauuuccucauaaccuauagugauuagugagaaaaaguuuggauauuggggauuucgggguugauuugauaauuucaggaaaaugaagaaaaccucaaauuuaagauauuaaaauguuuaaaaauuguccuagagaaaacgaugguacua

SEQ ID NO: 14623 - RNA, 494 nt, Homo sapiens
cucuuucugccaacuuggagccuguggaggccugcugggaacaggaauacuaaaaggaaguaugucuggaaggcugugguccaaggccauuuuugcugaguauaaguggggucuccagaaccaaagacagcacacagcucuuuuuaaaauagaaggugcuuaugcccaaaaugaaacagaauucuauucgggcauaagaugugcuuauauauacaaaacaaagaacaacaaagugacuccugguggcaaaccaaacaaaaucagaguaaucuagggaaagguaacucggucccagggaaauaguggcaugguucacgccaaauucugaagcaaucuuccugcuaaggccacuggacacagaaucugugugaugcuguaccccucaagcauuuaaauuaaugaaaaguaaauaaauaaaaguggauuugugcucuuggaaaaaaaaguaaaaaaaaaauuuaaaugacagaaacaguucugaagaaaaagacaga

SEQ ID NO: 14624 - RNA, 2118 nt, Homo sapiens
caggucacuggagaaugauggcgucuguuucaccgagcaggaaugggagaaucuggaggauuggcagaaggagcucuacagaaacgugauggagaguaacuaugagacacuggucucucugagugaguagcaguuuucucccuagaauucugucucagacauacuacaauuccuggcuggcagccuguaauucagaccacaccuguggcuccuguggcuguggguccucugucggccugcacgggcagagaaaugccagucucuagguccucccauuuacagaccugcacggguggagaaaugccagucucuagguccucccauuuacagagacuuuuggaaagcucgcagcauugugccuuuuguguuuuuuuuuuuuuuuuccuguggucacauagucuguucuugauaguauuuucuaauaaauaaaaugucauauacccuauagugugauauggcuaggguuccucauguuguuuuuuaauuuauuuuaucuuuuuuuuuucuuuuuuucuuugagacagagucuugcucuauugcccaggcuggagugcaguggcacaaucuuggcucacugcaaccucugccucacagguucaagcgauucuccugccucagccucucgaguagcugaaauuacaggugacugccaccacgcccagcuaauuuuuguauuuuuaguagaaaugggguuucaccauguuggccaagcuggucuugaacuccugaccucgugaucugcccaccucagccccccaaagugcuaggauuacaggugugagccacugcgucuggccuguuuuaucuuuuuuuuuuuuuuuuuuuuuuuugagacucugucaccuaggcuggagugcagugguacgaucucggcucacugcagccuugacagcuugggcucaaaugauucucccaccucaguuuuccgaguagcugggauuacaggcacaugccacugcgccuggcuaauuuuuuaaauuuuuuguagagacgugggucuuacuguguugcccaggcuggucuugaacuucugggcucaagugauccacccacgucggccucccaaagugcagggauuacaggcgugagccuccgcaccuggccucucaugcuguuuuuaauauuuaagacuauuugagaugggugugguagcucacaucuguaaucccaacacuuugggaggccaaggugggaggauagcuugaggcuaggaguucgaaaucagccuggucgacauagugagaucucuguugcuuaaaaaaaaaaaaaaaaaaaaaagaugauuugauaacccuauguuaccuuggaugaggcaggcagcacaggcugaucaaaagcauuuucuugguguuuggccggaauuauagcuggucauuguggucucagugauuuuuucuuguugauuaggagugcugcuuaauagauauaagucuuuauaugcaaaauguuaccuauuacauaauaaauguguuuuguuugguagacaaagucuuuuaaaaccuagguacauggaggagugucaagugccuggagcagaguaggagguaaaggaaauagaaaaugggccagaaaagugaccuuguaagcuugguugggucacaugcucucauugugacuguuuccuugucugucccagugcccaucuuaccuugcagugccuuagcaaggaugaaauuagauccccugaaaggaagcauuggcaagacuuaagcugcacgcacauggagaggcagaggugggugguggugccaucaagggcagugguagcucuguagccugccugccugagccacagccccucuaauggaggagcacuggaggcagcagcuagccaagucaguuguuaugauuggccagaauuuuauaauugucccaaacugcuaggggaaacugacaagaacaguagccuuugaaucuauauuuccucccugccauuggucaucuuggucacuggcagcugaucagugugcagugagcuuucacucucuccugggcucacacugugcuguuucccacccagagguccuuggccagacagagggagaagcggaguuggguacagagaugcugggugacuuggaagaggaagguccugguggugcccacccaggugagugg

SEQ ID NO: 14625 - RNA, 34953 nt, Homo sapiens
agcucuuuuuuaaagggccagcggggcacguggcucgggacgcaguucgcugccgcccggcaguagcucucagguuaggcgggucccgcuccgcuuccgccgucgcugccgcgccgccccgggcccgacaggccggguccagggacugcaacccagcgagggacgcgggcagccauggccgaagcggcgccugcccggguaagcgcccucggccccgcggacgcccggaaggcccaggccgccgccgcgugagcccgcgcgagggacucuggccgcgcgaggccgcggggugagagggccuugcgcgcagccuccgcgcucguugcccccggcccaucgcccagcccgcgucgaaggcauugaccgggcggcccaaaugccaggcccggcgggcggggccccgacgucagcggcugacgauccggcccaucugcggccucagccaggccgggccccagagucacgcucggcgacgaggaggccgcgccuuaggaguauugucccauuugaggccucgcggcccccccuacagcaggcugggcgggcaggggccgccagccccacgggacaguagcggaggcugagaugggaagggacaggcccagggucacgcaucuauuagaggcgggagccucacgccggggcagggauuuuggaauuagacacuuuaaaacgccucauauucuacuuuugccaaagagaaagauugugucguuuacaagagagauaguagauuuuuuuaaaaaagauuacuguagcagauuuuauuuaauuuuuuuuuuugagagggagucucgcucuguugcgcaugcuggauggagugcaguggcacgaucucggcucacugcaagcuccgccucccggcuucaagggauucuccugccucagccucccaaguagcugggacuacaggcgccugcuaccacgccuggcuaauuuuucuauuuuugguagagacuggguuucacuauguuggccaggcuggucucgaaccccugaccucgugaucugcccgccccggccucccaaagugcugggauuacagacgagagcuaccgcgcccggccauuuuaaaauuuuuuaauuaaaaaaguauauauauauacguguguguguguguguguguguguguguguguguguguguauauauauauauauauauauuuuuuuuuuagacacagucucacucucacccaggguggaguguaguggcgggaucucaucucacugcaaccucugccucugccucccggguucaagguauucuccugccucagccucccaaucccaaguagcugggauuacaggcgcaggugccugucucauuuauaucuaucuaucuaucuguccagauacauaucuauaugaauaaguuuauucauaagaauacacuauaaguauuccuauacagaauuuuucuccuggagaaggaagaaucacaucaguuuuuuuggcaucuucaucuauauaaguuaggccaguuuagcagauuuuagaaucuugguuugauauagugcaguauguccaauugggagauuauaauccuuuggccauuuuugacauacuggaaaacgcuuguaaaggcucaauagaugauaccuacuauuauuaauacaccucagugaagguuuugaaaccuugauuuuucuggauacuuuuauuaaaguauaacuuccucucccuccucuuagugagugugcugagcuucuuuuuggguucccugagugcaagggagagaaaaagcguugaggauucugcagguuuauaguccuguucccugggaagagggggcccuagaaggugacaucauccacucccccuagccuggggcucacugcuucacuaccuuucagaucacuccuguccaccugcuccucccuucuugcagcacuugagaucccaaaaaacuccccaaaagggacagauuugcccuggacucuuguuagcccauccuaucacacuguuguuguuuauaaguauuccuauacagaauuuuucuccuggagaaggaagaaccacaucaguuuuuucuucaucuucacuguacauuuacuaugauagguguucaguaauuguuauugaaugaaugaagcaauuauagauuacuagugcuaagggggaggggcagugaaaaucucuaggaugcguugucuaugcuagaaucuuaaaaacgagagagacucaggcauacagaggaugcauauugagagcugaugugaaguuggaggagggccggguggguccucggaauccacaggaggcuggcauggcuggagcacgacaggaacuggauggcucaaggucaagagaggucggcugggccaugaagaagucuagaucuuaugccagguacacugggaagcuauugaagaguuuuaagcaggguacugaaaugaucuauuuguguuuuuaaaagauuaccaggccgggagcaguggcucacugacucacgccuguaaucccagcacuuugggaggcugaggcgggcggaucacaaggucaggaguuugagaccagccuggccaauauggugaaagccugucucuacugaaaauauaaaaaucagcugggugugguggcgggcgucuguagucccagcuacuugggaggcugaggcaggagaaucgcuugaacuugggagguggagguugcagugagccgagauugcgccacuguaccccagccugggcgacagagcaagacuccgucucaaaaaaaaaaaaaaaaaaaagauuaacaauuacucuguggaaaguguauugucggggagaagccuggaaguaggggagaaggcuggaagugggggagaaggcuggaagugggggagaaggcuggaagugggggagaaggcuggaaguggggaaaucaggugggcaggaccgcaguggcccaggccaagcaaggugaugggaacuuggacuagacacuggcaguggagaaggagaaacauggauggauuugagguaauuuuggaaguuaggaccugauggugauuuaaccaugaaggaugaaugaaauugaggagugagauguugauuugucucuccaacaaggcuuuuagcagcaccaaccaggacugugcccauugcgcaugcacaaugagggcuugugaaucagauaccaggguaagcugaggcacuugagaagcuuuuuccaaggcacugaaggacaauggaauaaaagagguggagguuaaaaaaaaggccauaugaacuauuuauaccauaucccugagcuggaaccaucaccauaaucacugucauugucucagucugcucaggcugccuugguucccggcagggcucuuuuccugguuugcagacggcugccuucucauuguauccucacguggcauacagcaagaucaucucccuugugucuccucuuacaagggcgcuaauccuauuuaugagggcucugccuucauggccuaauugccucccagaagcuccaccuccaaauaccggcauauuggggauuaaugcuucagcagauggauauugagggagacacaagcauucauuccauagcagucagugucaucuuagcccugcaacauggggcucauguuuauuaucugugcugugcuacacauuguacuaagugcuuuguacacagauuuuucuuaauucucucagugcuauuguauagguacuauuauuaucuccauuuucuagauagggaagggaaguuggaagcuguugaaaacaccuugcccacaguuggccagcuuguaaguggcagagcugaguugcaccugggcuguccacuggggagucauguucucugugccacaaagccuuguccuuucauuuuuagaagaggaaacugagacccaagaaggggagucacuuguuugagacugcacgugguugcucaagccuguggggcaugccccgucuccauagcuagccuguaggacaggagccggggcuguuuuucuuccacuuucccacuugcugacacguugguccagccacuaucucuuguaucaguuaggcuggauuccuaacugauacccuagccucucccucucccccccagucugcugcuaacucaggagcccagaugggacuuuaccauggcaggugucauuuccgaaguguguuuuugagguggaaguuuugauuguauaauucucauaacaucucucuuuucucuucuugugagcaggaccccgagacagacaagcacacagaggaccagaguccuucgacacccuugccccagccagcugcugagaagaacucguaccucuacuccacggaaaucacacuguggacggugguggccgccauucaggccuuggagaagaagguggauuccugccugacccgcuugcugacucuggaggggcgcacggggacagccgagaagaagcuggccgacugcgagaagacagcuguggaguucgggaaccagcuggagggcaagugggccgugcuggggaccuugcugcaggaguacgggcugcugcagaggcggcuggagaauguggagaacuugcugcgcaacaggaacuucuggaucuugcggcugcccccgggcagcaagggggaggcccccaagguagcaccgggacacccuggggugggggagcucgaggggcugagccugugagcgugugggugagugagugcgacacuuaugguuccaggugcccgugaccuucgaugauguggccguguauuucucugagcuggaguggggcaagcuggaggacuggcagaaggagcucuacaagcacgugaugaggggcaacuacgagacgcuggucucccuggguaaggccacggagggaggaucugggccucuguccacagguugucuguggacagucugugucuuugcuuuggcuuuugguacuuugggcaucucugcaucucugugggcaugugggguccagcucuuccucauuucuuguucugugcacagauuaugcaaucuccaaaccagacauccucacccggauagagaggggagaggagccuugucuugaccgguggggccaggagaaggggaaugaaguagaggugggacguccaaggaugaugggcacugguaaguauaggagccagaugugguuggggggccgccaggggcuagcugcaccaucgccuacccucucgggcuucccagacaaucagggagggcaggaagggagcauagaccauuaacccaaagugggaccacucuguacaaggccacccugggcaggaguggguggcuggcuugagccauaggguuucuauaucugucuaagguggaacaucacacucaccuuacgugguugugaugacugagugauaaguguuaagcauguacauacugaucacuuuauaauaguggagacuggccuggcgcgguggcucacgccuguaaucccagcacuuugggaggcugaggcgggcggaucaugaggucaggagaucgagaccauccugguuaacauagugaaaccccuucucuaguaaaaauacaaaaaauuagccgggcgugguggcaggcgccuguagucccagcuacucgggaggcugaggcaggagaauggcgugaacccgggaggcggaguuugcaaugagccgagauugcgccacugcacuccagccugggugacggagcaagacuucaucuaaaaaaaaaaauaauggggacuuaguaauaccuccaccagcagcacugcugccuccuggcaucuucacguguguccauguccccgcuauugcuuguguccccuauugcagucccacaaccccagccuguggcaggaaggcaugucacgugcuggcuuccauuuguguacauggcccuugguaggagggccaggcaugcccuguccuuguagcugguauauaggacagugguuccaaaggggacugcacaucacaauccucuggggagcuuuauuuuuucaauuaaauuuuaauaaaguagaauagcacagcgaaucuccaaaugaucgucaccaaaacucaacacucugcuggguuuugccacaugcgcuucauccaucuguuuuuacccuuuuccugaacaaugaccacauaccaugaucacacccacagaauaucagaauaucaucuaauaccaucuaauaccuagccuuuguuuuguuuucccuaguugucucaaaaauguuuucuaugggucuuuggauccuaauuguaauacacccaaguccacauuuuacauuugguuuacgucucugaaguauauuaaaaaaacuuaugacaauccccccagucuuuuucaacagcuuuauugagauauaauucauauacuauauaauucaccuguuaaaguguacaauugaguacuuuuaaaaaaaauuucaacuuuuaauuuggauauaggcauacaccugcggguuuguuacauggguauauugugcccagguagugagcauaguacccaagcuuuucaauccauucuccucucuuucccuucccccuguaguaguccacagugucuauuuuugccagguuuaugucaaugugugcucauuguuuaggucccaguuauaagugagaacaugcaauauuugguuuucuguucuugcauuaguucacuuaggauuauggccuucagcuucauguugcugcacaggacaugauuucauucguuuuuauggcuauguaauauuccaugguguauauguaccacauuuucuuuauucaguccaccacugauggacacccagguugauuccaugucuuugcuauugugaauaacauugugaugaacauacgugugcauguauauuuuugguauaaugaucuauuuuccuuuggguauauacccaguaacaggauugcugggucaaaugguaguucuguuuuaagucccuugagaaaucuucaaacugcuuuccacaguggcugaacuaacuuacauucccaucaacaguguauaggcauuccauuuucucuacagccucaccagcaucugacgguuuuugaguuuuuaauaauugccauucugacuggugugagaugguaucucaugguuuugauuuacauuucucugaugauuagugauggugagcauuuuuucauguuuguuggccgcuugcaugucuucuuuuaagaaaugucuguucauguccuuugcccauuuauugcuuguugauuuaaguuccuuauagaugcuggauguuagaccuuugucagaugcauaguuuccagauauuuucucccauucuguagguugucagcuuacucuguugguaguuucuuuugcucugcagaagcucuuuaguuuaauuaggucccacuugucaauuuuuguuuuuguugcaguugcuuuugaggacuuagccaaaaauucuuugccaagggcaauaucgaggaggguauuuccuagguuuuauucuagaauuuuuauaauuugaggucuuacauuuaaaucuuuaauccaucuugaguuacuuuuugcauauggugaaagguaagggucuagcuucauucuucugcacaugucuagcuaguuacccuagcaacauuuuuuuuaaauuuuauuauuauuauacuuuaaguuuuagggugcaugugcacaaugugcagguuuguuacauauguauacaugugccauguuggugugcugcacccauuaacucgucacuuaguauuagguauaucuucuaaugcuaucccuccccccuccccccaccccacaacagucccuggugugugauguuucccuuucuguguccauguguucucauuguucaguucccaccuaugagugagggcaugcgguguuugguuuuuuguccuugcgauaguuugcugagaaugaugguuuccagcuucauccgugucccuacaaaggacaugaacucaucauuuuuuauggcugcauaguauuccaugguguauaugugccacauuuucuuaauccagucuaucauuguuggacauuuggguugguuccaaguguuugcuauugugaauagugcugcaauaaacauacguaugcaugugucuuuauagcagcaugauuuauaauccuuuggguauauacccaguaaugggauggcuuaccccagcaacauuuauugaauagggaagggagucuuuucaccauugcauuuuuuuuagucagacuacaggugcacgccaccauauccggcuaauuuuuguauuuuuucguaaagacagaguuucacuauauugcccaggcuggucucaaacucuugggcucaagcaguccaccuacuuuugccuccgaaaaugcuagucagcuuuuuuaguuacccugagauucagucugcacugaaaaggcagaauggaugcuuaauucuuuccuuuaucaguuucagaaugaaugaagaguugcugccuuaguagccuccaaaggugacccaugacuugggcuucuuuuuuuuccugaguuaaguuauugugacuucacagauaauuggauauuucauaugugcuaggccuuugcagccaugauuuuccugcuuaaacugucccaucuuuagcuagugggagccucuuuuuuaaguuggcccauagguuauucugaugugaccucaguggcuuucagacaccauaaggugugccagauuuaugugugugcuuccugcuccagaccuggaaucaaaaugucucuggauuuuugauuucuauuggugaggagugguauuuagagauuacaaugugaguguuaauuguugcugauuuuuggcacuacuucuaggccuguucagaaaauacauauuuuuggaaagaaaaaagaaaucaugaguuuauacauugauauuucuaauucaaauuuaauguucuuugguuuuuuuucuugagacggagccucgcucugucgcccaggcuggagugcgagcucacucacugcaagcuccaccucccggguucaugccauucuccugccucagccuccugaguagcugggacuacaggugcccgccaccacgccuggcuaauuuuuuguauuuuugguagagacgggguuucaccguguuagccaagauggucucgauuuccugaccucaugaucugccugccucggccuuccaaagugcugggauuacaggcgugagccacggcgcccagccuggcucuuugauuuuauauuguuuaucacuuuccuuuuagguggcaaucuuaaauucucaacgaaauuugcauaauuucuuaaaugaucuuauauccaguccuaccacuucauuauccuauaauuuaucuuacaauuucaaaacagugaagccauaauacuauuaacaauuagacuuccauugaaauacaagauuucuuugcaguucuuuuuguccucuguauacauucuaugcaggacuuaugggcaaaauaaugccuuuuaaagucacuugaaauauuuucucuauguaguuaugucaccagcuugguauacaguugcauucauuuguguauuuuuagauuuuuuauugauuauucuuuuugguuuuugauuuaacuuaauuuuuugaauauguaagauauuuuauguuugcgaagucaaaaugauuuaacaggguagauucaaggaagucucguuuccauccuuguggccucucacuauagauaaucaucuugauuccuuucuuauuuauacuaccauguuucaauaacacagagauauauuuguauucccaccccugucuuauucaguagguuguggagaucaccucauaugauuauguacagaucuuccucaguucuucuguggauucagaauguucugugguaugauaguuuauuuaacagucuguaccuuggacauuuaggguauuuccaguauuuugcugauauaaauaaugcugcagggaguacguugugcauaaaucaguucauguuuuugccaacguaucuuuuuuuuaaauuuauuuuuugugagaaggagucucacucacucuguugcccaggcuggagugcaguggcacgaucucgucucacuguaaucccugacuccuggguucaaaugauucuggagccccagccucuggaguagcugggaccacaggugugcgccaccacgccuggcuaauuuucguauuagcagagacgggguuucaucauguuggccaggcuggucucuaacuccugaccucaagugaucuacccuccucagccucccaaaguguugagauuacauaugagccacugugccuagccccaauguaucuuugagauguaauccuggaaguuggauuucugggucaaaagguaaaugaauauguuauuuggggagaauuuaucuccaaauuccccuccauagggcucguaucauuugcauucucaucuguguugugagaaagguucucaugccaacagagggcaaacuuguaggauucuuuucaguguaauaguaagaagucugucaguguaguuuuaauggcaccucucuuacugaguguggaugaguuuuuuuuuuccuuuagaacucuuucuauuuuaaucucuaauuuuuauggguacauaguaggugugcauauuuaugggguacaugagauauuuugauacaggcauacaauguguaauaaugaccucaggguaaaugggauauucauaccucaagcauuuauuauuucuuuguauuauaaacauuccaauuauacuuuuaguuauuauaaaauguacaauuaaauuauuguugacuguagucacccuguuaugcuaucacaugcuagaucuuauucauucuauuuaacuauauuuuuuacccauuaaccaucucuacuuccccccucgcaccuucccccaacccuucccagccuucaguaaccaucauucaacuucucugucuccaugaguucaauuguuuuacuuuuuagcucccacaaaugaaugagaacaugcaaaguuugucuuucugugccuggcuuauuucacuuaacaugauguccuccaguuccacccauguuguugcagaugacaggaucucauucuuuuuuuauagcugaguauuacucuauuguguauauguaccaccuuuucucuguccauuugucuguugauggacacuuagguugauuucaaaucuugacuauugugaauaaugcugcaguaaacaugggagugcagauaccucuuugauacacugauuuccuuucuuuuggguauuacuuagcagugggguuucugggucacgugguaguucugcuuuuaguuuuuuugaggcaccuccauacuguucuccauagugguugcacuaauuuacauucccaccaacagugcacgaggguucccuuuucuccacauccucgccagcauguguuauugcccgucuuuuggauaaaagacaucuuaacugggaugagaugauaugucauuguaguuuugauuugcauuucuuugaugaucgauuauguugagcaccuuuucauauaccuguuugccauuuguacuuuuuuuuuuuuuugagauagggucucacucuguugcccagaugugacaggagugcaguggcacaaucagagcucacugcacccgauuuccuggguucaagccauucucccaccucagccucccaaguagcugggacuagaggcaugugucaccacacccagcuaauuuuuguauuucuuguagagguagaguuuugccauguuguccaggcuggucuugaacuccuggacucgagcaaucuuccugccacagccuuccaaagcacugagauuagaggcaugggccaccaugcccaagcuguaugccaucuuuugagaaauaucuauucagaucuuuugcccauuuuuaaucagauuaucuuuuaauuggguaauuagauuuuuuuccuauagauuuguuugagccccuuagauauuuugguuaugaaucccuugucagauggauaauuugcaaauauuuuuucccguucuguggggugucuuuucacuuuguugauugauuccuuugcugugcagaagcuuuuuaacuugaugugaucccguuuguucauuuuugcuuugguugucugugcuuuaggguaguacucgaaucuuugcccagaacaauguccuggagaguuuccccaauguuuucuuguaguaguuugauaguucgaggucuuauauuuaaguuuuuaaucuauuuugauuugauuucuguauaugaugagagauaggaguuuaguuuuauuuuucugcauauggauauucaguuuuccuggcaccauuuauugaaauaaccauccuuauuccaauauauguucuuuuuuuuuuccuuuucuuuuuuuuuuuucuuuuuugagacggagucucacucugucacccaggcuggagugugguggcacagucuuggcucacugcaaccuccgccuugcaggcucaagcaauuuuccugucucagccuccugaguagcugggacuacaggcgccagccaccacucccagcuaauuuuuguauuuuuaguagagacggaguuucaccauauuggucaggcugguuuugaacuccugacaucaggugauccacccaccuuggcugcccaaaguguugggauuacaggcgugagccgccgcaccuggccuaauauguguucuugacaccuuuguuaaaaaugaguuagcuguagauguaucgguuuauuucuggguucccucuucuauucuguuguucuauuugucuuuuuuuaugccauuaccaugcuguuuugauuaccguagaucuguaguauaauuugaagucagguaauagauuccuccaguuuuguucuuuuugcuuaggaugccuuuggcuauuucagguuuuucaugguucuguauacacuuuaggauuauuuuuucuauuucugugaagaaugucuuugauauuuugauaggaauugcauugagucuguagauugcuuuguguacuguggacauuauaacuaauucauucuuccaaucuaugaacauggaauaucuuuccauuuuuugguguccucuucaauuucuugcauuaauguuucauaauuuucauucuagacaucuuuuacuuccuuuguuaaguuuuuuccuagguauuuuauuuuauuuauagcuauuguaaaugggauuauuuucuugauuucuuuuucagauuguucacuguuggcauauaaaaaggcuacugauuuuguauauugauuccguaugcugcgacuuugcugaauuuaucaguucuaauagguuuuuuugauggaggcuuuagguuuuucuuucuuuuuuuuuuuuuuagacggaguuucgcucuguugccuaggcuggagugcaguggcgcgaucuuggcucacugcaagcugcgccucccggguucacgccauucuccugccucagccucccgaguagcugggacuacaggcacccaugaccacgcccggcuaauuuuuuguguuuuuuuuuaaguagagacgggguuucacuguguuagccaggauggucucgauuuccugaccuugugauccgcccgccugggccucccaaagugcugggauuacaggcaugagccacugcgccuggcccucuccugccguucuuucaaaaucaucuucaaugagguugccuucuuggccugugcuucccuuuauucaucugggggcacuggaggccaaggagcugcguggagucuucaccugauggaacugauggaaguggcauuuuuggagaggccuaggacugccccaacuaggagcacugcugacuugcaggcugcuugauccugggggugcugccccuuugccagugcugucccccaaauccaacugcaguggaaucuggcucuuccucccaauauuuaaaaaauuauucauaauuuuuuuuggcagggucuugcucugucacucagacuggagucgugcaaucauagcuuacugcagccucaacuucccgggcucaggugauccucccaccucagcccccugaguagcuggaacuacaggcguaugccaccacacccagcucauuuuuguauuuuuuuguagaggcaggguuucaccauguugccuauacuggucucaaacuccugagcucaagcaguucucccaucuuggccucccaaaguguugggauuacaggcaugagccacuacgcccggccuuauuuucaauucuuaguggcucacgaacagucaggauucauauuuucacuuagacuguucuguuucucauucuuuuuugaggcuucauccugcucagucaccaccuugugaugcuuggggcuguuuaguaggauggaugauguguuuuucuuuguuguaggaaggauccaaagaugaaacuucagaggaugauccacugaaauuuuuaggaucugcugaugaagcaaccgucuuuaggcuugucaugaaagcaacauuuuuaggggcaguguaacccguugguuuauaacucucccguacguaaaggggaaucgguagcaguguuagcaggcacagacucaauuggauuauuacuuuucaucacuauuuuaccuuuugauaaccuucuagcugguuuuaccucuucuguuagaagagaaccucaguugagguagaguggacaggaccccacuuggguuacuuuuuauuuauuuauuuauuuauuuauuuauuuauuugagacagggucuggccccguugcccagguuggaaugcaacuggcacaaucauggcucacugcagccucauacuccugggcucaagccauccuccugccucagccucccaacuagcagggacugcagucaugugccaccauacucggcguuuggugguuauuuauuuauuuuuuuuuuugagauggagucuugcucugucgcccaggcuggagugcaguggcgcgaucucggcucacugcaagcuccgccucccggguucaugccauucuccugccucagccucccaaguagcugggacuacaggugccugccaccacgcccagcuaauuuuuuguauuuuuaguagagacgggguuucaccauguuagccaggauggucuugaucuccugaccuugugauccgccugccuuggccucccaaagugcugggauuacaggcgugagccaccgcgcccggucugguuguucuuuuaucucugacaaggcauuguucucuggaugcuuaaguuuaggaagauccagcgugguaaauuccaacccagguuuggagguagagccacuuuuuccaugauucuggguuucuugucuguucccuucugaucugaugcccauccaauuucaaauuccucuuagcaucaaguggacaaaugaugugagccauuugcugauuucaucucugaugguagcauucugucaacucucacugucagccuuuugcucaucauaguuuuuuucuuaucaucuuuuuuugcuuaaaaaaucagagcuuuggccaggcacaguggcucacuccuguaaucccagcacuuugggaggccaagaggguggaucacaaggucaggaguucaagaccagccuggccaagaugguggaaccccgucucuacuuaaaaaauacaaaaauuagccgggcaugguaaugggcgucuguaaucccuacuacuugggaggcugaggcagagaauugcuugaaccugggagucggaguuugcagugagccaggauugcgccacugcacuccagccugggcaacagagcgagacuccgccucaaaaaaaaaaaaaaaaauucaaaaaaaaaaaucagaguuugauuucuugugugagaggacaagugcucauuucggggcuuuaccauuugaaagucuugcuaacagcuggguugguuacgaucacucugggaggcgggcacugauuaaacauguauauagacacggguucuaagaaguaggcguagggauggaguuaucuugaaagacaacuucugaggggaaaaccuugacgcuccuaacgccauaucuucaguuguguuucugcccugccuuggguccccuaugccauaagagcagcuuggaggaggaggaggaggcccgacugcgggagguggugaccaccccacuggcuggugggacaggcaugguguuucucuuuccugccuuaaaaugccagauucugucaugaccugccuggcgaucauuaccgugauuuccugucugcugaauuccugugcugcaguuuccuucugugggacaugaggcuuuagacuggaaucuagcugccagguauuuggugggguccaccucacuaucaugcccugugcuggagcugaggccccaggaucgcagugacucugccuuuccccagagggucccuggucaucugggcaggagaccuccauguugugcucaaugucacugauuuacauucuccaggccucccuccguauccagagcaccucaccagcccacuuagcccugcccaggaggagcugaaagaagggcaggcccccaagcagcagcaggacucagaggcgagaguggccccagccgggccagaagcaggugagugaggacagugaggcggcaggaugaacagugucccgaggcagcacgcgaucaccaagcgauggugcugaggaaaagcccuggaagcauggggcugggagagagggcugggagacugguugggcugggccggacaggcuuucugggaaagaggccccugagacaggccuaaaagaagguagguuuuggcauuuucagcgugagaaaacagucuguauagagggguggguuccucugcguguugggggccugggcacauggguccgguggagugaggggaggggguagauggguguguugugccugcccagggucuuuacgagggucccauccacggggcaguguguguccugugccuagcgcggcgccagcaugguguuucucaguaaacgcccucuuucugaagaccuacugggaacucuggcuuuagucauccuuccagacuucuuugucugcuuuuauuuaaaggcagucccugccuguccuuucacaaaaguguauaucagggcauuuagcggaacacuugcaaacaguccagagcucuguucucugucuaguguuccucugcggggcuggcuccuccaccugguccugccgcuggcccgacuuucagucucugguugcuuucccuguggugauuucuggguaucuuccccacuggaucauccucccuucccuggguuucucuuuccagccaguguguaagucugggcucugcucauggaguuggagagaugggacccucuuaggugggaaggcaauguuccugccccauugcagaccuggaacgguguccgggagccucccaacccucuguucuuuucaggcucaucagggugacagaugcugagggacaagucauuagcacuggccugcaggaguguuggggacauggccuucguagcucuugucucaccucugaagcccucgggacagaagcccuaggccuccuuucccugacagggacuugcgcacguccagggcugcuggggagauggcugugcacgcugcaagccgcggguguccagcagccgguguugggagaggcccucgccgagucuuucucacguggccgccagcuagcaccagcauuuuaucuuuguuuuuuuuuuuuuuuuuuuuuuaauuuuuuuuuuuuuauugaucauucuuggguguuucucgcagagggggauuuggcagggucauaggacaauaguggagggaaguggggaaguggacacagcacauguuucagagagcacaggguuggggguaaggucaccgaucaacaggaacccaaggcagaagaauuuaucuuaguacagaacaaaaugaaaagucucccaugucuacuucuuucuacacagacacggcaaccauccgauuucucaaucuuuuccccaccuuuccccccuuucuauuccacaaaaccgccauugucaucccggcccguucucaaugagcuguuggguacaccucccagacgagaugguggcugggcagaggggcuccucacuuccuaguagggguggccgggcagaggcgccccucaccucccggacggggcggcuggccgggcggggggcugacccccccaccucccucccggacagggcggcuggccgggcggggggcugacccccccaccucccucccggacggggcggcuggccgggcagaggagcuccucacuucccaguagggguggccgggcagaggcgccccucaccucccggagcaccagcauuuuaucuuugauuaagccagaaggagagucuuuagauggggagucuccaaccuuccccaccagggacauccugccaggcauggggccuggggaagaagggcggaggcaccuguggccgcagcagagccccacaggagugugggggccuuuugggaguggggugggguugggguuggguggugggaccuggugaggggcuuccuccugaggguucucucccucccucuccagcuucuaucucccuggggacuguggggacccagaucagucugggguccuuccuggucuuuccccaucguggucuggucuggccuggcuggaaaggcacugcaugaaaacccaggcaucagaucccaggcaugugguccgaugaugauggaaaagcuguucacguggucuuggcguggcugggcucccagccccuccguguccacagucugugucccucugccuagagucugugcuucccugagagggcagggugccaggacccucccucacauuagggaccccugagagcugggugcugagaccuggggucucacgucuccagcacauugcugugaucaccugccacugccuugguuguccuugucacugcugucccagcagcuccuugccuccacccaaccugggaguugagugagacucacacagacccaggcaggaaucucaggucccagugccuccucucugucaccagugaguguaguggcagacaggucguggacgcucuguguggauuugucauguggaugagcagcugagcaugggugcagcacucaccaccucuaguccacagaggccucuuaggguggucugggggcaugcagggccccugggguucauugucuuucacagaugguaacuaaugucaccagaacucuugggggugggguccugccacccucucugcugugcccagggucucugcuucugugucccacuccagcugaccccugaccucugggcucccuggcuccuggccuugcaguuugaucuccccuccccugauguccuuagcuuggccuccaggaaugaggcagaugacaacaaucaggacugagugaccgugcaaggcagugccuguguggcagggcucagugagcaggaccccugcaaugugcugugagcacuguggggagauagggcccgggcugaggcuggaagccaggacugggccgagugaccugggggacaggguggugagguccacuuggaaaccaacauagacuccuuugccagguggugguguggccaucaagacagaggcacagucugaagacgagaugacgccugagcggcucuuucugggggugucccgaggccagaccgaguguagaaucccccgagggcccaggaacaggccugggggccccagccgucaucaggcccagggcaugcccagggugcgggcaggggagccacggccaccgggggccaguggggagacgccccgaguccucucccgcaggcggcagcgggcauuccccugccccgacugcgggcagagcuuccgccugaagaucaaucugacgauucaucagcggacccauguggaggaggggcggcaggaggcccccggccgcucgcccaccagcugcggggacagccaggccaugcuggagccgggggagguggugguacccggcccugucauccgcuggcuccccgaggagccugagggucgccgcuccguggcagggggccgugccuugguggggcggcggccugcagccagcaagauguaccacugcagcgagugccugcgcuucuuccagcagcgcaagagccugcugcugcaccagcgccugcacaccggcaauggccagggcuggcccgccugccccuacugcggcaaggccuuccgccggcccucggaccucuuccggcaccagcgcauccacaccggugagcggcccuaccagugcccccaguguggccggaccuucaaccgcaaccaccaccuggccgugcacaugcagacccacgcccgaggccaggugggcccacacuucccugccgcccccgcccgccacgggagccugccccugcccuggcccagccggaaggaggagggcugaccuggcaggagcccacagaggaccccuggcggggucucuccccugugccugacgcagguucuuccuuuuccugggauggagagagguuuguuguuuuuacccauucaaaugggaagcuagcugcccuucuggugacauugugugugaccgggugcuuucuguuuccuguuugcacucuucgcugccuuuucugcauuccugacuucuaaaagaugccuuaaggcuuaagggaugccauauuuuugauaaggccucugguagguaccacagccaagaggaccagagaucauggcccuuccaguaugggggcgauagagacaucggggaccugggauuuuuguuuugugcagagaucuccugccugcugucaccaugagaaacaguggaguggaguggauggauggccugacuugaagaaagggcccuggaaaguuuucuacuuugcuauuuugaaauuuuuuucccuucuuauagagacuuugaaauacuuuuguaaauguguguaguuguuaauggaacuuugccuuuugcaaagucggaaagagucggcuuuuccaugugaggcucgcagagcugaaaggggagcuacguccaccagccugugggucuuuugguuuuuuuuuuguuguuguuguuguuuuuuuaagauggaguuucacucuuguugcccaggcuggagugcaaugguacaaucuccgcucacugcaaccuccgccucucggguucaggugauucuccugccucagccuccugaguagcugggauuacaggcgcccaccaccacucccggcuaauuuuuguauuuuuaguagagacaggguuucaucauguuguccagacuggucucgaacuccugauguuaggugacccgcacaccucggccuccugaagugcugggauuacaggcgugagccaccacucuuggcccagccuguggguuuugauggggaugucuuggcugcugucuuggaggcacagugucuccccauguguguguuucuuggcccagagugacucccaguauuccuaguccuuccccacaggauagucacauccauuauuuacuuuuguugucagcugggaggggaaacugaagccuggacacgucuccccaagggcucaguguucauggguguguaagauccauugacuggaccccagaaagcacccugaggggcagugcagagagagcccaggaagccccuccacuagaggaggcccuuggucuggcugaggaccacguccacccugggccuccaggccugcuuuucacauuaaaggcggggcagucuccucucaaaggaguucucccuugagcacuuugggcucuggggcagaguugggcuaggagaucugggugaauccuuuagucacagcuagucucauguuccucuucugucaaaggggucauggccccaguguguccuaccucagaguugucagggucaaaguaacaggcacugggacaaauaugaagccuagcuuugugcuuccuuucaaauucagggccuccuuucuacuccauuccagccuuuuuuuccugucagaaucccucaggaaggaccuuuaucuucuggagugaguggcaguuccacuggguucagugaaagagucgcccauggggcucuguuccccaggaguccuuuguauuuuggugaacaaauucuuaccaaagcaugagauucggacuguagaaguucagacugccucaguucagacugccucauggggcagucuggaggucagcuggcuucuggugucucucaucacaccacugcggacgcugucuguagagcagccuuggugugggugacucugaagcuggagugaugggaccccagcuauccuuguuuuuuaccgccuugucuggcacugugaccacgcuucagggcugcuucugggggucuuggucccuggaugugccauuuccuugcccuucugacccucacacuucuuccaaagucuugagcagaguugggggccaaugguagcauugcugucaucucugggaggagagugaguauacaagucagugacaguucagccaggcucccuuggguuugggaagaggcacugcccuucugugcuguggauccugcuugucugcucuggaguccccccacccuugccaggagcuucacaaaccagagacgggcugucagcaagagcucagacaggauguggugcaagugcaggugcacgaguuuaacccucagcugcaggagcuagucucagguguucuggggaugccucaggcuaagaauuuugccgacuuucugggcuugguuggcuaaugccaaaugccccugcuuaaauaucacaaggugcugauucuccuuuuuucuuuuuuucauaccaaugugcucaaacuuugagcuaggucuugugaguuugccuagcacucagaccuguuuaaguaacguucuuuacauugaaacaagucaaccgaagcuuuguggugcaggagcugagggugccccagacucagugggagcccugguugggccccaaacucucccagcaggguccucgguuuccucauuugugaaauaaaugagugggccacgacguuaauaagcccaagagaacugugaaggugguagucccuugcccuaauuggugcucaauaaaguuguuggcauaaacgagugcgugcgcuugaucugguuucugcucucugggaggugaguggccgugcggggcgguggcagcuggcgacaccugcgggcuguugggcaccagcccggggcgggcgcucgcaccugucgggcgugcacaaaggcccggcgcacgcugugggggcggggccucccggguuggccaaugaaaagcuggcacugggucggaggcgccagccaaguggggggcggagcuuccaccaccggccaauggggaucuggcuucgggaugugggcgggguccacccggucgcaacccguugagucucugcacagcugccgcgcugacgcguuuuccgcgugucccgagccccggcggccccgcgagcucgguccgugcggggaaagcagggcugacgccgucugcggagaggacugcgcagccgggcuuguguggggccgcgcguaacggcagcggcuacucccugcccaggccggccagcacagggccauggccgaggcggcugcgccuccgguaagggcgacccucauggaggcuuggggacguggagccgaguccugaauucgccaggaggauguuccaccccccaccaucuccggcgaccuccuggaacuggggagggcucagcccggguggcaggaggaggacaaggacuccuaaggccacacgauaaacgcccuucucgcucuccguuuccuugccuguggaauaaggugauuggcaaacacaagauuuggagguucccuccagcccugauauccacuggacccggcucuggggggacaguggacuguggacgucuucauuccagacucuccaagauuccucuuucuggacccgccuuuuggcaccgcccccaagucgaccaucucaaagauccaccccucccuccaagcugagaccagugccauggccuggggagggauguccgcugcagucugcuggagccagagucuggcuccuggcugugaggugggcucuagacuugagcucugauuccagucaggaggauucugaugccugcccacucuuucuaaaauucccugacaaguccuucuggcugcugcugaggggaucugcauugugaggacuuuugguuaggggcuucaggcucaggcuugaccuaggccauugcuggccugcauaagaacuguugagauuuucauagguuuuuaaagguagaggggccaucuccuaguauaaauagcuuugcagugguuuuggauccauucccggguggcacauuuguggcagggcauugcagggaggugaggauguuugccccuaaucugugaagacggugcugccuccucugagcuccacuucauuguaucagacagaggccagacuugaggaugaauagccaugcuguguggggaaggaaagggccagguaucuggugucugguaccugguaugugugggacgcuuugcugaguacguuuauuggggaggucucugagaaacucaguugcacagaauuggauuaaucacagucuuugguucauaacacauucagaucacugguccauagccuuuauauuuguuuuuaagaauauaacaggugcuaaugucauacaccaugagugcuuuuucauaucuucagugcauuucauccacacagccaccuuaggagugaaggaaguuaggauguccccauaagugagaaaacagaaccuuggauaaguaauguggcuugaccucagguugugcaggauucagauggcaggagaggcacugagucaaguucuaggugaguuccauuuccaggagcacucccuuuauaccucaacuguucccugcugaggcauuccuggauuuuaaauuuuauuucuagcaauacacaauauauuuuccaccuccugugaacaggguauuccuuguaauguuucuuuguucuuuccuuuucugcuuucaacuuucucuggccccuguugccuggcagcuaggaggguggagaccacccuggggcugguugacaaggcaccuggaucauggggaugugguaucaggcggggcaggaagucacaccaguagaugucaggguggaugggccuuagaaaucaccaaggcagaacaacaggccuuucuccccuugagcccacuaaggggugugggcuuguucuagaagaaggugaggagucagauugcugccugggugugugugcacuggaccccagguccccuggcagguguucuggacuugggcuucucaccauuucuuggcuccugcugcuggccguguucccuaguugguugaguaauuggcugaguaaauagagccagugagugguagagcugggauccacucucuguucauuuaugaugguaauguuaguuaugucauuuuccguugccccggcucuugguucaggauucuucucgugggggcuuugugcgguccagugucugcugucuuugacuauuagguggggucuguuugggggucugaccagugaggccgccuggcacucagaagacgucucccccauuccggagaauccugaccuuccuguauuugggaauggcucugggcugcucuccuucugguggcugacuugcgaacuugugucugguugcaggacuggcauugcggacugaccuccagggagaggcccagaucugaucugcagagaucucccuuccggcuaucguggcugcuguucaggugguggagaagaagauggaaccccaggcugccuggcuacagagccuggagggaugcauguggacagccaagaagaagcuggcugacugcgagaagguggcuguggaguucgggaaccagcuggaggcaagugggccgugcuggggacccugcugcaggaguacgggcugcugcagagguggcuggggaacguggagaaccugcugugcaacaggaacuucuggauccugcaguugcccccgggcagcaagggggaggcccccaagguacaggagcuggguguaggaggagaggcccugccuggacucuguaggguggccauaugcauagcgucgccacagcagcauacccuuggcugcugaagccugaccucugggcguccaaggcagucacuaguugacuuuaaagggcuugaaaaaugucagaagaaaauugugacacagaaaaaugucugcuuuggaagauggaaugggguuuguugggagagauaugguugugcagcagugguuguacauggucucugagagugaggacuggcacaaguaggagauaugugugccugggagaggggagaacccaggagccccgauccuagaucccauuagucacugguucugcccuuuagcugaaggcagugugauggaguugaguuugcauuugcuuaguaguuuggccugcgaugcccucugcuucgggggaagggagaggggacgaguugguuuuggcugcuccgugaaaugguuguuauucauggugggugcaggcaacuuguacuuccaggugccugugacuccugaagacacggucggguauuucucagagcagcaggguggcggccuggaggacucauagaaggaguucugcaaauguguugugaaggggagcugcgacacccugagcuuccugggugagaggcuggccucugggggccuccacaccuugguuuuacuccuuuauucaaucacaugagacuccugaaucucagagcaggaagcauguggagaucauuucuucagcccucugucuucaggcagguagaagguaucugucauucucauuuugaaguuuuauguaaugaaaugcagagguuaugugacuuguuccagauuucuuggaguaaauaaacuggaaucugcuccucgcuguccugcccuucgcguggugccagaggcagcuccugcgugcacaccuguggcucaccagccuaucugcuccuggggagcuggggccuccccugguuuacaucugcaucucuaggacucccacgcugcacucugcacacugaguucucaggagauuccugcugagcaaagaaggaugaauuguaggccugcuuuuuuuuuuuuuuuuuuugagacggaguuuugcucuuguuucccaggcuggagugcaauggcgugaucucagucaccacacccuccgccucccggguucaagugauucuccugccucaguuuccugaguagcugggacuacaggcaugggccaccacacccggcucauuuuauauuuuuaguagagacgggguuucucuauguuggucaggcuggccgcgaacucccaaccucaggcgauccucccgucucggucuccuaaagugcugggauuacaggagugagccaccaggcuuggccaggccugcuuuuaaggaugccccagguccagaaaaucagggccaggccugggaaguucgcuccuucaggcaggugugcgucuucgugugagacuugaucagaccuggguuuuuguagcuaccccacuccgaagcucuccugcgugaaccuggaauucucacugcuuugggcaggugagcaguuggcuuuuuguccagucucuccccuuguugggaggcugaggcccagaacacagugccuucccucucuuugccuggcugcagagguuccuccuucagaaaagggucccagugugcugugggaggcagggugaggaggcuguccggccucaggcgaggaaggagaagcacguggaaggaagggcagcaggaagccugagccugacugccauggauggccagacccacucuugggccucaguuuccucaucugucuggacuaggugacuugucuaugugggcaguggaugggaacccuuccucuuggccucauggcacucacuucuagcccacgaaaacugagaggccuugcccacccuacucuccaugccccucaacacacgccuugaagaggcugcuccaagccuagcagaacacccucccuuuccaggccugcagaggacagcccugccacugcccuuuuccuccccacaggccaggccaccaccaagccagaucuggcaccaguggagaaaggagacaggcaggcaacugcagccugcccagugcggagaggggccagagcccgggcacuggugagucccucagggugugggccugggccucuccaccugcaucugguaagggcaucuggugucagaaggcccccuuggagaaagagaggcagagguggggggaagugaacugcugggccucacagcugguggucagggccagacccggguguucugacacccagagagggccugggccauuucccauacuccaugucccuuuggagccaucgcuuggccugagaccagucuggaggcuugaggggaagggcagagggcauagcagauaccaggaaccugagacaggccgucuuggugcaugcaggguuccgggaggagcgacgggcuggcggccuccgugagaccugcccugacacugcaucugcucccagggcccuuggugccugcgugcauguccuccucacuuugcagccuaaucccugcuuccucuccaggcuucacucuccuugggugaagggacugagucuugcuguguuaucccccuccucuagcaccuuacacagugccuggcauguacugagauuauaaauaauauauaauuacuaaaugaacagugaaccagaauagaagcucaguuuccuccauuuuucaaauaauagcauuggaucagaaugcaguuuuuuuuuuuuuuuaaaggugagaacccuuuauuccagugacaaccagaaacauauaacauggggacaaugggaccauucuaguugaaggacaggaacccuggagcugguugcucagaacacaguggaucaugccaagauacugcugcuugcuuucuagauucuuagauuuggggaggaaggcuccccugugaagcagacucuuugaguagguaaauuaagucacagugagcccagaguggggaagaagguggggguugacagggguacugaguggcuggcauguagguccaaggcuaaaaguggcauuuccaggcaccugcagggggcaggggcaccagagagagagcaggguugaguaaggggugggguguggcaggaugcaggucacauagcccaagcuggggagcccugagcgagaggccagcugggcagagcguggcucuuguggugucacugagcguggcucuuguggugucacugaacguggcucuuguggugucacugagcgcuauuacagcagcagccuggccaacagcuccuccccuguggugcagggaggggagcugagcccaggcacugcagccacccccgucuugggcuggcccccugcagcaggugugggcaggacuggggcauguucagaggcuguggccggugccacaguccccagggcugagcagcuccuagggggaugcaaagcagcaggcagggccuggccaaagagcugcaggcacggcucugccaugaggcugggcuugcaccugaaggcagcucaaggaagcgugguggguggaggaaugagaccugcucaggggauuaggguugcccuacggucuggguaguccuugccauucuagcaguuacuucuuguuuuccauucucuguaaacuuuuccagauuucuccaggagagagcuuuguuuacccccaaggacugggcuucacuccuaaaagcugcuucuaaacccuuugcgugcaggccccagacagugugggugcaugacugcuuuaucuguuggauguuuccacaggcaggcuguugcugccagaauucuagaagcaguguaaacgggcugcucauucauuagguacgggcagggucugggcacuggacuuucaacacuuuccucccgugauucuggugccguuaguuugaaaaucacggcucagagaucccucugaacagaaggugacccgccucuagccauugaaagugucuauguuuugauuaugcaaauggauucuuacacgaauauguucuuacuaagcaauguggaggucauggguaaagcuaagcggcucucugcuggccgcccacccaaccccaggccccucccaggguagccacugggaucauucugcugcauaaccuuucaggcuauuuucucaugcacauacuuacuuguguguacuguggaaaaauacagggguuaagaacacacagauauacacuacguaucuucugcgguuugcuguuuucacucaacaauaugucuuaaggaucuuuucguguugauacauuuugaucaauuuccucucgaaacgguuuccagggcccugguuaaugguggagccagccugguguguggcagccaggucgggcuggugucuucagaguggcugugucagaagggccucguguaugacagaaguaagugagcugugcccuggcuauaaaaucuggcagcguugagcgacuggacagcuguuagauauggguggcuuggaauguucuccauucauucauuuauuuaacaaaaaaugugccuacccugugucaagccuggagcaggaagaggagcaguaacuauucccugaucuuuagauaggccuuagaggugggcacagauuggugaggucgcccaguccuugaaggacacccaccugagggcacuguaggaucuguauuuggcugcuguaacagagacugaagaaaacaaaaccaaaaccgcagcuuccacacggcaggggguggucucccucccgacagagcuuguuuggcagcucacaggcccaggcuccuuccagccuaccgcuccaccauuccuggggccaggccuuguugcugugguucgagauggcccgcgaccaugcccacggcccuguugaaggaagcaaggggaugggcuggggguuggggugcccuuucccuuuuccuuuaguugaugccuuucccuuuaagcaaacacauugguuucuuguacauuuaguacuuacugugcacuuuauaaacauugacccauuuaagcuuauuccaacucucaguuuccucagaucauagaugaagaaacugaggcacagagaggccgaauccacugucaaagguccuguagcuggaggaggcagcgccccucacauccauuagucagaccagccacagggcacaccuacuugcagggaggcccagcaacaaggucuggagucuaggaggccacauggccagcaagacaccaagugcucuguuaguguugaagcgggguggauggcauuggaagauggcuggucauccccgucacagcucacagcccgucauucacagaccaagcuccccuggcuugacucacugccaugucacacguccccaggaugugcugugccuuugcugggaccuacaguucuguugggagucucuuuggugucauggucccaacugaggcugugagaggaaagauguccuaugacaccugcugcccucagggccucuuccucuuucccuuagacgcaggccagcuggaacguccccaggcguucuguccuggaucaagcaagaggaaggggcaagugggaggagccagcagggcccacaggagaccacuguggcacaccugugcucagguaaggcaugcugggccaugucuccucaggccuguaucccugggccuuaggagacauggcguccccuggggggccucacagcgccucuaguggggccuucuccugggcgaggcuccugagggaaggcagugcgcagccuuggcugugucucugcagaaucuuguaugcuugcugcgugguguccucccaugcaguugcacgaaaucauucuuuuauuccugauccuguuuccuguuuauuucaugaacuugucuguaggcagcauggugcugggcgcugcaggggcucauuaaugcaugagacacagauuccacucaggagagagaagacgaacacagacacaguacacggugggaaggggcacuuccaugucugcagccagagagcccuuucagaaucugacccaaaagauggccaguauucuaagaaaaagcacauaugcuuacgaugugcaaacagcugaagguguucuuucaacuauaguaaaaggggugucucgguggccacaggcggcccagaugaaggugcugcuggggaaaaugucaccacgcuggucuugggaggcuccaugagagggaggugggacuugagaggggcuuagagccugggugagaggcaaagaggaggccagagaccuucuggguagagaggacccucgggccaaggcucagagguggaugaacgggggagccuuagguggaacagcacaggguggaacccggcagaggacaaugggagcugauggaggcuaggccagaguggggccuucagugaugcuugaaccccaggcuucagacuccagaagagccaagggcagguggcccggcugcagagccuguggcaggcaggccucacucacuauacccuucuguguccuuugccugcagagaccugucugggccgcagagaggagucuggagguaggguccaagggccacgagccaguuugggcugcuggaggggggccuggcaaggagggcucucggggaagcaccugugggggucugcuuccugaccccagggagcuagaggccucccucccuccaggccccccgagccaggcugagccagccgcuaggggcacggagcagugcccaccuugcgcccaguguggccagagcuucggccagaaggagcucagugcgccgcaccagcgcgugcaucguggcccccggccuuucgcuggugcucagugucccaagagcuucacgcagcggaccacccccgccagccaccgucgggcgcacguggccgagugcaccuacacccgcgcccaaugcggcaagaccuuccuccagcagucgacgcucacacccacuacugcgcgcacaucagggagaagcccuacgagugcgccaagcucuuuggccgccuguccacgcugcuggagcaccggcacaugcacacgggugagcggcccuuccagugcacgcaauguggcugcugcuucagccgccuguccacgcugcuggagcaccggcacacacacaucagcgagaagcccuuccagugugcgcagugcgacaagcguuucacgcgucuggccaaccugaccgugcaccagagagugcacuugggcgagcgcuccuuccagugcgcccaguacagcaggagauucaugcagaagcccggcuuccugcgucaucuguguggccacucgcaggagaagcacuauccuugcagcccuuguggugagagcuucaccugucccuccuggcuugugcgucaccaggacagccaugcuagccaggccucuccaucuugccugguuugugagagggacuccucgaccgaugagccgcccacgggccucaggggugcagugugggggagcaccccuaguaauccuucugccgcacucagauuugagggcacugguacagagcugggccucaggaggugcccuggggacaggcagcggggcaguggugaucaggaaggucuugggugggggucccuugcccaguucucuuucucgcgugaagauggagaauguggguagcacccagagagcucccuaaaggggcucugagggcccaggggcaguuggugccccuuaaaucugagcaaccucuccugggggccacuucuuggccaggucaaaguauucuggccauggucuuggcuucccgggggagggcuguucucccaggcacugagauugcccaugggccuucucguugcagggaggcggcugggauagaggccagucccaaacaccugagccucacugaggggaaggccugggcuuggagauggggugcgcaggaguggcuggcuuugccuuguucuauuaggcgagugauuuucagagacaaagguccaaguuaggagacguaauuacucagugcuuugaagggacauccaaggugcucacucuuagccauagccguugguuuccuggaugcugacugugaagauucuaaagugcuuccuagggugggcggugguggcaggaggccuuggacggaguccaggccagacccagccuccuguuuaauaggcugagcccaagcgucccucagaugcgaauccaacagccuuggugaguuguaagauuucauggaaacuuucccugacuucugucucccccuugcuccccauuaccugggaaaggcagcuuugugggccaugugucccggaagggccugggcuggcuguggcccagugcucaggaccagccaucuuggcccucacagcgcccugcccaguugguguaauauuugucuucaagccauuguuggagcaggcaggcaaagggggcuuucugaggauccaacgugugccagccacugggauacaaagacaggccugguuccuagcuguggggcugggaaggguaucugacaucaaugguggcaccuggcagaggacacacagacaacagcaggcagcaugggcugcaguaaauguugcagaagcaccuaaagguugagcagaagggagguaggaaaccuggacauggccugccagcagcugagaagccccccugagauccuggcggccccgccaccaucugaagauuuaggccagucccuugggcuuuucaggcaggcccuuaugguggccggccaguuugggacccucccauuuugauacauuaguucccccucagcuacuggagaucucagccacaacugggcuccagcugugacccagacuccgccaggauccccuagauccucagcugucagauaauccccugucccccuccuccuccccacucaacccccagugcuugacaugaaugcaugugugcuuccuaggacuagaggccggugcugucucuaccauugcccucacuuuaaggggcacacgagcagaugguagcaagcccuggagagcagcacucgggcaagugagguggcucuggcacugccccuggacuuucauguuuguagcuugagcugguuuuaauuggaagcucugugauuuacauaaucacuuacaaucucuguaaauaaggaacuauuuaugaggaauuguaaauuuccucucucccccuucuuacccugucugugaucuugucugugaugcaguaaugauauuccacucuagguucccaugaucaguggugaaauauagugauuuucaccugugcuuccauucugaaguucugg

SEQ ID NO: 14626 - RNA, 23290 nt, Homo sapiens
uuuuuaauuuccauuaugauuucuucauugacacauggguuauuuuagcagcauaauucucauuuuugaauauauaagaauuucugguuauuauuuaauucuagcuuaaaagguaaaaguauugucagagaacauacccuauauaauuucaauauuuuaaauuuauuuacacuuacuguagggcuuaauauauggucaauuuuuguaaauguccuguguaugcuugaagagaauguauauuaagcagucccauggcacacaguuuuuguuugcuuguuugagauggaguuucacucuuuacacaggcugcagugcaguugcaugaucucagcucacugcaaccucugccucccggguucaagcgauucucgugucucagccucccaaguagcugggauuacaggugcaugcuaccaugcccagcuaauuuuuguauuuuuuguagagacagaguuucacuguguuggccaggcuggucuggaacuccuggccucaagugauccauccgccucggccucccaaagugcugggauuacaugugugagccaccgcacccggccccaugguguacuguccuauacgggccucaaucaggccaauuuuguuaaggaguuuguucgaaucuucuacaucccucccaauuuguuccaucauuuucagagaaagauaugcuaaaaccucccaaauaugauugugaauuuggguguuucuccuuuuaguucuuuacauuuugaggccagcagaggaaaaaauggauuuuuuuuuuaacccacaacaguguuaauacaaaauaaggcagggaagagaagcccccucggaagaggugggacaaacaaaaagcacaaaguaagaaagucuguuaaagccucaauaaaucagucagucaauuacauuuaaauggauuaagggcucccaguugacgagcaaaaucugucaagaugguuuaugagauaaaauccauagguugugcauaggagccacauccaaaacacaaacccgcacaaagguuaacagcaugccugcugcucuugaccaagcaccuucagcggggagcagugaaucgugguucuugcaccccgcaggccagccucccuuccaucaggaccccuggggguggccagaaaauaauaggggcacgaggagcccauucauucauauuuugaagcggaaccuucacauguuccugccugcugggggacucuggcuggcagacugggaaggucgcacucagaucagccaggacccguucggcucacccaggauggaaugagcagccuggagccuucucugcccccaauuccaaacccuggagcuccuuugaguucaaaaagguccuucaguuucucccaucaaagggaccacauuuccucuuccaagccacacugcacaguucuuaaaggagaugggcacagugccaaagaccuaaacugcaucuagauuuuccacuagaucaauucuagaaggcguuucagugacuguggacagguccuggagaccuagaccuagggaacugcuucugcaggaggaacgcagcugcagaccauggaacuucuuaccacuuauuacuuagaauccacauucuuaaaacaacuuuaaacuuauuauaugguccaacugggucuggaccaccuagaccaggcucaguccugaauacccuggucugucccagcaggcaaaggcugggagggggcaucugugcccagggugaggaugcgccgagugcuggcggcacuggugagggcucgagcucucuuccuagcucugcugguugaaggcugccuaacugugacagucacuuacagccaccaugcucauuuguucagucgugccugucaacuaggguuugcgugguggcuguuucggaagccagcaaagcaaaaccaccuuaaugugccacacagaaguguaaggugacccccccucccauugagucgacagcccagugaccccugcuuagaagggaaaggagaaugggaggacaggcaggcacgaugggacugcaccagcugcagcaggggugggcaagaguccucuccucacagccagagucagggcaggggcaguuucgcuucucaaccccccucugaaacugugucccaccccuugccguggcucugaaacgugcccggcacugcucccugcuuauuagaaggagagcuccucaggcaggagcaaccuagaaacuuucccuuccugauucugugcaagcacggcugugagcgaacagccuccguauuucaacaaacauccuacuuguauggucuuaggaucuguuuccagacagucaccucggggcucacucuaguccugaaagcaucuucccaucccuuugugauguucagucuguugcgggcauuccccucugacagguguccuugcccugcugcuucuacaggguggcaaagagcaagggcuucagcucccaagcucagcugcagggcacuuaggccccgaguguguccccagugacccugacuugagggacacacugggcgcugcagccacaaggcacugcuccuguagucauggugggcagccagcauugccccaggccacagugcuggugucccaggcuccucagggaccugaggacagggccaagugugccaguccacaccaggcuggcccugccaguccacaccaggcuggcccugccagucaacaggugcacauacagguccugaaaccaccucaggucaaauaagggauuugggggcacacagguugcauucugccucuugggaagaugaugcaagggaaugacaggcaggcugguuccaacgcauugccaagcgccagcugagcgggcugggagcaggcacauuccgguaaccaggacagaagugggcuagugauaccuggucaugucuuuucccaagacaaaaccaggaagacuggcccagcccguuugguguguuacaggcugaacugugccccuccccaaauguguauggugaaggccuaaccuccaguaccuccaaaugugaccucacuuggagaggggguguuuagagagguaaucagguuaaaaugaagucauuagggugggucauaaccccauacaacugcugcccugauaugaaggggaaaucuggagacagcuguguagaaaacaccaucugaacaggaagacagccaucuacaggucaaggggagagguccgggaccgauccucccucccagcccaaagcaggaacugaaccugacaccuggauuguagacuucuggccuccaggacagagacaauaugugcugcuguugaagcugcccaggcaggguuccucugugaggcagccccaggggacucagagugugccccaggaguccugugggaauugccccacccuuccuggcacacuccugaauguucucgaggaugucugggagacgaggcagcgugcugguggcacaaccagccccgccccagcgugggcccacauggaccucccuucuauaggagucagggccuuccuuagcaacucacuucuuuaauuucagaauccacagagguaaguccagcuuagaccagggggcugaguucucucaaaugaaaucugugccaauauuuacuccaggaaggcaagagcccagcccuucaaggcuccugagaucaggaacggcuggugguuaggaggcgcucuccuggccgcucuagcuguguggggcacccccugcauauguggggcacacguggccuaugcacaccacccaccuacaagcuugggcggcuccagugggaaagacaggagagggaagcaacauuugauugaaucugagccaagagggccagaggcugaggaaggcacccccacagcagccuccugagcaaacagcaccugggggcucuacccaguugggacaaagggcgaggcucccagcaacaguaagggagauggcguccucugggagaggguggccugggguggggugacagggcuuccacgccaccacugcacccucggcaagaacgagcagauguggagaagaggaaugccaucaaugcgccccccaucucgggucccugugcuccccaccccacaguucuuccuggagggcccucugcacuccucccagcaggcugcucggcuccuugggccgcucugggaucccgucuggugccacuccugaggucggcacgucugcaucugcacuggcugcaggaggagaggcucccugcagggguaaggcagcaggcacuaaagggggaagggggcucugguggcccccgguaugugcgaggagggggugugcaggcggcgcagcauggcagcuggguguagaggacagcagcugcugggaagagcugcaguggagcccaggagguucugccgggggagcgucuggaggcagcggacgugcccggcgagcggucccucuggagaguccuugcaggucaccagcccugcagcucucucccuggccacgcaggaucuuugguuuaggccucgugggucccuucugccuccaguagggcagaugucugugaccagggccaugagcccagcgagguccccgugggaggguccacauccaggaagcuuggcccauuggcccagggccuugggggcgccuccccagccgauucaccuggguccucaugguggccacuuccugagccaggccugccagcgcuguggcgagccgauccagcuucuccgcaagggcagcaccgaggcugugcagcuccugcugcaggggcuucccacaguggcauggcggcugcagggaggaggcuggcaacacaggaggcgcagcuuccggagggggcagcuccggagggggagacucacugggcagcucaggcgggcccugggggagcagccucucaugggucuuggcuaaaaccagagcaaggaccggucagaguuccugguuuguaaggaccuuucucuccccagaggucccaugaaccaagggcgcucaguacucugccuccuccaaggcccagcuuccagaaaggaaggaaggugggugaggccugagaacgcagaugccaaugcuuauggcaugaaaacuggcuaugucuccuggcuguuccccaaacugaugggcaggaucaaccacagguuggguuuccgugguaaccaggcuuuccuaaacugcggucuucccaccuucuaggaaucggugggucuuuguguuguugaugagaccaaauggcacccugcccuaggagucagugagaaggguccagagcccccgagacagcaugaggccaaggccgugggagcaccaggagaugggccaggagggccaggcaagccaagggccuucugcgcauuuuuuguggggugacccuggggccacuccagaacucagugcucuucguuacaggcaaaccacaaggguucccacccccuucugcuuuuacucucccuauugagaaguuacagauucauaggagucauaagcuuuuuguuuuuuuuaaaaaaagaucaccuaauccuucgcccuaaauucccuuggaauuggucccaacccugggcaaaccacaggaaaggcuuggccaggcaccugccauuccuaaccuguucagccccaggccgggcgcagagaugguuucuucccuguuucucugggcccccagcuguggcucugcccugcucuuuucggcaccuccagggcuuuaaaccgaggaaaaagugaagacuggaguagcuaaaggacccaaccgcuguuuggucaaguucaucaauaaggaucucggccuggagaccccagcuaggacuucuacagaggacaggcaaggcucgguggccccaggcagcucagagcucacagcaaagugguggcgccuggacagaagccaacacccugagccaguaagagaaccugccgcaggccacacucaaaguuccugguguggggcuguccccaagugacccagggcacuaggugccaggcccccugcaugucuccaccaugaguccguagggcacgugugugacauggagccaacccucucacagugaccauggccaggucauccuagccucaguuuccucaccuauucucuaaaguccccucaagccccaaacuuugauccuucacuucucaauuuccaccucuaaaaggugugucugcuuuuaugaaaaucccaacugcuucugugauaaaacacugaaaggaaauaugcaaccugaagugcauuacaggugagacuuccuacccaucacucaaacacugacccuggaaggcuguuuuccccaagcuggggcucuggguccuggcccgugcagagggaaugggggaagccaccaguucaccugcaacucugggucuuccauguccaagcuccaggccucuggaugcuucacuaacccugggccuuuucuccagcugagaaaccgggcagggauccugagcuguaccuauagaaagagcacagagaccuuggggcagggagacgaucguuuggccagagccauucugacauacccuaaaacaauaucaaacucucaacuuuuaaacaaugauuaaaugagauagaagacggaaacuuggcccaugagggagccuaauucugguggcagggcccgccgcggugcgugugugugugguguuccugcccuguaugcagggggcuccggcaggaggaggcggcuggggaggcagcugggaaaaaggacucucaucugcggguccugccccagugagacuuccaagggcgugcuggggcauccugugguccacacccagcccacucugccauuuuccacuaggcccacugcggagugaagaauguggugcagccugggucuacacagaccagggccaaugccuguaaauggagccagcugcaggaguuggggagagcucccuccccugaccauuucuggccucuuccuccuucuccccugcuucucccuccuucuaccacugcuucucccuccucguccucguccuccagcacuccugagggggccaggacagcagguacucucuaaacucucuuuucucccaggcaacugggaccugucuccugucccaucugcuuuuucugcuaggagcaaacagugggucacagugagauugagaagcaagguggccuggggcaauaggcagcauucuagcuuuccuaaugggacacucuccaagaaguacccccagcuggggaaaucucacuuuugagacuuuuguuauugauugccaaguuuuaaaagcauacgcuauuauuguauaaauacauccacaucugucuacaugcacacguguauauuagcaagcgcaaacaccguguacguggcaucaagugaguggcucagaccucccugcagcugcucaccagcacccccagcagccccgcccuccuucucggacacagcucaccuuacagggaacuaaagcacggccaaugugcaggacucccuggcaagagccaggcaaagcgacaggcaggacucaaaggauccagucuggacuccugguccucuggggaacgcaugggcgcccccucaggagaccccaggcucaccugcaccgaggccgcugcaguaccugggcucuguucuccuggggucuucaccagggcugccgccacugcugccagcaggggucccaccaggacauggggacagagggacaggaggcuuacagcugggaaggcggucccucucuaacgucacaaacaaagcuggcaucagaguggugacuggcgcccuggcacacaucccgcuauccucccucuccgcacaggcucacccugggggagcggcuuccagagaucaggcucuggccucgggucuucuccuucagagccgcugaagcucgagcuggagccggggcuggggcuggggcuggggccucccacgcaggcgaagcgcaagggccuuacaggcaagaucccccucagggcgcucuccaggcagugcagcggggagggcuugggggcagacccugggcaggggaccagagagugcucugucaucagccugaagagagccaggucucugccuuagugucugggcacacagaaccgguccccuuuucagcucagcccacgaucagcaugcguucuaguggacccuaaauggcugccucucuugccagagaaagaggacaaaagugaagccagagccuggccaggaccccagcagcuuuggaaagucugcuggggaacuuucuggaagucuccaguccuuggaagccauuagcagucagguucuagccaggccuaggucucacaggccaggcggcuucucccaccaggcaggugccaucccugcaccccaguaucucacaggggccagcagcccaaggguggggcucaguuagggcccauccucgucugaugggagggucagcaaaaccgcauuuauucagcaaaggcaucccagcaggcccugcagcagaucuaggaaggaauucugcuggaaguuaaaccaagcagcagcaguggacggcgggagcccccucaagaagcuucuccacuggagaaacccaauggauggacacaaacaaugaucuucccgaccccgcuccuugucagcacuuugugacacuuuaucuucuuguuuagcgaaccucaguuucuguuuggcaccagcuucuguccucuggggaaaggaugagagauggggaagaaacagagggacagagagggaagucuauuuccuugucaaacacuuuaacugaaguggggcugucaguaccgagggcaggugccagcucacccucugggagccaccuccacacuccuggccugguggccccagggucuuugaacccccgcugguggcaggcggggacgcagcuggaggugaacaccugugggcugaccagauggaggcuccgggugggcgcuucuccccuacccugcccgagacggcugacucgcaggccucagcccucaguccuguuuuaaugagaaaucagaaggccugucagccccacggggccucgugcugccacagaagaagggacagggaacaguuucugccauugcugggcucucaggcacaccagcaucaggugugggaaacacccaucugucauguuccagggagcgccugaacccuccagaacaucucuauucccagacccagcugcguggaccccugggcuuggagacuggugcccagacaccaaggcucguggggcuggcacggccgggacaaggacacccagccacaaggagccagcuccagcugggaugguggaaccgcagacaguggcacuaaggugccagcaggucuacacgugugugcugcagacuaucuggcuuucuggccuccaacaaggcucugcccaggucuguuuccagagcaccauguuggcucaggagcagaucugagcccacaggugcagcgccuagggcauccucagagcagcccugucuacacccagggccccggcagccacuauuaccuuccuugucugcuguccaguuccugggcucugcucuccucgguccccugucugcugcugaggagcagggccaggcaggccgcagcacaggcacagguaucuccuugagacaauucuccagacccugcaguggggagcuuccuggugggcuuccugugaagaucaaacauucacagaugagggggacuguagcucaaucucugcaaacugcagaagcccccugucuucugcuguguccagggaaggggggucacaggggugcugggcacagagcacuggacgugucaguccuggcucuggcgcggcccugcuuuggcugccguggaagaagccuggccuguccuggccacccacauagaagccuggccugcggcugucaugagggcguuggccacaggugugggcucuaguccuccucagcacacccagcugccaccaccgugagggaugacacauccuguguccccagcacaggggauggucccacagauggaaugugcuaagacuuccuucaccacucacagcagggcaacaacacaggcccccuggccucugggccauggcgggccaacaugcaugcaauuucaacuaggaaagaacuaaacacacugcaaacauccuauuuccagugacagcugugcgaguaacaggaacuagauggacugaaacucuagagugaggagagcccuuccuaauaaagcagacagugcugccacucucuuucccgacagcauuugcugacgacucugggcccaggcacagggcgggagggcaaccucagaacuucugaauguccacaggcuggaagggcagagaccagcccuuccagaccaggaagggcuggaaaccagaggacccccacaugcauuuucuccacagcacguucgcugaguucuggggcaacagagggagccgggaguuggcuggaagcuucugacaggcagugugaaauauccugcaguuuggguuacuuaguaaacaaagucugcccaggcagaacacaugaagcaugcuaccgaauaccacgcugcuguccaaaagaagaaacuggugcuaguggccaaggaacaugaaaaguauagaaaggggucaaagacaaaugcugacgacaaaggcagccuggagggggcauguauagaugcugcccucugugugaggaggaggaggggagugaacucacagcaguggcaggaggggcuggagugccgaaggcuucauuuucccuacauaaccuuuuauagcuuuugaacaaagcuaugugaucauauuaccuaugaagucaguugcacuauaggggaaaagccccacacccaagcggcuaacccauaguggggcuugggaauucaggcugcuguggacacuggcaggccccaggccuguucuacaggccccacaggccuggccagagcuguggcugcugugagaggccuguucaguaaauacauuggcagucaggacacaggugagcacggagggaguggugucggcaggacaacacagaccaagaggacucggauuaaccaggugggggaaauaaaaaggccaagaggggaugcuggaguccugcaagauccccaagucugcaggagcaacucgacuggagugagccggggaggcacaggucaccaagcacacgcugaaauguuucugacaugaaccucacuguauguuuuccuaaguugggggucaguuugauauuacaggcaauucuuuguggcugggguaaggaauucaaugcaaaaaggaaauuuuuauguauuuauuuuugagaugggggucucacucugucacccaugcuggagugcaguggugugaacauagcucacugcagccucaaacgcuggggcucaagugauccccugccucagccuccugaguagcuggacuacagacuacaggugcuacuccacccagauaauuuuuuaaaucuucuguacaggcugggcgcgguggcucauccccauaaucccagcacuuugggaggcugaggcgggcagauugccuguggucaggaguucgagaccagccuggccaacauggcgaaacuucuucucuacuaaaaacacaaagauuagcugggcacgguggcggacaccuauaaccccagcuacucgggagacuguggcaggagaaucgcuugaacccaggagguggagguugcagugagccgagauugugccacugcacuccagccuaggcaacaggaguuagacucgucucaaaaaaaaaaaaaaaaaauucuguauagacggagucuuacuauguugcccaggcuggucucaaacuccuggccucaacugaucuuccugccucagccucccaaagugcugggaguacaggcgugagccacugugcccagcccaaaaagauuuuaaaagaaaucuuagacauuguccugucccuucuaagacaagucacuaaaacggagcccccucuccacccuaggcucccacaacccacccaagauaagucccgcaucugcuccugccucaguaucccuggcucugcucccagcacgggcaugggggucugacccagucaagccagagggacugggcaaggggccuugaguccucucccaggaugaaccccagccucgggcuggcccagcucaccuuuuccaggaugcugccccugguuccccacaggacucccaaaauccaggucccagucggugcugcuggaugaggagaagcugguggggguuccucggggggccaggggccugcuggggccaucucucacacagcucugcagacccagaggcagaacaggcucucuggucgcuucuguagggaacagcacaguuguggucaccaggaggcucacuggagaagagacuccugggccauggggugcacgggcaccagaagacccugccccaaaguaucucccacuaggguuucccuguggcacugauucaacucccauagcacgugacccacagaaaccccacagugagucucgugacuggagagaguucugagagaaggaaguagggcaggaagaucugcacuggcuuucagcacaugcgggcggcuguuugggagugaguaugaaaggcagccugggggaacgggccugugucucaggaggccggggaacacaaugacccgacaguccucagcaucugccuccgcugccacgcucagggacaugccaccccgcgcccauggccacaaucuaccuucacugugugaucugugggguugcaguucaggcuucugagaccuagagucuccuggcuggggguucugggaacaagaaguggguggcagcugggaaggugacgacccauuugggggaaugcccuucagacaggcuuccagggcuuccagcggugagcuugaggcacuggcagcuggaacaggagagagcacccuguuaccaucucccacacauuccagccuugcccaucagaccccuggcuggcucuacccgacgugcuuucuacaggggugacgaguccuguaccaggcucuggcaccugccaggcaggaaacccuucugugggagacugaucggcucucgccccccacccugcucccuggaaggcaugaagacaggaggggagugaggagggccacaugucagcagggguagcuuucagggccaggaaucacugcaaaacgaaggccccgaggcagcgggggcuuggacaaaggccugggcugaggaggcuguggaugaagggauucacugcuugggaagaaaggccagggggcggcucccugcugagagcugcuucccugggguuaguggaaccuugccagggacugacaagcccauggggaagaccaccagagcagccaaucucaggccucaccuugagccucagggccccagcuggguugggggaccccucuggugucuccaguggcugagggacugaggggcugccugccaggcugacaggaugcagguccuggggggcucuggacccagcuguucuccaucuucacagagagcagaccgccagcuccaagaucaggauggggaggaggggucaggagguauccaggcccugcgggaggaggccauugggaagcccaagguucaggccuggacucacccugagaaucccuugaggccuuuauaggguuaggaggggcuuccaaagccccugugccuccacggcagucaccggcucagacugcugucacuugucaaucaccagcagagaccugagucacacgccuccuccccuaccauggccccuuggggugccuccaagguuucuaccaggcaugaagucagcccuccccagacagcaccaaucaugucuuucuccauggccagcacaccugacucaacccagcugcucagggcuuuguucugagaagcuaacaagcugaggugacaugcacggaacacgaaccccugugugggcuggguggguauaauuaggauuugggguucccagcucucacacacauggcagaaaccugacccaaacacacaggaccccaagccacaaugaggagcugcgugugugcugggcuagagcuccauccucuauuucuugaucucgcucccuccccacuuuccuuucagaauguccagcuccuccucuaagagccagccugagaauuaucaagcgcugaccgagccccucccacacagcucgcuccacuuacacaguggggaucccccgcauccggauccucuucccgacaggccaauaugggggccugaguguuuguggugggggccaccuacagcccugccuggggcaggguaauguaggaugucugggggcccucccagcccagcgagaagccuuuaccuccagaaccccuuuuccaggcuccuggauucuccuguagccgucgguuccccacuccugagggacugggaugccuguccugggccucggggagcuccuucagacaguguagcagacccuggaggggacaauccccugaaaccgccucggucuucacuaaggaaaaaggaacauguuuucaccuggagcucaguguccucagccuucaugacaaacaacaaacaggggacaaguuagaagggcguggggccaacucugaagaugaggcucuuccaguggcucgcugagucuucccagugccuggguccacacaccugccagaaccggacagggcaaagagggaagccauggaauucgcccugcaggcagacaaguggcaucacucugaggacaaauugaaggaagugggcugucagggucacuguuugagacagcucugggguccugaacagaacuuacauuugaggaaaauggaguuguacaguaaguacauuacugcagcuaagcucacugcggcccugugagugggaacagccuaggcucaaggcaucaggagccucuccgggucugacuccaagaccugugccccggccccuccaccaugcuguccagagcccaagcccaccccaugcaucaugccuggcgucaaugcaaagcaacacaugagcucugcagcucuuccccucgggucccaagucaggaggaggaagagacaugaagaaaccagggcaaagccugcuuccgaguuuccuuuucccagcugaccaaacgcugcccuuaagagagccaccuggcuccagaaaggugacacuggcaacacagcagcgaccaagcugguaacgaucccuaagggagacaguuuggagcaggaggaaucgcuguugaaaugcaaaccaagcuucagagaccucagccugaggccccagaacucaccugcccagggcgggcucccaggccccaggucugcucugguuagccuggacgugcccaggcuagggagagguggcaagaagcuuggggaugucucggggugccggggcccaggcacaaggauuuccuucagacaguugaugaggccuugcaaggggcuguucccaggagaaauuccuguggcacaugcaaggugggccugggucagugcaguccugacgggacaccgggagcgcuggcaggcauucaggucuccgggcggcugagauucccacccgugagaaugcagacaaggccugcccgguggagcugccaccaggcccaggcggcggagcagcaugaccuccucgugugaacuaaacacacuuccccaucgcuaccccacuaaggaaagcccgccucucaccggccucugaggucccucucuccuguccucuguggcucuuccuccugcuggggcuaugggugggagggcugggcuccccgcccagggcuccugggccuuccuuccuuguaggccacgguuugucggcaguuucuguugcaggagaagacaagagggccuuucuagccccagcuccagacucuggaaaaucacaccagaucugguucccauagaggacagcccucuccagccacccaagucccuguucgaggugggcugagggccuuuaccguuucuuucugguuuaacuggaaacagcaagacuguugguucacugugaacacucccagacccuucccccugagcccagccucggaauuuggcucaggaagugaugccggcagccuugacauguaggccacaaucucacacucacgcuucucaaaccagggcacacacagggcacacagaaccccagagcaagugugcccgacgaccccugaacaccagaugaaaccacagcuaaaugggguaugcucuuugggagugccaauuuuauuccauauaaauuugaaguacuuuuuuauaaaaacagacaugcaaaauuugugagaaguuuuaaaaauaaaaugagaccccagagaaauccuaggagcuccccuugcccugcucugcaguuaggguugcugugaugagacggucuaaggaucagaccagugcacacagguaggucaaugcugcuggccgugggccugcauguuagaaacugccggagacuuucuguguacaaagugcucagugaucggggcgggaugacaggcuccccaggggcugagcaucaugccuccucuuuggugguuacaccagaggcuaaauauguuguccugcucccuggcguacuuuguuaacaaaagaacagcacaacaggggaacugaguccuagaaaaaaaugaagagggcacaggguccagguccucugacgccacgaucagggcuuuugaaaugcugguucucccugucccugcugugucagacucacugauggggagaggacuucccuggaccccgucaccaguugggccacuggaacacgagcugucggugggcgugguggccagguggggcuggcugguagggccgucuggaaggcagcugagcaggccucggagagggcagggcucucuugccgcagcugcugucgggaaagagggagaaucaacaacugguaagaugccccuaacauugucacacugucacauucuggguccuuuccuugccauguacuaacaaugaccaggaugucagccaccuauguguugucaucacugggcucugaauggggccaugguggguggagggugacaaagccacacagaaaccaccaugcgaaagucagagcugcccucucgccagcuaugggcaugugcucagagggcggcacacggccuagccacgaggaacagcaggugacucugccucccggccugugccugcaagcccacaugcagugcagugccguggacuugugcuucaucaugcggagugcagaggaggcugcgugcacugccccacugucugacuuacccucggggcucgcucucucuccauccaggcuggcuccccggcucucgcucucggggcuguccauagcgcccuugacuucuccaaacaagaacucugggaucuccuucaccagcugcaccagggcugugaggugcaggcugugccggggcugucccccugcagagaggccacagugacccccccgcaccccugcggcugcucagcacucacaccuacgugcguguuuucacacccagcaucucacguaauccucccagccacaugaggagcagccagaggagacaccaugucccaugagauauagaggaccugggcucaggccaggcgcucuggccaagggacagccagggcaugggggcggggccuggguaacagggcuccucuguucuacguuacucauuaaucuccaugccucccaggggaaugcccaggcgggcugccgcuacacuucuuccaccaucugggcccucugccuuuccuggcacccccuaaaugccuggccuugcccagucugggccgguggagcacauccaccaucugaggucuugggauguaagccucguggcaggacuuuugggagcuggagcagguucugcagggguggcugugauaaggcuucaggguggugguggguggggggccugaggcaggagguacucuccagggugaccccaggcuuucucugagugcuucucugcauaacaggcuuccagcccagagggaugaggggugaaagcuugggagguugcaguaggggaggcagggaggugagaggcuggacugaguaggcugaggucacgcauugccuggggcugaggaccgaugagugggaggagacacccaaagucugacagauaacuuacccuggggaucuccacaaccagcaggcuccugccccucaucagcguggcucccucccccaacagcucuuccaggcucugagggugacaggaaagcagagagggggagcagcucagcugucccugggaaagaagagggaacuguggcccugggaauggaguggucuccgcuucgcacacaguugcauagcagcccaggccccugcaggucugugcacauucaugugaccacuuaaacucaaagaaccgcagaguggucggaaccucagaggccgccgcauacccccaccgaauuguaccuagaacccggucccgggacauagaauagcagcagcgugaacgauccccguguucauuucucagguggaaagacuaaggcugccggguccagggacuccggccucccuuccaccgcccaccaggcuccugccacacgugcugcucccucccguccuuacccacagagaccagcgucucguaguucucccgcaucacgucucgguagaacucccucugccccuccuccaggagccgccacuccuccuccgagaaccgcacggccaaguccuugaaggugauggacaccugcaggcacagucuccggggggguugguuguuccaucccagaggggacagccuagcugucccugcacuugguaaccccaccuaggccuccaggcgcacacuccaggauaauagccagggucugacaugcaggaauccccucaagagacagugcugggggugagcugugucucugcagagacacgcugaaguccuaacccucacgccuguaaguaggaccuuauuuagaaacagagucccugcagauggaauuacuuaagaugaggucauacuccuaaguaggggggacccuuaguccaguaugacucauuccuuaucagaagagacacagagacagacacaaaagaagaaagcugugugaagacaggcagagacuacagucaugcagccacaagccaaggaaugcccagggccaccagaagccacaagaggcaagaaggauccuggcccagagccuucagagggaguguggccugcccacacugugacguagggcuucgggucugcagggcugugagagaagacauucuugcuguccaccuaguuugugugcuggguuuagagaagugcucagaagaaaccugggguugcccuuggaagcuuugggucaccaggcuccuuuacacccuguacuccuaucuccuauucucuguacucaucuccuccuacccuguggcuuuuuaaaauaacacgagcauuuuugucuauguuucuuuacaaaauaauccuucggcugggugugguggcucacgccuguaaucccagcacuucggggggccaaggcagacagaucaccugagaucaggaguucgagaccaggcuggccaauauggugaaaccuugucucuacuaaaaaugcaaaaauuaggugugguggugggcgccuguaaucucagcuacucaggaggcugaggcaggagaauugcuugaccucggaaggcagagguugcagugagccgagaucacgccauugcacuccagucugggcaauauggcgagacuccaucucaaaaaaaaaaaaaaaaaaaaaaaguccuucaguggacuuuaaaguggccaucagacacuagaaaaugaccagcaucaauaggcuugaauuuaaaauuauggcaaaaauuaacugugcaaauuaagcaaacagaagguaaauuaugggaaggguccuuccuguugagaaaugaauguuaaacuguuuauuugugagaacaaauuauuaaagaaaaugaacacgccccuaauaaagcaaagacaauucaccgcuuguuucaucugcucagggcaguuauuuuaauuaauuaauuaaaaaagacaggaccuuacuauguugcccaggccagucuugaacuccugggcucaagugguucucccacauuggucucccaaagugcuaggauuacaggcgugagccccugcacccacccaagucagugauucuaaaaacugucccaggcugggugugaugguucacgccuguaaucccagcacuuugggaggcccagguggguggaucaccugaggucaggaguucaagaccagccuggccaacauggugaaaccccaucucuaauaaaauacaaaaauuagccaggcaugguggugggugucuguaaucacagcuacuugggaggcugaggcaggagaaccuggaaggcagaauuugcagugugccaaggucacaacauuguacuccagccccuguuucaagaaaaacaaaaaacugucccugccacuaaccggcagccuuguuguccacuuacugccgggcucucugccuguucucccugaacagcugauaacuugucccaugcagucacacuuaccagugcuccccucuggccaggcugcaucuacaccccuggcaaggggcagccccucccgugacugccugccugaggcccggaggcccagaggcugaugggcagugagaugcugcagccuuugccuccugccucgaugugcagacucucccugagcaaaccucuguggcucuggcccagguauggucacucccucucaggaacagucucagacacccuccaaaacuucucucaaagaguuauuuacauuucuuccuagcaucuuggaacagagaaaauguagccaacaucagggucuaugcagaagagcgugcagagcagcccuagaccgcuguccuuaggaaggccugcuugccaggagggcucaggcuggcuuccagguauuuaggugucaggaggcuucccaccauucccuaaaugaugggaguggcucaaggugccuaggcugagcaaaugacguggugugugccacaccccugcuuuccuucugggagucuggaauuuugguucauggcaggcagaggguucccacaugacauucugauggcucaacacagagcuggcaaggcaggucugagcucuagguaagaacaugauaccagcuauguugguugcacugguaccacugcugaccugauguggccauuaagagguuccggacccagagaccggggcagagcacggugacuggggccuagccucaggagccaggcugccagaauuccaaucccugccuuguuucauacuaguuaugagaccucagccaaaccuaaccuauuugggccucagugaacucaucuguaauacugggaucauaacaaccuaccucauagagguauugugaagacaaaacaaauacaggaauagugccuagaacaaaugcggggacuaugaauauuaagugcuaugauuaguaauacugcagccagaccugucugccuaaugcccgcuugcaggucugagccugccagcugagcucuuccacauacugcuccugaccaccggugucucucucgcuccagacuaaauauaucccagcucuuccaggaaucuguaagagaugcuuuccaggccucucaccaucucagccucaagacaaacuguuuugugauaaaauucuuagaaaaugagaaugggaacugacuguggccaggguaggcgcuucugccaguggccucccucuccccagaaaaagcaaagagugaggguuuugugugugagggagugagcaagugugagugugcaaacaccugggcuacaaaacucaucuucgggaggaggaaggccaccacuggcuggcucugcccacacaccaccggccuuccuccucgggccccacuucaccuccuucccccaaccaauggagaaaagcuuucugggcugacccaggacucuuguaacugggcagccuccuagcucauagcugcacacugguccuccuaacaucacccuuccaccgugucacuagcccagcacaaaaacugcagcuucagugccugcuggaccugccccucucucacaguccuucccaaccuagaccugcucucccagugggccucaggcucgggcucccugaucagacccugccacaggaccucucaaccuggaggcugugcucacauugcccugggcuucugggaacccucccugcuccucuccaccuuacagugaccuaccacuccccaaggucacuccuggccaccuucuccaugaagcuacguagugugaggauauuccccucaucagaucugaaaggucaauggcccaaacuccucacuuuacagaacaggaaacugugguaugaggaggccuuaggauggggccaugggcaugucugaaccagggugucccuaggcuacuuaacugugcagccagaccugaaaaggacacuugacugucccugcccaacaacauccaauuugccuagccucucccuucuccccaaaugcuugggggcacuaaugacgccaagggccuggcacaguguuugcucugccuagucacacgcugccccccauccauggcugccucggacuggccaaagcucaggagccaccacgguugcagaacuggcuccaggugcccauccagaagaacguggagcaguugcugguaucagcaccagauaccugauaccucacugauaucagcaccagaguuucccagcaucgucacagcccacacacaaccuagcccaaacggugcccaggcugucacggccuggggcucucccuccaguucucagaucuaaacgccuuaccugcaggcuucccaagacaaaacuugggguuuguucuaucuuuguuucuccccauuuccacguccccagcccccgggauccaggauuccaccaagaacagaaguaugagauuuacucacugccuccgaggccuucaugcccacucuaccaggauaacuuguaacgaaacaagccacgccaaggggguuuccccagguggagacugggccguggguaccggcggcggagagcuggagagagguuguccgaggaccugaacuucccggcacgaaccccugagcaucaggccugcccagccucacccagccgaucccgaaguugcgggggggucccagcucuuucucgcccuaccgccuucggggccgcacugcgccgagggguccgcgcguccgccugccuuaccuggcgcgccauccccgggcucagccuccccgccacuccucgguuuccggcgcgggcccuggcgcgggcgcacgcgacccucgucggcggcggcccagguccgcgcaggagaaggcggggccgggggccugggccgagggggaggggcgggggugggcgcgcccgggcccgcccccggccucguugagcccgccccgagcgccucgcaucccuugguggguggugccguuuccgcccggagcccccggcuucggcggcccggccggccggcgcagacgcggacuacacuucccagaaggcgccgcggcgccggcu

SEQ ID NO: 14627 - RNA, 20387 nt, Homo sapiens
ccucccuccgcggccgcgagcacccucccuuggcacccuuccccgcagcccgagugccuguccuccccagccuccucgcccuccuccacccccucucccaucacccuccccuccccuccccuccccucccccguccugagcucccacuuccacaccuacuccaggcucggagccuuaggaccaucaccugcccaccuaagcccacggugcucccuccugggaccccacuccugaaacccccugccccugccucccccagcccggugcgccggggcucuccgcccgcucccucggucccuccucccuugcaggcgccguuucccggcuucgacuccccgcgcgucuaucccucuccuccccgcgaaguuucggggcugucagucugucagucuuucaggccgucagcacccgagcugcaggcggcgagcgccauugugagcagagccggcggggcaggaggcccgggcgccuggguccccgcggcgcgggcggagcggccggccagccagguaagggccggggaggcuccucugcaggcggccccgcccgcgucucccucagcgccgcgguugggucacggccggcuccgcgcaggugacagccccggggguaggggcgcggacggcgggcgugggggaggggcgcggguccggggaggucgggggcuggggggaagggagggcaaggccggcgcgggcagggugagggcuguggggguagaggagaccgggggggcuggagggaagggcgggggcugggagggggucgggcgggaggcaggugggaagggggacgacgggccccgaggggaggagagagggagugugggagggggccgagggggaaggggaggaagaagcgggcgcuggggaccgggccacucgguaggggcgggagaggagggcgcugacaggugagccccggagcuggggagggggccgggaccuggaaugaagucggcgaucggagcugcuugggagggcggcggggcagggagguggagcugagggucccgucgggaggaaaacuugggaggggugagaaguccgaggggagcagaaauagggagggggcgccgcggcggagaagagaggcgcggagggguguucggaggggagacggaguggggagggcagggcccgcgggaaggucccgagagagcgggucagcccuagacccccaggcuugggggccggaggacccgggagcugggaagcagccugggaggggggaggggaagagcgguucuggggacuggggacggggagggaagcgaagcuggagccugcuggggagacagagggggaagggaggcgggggccucggaggggaaggagagcugcagaagggaggggggagggggagggcgguggggagacgugggggagggcuggaaagggggaggggaagggaaccgaggugaggcgaggaaaggagaaggaagggaaaccggggugggggaggagaggagggaggggagaggagaacuggguuggggaaaagagcugagaggaggagggcggggguuggcgaggaaggaaaagaggagggggaaaggaagggagagggugugcagccggggagggagauggagcgggggagaaccgggaggguagggaaaggcagccuggagucugagagggggaggggagcgcugccgccgaggcggcccggagcguagggucaggggaggcgguggcagcggagggccgacccggacggggccucgagggguuggcccugccgggcucgggcgggcggagccugaggggcggggccgggggcggagccgaggcgccggcccgauucgcaggggagagagggcggaaggcagagggagcgggaggggcggggcagagggaaggcugccggggagaugggggaggggagucugcugggggaggggcgggggagccgcggaaggcggagcagggaaggggcagcaggggcgguguccgggccuugggcagcccggcacgggugagaggugguuuugugguagggguuuaggaagaggcgaucauuuucuagcuacaagaggauccucucgaggaccuccccaagcaguaccccuaaagugacacucacucccgccccugggcuggcuccuauuucaccagcucgggcagugacagcuggaggaccugggagaugaaguuucccacuccccacccugggcucccacccucaagccucuccccagagaaucgaaucuugccugcacuuucccaggcaaggacgcuggggcguggaguugcggugcugaugggccgggguuggcggugacagaccugccaggugaggggguggcgcggcugguuuccagagcugacagaaaucguuucaaggccuucuugggccaccuucaaagaucucuuggcuuggcuuucuaaacccaguuucccaaauuucccccagcuguaccuggggaugucaccuuuggagcuccuggaagagcccauagggagagguugggcagagccagggcccagguggaagcuggcgugggaaaaaucugaacaaggcugucuuuucuccauagguucuguggccugauccccaggaggagcuacucuggguuaccaugagagagaccuuggaggcccucagcucccugggugagcuggcagaaaugaagggacuuggggaaaagcuuaggaggauucaggggcaucuacaacucagacagcagagccacccucaggaggcugcaacccugaggccccaggggccuguaggucagccuccuuuucuguagcacggggugucugaaugccuggaacaugguggaggcugcgcucuagaccauaugugcacuugagcacucacagagcacagucauauuuacaucuaugccaucucuuccuucuguccuuuuugacucaacucaaagggacugagguugauaccugucccuguccauguggugagagacccuguccuuccugagcagguugggaaaagucucuugggcaggcugggaaggggaacagcccccgccucugauuacuuguucuguacuggaugcuuuacuuggacccauccuucugccuguaacaggauucucugugggacagccagagauggccccccaaagugagcccagggaaggaucccauaaugcccaggagcagauguccucuucuagggaagagagagcacugggggugugcucagguagguaacaggaacccuggaaaggcucagggaggagucccccugcuuuccuccugcccucccuaccucucucccuucuucccuccccccucccucccucccuuccuucuuuccuuccuuccuuccauucaucaaauauuuauugagcaccuauuaugugugggaugcuauucuaaacauuuggaauaccucagugaccaaauagucaaagaucccuaccuucaagagcuuaauccuaaugagugcagagagucagcaaacaauaaauaaggaaauuucuaaacuauguucaaaggugauaagagcucugggggagaggauaauguccagugaagcagguugaagggggccgagacagcugcagguggggguggguggggcauguuauaggauuaaauagggugaggagacuggguuucuuugggaagguaagauuugugcaggauuugaaggagcuuggggaagccgggcaugguggcuuaugccuguauucucagcccuuugggaggccaagguggaaggauugcuugagccccauucgagaccagccuaggcaacauggcaagacccugucuccacaaaaaauuaaaaguuagcuggaugugguggcucaugccuguguucccagcuacuugggaggcuggggcaggaggaucccuugaagcccaggcugcagugagguaugaucgugccacugcacuccagccugggugacagagaggaccuuucucuaaaaaaagaaaaauaaaagaggugaaggcggcagcucagcagauuugggaaaagugcuucaggcaggaguacagccaggacagagcacuaaggcaggaaugugccuggcuuuugacauccugauucuccccagugauuugcuuggaaccaggguccaucugggggcugggaaguccccagcccuucuccuaggggcaucaggucaggggacuuccuugcuuccacugucuuacauacacauauuccaggaacucuucacagugguggcucuuguaaccuuguaguccaucucauuacauacccuuagcagccgcccugcuugaaggagucugaggcagccccagggaagcugggaacucagccccuuaauucagguaggaugugggaggaacccugugggcccugcuggagccaggguuucaaaugcuccugcuucccagcaccaguggggcccuuuggccaucugugaugucuccagaguccuugagguauccuauucucugccagggcacgaggccccuacaccggaggaaggugcccacacagaacaagccgaggcucccugcagaggccaggcgugcucagcacagaaggcucagccuguggguaccugcccaggugagucuucccaucacuucaucccaccacgggcucaggccaagggaacggggcccagcaagcuccggagcugcuaucucaugaggcagguaaucccccaagacaggcaguccaggcccuucuaacccaaguugaguucaggcccuggcaccuuucugcuguggagcuucaaugccgaaagggaauuucacaucuguagauggcaggagucagagaggcuggucaccaaagagaaacacagccuccccucaaaugccuucuagaaauccuaccucccccucuuuauuucucccagucuaagucuaauuacaguugccaugaagauacauggcuuugaucaacauuuucacugccucuccccugacaugccgccuuccccagcuuccacugaucgugaggguacccagaugcuccacaucugcuguauucaacucaucuccucauacccagggugaucaaacugcucacucucucucaacaaucccaccaugacuuccuuccacugccaccauccuuacuaccuuuugccugagggauaucauuuauucagcaaggauuuauugagugccgacuacauacaggcuguguuaaguacaguggaaagagaugaacuguagaguuaccuggaccugguuugaaucuuuguucugcauuuacuagcugagugcccuuggauaggccaccuugccuccaggagcuucgguuugugaagguuugugacaguguguguacaacacuucaucuacaguugguccucgagaaguggcagcaguccccauuuuuaucagacacauaaagacaccuuucuuauuagacacaaaagaaauggaacacaaaauguccauaccucagaagagaaaaucugguugagaugaccuuaauaugagcuagaacaaagaauuaaaagaacaguauaaaggcaagucacaaauaagcacaaaaguguuaacaguaagugcuauaggaguuuaugccaaaagauccgcaugcacugggaauuugucaaaaaacauuaauuugugcugcauuuuaagaaagguguagacuucaguucugaaaggggugggguggaggaugggaagacguucuaggcugagaagaucuugaagcaggaaaggggaggagagcagcuuggcugaaguggaagguccaugccugggagaaagaaaguuggacuaggguggggugagccucagaugcagcuagaaccuguuuuaucuucaaauaauagggugcugggcugggcacuguggcucaugccuguaaucccagcgacucaggaagcuggggugggagaacugcuugaggccaggauuucaagaccagccugggcaacacagcgagaccccaucucugaaaaaguaagaaauauuagcugggcauguuggugcacacccauagucacagcugcuugggaggcugagguaagaggaucacuugggcccagguguuugaggcugcaaugagucauuaucgucccauugcacuccagccugggagacagagcaagacccugacucaauuaaaaauaaauaaauaggagcuauugaugguucuugaguagaaaaguaaagagugccacaaugaaggugaaagcaguaucacagugugauaaguagacaggggucuggaaucaauggacugauagaagaaacugggaguaccucugauuguggaaguccacgugugauggaaucaaggcucaggccagacaggaacccaaauuaucugcuuaaaugauucacaaaugagaaucacuuugggagcuuuaaagaugagaacacguucgugggccuugcccccauuugugcauuuucucaacguuucccaggagcugaugaugcagcacaggcgugggagcuuuaaacuaguccaacucuuacacaaagggcaaauuuucuuagcggacuaagaaauguaacucaaagagguuaagugacugaaccaaagucacacuccuaguuagugacagaggagaaccuaaguuggacccucccgucuggaccccgggcuccuuccucuaggcuggaccauugcagcacccgacaggggcaacacuccagcggaauccccugcaaccugcccuuaggcugaggcuucccuagagggccuucccuguuucuccagagccaguguucacuaguuccccagacccuguaaacuccaucguggucuuccuaaaugggacuucuccucaggcuguccagcaggaaagaagggaguagcaggaauacguggguacccugguuccguggccacuagagguaaggugggcuggggguagggguuagagagcaagagaagcagcccaggugagaugucaaagaucaaguuuucaaggccaccagggaaggaggcucuaguccuaagguuaaagucagccagggcucaguuugggaagcucagguguguggugagaaagcugcugagcugcggccaguuugcaguaccaaggagagcugcuggaccagagauggagacugaggucccagaaaggcacugcuggagcaggaagaucugggccagccaccaaagggaugugaaccuggagcgaagcaggaggacugaaacuugggcaaccuuccucuucaggggugcuggagggcuccugggcacauccaggccggggaagaagcccccgggagccgugugguguucacacgcaucacagguucaggagaaugcaggagggggccugagaagagcugcggauuuggucacucccgggaagcguuagguagaguggagagcagagccagaccgcggggcuccaggaaguggagauccugugguuaaauagacguugccgcacguggagcucaauagacaauucuuguuuugacuuuccaggagaggaguggaugauucggaaggugaagguggaggacgaagaucaggaggcagaagaggaggucgaauggccccagcaucuaucguuacuucccagccccuuucccgcgccugaccuggggcaucuggcugccgcguacaaacuggagccaggggccccgggggcacugagugggcucgcgcugucugggugggguccgaugccggagaagcccuacggcugcggggagugugagcggcgcuuccgggaccagcugacguugcgacugcaccagcggcugcaccggggcgagggccccugcgccugcccggacugcggccgcagcuucacgcagcgcgcccacaugcuacugcaucagcgcagccaccgcggcgagcggccuuucccgugcuccgagugcgacaagcgcuucagcaagaaggcccaucugacccgccaccugcgcacgcacacgggcgagcggcccuacccgugcgcggagugcggcaagcgcuucagccagaagauccaccugggcucgcaccaaaagacccacaccggcgagcggcccuuccccugcacggaaugcgagaagcgcuuucgcaagaagacgcacuugauucggcaccagcgcauccauacgggcgagaggcccuaccagugcgcacagugcgcacgcagcuucacgcacaagcagcacuuggugcggcaccaaagggugcaccagacggccggcccggccaggcccucucccgacucguccgcuucuccucauuccacugccccguccccgaccccauccuuucccgggccaaagccuuucgcgugcuccgacugcggcuugagcuucggcuggaaaaagaaccucgccacgcaccagugucugcaccgcagcgagggucgccccuuugggugcgaugagugcgcacugggcgccaccguggaugcccccgccgccaagccccuggccagcgcgccuggcggaccgggcugcggcccaggauccgaucccguggugccccagcgcgcccccucgggcgagcgguccuucuucugcccggacugcgggcgcggcuucucccaugggcagcaccuggcgcggcacccgcgcgugcacacgggcgaacggcccuucgccugcacgcagugugaccgccgcuucggcucgcggccuaaucuggucgcccacuccagggcccacagcggcgccaggccuuucgccugcgcucagugcggccgccgcuucagccgcaagucgcaccugggccgccaccaggcggugcacacuggcagccgcccccacgccugcgccgucugcgcccgcagcuucagcuccaaaaccaaccuaguccgccaccaggcgauccacacaggcucccgccccuucuccugcccgcagugcggaaagagcuucagccgcaagacccaccuggugcggcaccagcucauucacggcgaagccgcccacgcggccccggacgccgcccuugcggccccagccugguccgcuccccccgagguggcgccgcccccgcucuucuucugagccuaguucucacgaggacccuuucuugcccacaguuucgagaggcccgugccaugagaccgccuggggugagcaaggcgaccugggcugcugcccgaagguuuggccgccgcgggacaccuguuuccuucccgcagugucugcguccgcacagcauacccagcucggaccuccuaggacagagacucagcgaacccuugcugggaaccgcugagcugaaguucuuggaaggcucccacccaggugccccguuggaaagcagauauuucccggacccagcgcggccucaaccagggcaggaaagagugguuauuuauguacuuaaaguuucauuaaaguuaaaaucggaaaguucuggggcugcuaaaugaauugggggagggaacaccugacucuccuuagccacugucccaccuccauccacacacagaccaccccccuccacuuccccuucuguccugggugaguuacauuuagccagcugcuguuaauugguucucccaaauaaaaauguaauauauuuauucacuaagccaccauccuggcuccugcuucuagcucggaaguauaaggaaggaagauuggggugcauuucucucacgccacgugucaccgacuagagcugaaggggggcaggccguccuuuggcgugggcuugggagcucuguguggucuccgcaacucuccugggggauucggagcucgguggcgugaggaaggagguggcacauccacugcagaugaagguugcuuucacaucgcacuugcaacaaguccuuucuuaaggcugcuggguccagaagucucuguauugcccuucuccagcccacgcagguaugagagcuagggcugccuggccgugaacggggaggguaggacgauggggagccuauggagcuugcagugaguagucuuggguuugaccccccucugccucucgugggacuuggagcgcagcauuauucauuucccagugagcggggaugagaggccagagcaguggccugagagaugaaggggucuuucacaccugugaagcaguuuagaccguguccaagggagggggaaccauggcaagguuaggcggggcaggaacagggccacgcucacauuccugaaguuuggaaagauguuuggcuagacaacucgggagcgaaauuggaggccugcgcaucaguuguccuggugacagguuguggugaccugggaccauaguugugucagaggagacagagaagugauggauucaagagacacuuaauaggcagaggauacaggaccuguugacuagugugggucggggaaucaaugagcucagcccgauuucuguuugacacugacuggaugacaguggcauacucccagaagggagacucgguguugggggcagcuuugugcugggggaguaguccugggucuccugaguugugagcagugugugcccagcaggaaggaggcuguguggguggagagcucaggagagggccaggcugcagacauacagcugagaacuauccgcaugugcuucugaagcuaugggggagcggaugaucuucccaaagaacugaguguggagugagaaauugggggccugggacagaagccucugggacaccaacauuaggggauggcaccgagagaggccuguaaacaagauuggagagugcaggugcaaggacuggacaggaaagccccagguagaggugauagaggagccgaggaaagacgcgcuucagggaggaggaggccgcuggaggcuagagagaggucaccuaggcgaagggcuuccaaacccuuuggaugucgcugcaagcaaauccagucucggugacagcagcaucaggagcagcugggucagaauucagaucacaauggugaacuacaaaagcaaaaucccagagaagguaggagacaaugagaccuggacacaggugagggaggggcguuggcugggaggccugucagaggaugcaugaaugcaggcguguuuauaaguuucguggccaagaaugaguuggugacuccagguuauuuuaaauaucuugaaaugucacauaaaaaucuggacuuccaucuucuguugugaaaaaagcaaaagguuuggcaacugguggcuggagcugaguggaaguuguccucuuuggacuaagggaucggaguccucagcacucccccucgucuuaaagcccaacugggcuucuccaagguucccuacccagccucuuaggcacagagcuugugauuccagcuaaaaaaaaagucauuucacagacuuuuaaaaucaaacacauaaaaacaauguuuguguugguuagaccaauguuuuccuuucuugaaacauucuggaauucucguguaagaacagcuuuuagaucuuacagcauauuuggugaggccuaccaugugccagacguuuucaggauuucacauuauuuuaaagauucucuacaaggcaugcauaucuuuguccuuauuuuuuagcuuguuugcaaauagucaaaauuuguuuagcauccagucuggcaauagccaacucagaagacgucugcucaacaaaugcaccgugugauggaagacugagguuucugaaggcucuucccaaggaagaguucuagacucagaaagugguggccucacuaaaaucaauaccuaccaucaccaccccuaugucaccccaggucugagccaccccagguacaacuaccuugauaaggcaccaaauuguugacuuuagaaccacauccuggugugugaaaaugcucagagaaguaaagcacucauuuccuaguucuauaucuaaaagagaaagguuuuauuaguuagcuaaaauuuauuuacuucuccccaauccuguucaaaaaaagagacuuacuguauaacggguauugaguacccaguaugugcccagaauguccccaguaugugcccagaaugugccagucccugugaguagcacagagaugucuagcauaugccaccugucuguaaggaaccugcagucugacuggagaugagacaucgauguccaugaagcagagaaucuaagugcuagguggcauucugugggcucuaaagaccugaggggacagagaaagcuguggagaggggguggggcugaacauggagcugcauagacaggauuuguggaucgcccggggagaaggagagagaaggccccaaccuccccuucuugcagcauauuucucccucgauucucuguccucccaacucuuaucuaccccuagucagcagccccuccuccuucucuaaucuccauggagccugugcuucccaaucuuuaaaaaauuuuugauugugguaaaacauaaauaacaugaaauuuacccuuuuaaccauguuuacauguacaauucaguggcuuaagcacucucacaauggugcgucaccaucaccacugucuauauccaggacuuuuucaucaucccaaacagaaacucuucccaaucuuuuuaauggguuggcacauuuagguaaggauaauauuagggucacuggggaguccacuggaggccuguggugauggcuggggccgccccagccccacaccuggugguccugauagcugagagaaugaccuccauaucccuggaacucccaacacguuggagagcucuguuccaugucacagacccgaauucuuguuugugagggagaugggacauauucauuugucacaagaaugacaauauccaaguucccuggauugugaugguuaauagaagaaacaccauggaggccuuaaccccaccaggcaucaaccuagcgaugccucaguugggcccauggcuuagccuuuaucagagcccucaguucucuguacccuaccuccaccccaucucaaaaguuugagcuuuugagcucaaacuaucucauugcuaucucauaccagaauuuucggcagccguugacucagauaaucuuuacacacuuguguccaguuaacccuucaucuuccucucaguccuuucaguggguuccuaucuccucccuccacugcuaaucuaucccauucuuagaaccuccaacugauagauaccugagaccugaagaauuuguuuuuuuuuuuugguuuuuuguuuuuuuuuuuggagacggaaucucacucugucacccaaacuagaguggcgcgaucucagcucacugccacuucugccucccggguucaagcaauucuccugccgcagccucccgaauagcugggauugcaggcacgcaccaccaugcccagcuaauuuuuguauuuuuaguagagacaagguuucaccauguuggucaggcuggccuugaacuccugaccucaugauccacccgccuuggccucccaaaaugcugggauuauaggcaugagccaccgcgccuggccaaccuggggaaucuuaaauggaacccaguccacagccauucugaugacgaucuugcuggaaggagguggagaaagacaaagaacagggcugcccucccacaggcgagguuaggcacccaagaggagagcagagcagugguuaaagagggcaggguuucucaucugcuuaggauuucaagccuaaccccaagacucagcuccuuagagcaugagcaccaauuaacaaguaccgagugcauccaagcgcuuaguucccaaguugcugcugccuuuucaauuugaggagcaggggaaauggucaguaaacagccagagugccacauggccaguguauugcuuuauauuggaagauucucaggugccuggacuguuccucuuguccaugcuggggaaaugaaauuaaucaucaagacuggguuuggcaggguagagucagagcauagugaagggaggagacuaaagacauauauacuucauucgggcuuuagugaaucuugccuaucacaggacugguaagacacaagaaucuuuugcgcagccuggccuccuguaucuucuccuucuccaucugcagggucggacaccaagagcugcuaguagagugcucugguuauguuccccaggcuugacugccucaggcauccagggcgaguccagcauuuuaauccuccauaaacauuggcugagcuuuaaaaucuacccagccuugugcagacaugguaggaauagaaugacagcucucgcccucauggaguugauaguucagauguaaggcaaguuuaauuaaggaucacucauggcccugggcgcugggugcuuugggagacuccagagaaguaaauauaaauaucaugcgugguuccugacccacaaaccuaacccuuagcugggagagaaggcuggaguuucacggcacgccuaaaacucaacccagguaugguauccuauucuucaggagagggcaugggcuggagcagucaggggguuucugagggaggaggauccugguugaguuuugacuggagcuaggacuggaacaaagaggaggcggaggaacaaaagaucaaugcaagacaacgcaagacaaaagugcaaguaagugcucaacuaugcuggcugcaggaagucagcuauuugcaauacuaaguuagaggugagaaggggucaucuuccuuaaugucagugcagggaaaauccaccucugcgguguccccuacucuaguuccugugccauugaggcacuggaugaauagaacucuuccuucuuccauagcccuucacagagccacagcugcaugacaucuccgccagucagugcuccaaagaaagggguaggcaauaggaaaaguguuugccauuauuaccacuaauaauaaugguagccaauauuugucuaauacuugcuguaucaggcucuccaaccugaguucuucacgcacacacacacacacacacacacacauauauauauacacaugucauauauauuuccacagucaaucuucaugguaaucauuauuauccccaaguuuuuuuagaugaggaaacugaggcacagagcaauuaagucauuugaacaaggucauuuauucagucacauauucaacaaacaugcacuggggcugggcgcgguggcucacgcccguaaucccagcacuuugggaggccaaggcgggcagaucaccugaggucaggaguucgagacuagccuggccaacaugaugaaaccccaucucuacuaaaaauacacaaauuagcgaggcaugguggcaggcgccuguaaucccagcuacucgggaggcugaggcaggagaaucgcuugaaccugggagauaaagguugcagagagccgagaucacgccauugcacuccagccugggugacaagagcgagacuuggccucaaaaacaaaacaaaacaaacaaaacaaaacaaaaaccaugcacugaguaccugccgugugucuggcauuguuggaccccgggaauaaugauacuaauaaacuaggccgggcgcgguggcucacgcuguaaucccagcacuuugggaggcugagacgggcggaucaguugaggucaggaguuugagaccagccuggccaacauggcgaaacucugucucuacuaaaaauacaaaaaaauuagcugagcguggugacacgugccuguaaucccagcuacucagguggcugagguaugaaaaucgcuugaaccugggaagcaaagguugcagugagccaagauugcgccacugcacuccagccugggcaacagagugagacucugccucaaauaauaauaauaaaccaaaauuuaucaacaccuacuuucugcuagauacuauacaaauuaaggguuuacaaguguugcuuuguuuauucugaccaccucccuauuauggggcaucguugucccugguccaauuauucuuuuuuuuuuuuuuuuuuuuuuuuuuuuugagacaagucuugcucuguugcacaggcuggagugcaguggcacgaucucggcucacugaaaccucugccucccgcacucaaggaauuguugugccucagccuccggaguagcugggacuauaggcacgugccaccauguccagcuaauuuuucuguauuuuaguagagacgggguuucaccauguuggccaggcuggucuugaacuccuggccucaagcggauccgccugccucccaaagugcuuggauuacaggcgugagccacugugcccgccccagucugguuauucugaugaggugaaggaaacucagacagucuccaugaccugugcacagacaugaggccauacgugacgcaagaaagcaaccugguggucugacucuagagcuugugcuuuuuaaaaaauuacauuauuuuaaauuguggcaaaauacacagaacauaaaauguaacaucuuuaccauuuuuaaguuugcaguuuaguggcauaaagaacauucacguuaugugaccaucaccaccauccaucuccagaacucuuuucaacuugugucaugguuaauuuucugugucaacuuggcuagaccauggugcccagauaugugaccaaacauuaucuuuauauguuuauaugaggguuuauggaugauauuaacauuuaaauugguggacuuggaguaaacagauuauccuccauaauguggguaggccuuacccaaucaguugaacagaacagaagacugaccucccccaaggaagagggaauucagccagcagaagcaucggcucuucccuaggucuccagccagccaaagccacccuauagauuuuggacuugccagccccuguaaucacaugagcccauuccuuaaaacaaaucucuuucuacauguauauacacacaccccaagguugucuuucucuagagaauccugacuaauacaccuugcaaagcugaaacucugugccuauuaaacccuauucuccccucuccaaaucccuggcaaccaucauucuacuuucuaucucuaugaaucugacuacucuagggaccuccuauaaguggaauaacauaguguuugucuuuugugacuggcuuauuucacuuagcaugauguucucaagguucauccaugcuguagcaggucuuagaauuuccuuccuucuuaaggcugaauauuccauugcaugucuacacuacauuguuuauccaaucauccaccaaugaacacuugguugccuccaccuuaugguauugugaaucaugcugcugugaacaggaguguacauaugucuguuugagugccuguuuucagcucuuuuggguauauacccagauauggaauugcuggaucauauggucauucuauuuuuaauuucuugaggagcugacauacugucuuccacagcaucugcaccauuucacauucucaccagccaugcaugaggcuuccaaugacgccacauccuugccaacaauuguuauuuucugguuuuugauacuggccauccucauggcuuugaggcgacaucucagagugauuuugguuugcauuuuccuaggaccuguacuuuuaaacaccaagcuccacuguccccuugcagagaggggucuucaggacacacauucaaggucuucagggcacucacagacucgcgguuggaccuaguggguugguaagagaaguaugugcaaaggaucauggaacaaggagcaaggagcagggacucacaccuggagaucaggagggcaucucugaggaggugaauuaacuugccaagacuguaagcaacuggggaccaggcuuccagccagccgggaaaccuguuacacacacacguggcauuagcaugcaucugucuccugggagaggacagugcuggguggcagagaccugggaagaagcaugaagccauggaaguugggccuggcuaucuguugcaaaauguucccuuucuagacgcgaucaugaaucauggagcuacagcuaugggaaucuuuguugaggcguggaugucagcugugauuuaaaauagguaggaaucggcaggcagaaugaagcuucauuuucauagaaaacauauauuauggcauccugaaucgaggcacugagaaaggguggcugauguccaagcaggugauguaccaaggagaccaggcagugcagacagguacagcucugagagaacaccaggaaggaagggggaaaggaagguagcaaagucucaggauguguuuauggggcaggcagauagcaaccugggaagagggucgaggccucacagacucccaagacacuggccagccugggcccaacuccaagccacagucucugugaauugccugaaaauuguccugcugacauugcugcccccugcacacaggcaaggggggagcugugccauguggcacugcguucaccgaagcugcuguguucgcuuccugaggccuccuuuacaaagugcuacacacugcauagcuucaaaacagcagaaaucuauuccuucacggucuggaggcuaugagugugaaaucagguguuacacucccucugaaggcucaagggaagacucuguuccaggccuuucuccuggccauuucuugacuuauagacacagcacuucaaucucuaccuccauccucccaucaccuucuuccugggucuccuccacucugggcaugucugugucccuccucuuccuauaaggacaacagucauauuggagaacggcccacccuaaugaccucauccugauuuuauccgcaaagauccuauuuucaagaggcuauauucauagguuggggccagggcuaggacuucaacacaacuuuuuggacuucuuggggggcgcaauucaauucauaacagagaccuugaguaaaauacugugucaaaguugggggagcugaggcugaaaugagggcuccugguauugggagggaauggggcagugcagcucuaaucagagcccaugagaguggaccuguggguccaggcagcucuuaccccaggagcucuuggauccacccugugcuauguuuuggagaugugucauaucauucaaaaaagccaaaagaggcugggcacuguggcugacaccuguaaucccagcacuuugggaggccgaggugggagaaucacuugaggccaagaguucaagaccagccugggcaacauagggagacuccauuucuaaaaaaaaaaaaaaauuuaauuacccaggcaugguagcaggccuguaguccuagugacucaagaggcugagguaggaggaugccuugagcccaggaguuugagguuacaguaaaccaagauuguaucacugcacuccagcccgggugacagagcaagaacuugucugaaaaaaaaaaaaaaaaagauaaaacauaaacaguuuugcuuuguguuacuuuauucuucgugugauuuuuaaauuuaaauuuuuccuaguccuauaacaguaaaauagcuuugauaggacaguaaacaguugacuuuuaggagacacuaagagcaacugggaacucagccuuuuuccaucaaacaugacuguuuuguuugguguuucuguaaacuguguuuaugugucgggggugguggugugcacaccaggauuuacuuguagagagacauagaugaaggaaggagacagccucccgaggaagauguugccuaugcuggggagagggcuugaaggggagccgggguggggguuggcgagguggguugagggugggagggcuucugcuaguauguucagggagacagaugggccgacugaaggcagacagguuggugagugcguucacgggacaugcugguuuccaguagugaaagauucuuucugcuccugggacucaagaaccugcucguaguuguuaacuccaggguccuggggaggccacccaugccccacagggaagaaaacuucuucacucacuuacugauccuugaaaugucuuuuaaccagagacaagucuuguauuucacagucagagggaguaugcaagacccccagaagagggcgcacggccacaauuccacgcugguggaaggacuggaauccuguccuucccugggaacccucaccuggggaaggaugagugagugucacacugaggccucccacaguggagaagcagcaacggagaaggaggccccaggaacccuaaagacagagacuuuaaggucgggaggguuucacagaggcuuuaggaaacagauuuauccaacugccacaaaggacugagccuucaggcgugggauuaggucagccuuggggcaggggacauucuuggucaauagcaggacuuugauuuacguaacgggcuuaugcaaugucauuacauaacaucauuaggggcaucgcaaaucggauucuauuucaggcucuacaggagccagacccagggcuccccuccggcccagcaagacaggauucccgugggcccagugucccuguccucgcugggauuuucucucuugagauuucacuguggggcuuccaggagaacuccuaaggccucaggauccucuuucuccagaaugauggagcucgcgucauagcacgcucauccuuugcagaugccugcccugcugccccugcugccccugacccucccaguacuguccccccaag

SEQ ID NO: 14628 - RNA, 6825 nt, Homo sapiens
agugacagcgcggcgggcuggaucaggagaugcgcgugcgcggcccggcccggcugaucgcuucgggugcucgacuccuguugcgcaugcucagcgcgcugcccggcuggggacccgcgcaccugcagcgcccgcugcucggcccugcauccugccugggcauccugcgcccggccaugacggcgcacucauucgcccucccggucaucaucuucaccacguucuggggccucgucggcaucgccgggcccugguucgugccgaagggacccaaccgcggguaaggaaagcgcgcaggcccugcagaccucuccaccccggcccccuggcccggcucgccccuccgccccggggcggcggcuuccugcucugcagcgagcguccgcaggagggacgccaggaccccggacgccaccucugaggucucucugcaccugggucucugacagccgggaacaggcaggagguggggcgagagggcauauccagaagguaaagaggagagugacauuggagaugucugucaccccuccugcagccaguaaagggcacaagugggcacugacgcaguuucuccacuccuugcuagcugugugaccuagagccaauaucaagucucaguuucuucauggguaaaauggagauaaugucgacuccugccuuaaaaggcugcugugaggaugaccugcgguaacgcauuuaaaacaccuaccagugcgugacacuuuguagguaugggauaaguuuagcuggcguuauuuuucgaagguccucuagcagauugcugcgccauucaccaguuucugcuucauauuaucuucaguuacaaagcacccuucccuugacugcauguucccaggggcuggaguuuguccaguucaccauugucuacucagugcccagccaggacuggcacaaccugcuuaguaauguugaaaaagggaucgcgugcuccuguguccagcaccagcuugcagugcuuuagaucaaagaucaagggccucguuuggauuagaguuagcuuugcccaaaggccguuuggacaugugagugcugccuuuguucuuaaagacaggcaggguuugggaucccacagcuucacuuuguaaaccauuuucgugucuugcgucuccugcuauucuuggugaguucuugcuucaguuugacugaaauuucuuuugcugcacuugaagcaucugucucuggucuucucugaguacacgcaaaguggcuagucccuguucucuuuguaacaacucacugggccucagaacuggcucacagucugccugcuucuugcccugucuucuagccuauuguuuuccuuccccuugcuccaugaauuuugaauucuacagaccacucccuguuggguugccacaaaugcagcucugugcagugccuuuccacaacacgucugcauuaagauggagcaauauugggugguagagaagggaaaugaagggaaggauucuuaaggcaacuuggauguggucaagguuggccucucugugaggugacacuuucaguuuuuauuuucugccuugcuauucuuacccugaguagaacucagccuccuguguccaggaggcaucaggaaggccaauggaaaagagcucacaccaggagcucuucuugcucugguccuggccaggccuugugaggugcuggcugcauuuguucugacccguguccucuucugcugcagagugaucaucaccaugcuggucgccaccgccgucugcuguuaccucuuguaaguacuacucuccccagcucaaagucagccaguuccuuuguccucccuccuuuccuccucacccuagccugcucuuccuucuguccugguaguaaaugccucuugaaaggcugaaccuauaaaacaacaggaguggaggugguguggaaugggaaagagagcagugggccagaagucaugaacccugggcucuggaucuggcucugcccccagaguucuggcccccaugggcuguaguuuucucaccugggcaaggaaggaggcaggccaccucagugcugucugugccugacugggucaccuggagugauuguucaaacacaguuuucaggcugcacccuacacccaugaaauuacaacucucgagaucugcacuugggaauuccuguuguucaugaaugcccccaggugacuggaaugcagccaucuuagaaccacuaggugagaggccagacguggcggcucacgccuguaaucccagcacuuugggaggcugagguggguggaucacgaggucaggaguucgagaccagucuggccaacauagugaaacuccgucucuacuaaaaauacaaaaauuagccaggccugguggcgcgugccuguagucccagcuacucaggaggcugaggcaggagaaucgcuugaacccgggagacggagguugcggugagccaagaucuuaccacugcacuccagccugggcaacagagugagacuccgacucuaaaaaaagaaccacuaggugagaguaagucaucaaacuuggaauagguacccuggggauauagaagaacauuccaagggacuugaauaccuggagagugugaggaaaucaguuugcagauccucagugucuauuguuuagucucuugcuaaaacugccauucacaauagccaaucccucuuuauuaaaaaaauuuuuuaaaaggaaaaagaaaaagacccugcccccgcauccaucccaaaccugcgguuacauugcuccauguuuagaugauccuggcugccaaccaagagauaaguucaaguucuaguuuguugggaggccugucucaugguuaaucaagcugcauuaaggcuguuggguuucccaucuuccuaugucuuguacauuauuuuuauggguuaagcuuggcaucguuggguguucuuaauucagaauaaucaaaacaggacagguaaagugaugagaugcucauucuuuaagagguaacagauucuuuugaaacaacuggaauauuuuccaggguugccaaauuuuucaaaauacauaggacaaaacccacuuucaaaaaauuuacuucauugauuuaagauuugauguuaucauaguuaaaauuguuuuaucugauuaggucauggauucuuuauuccuauuaaccaauucucuuaauuuaccuuauguuuuauugauugauugauugaaauggggucuugagaccaggccaguauggucucaaacuccugggcucaaaugauccuucugccucagccuccccaaggagcugggaugacaggugcacaccauugcacccggcuguuaacuaauuagauaauugacagggucuuacucuguugcccaggcuagagugcaguggugggaucauagcucacugcagccucaaccuucugggcucaagccauccucccaccucagccuagcuuugaccacaggcaugugccaccaugccuggcugauuuuuaaauuuucuguaggacagggucuugccauguugcuaaggcugugcuugaacuccuuggcuuaagugauccuuccaccucagccuccugaguagcuaggauuacagguacacgccacugcacccagaaauguauaagcccuccuacugacaaaaacuaaacuuguuagaaauaaugaugacuauuaacacaugguuuaacuuaaacccacuuuuuuuuuuuuuuucaaaauucuuccuggacagagcauucucugagguccuuucucuaaugcuauuucuagguccuucagggcuugagaaaagauccucaucugcccauggcagggccucagaggggcuuguguuugguggcugggagggugggggagacggggccuacacaagaugcgggguaaucccaaauaccaacugaaucaacauacgggaaacagaaaacacacugcaaauuggaugcauacagguagaaagguggggucauucuaagaaaauguuacgccuagaaauuauauuuacaaaacauaaacucggagagaaugcugauguaaaggagguaacaauuucugauggcuuccugggcguuagguccuccuaccuacugugagggauucaaagagggaaaauaccgauccuuccugcagaaacagacaaagcaguguggauguggucguggggggcccuuccaggucaggcacugacagagcguggggaccuacuaacuacuguggcaaaugaaguugggagcuuugucaugaaugauggggccagacagccacccacacgcccagcagugaugacagguggggcaggucccugaggguuuucuggccugaagaacagagguggccuggcagcagccugaacaggaggccccugacccgucagcuccucacgucuugggguaguuccuucucucauaagaggaggugauucugacgugcugcccgccaggccugcccuguucgcucccuggugcauggagccgggggagccuggacagaggugugugagggcacagcugggagucgcucccaaagcgccccugaggcugccuccccucuucucuaaccccagguucagccccaacucggggauccugcagaucuaccgaacaucaaaugaaaccaaaaccaaacccagaagugccauaccaaccccaugugccugccggaguguggauggcucccugggcccuucuucacccugggaacacaggcccugccaucugcuggguuggccgcauccaaaauaauaugaccgaggccuccccugggugugggaggacccuccugugccaggcucaccaugcuuugcugucccuggcagcuggcucaucgccauccuggcgcagcugaacccccuguucgggccccagcugaagaaugagaccaucugguacgugcgcuuccugugggagugacccgccgcccccgacccagguacugugugggcgagggguguggguggggaagaggggaaagacaaggcuuucccacacccagggcaggccucggucauauuauuuuggaugcggccaacccagcagauggcagggccuguguucccagggugacgaagggcccagggagccauccacacuccggcaggcacaugggguugguauggcacuucuggguuugguuuugauuucauuugguuagaguucuuguugggauucaggcaucuauuuauuucaugaaaagaaaagguggggaggggacugaacaucaacucccuuccugccuggccuguguuggccgccagggaugaaaugggaaccaugcucccagcaccccccucccccauccucacagcgcuucaccccaaggcaagacccuaaccugggcccuaaccuggacggagggagggaaaggguaagcugaggacuaucugggcaggggugagggggcuuuccagggaggguugggggcaguggagucuccacugcaaggccgggacccuuccaugugaugugcuuuucaggugcccagcucucggaaugacuguggcuccacugucccugacaaccccuucguccggacccucccccacacaacuaugucuggucaccagcucccuccugcuggcacccagagacccggacccgcagggccugccugguuccuggaagucuucccagucuucccagccagcccgggcccuggggagcccugggcacagcagcggccgaggggauguccugcuccaauacccgcacugcucuggaguuugcccucuuucccaaggagaugcugcuggggagcugguauggguggggucuuucccuuuacagacggggcagaugccaggacucagcccauccugaggaggacacguguccucauggagagggugcuccggcccaggcgggggagucagugcccagucagcagcucugccaccauccugcugggaacugggggggccucuauuggguuauaggcaaggccuuuucucuggcauggaauuguuaauuuucugacacgucuagaugugaaauuucugaaaauguugaagcagagaaacauucacacacaaaaagcaacauagucauguggguccagauggccucaguccuagauguuggcacccuuugcugugucuccucagaguauccuguuccgccuccugccaccuggaccucccucaguggaugucuucccucccccgaccccagccugucaguccgagcacagugcagguuuggcucugacuugggcuuuuggcugcaguggggguggauuucagagccucucauggcagcaucuaagugaccagagcugggaugagagaggggaaggggcaaugugaguggcgcuaugggacgggccagcccugcuccugagccagccccgcccucugcccccuggcccugggcucugugcuagggauggugaagaaugggggcgugccagccuggcaggagugggaagcaacacgcaggggucccggaccucuccagccuugcccucacgcuuacccgagcucccagugugguuagcacagagcucacccaccuugccuggcucccagcuggggccuguccucacuggugcuccaggggaagaaacgacagccucacuucuguauggacugcugauguggccugccauccuguucagcgggcauugucuuuggagcagcaggagaauaggaugccucucacucacaugccaguuccuggcuggccagcugcucagggcucaggcuggggccucccauugacauccucccccuacacucccucucugagccuccgucgccccuccuguuggguaaggguguugagugugacuugugcugaaaaccugguucauauauaauaaauaauggugaugaaaagauuacuguuuggugacaaag

SEQ ID NO: 14629 - RNA, 2770 nt, Homo sapiens
gcugagaggcagcugggagagcagcuuuauuaucauggcuggggauagaacggguuccucucccugggggcuggggucuuccacugguuaccacccgcagcgguccuggaggcaccacgcaucucuagacaaaaggggaaacagguuugggggugagggagguugcuucagccccagucccagcuuuccucccaggcuucugaccuguccccucccaggcucccaaagcccagcccagccccucagcauucccagggcuggccucauccagacggugcucucagcccccuggugccuaccagugcuggcuuagcugcggggcagggccuuggagaaggcgaacuguccagggaaguagaagcuguggggguccucaccagcccgcugcacccugaggcacugggucuccuggugcuccucagccuccugccagugcccaaaacuguucaggcaguguaggaggggugggcagugccaguggagggcugccagcauccuccacauccccuccacaucccuuggagaauguccaaacaggcacagcgcuuucuagcccccacugcccucccuccugcuuggccaagcuuuagccucgagaccagcccauaggcucagcuuccauccaucuucccagcccugucaccaccugugcacccuugccccuucuuacccgcagaacuugggucucuauggggcaguggaccaaccggcccagaacuuuguccucagagcccaguuugaugcaggccaggcauuuccguuuccucugugggggagcggggagcauggggugagcagaggaaaagggugagggaggccugggcaucaugagggugggagccagggcugcccaucaugggaccagauccccaacuaggcccucgagcccaggagcaagaggucaugcaggccagcagguuucaggcacagccacccuagaaugucagaagucagacccaugcaguuuucaaacuauggaacuuucaugugugugcaggcaggaguccuucccagauggguuguguggcacaugcauaaacacgcauguaugugguuuguaugcaggaguguggguggaugggugugugauguaugcauggaugugucugcuugugcucgugugaaggcaagaauccuccuccgauggguucuucccacccaacgccuccagaguggcucagcugucaccuauucuauuuauuuucuuguaagauuugauuuugagguugaugaaucauugcuauaguccagugcccuccuugagccgacagagggaacuggggccuuugcagaaccuguaauacagagcccaggccgugcucacagagcgggaacuagaacacagucacugcacucccagcccaggcaucacccccacgguggaagguuugcccccaccgugacugaugacuggaguccugcuaggcuaggggggcaccagacacacccacacagccggcuccuuccacccaggcccugaugcuugagagaggaacucagaccgaggugagcccugcucugaugaagauaaguccagggguaaccaaaccaucuuccugucugccaggccccagcucccaccagccacucucacaaccuugggcucaggcugagccacuccaccucuaaggaggcucuucgcaguggggucucuaaccucagggcuucuuaauggaccucccaauucaugcaugcacacccaggcaugugccccacaccccaaaccccaaguccaugcacucacacccagcaugcgcccauugcucucacaccccuucacucaccccauugggccugacuuugcacucggguuucuuccagucccucuuccggcagcuugucugcugcagcuuaaauuccagccucacaaauauuccagcugggaagggcugcggacagacaggcaggcagaggauggccgguagccagcugagggugcagagcaagcccuggugugauccgcaccucccucacgcagucacauuccagcaggcuggacaguggccuuuucuccaaagggcuggggcucagagcccaagcacuucugucccccuucgugggaaugcgcuggucuccugggguacgacccuccccgcuccugcccgggccaugcuacucaccguguccacggcgcucuccacacuggucuccuggaaggcccacugcacgggcgggugcuugugaaauuccuccagggccaccugcaggccccggcgcugggcuuccgugagcucggcgacgcccacgcccaccgcacccagccacagggccagagggaucagcagccgucgcaugcuuccgugucacccuggcccugcgaagcgggugugcgccccucagcucuccgagccagcccgagccgccuccucccgcgcccugcucuggggggaggguggggagcgggggcgggguccaggccuguagaacgcugggcacaggugaaggagccuggaaauggcccuuucuccaaauugaccuuaggguccgccuggcccucuccguucccucccacccugcccgcgcuguucccuggggccugcaguuuuagcaaaguucccugcccacgcuaggaaucagucaguucgcacucccacccuacaccccuaaucuugcccauugugucucucccugggucuccggcacgacccacucuccucccugccguccccggagccccucucuccuuuccccgcucagccuucuccccaaccgcuacucccuccccguccagaaucccccugcucccacgggguuccccccacguccccga

SEQ ID NO: 14630 - RNA, 2770 nt, Homo sapiens
ucggggacguggggggaaccccgugggagcagggggauucuggacggggagggaguagcgguuggggagaaggcugagcggggaaaggagagaggggcuccggggacggcagggaggagagugggucgugccggagacccagggagagacacaaugggcaagauuagggguguagggugggagugcgaacugacugauuccuagcgugggcagggaacuuugcuaaaacugcaggccccagggaacagcgcgggcagggugggagggaacggagagggccaggcggacccuaaggucaauuuggagaaagggccauuuccaggcuccuucaccugugcccagcguucuacaggccuggaccccgcccccgcuccccacccuccccccagagcagggcgcgggaggaggcggcucgggcuggcucggagagcugaggggcgcacacccgcuucgcagggccagggugacacggaagcaugcgacggcugcugaucccucuggcccuguggcugggugcggugggcgugggcgucgccgagcucacggaagcccagcgccggggccugcagguggcccuggaggaauuucacaagcacccgcccgugcagugggccuuccaggagaccaguguggagagcgccguggacacggugaguagcauggcccgggcaggagcggggagggucguaccccaggagaccagcgcauucccacgaagggggacagaagugcuugggcucugagccccagcccuuuggagaaaaggccacuguccagccugcuggaaugugacugcgugagggaggugcggaucacaccagggcuugcucugcacccucagcuggcuaccggccauccucugccugccugucuguccgcagcccuucccagcuggaauauuugugaggcuggaauuuaagcugcagcagacaagcugccggaagagggacuggaagaaacccgagugcaaagucaggcccaauggggugagugaaggggugugagagcaaugggcgcaugcugggugugagugcauggacuugggguuugggguguggggcacaugccugggugugcaugcaugaauugggagguccauuaagaagcccugagguuagagaccccacugcgaagagccuccuuagagguggaguggcucagccugagcccaagguugugagaguggcuggugggagcuggggccuggcagacaggaagaugguuugguuaccccuggacuuaucuucaucagagcagggcucaccucggucugaguuccucucucaagcaucagggccuggguggaaggagccggcugugugggugugucuggugccccccuagccuagcaggacuccagucaucagucacggugggggcaaaccuuccaccgugggggugaugccugggcugggagugcagugacuguguucuaguucccgcucugugagcacggccugggcucuguauuacagguucugcaaaggccccaguucccucugucggcucaaggagggcacuggacuauagcaaugauucaucaaccucaaaaucaaaucuuacaagaaaauaaauagaauaggugacagcugagccacucuggaggcguugggugggaagaacccaucggaggaggauucuugccuucacacgagcacaagcagacacauccaugcauacaucacacacccauccacccacacuccugcauacaaaccacauacaugcguguuuaugcaugugccacacaacccaucugggaaggacuccugccugcacacacaugaaaguuccauaguuugaaaacugcaugggucugacuucugacauucuaggguggcugugccugaaaccugcuggccugcaugaccucuugcuccugggcucgagggccuaguuggggaucuggucccaugaugggcagcccuggcucccacccucaugaugcccaggccucccucacccuuuuccucugcucaccccaugcuccccgcucccccacagaggaaacggaaaugccuggccugcaucaaacugggcucugaggacaaaguucugggccgguugguccacugccccauagagacccaaguucugcggguaagaaggggcaagggugcacagguggugacagggcugggaagauggauggaagcugagccuaugggcuggucucgaggcuaaagcuuggccaagcaggagggagggcagugggggcuagaaagcgcugugccuguuuggacauucuccaagggauguggaggggauguggaggaugcuggcagcccuccacuggcacugcccaccccuccuacacugccugaacaguuuugggcacuggcaggaggcugaggagcaccaggagacccagugccucagggugcagcgggcuggugaggacccccacagcuucuacuucccuggacaguucgccuucuccaaggcccugccccgcagcuaagccagcacugguaggcaccagggggcugagagcaccgucuggaugaggccagcccugggaaugcugaggggcugggcugggcuuugggagccugggaggggacaggucagaagccugggaggaaagcugggacuggggcugaagcaaccucccucacccccaaaccuguuuccccuuuugucuagagaugcguggugccuccaggaccgcugcgggugguaaccaguggaagaccccagcccccagggagaggaacccguucuauccccagccaugauaauaaagcugcucucccagcugccucucagc

SEQ ID NO: 14631 - RNA, 38224 nt, Homo sapiens
uggauucuuuuuucuuuuagcaagagacucugggaacuagauaugcggcaggaaagcaucuugugugguggaauuuggggacugacauuugaucucagcccagggcuacucuuacagcgugcgucccugucgugcauuauacauguuuucaugcacuuaaagauauuuuuagaacugcagaaguagaagcacuuugaucuuuuccugaauaauuuucacaugacuuagcaggccuccuuccaccugagaugggaaaccuuggaaagugagggggccuucuucagugugugccacuguagggguuuuuccucagccccccuagauuugugguuggaacggacuccuguuacaaaagacagauuaacaagagaaaaaccaguggaaguuuauuaacauguguauuucacaucugccugggagacacgcaggaauugaguaguucucaaagugguagcuuugaauuccagcuuguauagcaucuucaacaaagaaaagccaaguuuuagggaagcgacaggacaaaggaaaagaacuuugagugucuaaggggagaacuuguagaaagguaaguaacuggcagauaaauagaguuaguaaagcgccuucauguccauuccucugguuccagcuccaggcccauaagagucuaaaguugucuucagugguuaacuuuucccuggucgagagagggagcagaccccuuuuauccuucuaaaucuauauccugcauuuaggcaguggagggcagagagcuuucuuccauuuacuuuuucacugccuucaagcucaacaacccuucaucuuucggggccuccccaacugcguucucuuggugcucuccagcugggaaggcucaaaggaugggaaguguguacagcacguaccugugacugcuaccagagauuugccccuccucagggucagugagggaugugcuuucugcuuccuccccagacugcaaaccccuggaaauuagcugcgugagagucuugcauauuugccguagggaugcggcaggagguaacggagaugauagucaagggaagguucauuagagcaaauugauccucagucuccuccagcuuuccacagucauccauccagaaauuaucaacaagcgcuuguuuuuauuuuguaguagguaccaaaccaagaguuauuuccguaguuaaauaagcguuaaaagucuucucagcacccucucacauugugggaaaacugcacagaccaccucugccugacucaugaugaggccgggcaccuggcacaguggcagauggugggcacugauuaaauauuuguuggauguaugagcaaguccuguggggggagcuggaacuguaugucugcaagaagugggugcaguuuucccucuuccagauacagggccacuucugaacaauacuugggugucuucacagaggauuucuggagacacuguuccugucacccccuggcaugccagcccacuuugcaucuaaucugauaaugggagccaggcacuguuggaggggaaaauugauccucccaggggcccuaucaauauucgcuguccagugggccccuuccuguccagcccuuucuccggcuagcuugucaaaagcugagaccgucuccacugggcuaggccauugggccauuuggcugguugcugggccauccuccaagacauuuugaagggugaagucucaaauaccaaggccuuaagcuuccagcuggcauaaaggcucaggaaucccuucgcaacuccuuugccacucauuuucuuucugcagagugaaggcacagucauacuuaguuuccucuggcgaugcuaaagaggaaguuacagcaggugguuaacuccugacugggagaagagacauuuccucuaauggaggcuggggagagagaaagaagguuagggccuuguuuaaugaagaaccuuucugcuaugaaagacggauuacagacaaggagaagauacuuugugagucuaugaaggaauucugcuucgcaggcucuugcaggaacguagggaucaaguggaauuuuaggaauggagaagcauuagauguccaaacucacucguuaacccugggggaucccacgcuuacccugugcccaggccagcacacaugcaacuuuagugguuaacauugaggacacaggggcacugcuuggguucaaaucagccacuaucccgcugaguggccuugaguaaguuccugaacauuucagagucucgguuguuacauuuguaaaauaaggaccagaagaguauugcauaggguuguugaguggauuaaaugagauauguaugugaggaguuuaucaccaugccugacacaaaguaaagccucccaaaauguuaacuaauaaauuacuaaguauuuagguaaaaacuggagcaucuucuuauuguacuguugguagaaaaauucauucuuccguaacuacuaaacuuggccuauauuccacaauaugcuauaaccauauuuucagaacccccaaacuauaugauaugacaaagacuuuuuucauauuugugaauuuuauuuuauaaaguauaaaaguugggcugggugcgguagcucacaccuguaaucccagcacuuugggaggccaaggugggccgaucaccugaggucaggaguucaggaguucaagacuagccuggcuaacauggcaaaaccccaucucuacuaaaaauacaaaaauuagccagguguaguggugcgugccuguaaucccagcuacuagggaggcugaggcaggagaaucacuugaaccugggaggcggagguugcacugagcugauauugcaccauugcacuccaaccugggugacagagcuagacacugucucaaaaaaaaaaaaaaaguauaaaaguuaaguaguuaauguacagauuagucaacuugacugggacagguaaaauaagaccugaaugaauggaguggagagaaugaaucuuaaagacaaucacguuuuuaaaacauugacaagaaauucuaaaguucauuuuguuacaaaacugaacuggggucuacuugcccggcgcaguaagaggaaacaccaacacugagguugugcauccggagaaaggagcacauuuauuugcagggcaccaagcgaggagaagugggucauacuuaagauacaaccucuucgaugguuuacaagcaagguuuuuuuuuucccccagucggagucuagcucugccgcccagacuugaguacaguggcaugaucuuggcucacugcaaccuccgccuccuggguucaagugauucuccugccucagccucccgaguagcugggauuacaggcuccugccaccacguccagcuaauuuuuguauuuuuaguagagacgagguuucacuguguuggccaggcuggucuugaacuccugacuuugugauccgcccaccucggccucccaaagugcugggauuacaagcaugagccacugggcccggccacaagcaaguguuuuuaaaagcagggguaaauuucaggaaaggagaaguuaugggcaaaaucgugaauugauacauggagguuaugcacugguuuagccucaaagggcaggguauuuugaaggaggagccuuaaaggucauacaugaauucaaagacucugauuugugauaaguuaaggaagcaaagcuuugccuaaaaccuugggguuagcagaaaggaauguucaggucugguccaacuuccaucaggauccucaggaagaaauuuagaacaaagaacagcagagcuuaguccucaguucccucuugucugaggucugcaggccagggcauccacuugggaggggggcccagguuucugaagagcaacucagggacauauauuaagauguuaucuuuaguuucuauagggaaccaaacauuuugugacuguaacuuccuuguuuuaagcuacaguuaccuucuuguuuauuagguugcuagcugggugccuggaauuucccuugaaggaauucaagauuuuccuuuauuuccaugcuugcccccuccccacuuccugcaggccuguaagaggggugccggcuccaugucaguuuggaagaauaaaugaagugauucuagccaagaaguuaugaagaauaaaaaaacccagaaucuuuguguaggggaaguacuuaaacuaccagcuaccaaaacuuauuuucugugauaaaacugcagacauucaauguaguuuuagguugcggguagccucucuaaacauaacucuaaaggcagaaaccauaaaggaagacugcuaaguuuuggcacauuaaaacaaaacuuucucgccgggcacgguggcucaugccuguaaucccagcacuuugggaggccaaggcgggcagaucacgaggucaggggaucgagaccauccuggcuaacacagugaaaccccgucucuacuaaaaauacaaaaaaauagcugggcgugguggcgggcacuuguagucccagcugcucgggaggcugaggcaggagaauggcgagaaccuaugagacggagcuugcagugaaccgagaucacaccucccucuacacuccagccugggagacaagccagacuccaucucaaaauaaauaaauaaauaaauaaauaaauaaauaaauaaauaauaaaauaaaaauaaaacaaaacuuucuuaugcucgcuucagcagcacauagacuaaagcaaaacuuucucacaucaacaacugaaaagguaggccggaugcagugguucacaucuguaaucccaacacuuugggaggcuggggcgggaggaucguuugagaccagccugggcaacacagugagaccccaucucuacagaagaaaaacauuaaaauaaaauaauuagcuggauguggugaugugauccuguagucccagcuacucagaggccgaggugggaggauugcuugagcucaggaaguccuggcuucagugagccaugauagugcuacugcacuccagcucuggugacagagugaaacccugucucaaaaaaaaaaaaaaaaaaaguuaacaaguacgaggaaacacgucugcaacaaacaugacaagucuuuaauaccuguacuuuaugagugccccccaaacaauaaaccaacuccccaacuuuuaaaaugggcaaauagaaaagugggcaaauggacauaaacaaauucacaagagaaaauaaaacuggcaaaaaauaaccaugugaaaaaacaauccagcuaacuaguacucuaagaaaugcaaguacaaaagaugagaaauaaccauuucaaacuaaauuuuuuuuuuaaaaaagucuguguugucaaguauauggaaaaugggcauuucucagggaaaacuaauacguuuuccuggaagauaauuuagaaaacauuuaaaaaauauauuccuuuuauacagccauaaauaaucauguuuaaaagaauaucuaauaaaauggaagaaaauucacaagaucguguuaagugaagaaggcagaauacaucuucgcaaggcauuauuccaauuaugccagacaugccauggauauacguagagaaaacaccggaggcaacauaccaaaauauuaaauguaauugacucuacgagguaaaacugaguuuuauguuccccuauuuccuauuuaugcaauagauuuaaaaaguauuuuuacgacuaauuauacaauucaaaaauugccuguguugaaaagcaugaaaguacaugaaauuguacuacccuggaaaccccaggaaguguuuaguuuggaaagccagggccaccugcuagugggugagucaugggcacaggcucgcaccugccaccgcagacgccacacaggcugcugagccuuuccaagcgaaaugccccacgugcgccaacggccaccucggccgucgccccacgcuuggcccgcagccagaggaagcccagcaacuucugcucuuucuuaauuucuagaaaagagugaagagaggccuuuucaaaguucgcaggaucgggccuuuuugugcuccacuuuggaacaaaucggaagcuagggccuuccaggugcgccaccgccgucccgggaccgccgcggccgcaagcguccgcacugcggccggggugcgcggccugagaaaggcccgggcaacgacgcuccgggggcuugccggagcccucuuugaagucucccgacgggcucccagccucucauaaggcagcuaaggccgaacaccccggugaccauaggccagccacgcggucgcccggggacgcgcgugcuccgcagggacaaagggucgggaaacuugagcuccggccagucccagagaaacccgggcugguggucgccauggcaacggaguccgacccuccgaggccugccgcccuggcgcggcaguggcuugagugacccggcccgcucuuggcgggggcgcccgcgccccggccccggcagucccuccccgcccccaggccgcggccgcgggagccggcgacugacccucggcagcuccuguagucacguggcgcugggaacccggcggggggagguuggggacgggccuggcaguugugaacucgaaccugccgcugucgccgcggcggggcggggagcgagagugggccgcggaggccggccuucgggcuccauggacgggcgccgcgucccugcacagcccgccgcagagguacggccggggcaggggcgcggggccaccgcgggcccgcggggggccgcuccaccugcggggcgcgugaccgugagugugcgcgaccgugugugagugcgcggggggggacgcugcuggaucugcgggggugggggagcgcaccugcgcacaggcuccgcgagcugcgccgugcgugggacccgaaauggcucacucgcaagaacgggacccgugugcccgggagcguggacggaggacacgcaucaguacaaaagggcgguguggggcuucugccacccgcggccagccgcgaugcggaaggggauucugacggagucguggucacaccagcuggcccugcgcagccccaugggaaauaggccuggaauuccugucgggaggaggcugggggaaggggagccagcagggauuccagaguuccugccauaggccggccuuuggccaucagggaaagcccagacucuggccacagaauggagaauucguuccgugaccuuaccagggaagaaagugaccccgaaagacagcagugugcuuccuuguugaaggggcacauucauuuauuaauccaauguccauuaaggucacucugccaggcaggauguggggcuuauggcuggugcguguggcuuuguggggggagggguuguggcuggugaggacacaaagcugacugcccuagaggagcucagagccucacuucuguuuucucuucccuccccacagguaaggcuggccucucugcagucagaggucugagcucugccauggggauaggggugucuuuauuacugcaguuuucucuaacaccugggggcuaccggagugugggccgaagcaggcgcugcagccgcggaaguauccccaggaacauccccaagaggagcuggaaaaagccucauccccagcucugcagucuccaggguagagucuggccuuugcugugcucccaaaccacgccacaacaggggugcacgggcguccccaucccggcggaaggaaauggcccuuucucauauccuggggucuucccugugcacagucugacacugggaaugagugaccuuuguguucccugagaagagagagugcgcucuagggaauuuagaaggaugugucuggagcuugugagcaggcacagaagggcccuuaggagccuaacugcuuccuuccuccuuccgcggaggaggcuccugugcaggaaucugggcuccccugagcuguggaagagcugaacauggggcagccccuggcgagguuggggcaggaccgggcaggggacugagauugcagucucaucuucccuccccuucuauugccccaguaaucuccagcaccccgagggaggcagagccggugaucaggccccgagggcagcaggcuguggguguuccuuggauucagggagagccuuccuuccugcaauguccuaauuuguguggguggaagagggcaggcgggcagaaugggggcacagucugggcaggcgguggucuggcguuagacugccgggaguagcacccagggcucugcuccuguuccccgagaagggcuguucucacuuguccuccagccuccuacggagacugcaguuagugaugcugaaagugccuccccuguggggcuaggaaugaaaagcuauagacaccuuuuucucugagaucuuugcaaacccaggcgcuuuagaggaaagaacacuggccugggaguuuaaagaccuguucccuagucuugauucugcuguuggcuuacugugucaccuugggcaggucucgucaucuuugaugucucacaguugcuucaucuguuaaacagggagcucagugucuguuuguccagcuucucagaguugcugugcagcucggauguggcauaggaaacagcagacacagggagagggcagcauaaggcacuguagggagcaguggccacauuuucuggugaguccuguggcaggaauguuugugcauucagcacuggagcauuuacucccugucugacacugggguagcugccaugagggggauucuaguaucagagucccucccuucuggaaguuuccagggcaacaaagacauaagacaaacauccuugaaauguuaucuaaaaacccaagauugaaauaauacauaccacacaaggaaacaggagaguagucuagcuccauguccggggcucuagggguucauagauggcagcuccuguccggggcugagguugggaggggagaaacaggggcagagugaguuggucucuggagugacugugcuuuuccacccucagcagaggaagaaccgaugcuggaacgucguugcaggggcccccuggccaugggccuggcccagccccgacuccuuucugggcccucccaggagucaccccagacccuggggaaggagucccgcgggcugaggcaacaaggcacgucaguggcccagucuggugcccaagccccaggcagggcccaucgcugugcccacugucgaaggcacuucccuggcuggguggcucuguggcuucacacccgccggugccaggcccggcugcccuugcccugcccugaguguggccgucgcuuucgccaugcccccuucuuagcacugcaccgccagguccaugcugcugccaccccagaccugggcuuugccugccaccucugugggcagagcuuccgaggcuggguggcccugguucugcaucugcgggcccauucagcugcaaagcggcccaucgcuugucccaaaugcgagagacgcuucuggcgacgaaagcagcuucgagcucaucugcggcggugccacccucccgccccggaggcccggcccuucauaugcggcaacuguggccggagcuuugcccagugggaccagcuaguugcccacaagcgggugcacguagcugaggcccuggaggaggccgcagccaaggcucuggggccccggcccaggggccgccccgcggugaccgccccccggcccgguggagaugccgucgaccgccccuuccagugugccuguuguggcaagcgcuuccggcacaagcccaacuugaucgcucaccgccgcgugcacacgggcgagcggccccaccagugccccgagugcgggaagcgcuuuaccaauaagcccuaucugacuucgcaccggcgcauccacaccggcgagaagcccuacccgugcaaagagugcggccgccgcuuccggcacaaacccaaccugcugucucacagcaagauucacaagcgauccgaggggucggcccaggccgcccccggcccggggagcccccagcugccagccggcccccaggaguccgcggccgagcccaccccggcgguaccucugaaaccggcccaggagccgccgccaggggccccgccagagcacccgcaggacccgaucgaagccccccccucccucuacagcugcgacgacugcggcaggagcuuccggcuggagcgcuuccugcgggcccaccagcggcagcacaccggggagcggcccuucaccugcgccgagugcgggaagaacuucggcaagaagacgcaccugguggcgcacucgcgcgugcacuccggcgagcggcccuucgccugcgaggagugcggccgccgcuucucccagggcagccaucuggcggcgcaucggcgcgaccacgcccccgaucggcccuucgugugucccgacugcggcaaggccuuccgccacaaacccuaccuggcggcgcaccggcgcauccacaccggcgagaagcccuacgucugccccgacugcggcaaagccuucagccagaaguccaaccuggugucgcaccggcgcauccacacgggcgagcggcccuacgccugucccgacugcgaccgcagcuucagccagaaguccaaccucaucacccaccgcaagagccacauccgggacggcgccuucugcugugccaucuguggccagaccuucgacgacgaggagagacuccuggcccaccagaagaagcacgaugucugagacggugggcggggccguguuggcugagagagggcugggguccuucguggugggagucgcagugggcugggggugccugccuagugcuggaguaggggacaaugggaauccuagaggggauggaagacgcggggagugagcugggugggcccugcuagcgagagaggucaaccccgguggccagggaacccacuuccaagcgcagggacgccggccuccagcuggugugugcuaaggcuccguccugacugcccugugcccuggaaaagcagcaauagcauccgccccuuagagcccucuggcuagaggagccaccaguggaaaggaagacccuccauccucugguauuaacgccuuaaugccccugucuuuuacuguaaguuacuuaagaucauuuuuggaagcaggcgugguagaguccuguaaaugaaugcucugggcuagauacagcuuggagaaccugcuggccuuguuagacagcacuugggccuuugccagcagcaagaggugaagcgaagccacucuuaccucucccuuccccucccaccugcccccugcguaggcacccagacuuggagagacccgucugcuguuaauacuuccauccucuuccuucccaaagagcagaucccaaggcauuuacuccuuggucugucucgcuuuaucugucgccccucccagcgcugagagccuccccuggcugucagcagcacuguguccaggcucuugucugaacaccgcagccccuccuucgcuccuuccagagcucagcaugucacggcaaggacugccgcauuggugauggagggccagcugaggggaaguugcuggugaguuuccuuuucuccauuucuagcauauggacaccuggccucugcuugagcacuuaggugacaggaacuuccgcaccuccugaggcccuggaugauucuaauuguuagaaauucuaauuguuagaaauccuuccuuauaaugaaugaauucugcuuuccuauaauuucuaccuauugggccuuguucuguucucuggaacuaaacagaacaaccauuuaccccuccuuuucaaacuagagaauaaagauuugguuuuagaacugguggcuggggaguguuacuuuuucugggggagcugcgacaugucaggaggagcagcaugcucuccucccuagaaggacggggggcuguggguggggcucuggccacaggccacaugcccagcuugcugagcucuggcccccugccucaguucuucccugagcauacccaggcaguugggcuaauucucuggguggugggccgaagcuccagagaacugugguggguggaaugcucucagcuuggucccaagauuuauguucuuggucacuugcccuccuagaugggcccagcaacaccuaaucuuucucaccaccugggccuuuaugaaacuacagcaagcacuaugagcucuuuugaggggugcuggguguuaaacggacuuugguuauacuuggacugugccuccaguaguccuucagagguuggacagaugaaggagccucugggaggggaggcuguucccugcagcuaagacagcacucagcuuccacacuccacacaccaggguuucagccuucuuugagguuguugucaaacccagccuggguccacuugcccaguguuugcaaagccuaacaccgacagugagauuugcagccagagaaaguaaggcguuuauugcagagcaccaggcgaggagaaugggcagcuaaggcucaaacucccugauggcuuuuaagcaaggguuuuuaaggcagggguggggagguuucaaagggaguuaggggcugaggaauuucuggaacuuccuuauccauuuucugguuccagucugucugaggucuacgugcuggcauugucacguggugacauugguggggguccuggcuccugaaaaacaacucaaggauauaugucaagauguuaucuuuaggccaggcaugguggcucaugccuguaaucccggcacuuugggaggccgagguggguggaucaccugaggucaggaguucaagaccagccuggccaacauggugaaaccccaucucuacuaaaaauacaaaauuagcugggugugguggcgggccccuguagucccagcuacuagggaggcugaagcaggagaauugcuugaaccugggaggcggagguugcaaugagcugagaucgugccacugcauuccagccugggcaacagaguaagacuuugucucaaaacaaacaaacaacccaaaaaacaaaacaaacaaaaagauguuaucuuuaguuucuaugaggaagcuaacauucugugacuacuacuugagugacuauuguuuaagcuauuauuacuuucuugcuuagcggguuauucauucauuuccccaauucaugguuguagagcuagcuaggugccuggaauuucccugggagggacucacauuuuuguuuauucucaugcuuuucaagugaugggcagaacccagcaggcuccuaaguggagucucugaggcugggcgugguggcucacgccuguaaucccagcacuuugggaggccgaggcagguggaucaccugagguuaggaguuugagaccagccugaccaacauggagaaacccugucucuacuaaaaauacaaaauuagccgggcaugguggugcaugccuguaaucccagcuacucggcaggcugaggcaggagaaucacuugaacccaggaggcagaaguugcagugagccgagaucgcgccauggcaccccagccugggcaacaacucugucucaaaaaauaaaaauaaaaaaaaauuaaaaaagagggucucugcuccaucucaaggucaggucagacuuuucaggugcuaguugcuaggcaggaaagggggcugauuugauucuguccuacagugucccuggccggccugcuguaggacuccagauuucugugagcagucacucuguaugcgucccugaauuggugguuucauacaaauuugaguaccucuuuuuaccaggcauuaauaguucuuuucuugccuguguuagcaauuucugcauauaucuccagcauuuagcacagagcacauaagaauaaccacaauuuguugacgugaguggcaccuggugaaguuuaccuaaauuaucucauguguccuugugugggagguagucuucuuuuauacaugaaaacauuugcccacagucauauaacugguaaucaccagaggcagauucaaauucaagucugucugacuccugaaaccugugcucuugacaaccgcugugugcuuaguggaugaacgcugcgugcugcuguuuuugguuaaguauuaaaugccaacuguguggguggggcuuaaaguguguaggauggaaagaacagcuucaaagcuucauauugguuuaugggguuauggagccacuuaaaaaccuguguaguugauggcaaauuaucugucaaagccugggagcagagggcguggucucaagaaagccccagucacauuuuuucucuuugugggaacacaggguuuccagggaaggggagauggccaggaaagaguaggucgaugucuggaaaugaugggcagggagcaggggcggguccuuggguuggcaccuagguuaguauuggagccguuagggacaaggaugagggugagaggggaucugaccagggguccuaaccuuuugaaaagucccguuuaaaggaaauagucugggauauggggaaagcggggugugggugucgucagugcuucacugcccacugcuuguuauggggaugggaaagagagguccaaaggacggaaaggucacacaaguggccuugagggggcugguaaagcaggaacagagucaaauugugccugguuccuuccugagucccuugguggguggcccagugguucucaagcccuugcucugccugguucaucaccacagcagucacuggggaggacugccuggguuguaggggucugcuggcaggagcugcccaucucuucugaagaauccacaguuuuucuuuguuuucuucuacaauuacaaaagcauuaaauuaucuuuaaaaauaaauaauucagauaauaaugugaacguucuccuucauuccccuauuccacucucaaaauccuuuuuguuuacacugagaaaaguuugaggaguauucuccuaacacuuuuuuccuguguauuugcaaacacauaugcagccucucccccugguauuuuuuuucuuaguggaaauaggaucccagagguucuccauucuuuccaccucugaaauacccuuggucaugggaugccaaucuggaggaagucugcucuguaagaaggaaacaggcccagagaguggaagugacccccaccgguggggguccuaauuucugaaaaacaacucaaggacauaugucaagaugucaucuucaguuucuauaaggaagcuaacguuuugugacucuuauuuggguacuauuguuuaaacuauuacuacuuucuugcuuagcaggucauucauucacuucccuaauugcugguugcagggcuagcuaggugccuggaauuucccuugaagggacucaaauguuucuuuauuuucgugcauugaauggggggcugguggcagaccccuaagagagguuccugcucugucucaacacuuguagccaguggcaaaucuggaacuagaauacuggucucagcaacaggaauguauuccacaagccuucguagaaccucuucuagguacucuucuagaaaauaagcuaggugugguggugcaugccaguagucucagguguaguucaggugggaggaucccuugaggccaggaguuugaggcugaagugcguuaugauugugccugugaauagccacuguacuuuaaccugggaaacauagcaagaccccgucuuuaaaaaaauaaacaggagaaugagacuccaaaguguugauagcuagugauguguggccucuuuauaggguguguaugauuuuguauuuuacaaauccuucuauagauaauauaaccaaauuaacgguaaaaacucaguaagguaugcaggcaacuagaaaauuauuaacccuauuuuauagacgaauaagucaaaguccagaaacagaaaaguaucuuuuauaaaaaguacacaugaaguuagugacaaaaucgaaucucaguccccaguuccugcugugcuacugaggcuaaaccgcagccgggccuguggcaaauguuuaaucagcuguugacugaagaaaauaagguccgccugcccaacagcaaccguuuguagagucucagaggcccagcuucugucuguaucuaccucaugccccagaggcagcuucuagcagcuccggagagcauccugccagugggaguugacccagcugcgcccccuuugagggagaagugugaggaauuuccuuacaaugggguggggaguugcgaagauacuccuuccugaaggucuggcagucuggaccgggguggcaacugggcggagaugauuccgcucacgggaacccuaccuaguaacccgaccuaguaacguaaccucagagccguuccucagcuagaaaacaaagggauuaggccgggcgcggguuuguaaucccagcacuuugggaggccgaggccgcagggucacuuaagcucaagaguucgagaccagccugggcaacauggcgagacccccaucucuacaaaauauuuaaaaaguuagcagguugggagguucgguugagccacggguucgagguugcacugagccaugaucgcgccacuggggucugagcgagaccaccucccugaaacagaaaacgaaggggucggguauaaugauuucuaaggucccucguagugaacccuaaaaguuaucacaccccacgguggggcuaucgcggcuugagggcagccacagccucagccgggguuucuguccgggcccugauggguccccagcagggagaaacagcguccggcgcgcuguggcgcucggcgaacgugcgcugaguucaggcguuacaacggggucgcacgcggaguccaggccuggcaggggugccaggacgccgccggccaucuggggcccgaccucccaaggucuccuccccgcggccggcggcuagcgcgcucacggcgcccgggccuugcgcgcccgccgggggcgaggucagcccuccccccucggcuauuggcuccagagaacaaaggagccgccccgcgggcugcuccgauagggccgggcgggucaucugagcggcgcagccaauggaguggcugggcggccccggggauggccaggcccgccagccaaucaggcacccgugcccgccccgccugccccgggaauggccagggccgggagcccggugcccaagucgcccucgggguggcaguucccguuaaccuuagccacaaagucaaagguauuuauuuccccgucgccucccuccgagucccucugcauuuugggcggggaggggcggugcgagggauggaccagcgcccggccccgcuccucccgugcugccuccgcccggcccgggcuggggcggagggauggggcgggggccuggggugccccgagccccgcgcgccccccgagccccgggucucaagcguucccucugccccgacacagccgaggggaaaggggcgcggccgaggguggggagggcgccaggccagggcagcgagguuaggagggaggcuagugagaauggagggaggacgcgguggcgaguagaggggucgcccgcgggcggucucuccugggcugucccguuguuccgaguuccccgucccuguucgccucccugauagaucaguuucugggggcaggaaccccaaugcucgcugcagagugacagacacauaguaggugaccaauaaaugugugauuaaacgagcggggauaaggauuggggguggagauaagugagagggaagcaccgcagaaguuggaaguguguggugucggguguggcggagaacuccucucuaggaagaugggcacagcagccgcgaacucgguggggcggggugcgggcauccccucugugaagaacguugaggauaucuacauguggaagguguggagauggguccuccuucggcccuuugagcaagaugaucugagcuggggcuggguguggucagagccccagggguuggaggcggacgacagcccaaggcuucacagcuaacuguucccauguucaucuguaaaaugaagagauuagauggcaguugucuccuuucagcuugaagguucaugcuuccgugcuucaaaucuguuuuguacugaaauuucuuuuauuuaaguguucccuuaugacaguuuuuauuaauggauuacuguguguggagccuguacugggugcaggggagagagaaggacccuguguuaagaugcauguagucuugugcagacuaacaaauugaugacaaugaugauuccauguagaugguccuaggugcacagguuaaacagagaagggauuccuggcugugccugguguguccaaaaaggcuuccuggucaaagcgaucccuaaucugggcugggaaggggagaacugagcaagggccuuccaagguuggucacagggugcgaggacacggugaguucaagagccacgagaggauggggcgugucggggugcaauggggaaagaugagcagaguugaguucucaguucccucuuauccgaggugugcgugccagcaaguccauuuggugggggucuggguuucugaaaaacaacucaaggacauaugcuaagauguuaccuuuaguuucuuuaggcaaccacacguuucguguggucugacuuccuugcuauuauuuuagcuacgauuaccuucuuaucagguugcacauuuacuucucaggaccagcuaggugccuggaauuucccuggaaagaacucaagauuuuccuuuauuuucaugauuggagggcacagcaggugccugaaggggucccugcuccaucucacuuugcuuucccaagguccuuugaaugcagcaagggaugcaaacguguuuauuaauuaaaaugugacaccucuucagagauuguuagcagcuggguuuauccucggccuucagcucagaugcaggcccugacagguuccugaauauuagaauuggggccgaggaauguaagugcagcucucgccucugaagggaggugggugaggaggagggggccagggguguggcgcaggggaggugugggugggacaguuccagcaagcguguuuaccucuggccggugaaggaagucuuggaaggagguaccucaggaucauggcugggguugaauuggggaccucugggaggugggcaggcauaguggauaaggcaagugaccugcuugcaugcagaucaggucuccugggaaugucgaggggagcaaacugaagccaugaaaccaggcuggcuguucauacccugagguacaguucuuauaacccugaguggggagcgggugauggcaacagcaacgaccuaaaucgaauuugucuugcaccuugggaaugucucucagaguccucucacacuguuugcgucccgccauccccaccccccaccgcccccgccccacuugauauaacaauucuguaccacgagcaagcguuauuuccauuuucagguggggaaacugaggcccagagaaggaaagugguuugccugggaucauguggcuaaccagaagcaaacccaaucucagucccugucuggggccucucagcggcuuuuuccacuauggccuguucuuuggguuggacaguggcccgcccuuucccuuggcuccccuccucuguucccuccccagauugaggacugggguguuugggagacugaggucugaagaugguggaguaggaagaggggaagggucagggcugggagaguggucacaguggggguggccuugugcugagugggauccgggaaguuggagaggagcagggugggucauggggggugggacaggggaguugugggaggcuucagggugccugaugcuggguguggggauggaggccuccaggugggggaggggaugcccaccugguuugggcugggaccucugggaggggcaugcagaaccacccugguaaguggagggcucugcagacagugccacaaccagagccgugcaaacccucuuccuccugcaugguggagcguggaggcuccuguguggcgcugggggccucugagauucccaacuggcuggaaggagugauggcuuaggaggagugaguggcagcggggacgcuggcagagaggcuuguacagauacugcccgaugcauccggcucaggcuugccgcccuguggugcuccucccaaacucagggagcagguauuuccguucaccugcgccuucaagaaccugagcucaaagcgcugcaaugacuggccagggacuagcagcggcucaguggugggugggcugggacuugggguucuugauuaagacaugggguccugaggggagggaccaggaaggguggccuugagaaggacaucccugccagccucaggcagugggcuucuagggggagacuagggcugaggagccagccagguggcggcugagggucacccaaagauggcugaaggggagagggcccgcugcauccccuugggccagagcccacaggccaggcccugaggaucuuaggcugcaccaggcuugccggacacaggcucauugucucuagggcuuucugucuugcuguaacgucucuccagccagcugcagcuccugcugacuuaucccaccccagcgcaggucauccaacggugacuuauggccccggccuccuggcucgaugaggguauguugcuucuguuucuaccucucugaguucuuuuccucggagcaagugacccugaugggauggccauggguguacaaggauacuugugucauggguggcuuugcaguucuguguuccuaagugugcugugcagugauucgugcugcccugguucacaguggcacguuugugugucuguggaucuguaggugugucugugaguuuuaaaaaauaucucacauucucuguauuugcauagacaguuuugcagguguucucacguaguuuugugucuuugaacuuuuguuuacuuagcuguauuuagauaugauuguaucuggguguguuugugugugguuuagcauuuacaucaguuucuuaugucccuaugaucauauauuuaaauuaaaaacaucugcuauuaacugaaaucagaggcagagaauaccauugccugguccugagggauuucuuaauagugacagaagacuggagccugaggagccaccucuuggguccuccauuguuucauucacucauccguucauucauucaauacacauuacacaccuucugcauaugagggacgcgcaggugugggagcaagcccccgcucccuggggcuaaccugagugaggggucucacagggagagaggacugggugaggacauagcagucagguaugggcugcaggagggcagggaggcgcuggggacccgguggaguugagaaggaugaggcuauagaaaggggcagcauggcagggaggcauuggcugggcaugggcugggacuggagaggccaguuucugugggggucuccuauggaagaccagcugagcugugcccagcaagugaggaccugcugggaccucagggcugagaagggccugauacugggccuuuggcugggguuuggggagcugcccccacccccaaaagccuuagcgccuaguggcggauccugcucccgcuccacuagcagcagaugauaccuguggcauggucugcuucugacugcccgaccuggggcgcugaggcugugagagcugugcugggcuggugggagguuccaggggcggcgauggggaggaccuugccucuuucuggccuguggccuuucuccucccccagcugcugucuggccgccccacccccaagucucugccacaaccaaagcuccuuuguugccucccccugccccgggccucuccaccugcugcuagcucaauccccucuuugugugguuggucuucaguugucauggcagcugggcccaggcugaggccugcccacugugaggcucuuaacugaacugcagccugacccggugcgcggagggccgggccagggccaggcgugggaagggggccccuguguguccugcuccccucagagcccgaggggcagcagagaggaaaggugguccgguaggggcccgggggcccuugugcgauagacaaagcggccuuccaagacuuggugugggcacuggugggagauggcgcaucuggcccuugaugccugucuuccagccggggcgcuuugcugggcagccugcucaccuggcuccugggugucuccagguggcugaggacaugucaggaugguagguuaggaggggcccgccaugcacagagcagagugaaaggcagaauaggagagaagcuuaggguggggacgugugugucuggccagccuggaacaugacacauggagggcuuuccuggauuuugucuguaggacaccugcugugccauuucccagacauagcccaccugagcacacagguagaggcggguccccaaagacuuggccuccccucauuccuguccucuguguuucccccuuugaauuucucacuucuuccucuuggguccucuuccuucugucuccauuucuguucuuacguaagccacaggcugcuuccccucgagcccugguauggcccgagacagaggcaccgaggcuugagggaggagcugcucugggaggucccggacaguggaaggccugcuacuaccuggaguggcuguuagguccuaauaccucuugggaggcagggugggugaaguaggacugucuuugauuugccuugggggucucgcucuguggagacccaggcccauccuucuguccuccugaauuuguggccugggcucugcccuccucggucugaguuccccuuaccaagguggcuucucuguccacuagccccucugcgccucuucagguggauguuaaguccaguuggugagagguuucccaagauguggcaugcagaagcucacagaguggccccaagggaggaggguggcgagggagggaggagcccccagcacccaucagagccccaccaggggcuccucccgcccccuuccccacugcucgccuuuucucugcaccacaagcagguucuguaagaaaccaugguaggcaugcguacaggccccuguuggggaaauagaauugaaaacaaaaucucuugccaacccagaaaagcucuuugcaaaaguagaagagaaaaacagcuuuuaaaagauugaaugugcaugaaaccagaauguggugcgcaccauggacaaucccccgagcaacugcaaagacgggagcucugagccugcaauaccccaagcgacugcaaagacgggagcucugagccugcaauaccccgagugacugcaaagacgggagcucugagccugcaauaccccgaaugacugcaaagacgggagcucugagccugcaaucccugaguaacugcaaagacggaagcucucagccugcauguagccggcaggugcagcccguuacagacauguucucaggauaaacagcaaccagcccuccagcaagaggacuggacauuaccauuugucacacgcaggcaggucguccuaaauucaccucauaauuggagugaccaucuguguuagcuaauugccuuuacccacaggaaaaauaaaguucuuauauuuuuaugacaggagauaguuuugugauuuggagccaggcaccugcugaaauuaggcuccuacccucccauggagacugggaggcaggggugaugucuuccuugauacuuaaauuucaaagaaauggcccccaggaccuugggaaagacaguccuggguuguaauguuggcagaaggcuuauuuagcuuuuuuuugagacagagucucacucugucacaaucucggcucacugcaaccucugccuccugaguucaaacaauuuuccugucucagcuucccgaguagcugggauuacagacaugugccacuacacccagcuaaguuuuguauuuuuaguagagacgggguuuccccacgucggccaggcuugucucaaacuccugaccucaggugaucuacccaccucagccuuccaaagugcugggaauacaggcaugaaccaccgugcccagccuuauuuaacuuuuaaaaagauuuauuucuacuugaggagcauuuacugcaaaaauaaaaaauaaagauucacaugcaucucaaaaagacagagauagagcuuauuaauuagaaguuucuaaacaaaaugcucuugaaaaaagugggugucucuucuucucuuugcaccagggaaaaugacuuucugcauuuucuagauucauauucaccccucccccgacgucucuugucaggguccagauucccagucugugugugugcccccagugucugggcucugaaggggaccuaggagagggagucugggucucugcgaggcucucgggcccugggguggguguuucuguggggguggccgagccagggugccugggaggaggggcugacugaaaucuggaagagccccucccugaggcagcaggaaggacgagcugugcaucucuguggggcagccacaucuuugcucugcuaggggguacaggugcacgggaccacaucccuguccuuaggagaggugcacccccagcgaggaggagaugagucuucaggcugcacagcuccuggccaggcagggcagcacauuccugccaccugcauuuguuacgggcccucugugugcccggcucugcucugagcccugcggauccagcagcaagcaugaagagcuccugaccuugcugugguggggaacagaaaaguuaagaucaugucagguggcaaaaauguuagagaggaaacgggagguggaguuaggcuggugacuguaaauaggagcgccaggggccagcacgguggcucacgccuguaaucccagcacuuugggagaccgagguggguagaucacaaggucaggaguucaagaccagccuggccaauauggugaaacccugucucuacuaaaaauacaaaaauuagcugggugugguggcgcacaccuguaaucccagcuacuuaggaagcugaggcaggagaaucacuugaacccaggaaguggugauuguagcgaacugagauugggccacuacacucucagccugggcaacagaggaagacucugucucaaaaaaaaaaaaaaaaaagaagcacaagggaugccugcucugagaaggggacauuuaagcugggagcugauagaaguguggggggcaagccaggcggggaucugcggugaggggacagccagggcaaaggcguggggcauccacacagcagugugaccuguccugucauguuccaggcacagagugagccacucaggaagcgcucagaagacuugggcauaaaaacaaaaaaagaaggccgggcgcaguggcucacgccuguaaucccagcacuucaggagacugaggcgggcggaucaugaggucaggagauggagaccauccuggcuaacacggugaaaccccgucucuacuaaaaauacaaaaaaauagccaggcgugguggcgggcgccuguagucccaguuacucaggaggcugaggcagaauggcgugaaccugggaggcggagcuugcagugaacugagaucccgccacugcacuccagccugggcaacagagcgagacuccaucucaaaaaaaaaagaugaauccuacaucagugaacugggcaugggcucagcaaugcccaauugaccguguguguucuuguauggagauggcuggccccgaagcuccccagagggauuugugcuagaacauggauggggacuuugaaagagggggcgggugacggaggaaacguguagggccauucugccuuccgggugcauuccucauggccagucgcagacaugucucuaaccuuacuccaggcuccugcuucucaggcgugguguccaucacaugccgcccugcgaauguugagggugugggcucucgugugggaguuagaagaccuggguuuuuguccagcucugccauucaucaccuccaugacucugggcacaucagggguccuucguggucucaguuuccucuuuuguaaaaugggaauuauggcuguuuuaccuucucagcagguaugcuuacaaugaaagaaccccugcccaugucgaauguggcuauggauagaaaagcucuuuggaaaagagagugcuuuaugggaugggaggggggcuggggacccugaguuuuguccuugucccacaggcccauucucuuucuucugcuucucuuucugacagauggcaggaaagggacacagccggcgcugaugcugggaggccuccagggauggagaguggccuggcuggcaacggcacagguaagagagaagaaagaggaggcaggggagcggggucuccucugcugaggucacgugcccuuaucuuuucuaaagccaggcgcgagccagugcccucagccaguagcuaguacaucccacugaugcagaauuucaggguggggaccaggacuuagacagccaugucaaagaauggaacaaugacagaggcugugggagcucaaaaaauggcaaagccugguccauuaacuugcccagcaaggggacacaugugcacccaugccuuguagaaauugagguguuauuuacgugcuagaacagggaguuugugggguuauacuaauuagacacggaaaacuggcacucuagguaggacgauuggaacaaaccuguggcucaucagucaggacauugucuucaguucaguccauuaacgcuuccugggggucacucaaaguucagggucguuauuggcuaagccgcuuagagcugguugugaugaaauacaugcugccaguggaaaguuugcccgcacagucaugugcuuuuggcuggagccccugcccagcgucccugcgccuggaguggagcagccccuggcgucuguguguagcacuugcagcccuuccuggagugcccugucgcauguggcguguggcccagcugccagaagggcucuaggccccuuggcaggguugaguccagagcacaccggcuacccuugggaacccugcccuuuggcacagugugacucggguuucuuuaccucccucuccccucccaggggaauugccccauagaccccagggccccuuccucauugccucugugggaagagccgccuccccucccaggaauaucaugucaggagacccaagacugagacaaaaaucaggcagcgggguaaaagagaaacguggccgcaagugcaaaacauggcagcgugguguguggacacagacccucagggagccuagccaugcagcugcgugccuguccaaggagccaggugguggcaggagcacccuagcugcauguguguuuuggaaauuccaguggaacucagagcacaugugcccagcguguuauagaaggcccuuuccccagauagacucauaccugggauccugagucacugugagguugcucugguugaugugagcuguggucugcugggguccucucuccucucuacggcagcuucuggggaacccugugguuuuagagaagaguuugaaaaacacuagccuagacuccuggagacacggaggcacguggggacuggccucuggccagacugagggaaccacucaucuggaggaccccguuuuucagacaauugacagcuuaccucuuuuaagcaacuuuuaauuuuuauuuguguguguguguguguguguguguguguguguguguguguguguguguguguguguguguuauggcaaaauauacgcaacacuuaccauuguaaccauuuuuaaguguacgguucaguggcaucaguacauucaguguuguguagccaucacugccaucuauuuccacaacauuuucaucaccugggaaacuguacucauggagcaauaaucugugcuuugcaccuucuaauuuuaucugaaccauuaaaaccuaaaacaugauccuuuucaugaugacugaggagcggugccauuauuucgggacucuccacgggcaggccaguggccugcgcucuucauauggauaccugaacccucgggagugugccuggggcugcuggagccccagcacacuccaccucagcuccagggccuccagggaugcgugcuggacuuagcaccucgcccaacccagucauuugcguccgccaggggcccuucggcagguggaugugacagcacuguccuggcauccuggggcucucuggcccacagucaucuuucuggcuggagagggcugagggggaaccagccaucagccaccugauggacacagcacagccaccggucucagauuggugugacucauccuggaucaugccuguguguauacauagagacauaugguuuaauuuuuuaugaauucaaucagaugauucauaugguuuuucaacuuguuuuuuguuuucucuuaaaauguuuugagaaucuuuucauauuggcauacauaguucuuuuccauucuuuuuacuugaugcauaguauuccauauuaugaagggaacuauuuuuuaggauaauuaaguuauuuuccauuguuugcugauuacaaagaacacuucagugaauauuccuggacauuccucuuuacacucguaugucaguauuucuuuggugaacacgugggauggaauugcuggcuggaaagggccagaaggcucuccacacuucuaauuuuaauaaacacugucagaucguccuccacaaauucugccucaguuuaugcucucagaauacccauguguauacuuguucuccuguguaguguccacgcauauuguaaaguagagguauuauugauuuuuuaaauuuuuguugguaugagggguugaaagaugcuacacuuuuaguuugcauuuuguugaugacuagugggguugaaccucuuuuuaucacguauaggagucuguuuuauagucuggauacuaagcguuugucuauucuauaucugcacauauuuuuuccuggacuugcacuguccagcacguggccuagccacauaggacucuucuaguuuaaguuuagguuuaaauuaacuuaaguacggccaggcgcgguggcucacgccuguaaucccagcacuuugggaggcccaguucgguggaucaccugaggucaggaguuugagacccgccuggccaacauggugaaaccccaucucuacuaaaaauacaaaacuuagcugggugugguggugggcgcaugcaaucacagcuacuugggaggcugaggcaggagaaucacuugaacuccagagguagaggcugcaguaagccaagaucgcgccauugcauuccagccugggugacugagggagacucugucucaaaaauaaauaaauaaauaaaaauuaguuaauuaauuuaaauacaauuaaaaaugucauuucuuaguugcacuagucacauuucaagugcucaguaaccacauguguuucaagagcucagauguaaacuguuuuugcuauugcagaagguucugugggaaaaugcugcucuaaauucccauuucuuuuuccuuucuuucuuuuuuuuuuuuuuuuuuuuugagauagaguuuuugcuuuuuuugcccaggcuggagugcaguggugugauaucagcucacugcaaccucugccucccugguucgggugauuuuccugccucagccuccugaguagcugggauugcaggcacaugcuaccacacccggcuaauuguuuuguauuuuuaguagagacgggguuucaccauguuggccaggcuggucuugaacuccugaccucaggugauccucccgccucggccucccaaauuguugggauuacugacgugaaccacugcaccuggcggaaauucccauuucuauuggacuuauguuuauaguaucuuuugucauacagauguuuuaaauuuaguuuuuaucuuuuguauccuguuuaagaaggcuuuuaauuaccucuggauucuaagcaaauucuccuaauucuucuaauacuuccauuuccuuuuuuuaagcuggcacuuaaguccaucuggaacugauuuuuauaaacaaucuucacuaugaaucuaacuuaaauauuuuccccaaagagagaguugguucuaagucgaugaauagccuuuuuccauggacuuggaauaucucuuguaucauguaucaaacaauacuguuccauuggccuauuugucuauuauguguacuguacauuauuguaaugauuauauuuagcauuuuuacuuuuacuuuuauuguuuuguggaagggaaucugacuugcagccuuaagucaccaggcccaccauggaagagccaugccaauaacaauaacaacugugucagucaagaguucgguuuuauuuucuuuuuuucccaaauggaucucucucucucucucucucucucucucucucucucucucugcaguggcaugaucagggcucacugcagccucagccuccugggcucaagcaguccucccaccucagccuccagaguagcugggacuacaggugugcaccaccacacccagcuaauuuaauaaauuuuuuauacagacagguguugcuauguugccuaggcuggucuucaacuccugcacuuaagcaauccuccugccuuagccucccaaagugcugggauuacaggcaagagccacugugcuugaccuagacuuuaucuuuuagagcaauuuuagcuuuacagaaaaauugugaagaaaguagaguuccccuauaccuuagcuccaguuucuccuauuauuaacauuuugcauucauaugguacauuuguuauaacugaugaaccaauauagauacauuuuuauuaccuaaagucuguaguugacauuaggguucucuuuuggucuuguaccuuaccuggguuuugacaaaggcauaaugucccguaucacuauuauaguaucauacagaauauuucacugccccccaaguucccugugcuccgucuguucaucucucccuaccccccaaccccuggcuaccacugguuuuuaaauucucucuguaguuuugcccuuuccagaaugucauauaguugaagucauacaguguguagccuuuuauguugacgucuuucaccuagaaguuugcauguaggguaccuccauggcuuuuuugacuuaauagcuuacuucuuuuuauuguugacuaauauuccaucaugcggaguuauccauucacccacugaaggacacugugguuccugcccaguucuggcaguuaggaauaaagcuauaaaaauucauguguaguuuucuguguggacagagguuuucagcucuuuuggguaaauaccuaggagagcgacugcuggauuggaugguaagccuguauuuagcuuuguaagaaacugcugaacugccuuccagagugguggcagcacuuugcauuuccaccaggaaggaaagagccccuguugcugcucagccucacugugugcacaugccagugaucuggauucuagccacucucauuuauuuuauuuuauuuuuauuuuuuugagacagaguuuugcucucguugcccaggcuggagagcaauggugugaucucggcuugcugcaaccucugccuccuggguucaagugauucuccugccucaaccuucugaguagcugggauaacaggugccugccaucacacccagcuaauuuuuuguauuuuuaguagagaugggguuucaccauguuggccaggcuggucuugaacuccuaaccucagguguuccaccugccuuggccucccaaagugcugggauuacuggcaugagccacucugcccggccaauucuagccauucauauguguacagugguagcauuuuugcuuuuaaugucguauaagccaaauucuucuuuguucauuuuuaggauuuucugggcaauuuguauagaugauaaauuuuacaguucacuuaaauaggauuacacugaauuuaaacauuauuucagagugaagaacaucuuuggcuucucaucuaagaauaugauauacauugcuccuuuucuuuaguuuucuuuaucucuuuaguaaaguuuaauaguuuucuuuguauauguuuugcauguuuauuggguauauuccuaguuacuuguauugccauuuuuuaaaaagugauuuuuguauguuuuuguacugggcaaucuugcugaacucuuauuucuauuucucaguggauucccuugcacauuccagguuguuaauaaucauaaacaaauggcagcuuccucuccuuuccaauguugaugcguuucucuuuguuuuccccucugccuuggcuaguuccucaaggacagccggcugauuucagggauggugagcaucgcauuuuguuucuaccuguaaugggcuucuaaucuuuugccuuugguuauaauguucgcuguaauuucuagaguacauucuuugucaacuuaguuuccucuauucuuaguuugcuaggagcuuucuucucucucucucucucucccucccucccucccucccuccccucuuccucuuucccuaccuucucccuccuuugauccuucccuccagaaauaauguugaauuuuaucauaugacuuuuucacaucuauugggaguuuuuucacuuuuaauaagguaauguuauaaauuauauugggccaucuuugcuuuccuggggaaaaucucagcaagguuaggguauguuauuauuuugauaccacugaaguugcuuugcuaauguuugugucuauguucaaagaaugauaaaccuuuugcccacuuccauucuuggcuugauacuggaguuaugcuaaccuuguagacuuuucuuucccuuugcuccuauucacuguaauaguucauauaagguggaaaaaguccucacuugaggcuuuagcagcaccuguuuauauaguuacagagccuguuacccauuuuugagguacacugagauguucuucucagucucuuuuaguuguuuauguagucagauuuucuaccuacucuugggucaguuuuaguuuacauuuucuugcaaaaucuucuauuucauauagauuuucaaauuuauuuauauaaaguccauauuuggggauuuucagaauccuuuuugcggcuacaugucccuuaucuauaaucuguuuuuaucuuuauuaaugccguucuucuacuuccuuuggguuuauuuuguuggguuuguaacguugacgucuguuuaaagauuuuucucuuuguucacagcuguuuuauuccaccuacuuuuaauuacauguaaaccuuuuuggaaaggugcauggaucacaagcucuguaaauucuuauaaagcaaacauuccccuguaacuagcacccacaucaauggagaacauugccagaaccucagagcccaugcugccuuccacccacagugcccucuguaauagggcauuauccugacuucuaacucguggguucauuuugccaguuucuccucuucacauaaauggaaucacacaguaugcauucuuuagugucuguggcagaugguuucuuuauggcuucuuauucugugagcugggaagacaaagugccucuguagacuugugcacggcccaagugugggcugggagcagugggugugggacccccaugaguaaaguggauuggauuuaacacaaagggaaggcgacaccucuuuugggugcugaggucuuucuggccuacuuucuuguucuugguuuuguugaaggaagaugaguugccagacagccaaggucccagcaggugaagugcucccccgccauggcuucugccuuggagcaggagccccgacaguauagacggugcugcagugacccagggguuggucucccugaccacugagggacugagcaugccuuugcuuagaaagcuuccagcacgucgauccucuuagaaaaagaaugguauguuuugcagcuuggccacuuucuccuugcccccugggucagcagauuucacuggaucgguuucuuuaaaccuucucugcaucuccucggccucaggguggagaaggcagagcagccggugccucggggauccugaggccugggcacccgagugauucacuuacgguuccuuucuuguauuuuucuccuucacuccuuucuauaucuuaaccugcccuuguuguccuuucugccuucccgacucuuuuuucuucuuuugccccuguuuucuuagguucauuuaaaaaucuuucccuucugccuuuucucgugcccucuuuucagccccucucugcccuccugcaccacuucccucucucuugcuccuucucuccaucccacccagcggagcagcagugaccucucucccuccucucucccgcuugccucuggcaggagcugggcuggugaugaaggucaagcaggagaagccggagcggcugcugcagacgcuggcgccgcaggccaugcuuguggagaaggacaaggagaacauauuucagcagcaccggggccucccgccacgccagaccauggggcggccucgagcccuggggggacaggaggagucugggaguccaaggugggccccucccacugagcaggaugcggggcuggcaggccgggcucccgggucagccuccggcccccugagccccucgcuuuccuccggcgagggucacuuuguaugccuggacugcgggaagagguucagcugguggucgucccugaagauccaccagcgcacccacaccggggagaagccguaccucugcggcaagugcggcaagagcuucagccagaagccgaaccuggcgcgccaccagcggcaccacacgggcgagcgacccuucugcugccccgagugcgcgcggcgcuucagccagaagcagcaccugcucaagcaccagaagacccacucccggcccgccacccacucgugccccgagugcgagcgcugcuuccgucaccaggugggccuccgcauccaccagcgcgcgcacgcccgggaccgccagggcucccgcgccggccugcacgagcugauucaggacgcggcggcgcgccgggccugucgccugcagccggggccgccgcgggggcgccccgagugggccuggcuggggcucugccagggcugguggggccagcccggggcccgggccgcggucuccggccccgaggggccgggcgagccgcgccaguucaucugcaacgaguguggcaagagcuucaccugguggucgucgcugaacauccaccagcgcauccacacuggcgagcgccccuaugcgugccccgagugcggccgccgcuucagccagaagcccaacuugacgcggcaccugcgcaaccacacaggcgagcgcccgcaccccugcccgcacuguggccgcggcuuccgccagaagcagcaccugcucaagcaccugcgcacgcaccugcccggcgcccaggcugcgcccugccccagcugcgguaagagcugccgcagccgcgccgcgcugcgcgcccaccagcgcgcccacgcugucgcugagcccgccguuccggccggggaaccgggcgaccagccgcaggccgaggccaucccgggcuuggccgcgaggccgcggagcucccaacgguccccgggggcccgggacacgcuguggggccggggacaagcgggccucgcugggccuggcgagccgcgccaguucaucugcaacgagugcggcaagagcuucucgugguggucggcgcucaccauccaccagcgcauccacacgggugagcggcccuacccgugccccgagugcggccgccgcuucagccagaagcccaaccugacgcggcaccggcgcaaccacacaggcgagcggcccuaccugugucccgccugcggccgcggcuucagccagaagcagcaccugcucaagcaccagcgcgugcaccgcgcggccccugcgugcagccccaaggaggaggcgcgcuaguggacuggaccucagcggacccgugguggugcgggggauguuugcgggguguguguggggaguggggguggccaggauugcuggcucuuagaaccccuuagagcgggaccgguggauuccuuaaggcucugaagggcugagaacaguucuagaagcgucccaaagggugcugggaaaggucccagcguggguugagggaggagggaagauccgaguuccucaccgcgggccgggaugugaccacccucuucagagguuggaccccaggcuucaagcaccgagugaggggucuguuggggacgcugggagagucucuggugugaaguggcuuaggucuggacuggucagcuguggcaccagccgguccugcccacgcuucaggauggccgggggcugccccugugggagaguugccaagacucggcgauaccaaggauggaagccagaggcuguggcgagggagagccaagcauauucccagcaccagggccacugcuggcacgucguagacauccaauaaauauuuuuggaaggagugaaugguuugaugucccucuccaucccugccagcccccugcccaaggugugugugugguugggcccgacucuagaacugguaugugugugauggucaggcaggcaugagcggggugggcucugcugaggcuuggcugccugaggagguagcugugcaggagagagccaaacacgcugcuucuauuccugucuggggcaugucugaagugggcuggcugucuugacuggcuuggauccuuaucagucugguguugcagaagagagaauggauggaauauuccacguggucucacuuuccuuucugaaccacccuugcugaagcccgggucugugugugcucagagauccauuugccccaggcuaggagcacagcacuccccacacccaguucuugccagggguguuuucucucuucccuucuccaagucaguuuagugucuucccacauacccuccucggccuccugcccccaagaggucaccccucacgcccuuccaaagcaggguuggcugagucccuggugcugacagaagagcccaggacuccagcccaggcugugaccucagauggugucuucccagaggagaggagggaacuggagaugguggugauggguuuggggugccaggguuggguagcugggagguaggaagaaaggaccccaacauggcucuagagaaggaagaagugcacuugcccccaucucacagcccagauccuucucuguaugcagagaaguguuaccuucugggagcugccacgguucagccuagcuucuggucacuguucuuuaauccucuguaucuggaaaauacuccaguuguagaucuauggaaggacauacgaaggugauggguggacccggagggccgcccugacuguuauggcuuacuaggguaacagugccgaugaugguuagcacucagccagggcugcugcaucuccgucccguucuuugaucacaaaacaugcagugugaaaucacacgggguguuguacgccgggguugcuaccaccuacuugagcauucagcgcuuaggaccacgggaaaccaaaccaggaggguuuuccugggcacccuccacccgacaccagcccuaggggcugcccugacucuaaugaccugccccucuccuggaacuccccuuccauccugcaccgccccagggagugcuugacugccuugcagcucaucaaacccugcuuuaacagggugggggaggggggcucaggaguccuuugcuuuuuucucuuugccacuugccaaauucugaaaucaaguugagcaagcccacccacuucaggccucacugagucccgucuuucauuccuggguuagagaaacacugcccgcaaggacagaucuguggaaacacuaggucccugugacucaggugccggaggaugcagugucagcagaugcugacgagaucaguccugcaggagcaucuuuacgacagaacauguuauuuuccauaaguggccuguuuaaugaucaaaucagucaaauagcugugcugguaggacuugggguuaaaaaugaggccuaauugcagcuuuuuucuccagcaccaauucaugagaaugccugcucgcugaccccaggugacugggccucccacaaauggguguuuugggucacaaagggggcagggucaaaucccucaggcaaagagugacugagguguaugacucacugaccaggccgggacugcacggcauucguucacuaaagaagccugcugugugccaggcaucaugcucagaugcugcccgagacacagccccuacccgaagagcucaaggaccuuuauggaaaaucauuuugauacacacagggcuugggaccaucuauguguucaacucuuuaaaaaaugguucccagcccca

SEQ ID NO: 14632 - RNA, 7531 nt, Homo sapiens
acuuaaguccaucuggaacugauuuuuauaaacaaucuucacuaugaaucuaacuuaaauauuuuccccaaagagagaguugguucuaagucgaugaauagccuuuuuccauggacuuggaauaucucuuguaucauguaucaaacaauacuguuccauuggccuauuugucuauuauguguacuguacauuauuguaaugauuauauuuagcauuuuuacuuuuacuuuuauuguuuuguggaagggaaucugacuugcagccuuaagucaccaggcccaccauggaagagccaugccaauaacaauaacaacugugucagucaagaguucgguuuuauuuucuuuuuuucccaaauggaucucucucucucucucucucucucucucucucucucucucugcaguggcaugaucagggcucacugcagccucagccuccugggcucaagcaguccucccaccucagccuccagaguagcugggacuacaggugugcaccaccacacccagcuaauuuaauaaauuuuuuauacagacagguguugcuauguugccuaggcuggucuucaacuccugcacuuaagcaauccuccugccuuagccucccaaagugcugggauuacaggcaagagccacugugcuugaccuagacuuuaucuuuuagagcaauuuuagcuuuacagaaaaauugugaagaaaguagaguuccccuauaccuuagcuccaguuucuccuauuauuaacauuuugcauucauaugguacauuuguuauaacugaugaaccaauauagauacauuuuuauuaccuaaagucuguaguugacauuaggguucucuuuuggucuuguaccuuaccuggguuuugacaaaggcauaaugucccguaucacuauuauaguaucauacagaauauuucacugccccccaaguucccugugcuccgucuguucaucucucccuaccccccaaccccuggcuaccacugguuuuuaaauucucucuguaguuuugcccuuuccagaaugucauauaguugaagucauacaguguguagccuuuuauguugacgucuuucaccuagaaguuugcauguaggguaccuccauggcuuuuuugacuuaauagcuuacuucuuuuuauuguugacuaauauuccaucaugcggaguuauccauucacccacugaaggacacugugguuccugcccaguucuggcaguuaggaauaaagcuauaaaaauucauguguaguuuucuguguggacagagguuuucagcucuuuuggguaaauaccuaggagagcgacugcuggauuggaugguaagccuguauuuagcuuuguaagaaacugcugaacugccuuccagagugguggcagcacuuugcauuuccaccaggaaggaaagagccccuguugcugcucagccucacugugugcacaugccagugaucuggauucuagccacucucauuuauuuuauuuuauuuuuauuuuuuugagacagaguuuugcucucguugcccaggcuggagagcaauggugugaucucggcuugcugcaaccucugccuccuggguucaagugauucuccugccucaaccuucugaguagcugggauaacaggugccugccaucacacccagcuaauuuuuuguauuuuuaguagagaugggguuucaccauguuggccaggcuggucuugaacuccuaaccucagguguuccaccugccuuggccucccaaagugcugggauuacuggcaugagccacucugcccggccaauucuagccauucauauguguacagugguagcauuuuugcuuuuaaugucguauaagccaaauucuucuuuguucauuuuuaggauuuucugggcaauuuguauagaugauaaauuuuacaguucacuuaaauaggauuacacugaauuuaaacauuauuucagagugaagaacaucuuuggcuucucaucuaagaauaugauauacauugcuccuuuucuuuaguuuucuuuaucucuuuaguaaaguuuaauaguuuucuuuguauauguuuugcauguuuauuggguauauuccuaguuacuuguauugccauuuuuuaaaaagugauuuuuguauguuuuuguacugggcaaucuugcugaacucuuauuucuauuucucaguggauucccuugcacauuccagguuguuaauaaucauaaacaaauggcagcuuccucuccuuuccaauguugaugcguuucucuuuguuuuccccucugccuuggcuaguuccucaaggacagccggcugauuucagggauggugagcaucgcauuuuguuucuaccuguaaugggcuucuaaucuuuugccuuugguuauaauguucgcuguaauuucuagaguacauucuuugucaacuuaguuuccucuauucuuaguuugcuaggagcuuucuucucucucucucucucucccucccucccucccucccuccccucuuccucuuucccuaccuucucccuccuuugauccuucccuccagaaauaauguugaauuuuaucauaugacuuuuucacaucuauugggaguuuuuucacuuuuaauaagguaauguuauaaauuauauugggccaucuuugcuuuccuggggaaaaucucagcaagguuaggguauguuauuauuuugauaccacugaaguugcuuugcuaauguuugugucuauguucaaagaaugauaaaccuuuugcccacuuccauucuuggcuugauacuggaguuaugcuaaccuuguagacuuuucuuucccuuugcuccuauucacuguaauaguucauauaagguggaaaaaguccucacuugaggcuuuagcagcaccuguuuauauaguuacagagccuguuacccauuuuugagguacacugagauguucuucucagucucuuuuaguuguuuauguagucagauuuucuaccuacucuugggucaguuuuaguuuacauuuucuugcaaaaucuucuauuucauauagauuuucaaauuuauuuauauaaaguccauauuuggggauuuucagaauccuuuuugcggcuacaugucccuuaucuauaaucuguuuuuaucuuuauuaaugccguucuucuacuuccuuuggguuuauuuuguuggguuuguaacguugacgucuguuuaaagauuuuucucuuuguucacagcuguuuuauuccaccuacuuuuaauuacauguaaaccuuuuuggaaaggugcauggaucacaagcucuguaaauucuuauaaagcaaacauuccccuguaacuagcacccacaucaauggagaacauugccagaaccucagagcccaugcugccuuccacccacagugcccucuguaauagggcauuauccugacuucuaacucguggguucauuuugccaguuucuccucuucacauaaauggaaucacacaguaugcauucuuuagugucuguggcagaugguuucuuuauggcuucuuauucugugagcugggaagacaaagugccucuguagacuugugcacggcccaagugugggcugggagcagugggugugggacccccaugaguaaaguggauuggauuuaacacaaagggaaggcgacaccucuuuugggugcugaggucuuucuggccuacuuucuuguucuugguuuuguugaaggaagaugaguugccagacagccaaggucccagcaggugaagugcucccccgccauggcuucugccuuggagcaggagccccgacaguauagacggugcugcagugacccagggguuggucucccugaccacugagggacugagcaugccuuugcuuagaaagcuuccagcacgucgauccucuuagaaaaagaaugguauguuuugcagcuuggccacuuucuccuugcccccugggucagcagauuucacuggaucgguuucuuuaaaccuucucugcaucuccucggccucaggguggagaaggcagagcagccggugccucggggauccugaggccugggcacccgagugauucacuuacgguuccuuucuuguauuuuucuccuucacuccuuucuauaucuuaaccugcccuuguuguccuuucugccuucccgacucuuuuuucuucuuuugccccuguuuucuuagguucauuuaaaaaucuuucccuucugccuuuucucgugcccucuuuucagccccucucugcccuccugcaccacuucccucucucuugcuccuucucuccaucccacccagcggagcagcagugaccucucucccuccucucucccgcuugccucuggcaggagcugggcuggugaugaaggucaagcaggagaagccggagcggcugcugcagacgcuggcgccgcaggccaugcuuguggagaaggacaaggagaacauauuucagcagcaccggggccucccgccacgccagaccauggggcggccucgagcccuggggggacaggaggagucugggaguccaaggugggccccucccacugagcaggaugcggggcuggcaggccgggcucccgggucagccuccggcccccugagccccucgcuuuccuccggcgagggucacuuuguaugccuggacugcgggaagagguucagcugguggucgucccugaagauccaccagcgcacccacaccggggagaagccguaccucugcggcaagugcggcaagagcuucagccagaagccgaaccuggcgcgccaccagcggcaccacacgggcgagcgacccuucugcugccccgagugcgcgcggcgcuucagccagaagcagcaccugcucaagcaccagaagacccacucccggcccgccacccacucgugccccgagugcgagcgcugcuuccgucaccaggugggccuccgcauccaccagcgcgcgcacgcccgggaccgccagggcucccgcgccggccugcacgagcugauucaggacgcggcggcgcgccgggccugucgccugcagccggggccgccgcgggggcgccccgagugggccuggcuggggcucugccagggcugguggggccagcccggggcccgggccgcggucuccggccccgaggggccgggcgagccgcgccaguucaucugcaacgaguguggcaagagcuucaccugguggucgucgcugaacauccaccagcgcauccacacuggcgagcgccccuaugcgugccccgagugcggccgccgcuucagccagaagcccaacuugacgcggcaccugcgcaaccacacaggcgagcgcccgcaccccugcccgcacuguggccgcggcuuccgccagaagcagcaccugcucaagcaccugcgcacgcaccugcccggcgcccaggcugcgcccugccccagcugcgguaagagcugccgcagccgcgccgcgcugcgcgcccaccagcgcgcccacgcugucgcugagcccgccguuccggccggggaaccgggcgaccagccgcaggccgaggccaucccgggcuuggccgcgaggccgcggagcucccaacgguccccgggggcccgggacacgcuguggggccggggacaagcgggccucgcugggccuggcgagccgcgccaguucaucugcaacgagugcggcaagagcuucucgugguggucggcgcucaccauccaccagcgcauccacacgggugagcggcccuacccgugccccgagugcggccgccgcuucagccagaagcccaaccugacgcggcaccggcgcaaccacacaggcgagcggcccuaccugugucccgccugcggccgcggcuucagccagaagcagcaccugcucaagcaccagcgcgugcaccgcgcggccccugcgugcagccccaaggaggaggcgcgcuaguggacuggaccucagcggacccgugguggugcgggggauguuugcgggguguguguggggaguggggguggccaggauugcuggcucuuagaaccccuuagagcgggaccgguggauuccuuaaggcucugaagggcugagaacaguucuagaagcgucccaaagggugcugggaaaggucccagcguggguugagggaggagggaagauccgaguuccucaccgcgggccgggaugugaccacccucuucagagguuggaccccaggcuucaagcaccgagugaggggucuguuggggacgcugggagagucucuggugugaaguggcuuaggucuggacuggucagcuguggcaccagccgguccugcccacgcuucaggauggccgggggcugccccugugggagaguugccaagacucggcgauaccaaggauggaagccagaggcuguggcgagggagagccaagcauauucccagcaccagggccacugcuggcacgucguagacauccaauaaauauuuuuggaaggagugaaugguuugaugucccucuccaucccugccagcccccugcccaaggugugugugugguugggcccgacucuagaacugguaugugugugauggucaggcaggcaugagcggggugggcucugcugaggcuuggcugccugaggagguagcugugcaggagagagccaaacacgcugcuucuauuccugucuggggcaugucugaagugggcuggcugucuugacuggcuuggauccuuaucagucugguguugcagaagagagaauggauggaauauuccacguggucucacuuuccuuucugaaccacccuugcugaagcccgggucugugugugcucagagauccauuugccccaggcuaggagcacagcacuccccacacccaguucuugccagggguguuuucucucuucccuucuccaagucaguuuagugucuucccacauacccuccucggccuccugcccccaagaggucaccccucacgcccuuccaaagcaggguuggcugagucccuggugcugacagaagagcccaggacuccagcccaggcugugaccucagauggugucuucccagaggagaggagggaacuggagaugguggugauggguuuggggugccaggguuggguagcugggagguaggaagaaaggaccccaacauggcucuagagaaggaagaagugcacuugcccccaucucacagcccagauccuucucuguaugcagagaaguguuaccuucugggagcugccacgguucagccuagcuucuggucacuguucuuuaauccucuguaucuggaaaauacuccaguuguagaucuauggaaggacauacgaaggugauggguggacccggagggccgcccugacuguuauggcuuacuaggguaacagugccgaugaugguuagcacucagccagggcugcugcaucuccgucccguucuuugaucacaaaacaugcagugugaaaucacacgggguguuguacgccgggguugcuaccaccuacuugagcauucagcgcuuaggaccacgggaaaccaaaccaggaggguuuuccugggcacccucc

SEQ ID NO: 14633 - RNA, 7531 nt, Homo sapiens
ggagggugcccaggaaaacccuccugguuugguuucccgugguccuaagcgcugaaugcucaaguaggugguagcaaccccggcguacaacaccccgugugauuucacacugcauguuuugugaucaaagaacgggacggagaugcagcagcccuggcugagugcuaaccaucaucggcacuguuacccuaguaagccauaacagucagggcggcccuccggguccacccaucaccuucguauguccuuccauagaucuacaacuggaguauuuuccagauacagaggauuaaagaacagugaccagaagcuaggcugaaccguggcagcucccagaagguaacacuucucugcauacagagaaggaucugggcugugagaugggggcaagugcacuucuuccuucucuagagccauguugggguccuuucuuccuaccucccagcuacccaacccuggcaccccaaacccaucaccaccaucuccaguucccuccucuccucugggaagacaccaucugaggucacagccugggcuggaguccugggcucuucugucagcaccagggacucagccaacccugcuuuggaagggcgugaggggugaccucuugggggcaggaggccgaggaggguaugugggaagacacuaaacugacuuggagaagggaagagagaaaacaccccuggcaagaacuggguguggggagugcugugcuccuagccuggggcaaauggaucucugagcacacacagacccgggcuucagcaagggugguucagaaaggaaagugagaccacguggaauauuccauccauucucucuucugcaacaccagacugauaaggauccaagccagucaagacagccagcccacuucagacaugccccagacaggaauagaagcagcguguuuggcucucuccugcacagcuaccuccucaggcagccaagccucagcagagcccaccccgcucaugccugccugaccaucacacacauaccaguucuagagucgggcccaaccacacacacaccuugggcagggggcuggcagggauggagagggacaucaaaccauucacuccuuccaaaaauauuuauuggaugucuacgacgugccagcaguggcccuggugcugggaauaugcuuggcucucccucgccacagccucuggcuuccauccuugguaucgccgagucuuggcaacucucccacaggggcagcccccggccauccugaagcgugggcaggaccggcuggugccacagcugaccaguccagaccuaagccacuucacaccagagacucucccagcguccccaacagaccccucacucggugcuugaagccugggguccaaccucugaagaggguggucacaucccggcccgcggugaggaacucggaucuucccuccucccucaacccacgcugggaccuuucccagcacccuuugggacgcuucuagaacuguucucagcccuucagagccuuaaggaauccaccggucccgcucuaagggguucuaagagccagcaauccuggccacccccacuccccacacacaccccgcaaacaucccccgcaccaccacggguccgcugagguccaguccacuagcgcgccuccuccuuggggcugcacgcaggggccgcgcggugcacgcgcuggugcuugagcaggugcugcuucuggcugaagccgcggccgcaggcgggacacagguagggccgcucgccugugugguugcgccggugccgcgucagguugggcuucuggcugaagcggcggccgcacucggggcacggguagggccgcucacccguguggaugcgcugguggauggugagcgccgaccaccacgagaagcucuugccgcacucguugcagaugaacuggcgcggcucgccaggcccagcgaggcccgcuuguccccggccccacagcgugucccgggcccccggggaccguugggagcuccgcggccucgcggccaagcccgggauggccucggccugcggcuggucgcccgguuccccggccggaacggcgggcucagcgacagcgugggcgcgcuggugggcgcgcagcgcggcgcggcugcggcagcucuuaccgcagcuggggcagggcgcagccugggcgccgggcaggugcgugcgcaggugcuugagcaggugcugcuucuggcggaagccgcggccacagugcgggcaggggugcgggcgcucgccugugugguugcgcaggugccgcgucaaguugggcuucuggcugaagcggcggccgcacucggggcacgcauaggggcgcucgccaguguggaugcgcugguggauguucagcgacgaccaccaggugaagcucuugccacacucguugcagaugaacuggcgcggcucgcccggccccucggggccggagaccgcggcccgggccccgggcuggccccaccagcccuggcagagccccagccaggcccacucggggcgcccccgcggcggccccggcugcaggcgacaggcccggcgcgccgccgcguccugaaucagcucgugcaggccggcgcgggagcccuggcggucccgggcgugcgcgcgcugguggaugcggaggcccaccuggugacggaagcagcgcucgcacucggggcacgaguggguggcgggccgggagugggucuucuggugcuugagcaggugcugcuucuggcugaagcgccgcgcgcacucggggcagcagaagggucgcucgcccguguggugccgcugguggcgcgccagguucggcuucuggcugaagcucuugccgcacuugccgcagagguacggcuucuccccggugugggugcgcugguggaucuucagggacgaccaccagcugaaccucuucccgcaguccaggcauacaaagugacccucgccggaggaaagcgaggggcucagggggccggaggcugacccgggagcccggccugccagccccgcauccugcucagugggaggggcccaccuuggacucccagacuccuccuguccccccagggcucgaggccgccccauggucuggcguggcgggaggccccggugcugcugaaauauguucuccuuguccuucuccacaagcauggccugcggcgccagcgucugcagcagccgcuccggcuucuccugcuugaccuucaucaccagcccagcuccugccagaggcaagcgggagagaggagggagagaggucacugcugcuccgcugggugggauggagagaaggagcaagagagagggaaguggugcaggagggcagagaggggcugaaaagagggcacgagaaaaggcagaagggaaagauuuuuaaaugaaccuaagaaaacaggggcaaaagaagaaaaaagagucgggaaggcagaaaggacaacaagggcagguuaagauauagaaaggagugaaggagaaaaauacaagaaaggaaccguaagugaaucacucgggugcccaggccucaggauccccgaggcaccggcugcucugccuucuccacccugaggccgaggagaugcagagaagguuuaaagaaaccgauccagugaaaucugcugacccagggggcaaggagaaaguggccaagcugcaaaacauaccauucuuuuucuaagaggaucgacgugcuggaagcuuucuaagcaaaggcaugcucagucccucaguggucagggagaccaaccccugggucacugcagcaccgucuauacugucggggcuccugcuccaaggcagaagccauggcgggggagcacuucaccugcugggaccuuggcugucuggcaacucaucuuccuucaacaaaaccaagaacaagaaaguaggccagaaagaccucagcacccaaaagaggugucgccuucccuuuguguuaaauccaauccacuuuacucaugggggucccacacccacugcucccagcccacacuugggccgugcacaagucuacagaggcacuuugucuucccagcucacagaauaagaagccauaaagaaaccaucugccacagacacuaaagaaugcauacugugugauuccauuuaugugaagaggagaaacuggcaaaaugaacccacgaguuagaagucaggauaaugcccuauuacagagggcacuguggguggaaggcagcaugggcucugagguucuggcaauguucuccauugaugugggugcuaguuacaggggaauguuugcuuuauaagaauuuacagagcuugugauccaugcaccuuuccaaaaagguuuacauguaauuaaaaguagguggaauaaaacagcugugaacaaagagaaaaaucuuuaaacagacgucaacguuacaaacccaacaaaauaaacccaaaggaaguagaagaacggcauuaauaaagauaaaaacagauuauagauaagggacauguagccgcaaaaaggauucugaaaauccccaaauauggacuuuauauaaauaaauuugaaaaucuauaugaaauagaagauuuugcaagaaaauguaaacuaaaacugacccaagaguagguagaaaaucugacuacauaaacaacuaaaagagacugagaagaacaucucaguguaccucaaaaauggguaacaggcucuguaacuauauaaacaggugcugcuaaagccucaagugaggacuuuuuccaccuuauaugaacuauuacagugaauaggagcaaagggaaagaaaagucuacaagguuagcauaacuccaguaucaagccaagaauggaagugggcaaaagguuuaucauucuuugaacauagacacaaacauuagcaaagcaacuucagugguaucaaaauaauaacauacccuaaccuugcugagauuuuccccaggaaagcaaagauggcccaauauaauuuauaacauuaccuuauuaaaagugaaaaaacucccaauagaugugaaaaagucauaugauaaaauucaacauuauuucuggagggaaggaucaaaggagggagaagguagggaaagaggaagaggggagggagggagggagggagggagagagagagagagagaagaaagcuccuagcaaacuaagaauagaggaaacuaaguugacaaagaauguacucuagaaauuacagcgaacauuauaaccaaaggcaaaagauuagaagcccauuacagguagaaacaaaaugcgaugcucaccaucccugaaaucagccggcuguccuugaggaacuagccaaggcagaggggaaaacaaagagaaacgcaucaacauuggaaaggagaggaagcugccauuuguuuaugauuauuaacaaccuggaaugugcaagggaauccacugagaaauagaaauaagaguucagcaagauugcccaguacaaaaacauacaaaaaucacuuuuuaaaaaauggcaauacaaguaacuaggaauauacccaauaaacaugcaaaacauauacaaagaaaacuauuaaacuuuacuaaagagauaaagaaaacuaaagaaaaggagcaauguauaucauauucuuagaugagaagccaaagauguucuucacucugaaauaauguuuaaauucaguguaauccuauuuaagugaacuguaaaauuuaucaucuauacaaauugcccagaaaauccuaaaaaugaacaaagaagaauuuggcuuauacgacauuaaaagcaaaaaugcuaccacuguacacauaugaauggcuagaauuggccgggcagaguggcucaugccaguaaucccagcacuuugggaggccaaggcagguggaacaccugagguuaggaguucaagaccagccuggccaacauggugaaaccccaucucuacuaaaaauacaaaaaauuagcugggugugauggcaggcaccuguuaucccagcuacucagaagguugaggcaggagaaucacuugaacccaggaggcagagguugcagcaagccgagaucacaccauugcucuccagccugggcaacgagagcaaaacucugucucaaaaaaauaaaaauaaaauaaaauaaaugagaguggcuagaauccagaucacuggcaugugcacacagugaggcugagcagcaacaggggcucuuuccuuccugguggaaaugcaaagugcugccaccacucuggaaggcaguucagcaguuucuuacaaagcuaaauacaggcuuaccauccaauccagcagucgcucuccuagguauuuacccaaaagagcugaaaaccucuguccacacagaaaacuacacaugaauuuuuauagcuuuauuccuaacugccagaacugggcaggaaccacaguguccuucagugggugaauggauaacuccgcaugauggaauauuagucaacaauaaaaagaaguaagcuauuaagucaaaaaagccauggagguacccuacaugcaaacuucuaggugaaagacgucaacauaaaaggcuacacacuguaugacuucaacuauaugacauucuggaaagggcaaaacuacagagagaauuuaaaaaccagugguagccagggguugggggguagggagagaugaacagacggagcacagggaacuuggggggcagugaaauauucuguaugauacuauaauagugauacgggacauuaugccuuugucaaaacccagguaagguacaagaccaaaagagaacccuaaugucaacuacagacuuuagguaauaaaaauguaucuauauugguucaucaguuauaacaaauguaccauaugaaugcaaaauguuaauaauaggagaaacuggagcuaagguauaggggaacucuacuuucuucacaauuuuucuguaaagcuaaaauugcucuaaaagauaaagucuaggucaagcacaguggcucuugccuguaaucccagcacuuugggaggcuaaggcaggaggauugcuuaagugcaggaguugaagaccagccuaggcaacauagcaacaccugucuguauaaaaaauuuauuaaauuagcugggugugguggugcacaccuguagucccagcuacucuggaggcugaggugggaggacugcuugagcccaggaggcugaggcugcagugagcccugaucaugccacugcagagagagagagagagagagagagagagagagagagagagauccauuugggaaaaaaagaaaauaaaaccgaacucuugacugacacaguuguuauuguuauuggcauggcucuuccauggugggccuggugacuuaaggcugcaagucagauucccuuccacaaaacaauaaaaguaaaaguaaaaaugcuaaauauaaucauuacaauaauguacaguacacauaauagacaaauaggccaauggaacaguauuguuugauacaugauacaagagauauuccaaguccauggaaaaaggcuauucaucgacuuagaaccaacucucucuuuggggaaaauauuuaaguuagauucauagugaagauuguuuauaaaaaucaguuccagauggacuuaagu

SEQ ID NO: 14634 - RNA, 7529 nt, Homo sapiens
gccggcgccuccguccgacccucuuuccugucgcugggggcgguuugugggccuggccuugggauuaggaaaauagggauggugcuauaacggccgaaugcaggccucagggaaucccgaaagggggaaugucugggucggcggaucggggggcuugagagggcccgcuccgugggacguucaggccccggaaccggcccccgcauggucgccgcuccggcccgggcgggcgcagcgcuggcagccccguuuuccgccagccgggcugccggagaguuagaccucccagccucacggggcugcugugcggcugcgacgacgccggcgacugcggcgcugcagcggagacggaaggcucgggaggcggcgccaugugagugcgcgcggggccgcgcuggggccgcggcgggagguuaccguauuuaccgaggccagagccggacccucgggggcgggucacugcgggcgugcuaccguauuugccgggucccgcgcagguccuuuccgggagugggagcgccgggacuuaauuacguauuuauccaggguugcguggcuccgcgggggggcgcugcggccguggggggugggcugcauucauucccucugggagcuggggcuugcagucgggcgggguggguugcggcagcaggguggaggccuacguauuuucgugggggugggguugcgacgcagaguuuaccauauuucuccaggguugcuccggccgcagaaguuggcaagguuguguguaaggucgggugggguggggucagcucucccgauuaaugcagcuauuugauaagagcaacgucgcgggacgcuugccgucuuuaugggggcggggagaaggggcgcgggugucgcugcgggagaguuaccguauuugcguugagcagcgcagacuguagagcaaagagcugcggccggagaccggaggagcaggggcucagcugggcugugaguguggcaugggaggaaagaacuugggggagagacggggggccuuucggcgugcaggcggggccucagucagggguauagcuggggagagugaggaggcugcccagucacagggccgggcugagauuggccaaggggacuuugaugaucugucuuugcagaugucagugcagcugccuguggaaaagacuuguggguggggucucuugcaaguaggacuugucuccuuccccagggucaguuccaccccggccucgaggguacggaagacagaggagguggcccugagaccccacucugcagauagguugacugaggcuggaagugaagagaggccuucggggagguccaguggaauauucagccggcuucccugaugggguuggggagaauggaugaggcaggccuuagggcccugcaggagcccaaguuuuggugggggucgugggagugguggcaguagacagugcaucuacaggagaaguggcccuuuggaaugcauggcucugugacggcugggaugguggcagugggggguguguguguguuuugaggaguguuuaguuguugagcagcuaguacauugaaaagagcuuucaacagugagacaggagacuuaaggccuaguccaggcucaccuugcucugugaccuuggcaaguauguugaccucacugagccucaguuuccccaucuuuaaaguggggcucaauaacccugcuccgccccuuucucagggcuguugugaggacaaugggaaacaauuuaagaggaacacaguguccugggaagaggauccuuuggagaagcagcaugaagggagcuggguuuggggguguuggcugggcacugagggugcugcucagccuugggccaggcuuugcugugaggauaccaagaggaaucacgcugagaccagucccccugggagcccacacccugguucagugacuuggaaaccuuuugaacacaugccucauuuugauaaacaaagagcugccgccuuuaauguuuaaccgaggucacuuucaaguuuacaggguuguguuuuuuuuccuguuuuaagcuucacaaaaauaucuuuaaaucacugauaaugccacccuuuucuccaaguuuggggugcacuucccuaccucccccuguccuugagaucugguuggagggauaagacauaucuagacgaagguaacugaaaauccuagcugaaacugaaacugaaaauccuaacugaaacucaucaccaucugucuagugucuuguguggcuggcuggcauggugcuaggugcugggguugaaagaaggcagcucuguccuuagggugcugggagucgggggacagagguggcaugacugacccucgugcaguaugaucagugagagccacaugguugugucacacgguguuuaagcccgggguggaaaggucagggaaggcuucuaggagaaggugcccuugggaagggacuggaaggaguguaggccgugcuuaaaaggcaguggaggaagaggaacaccaauucccagcaggggaacuugagcuugaacaaaacggggcgaaagguggagguugugggaggugagugucccugccaggcuggggguuggcuaacccucguguuccccgaccccucucucuccaccccccacccccgcccccgcuucugucucccuagggacuggugauugcagcuggaagugcccaugaccgagcuggcguccuccgggggcggguccccugcgggggacggggaggagggucugggggacgagcgaggccuggucauccaccacccugcagaggagcagcccuaccgcugcccgcugugcggccagaccuucucgcagcagcccagccuggugcggcaccagaaggcgcacgccggagcgggccgcgcggcugccuucgugugucccgagugcggcaaggccuucagcgucaagcacaaccucgaggugcaccagcgcacgcacaccggggagcggcccuuccccugccccgagugcggccgcugcuucagccucaagcagaaccugcucacgcaccagcgcauccacagcggcgagaagccgcaccagugcgcgcagugcggccgcugcuuccgcgagccgcgcuuccugcucaaccaccagcgcacccacgcgcgcaugcccgcgccgcacccgcgccgccccggcgucuucggggagcggcggcccuacuucugcccccgcugcggcaagagcuucgcgcgcgagggcucgcucaagacccaucagcgcagccacggccacgggcccgagggccaggcggcccacuuaggacgcgugcuaugaugcgcccggggccugcugccgacggcugcuucccgccccgcacgugcguccccgaccccuggagauggcccugggccgcagcucccucucuagaugggaucccgggagaggggcagcgcuggcuugggcucuugaaggugugggccgccgccaggcuccggccgcccgcucgcguuccucccucgggacccucuggcuggcugcgcacagcugcuuccggcuccugccaugguucuccuucucuggcccauccggccuagagcaggugagaccugcggggcuggccagagccccucucagggcugggagugguggggguggagugcgugguguugauucuugauggcagguggggcggucuggguaccgggcuguagguuucucugugaugagcugcuuaccggaucuucauccccagaaugucagaguugaaagagacuuggagaggccacuuuccacaaaccccacgcccaaccucagccccuaggccuccuggcuccuguacacacucucugcuguccuugagaugucauuucacuucauguuucaguuuacucaucuguaaguuggggauauagaugagggacucuuccucgcugggauauauugcagcuacuggaugagagagggugaggucacuggugcacagagccuuaguugauucugccacaccaugugccacugacugugccgggcugggcucucccagagacacacaugaggaccgcaggcccugacacggggugcucacacucggugugugacgcggggccaaccuacaaagugcucuggggugagaccgaggagggugacugguuucucuucgucacccaggggaguuugauggcuuugaaccaggucauggggacaaauaaaauuguucuaggaagagcaaguguguagaaggguguuuucaagggaggggggguccugauaguucagugacugucuccaggugucccaaggggagguuugcccuacaaaggacuucguggucaggggguggggacacugagauuuuuaaugagaugagugcuaugaucucagacuuaugcuuuaggaggagaaucagaggcacugugaggacagacugaugugggaagagcuggagccucgaggggcuugggucaucugggcaagagaacauaaggcccccagcuaagaggccuggccaaggucuggcagugagaaagggggcagccaggacucugcuccaggaccucugguuccaagcuggcgcucugaggcacgggccucuucagccuuuuggcagaugaggaaacagguuugccaagcuugccuacaccacaguugguacuuagggguacaacagguggaagccagggcuuuguuuuggauucugaaucccagaaccuuuuagcuucacugcuuaaaaaguggacgauggagcagggaggauuuggggccaugugauaggagcuggggcagggguguuaggggugguacggguguuugaaggggacauggcaucccugggagugguuugggaggaagggagcuggggcuucgaggggaccugcacauucaguccugugcugggugcuggagacucgucccuccccacugcccccucugcccauccucagugcuauguggcuauggcuccucggagacuguccucugccuaccacucccaggugcuguagacuagcauugguggcaaagaugaaauuaaacaggggcuucggacaccuggagucagucaccaaaaugcccugaacccaaggugucucaucuguaaaugggauucguaauccuugcagugcuugguaggggacaaagaggauucauucaaacccuaggacagauucaggguaggccagcugaucgcucccuccuagccccagagggguggcugggcagggccaugucacggcuccacaccugauccugaucucuuuguuucugucgacaguugcagagugggcaggaucuuaagacccgauaggugcagaacccaucuggacacggagaccaggaauggaguuccauggaggccuggcuggcacugcacccgggcaugaggacacauccaguaagaagaccugccucaagaggugcacugcggugaccaguggaggugacugguuggagccuggaauuggaagcagauuccaagcucugguggacaaacucuccaggccuggugggaaucacagcuggggcagaccucauccuggcugccuggccacaggcccccacucucugccacuggugguaggacgaugccuguguggagagcuggcuucucugcucccgccugguccaccacuuggcuagaguucagagacaggaagugauuggucuaagcuaacacagcaaguugguggcagaccugguucuagaggcaaaaccuucuuccagaugugaaugaaaccugcaggcuucauuuuccuuucugagcagugcuucuuagcucuuuggagacacgaagcccuuggaaaaucugaugaagguuacggaccuucccuaggaaaacagauaacugacguagacucaaaaaccccaagcaauuucaggagccacuggacucccugaaugaaacccaucccuggacuccaggcuaagaaccucagcccuggggacuucaccugcugcccuuuccuuaccugucacacauugagccccgagucaaggccacuguacaaguagugccccucccucccccuggccaagccuccuucccuuguucaggaauaaagaauuccgaggagcccuuuuuagucauucccuucucccagaccuaacgaauggugcgucagguuucuggagccucauuucccuuccccagacauuggcagaggucccuugggcuagauuuucucuucugguuuuguuucuuguucugccugacuggccgcuggcuuccacaaaggagcccuuugcuccuggccugggcucugauuucacuguguggucucaggggaagcuggacugcuguggacgcuggugggagcuugagucuggucugagucugccccagggagaaagaauccugcuuccaccaaccaagcccagucagcgguuccucccagcuggccaaguguucagcccagugggcuggggaggaagaggaugagggccucgcuccuggugccuguggcucugggcagggugagaggucgguggaggaucuuucuguguguucucugaguaugcagcagugcaguugaagggaacagggcccaggcaggcagcagggcaaggacuccucccaucuucacaccugaaccagucagccuggaagcuacaaguucucaccugccuccccagaaugaacaucagaaaaggcaaaacugaccagggcugggauggguuugggucagcgugguuggagggcagccuguggaucccugcacuggagucuugcugucuucgaugcagguuggaucauacauuguuaccuccuacuguaugccucacccuggaauagcagaaugcucagggggagauccgagaacgagaaggugcucccagccccaggagcuuccagucuggcucugauccuuggccgaccuagaggaaaccuccacacacgccccuuuugugcuaauggugcaguuugugucccccucugcccaucacugugcugugcuuguuccugccucugugccuuccccuauacugcucggacauguccccuuuccucuccucuacccagcuaagcccuucugauccacggggcccggcuucccaaaccacccagcccacauuccuccuuccugcuccgaacagguccggugugagccccugcccccgaacugcgugcugucccauggacgcuccagucucuuccgugugugucuugagucccuaacuagacaguuagcucccugagggcaagggacugucauuuccucuugaguccuaccagggucuagcacaggacugggcuccuaacucucaggaaacacuugucggcugacuggugccucaagcgcuggagcuugucgguggccgguaaugggcagugcacguggggagaggguaugugaguuaacucaagggugccuuuucuugggcugugggcuggcuccccugggucaaaaguggaugucggaggccucaggcucuuaccuccuuggggcagugggagcaucagggacccccacccccaccccggcucugcaggagugcacggaaguggucguccagccuggauauuucuacagguugcugacuccugcgggagcugacugaguggaauaaauguucucucaacaucagcu

SEQ ID NO: 14635 - RNA, 9558 nt, Homo sapiens
gagggggaggcggggaggggaggcggggguggggcugaacuucagccccucggguucaugacaggcugcagggccugggguccgucugggguucuccugcugcgcgagggucacugggcucuggggagcugggaggguccgcgggcggacggcccugggaaagcccguggggucguucucgccuccagccccgcccggccagggccggcgugcaagugugcgcgagugggagcgcagggggcgcgcgggggcucggucuucucccgcccgguccgcuccuccgggcggaacccccuuugccgggcccccgggccgcagcugguuucgggaaaccgcgcagccugggcggggccgcagcccccacccgugcaucugccgucuccgcccucccgucgcuccccugcucggggucagcuaguguccgcucugcucggccgcgggcucccggaggacugcaggugaggcagggccuccgcggcccgggagacccucuugccgcaggacccucugucacgaggaguccccagggccaugcccccaccccguccuguccacaggacgucuuucuuccuccaaccugguuuccaggaggacucacguaggagggagggacagcugggugcagguguuucuccccagaaaaacggcuggagagcgggaggagaggccuggggcuggcgcgucccguccaccuucugccgccugcacgccuggacccuggcuggagcccuacggugggguggcuccugggacggggccagggagcggcggggcugccggacgcuuuccccagccccggggcacgggaagagcuggacagaggaaaguguucggggcagccgggaagagcccaccaccuaccaggcgucgggcggcccgcaggggaaucuccguggugccggccugguucagauccgacucuucaggcgggggcgaggcagaucuagggguuggcguggggcgggggaagcggugguccugggggcccggagguagcuggaacccgaggugcccucagggcgaggccugggccgucaagggaaggucuggcuggaaucuggggcugggcuggaagcagucugaagcuccuuuguacgugugcggaauugucuaacuccuguccuuucuaaccccaaggaggccaggugggugaaagagugaaacugcuuugaaaaguagguagaguacgaaugggagguguuauuagaauuguuaauaauauuugauuuaaacugugauacuuagccaggauguccauuagaauugccuaugcaggauuuauuuuagagccaggcaagcugauucuaaagugcaugugaagaaguagucuagcaaaaauggccaugacaauucugaaagaaaaaccacacgaggggaucaugaaacagcccaauuagcauuaagcuccauguuaaaauugugguaaugaugccuagcccaugagacaugccaaugggcagaauauaaggacuagaauaggccuacauuccuaggggaacuucauuucugcucaggagagaauuuuaaaucacugagaaaaagaggauguauuuuccgcaaauggaacguaucuuucagaaguuaaacaucugaaugacagcaacagaacuuggauccgugucucccaacggcgaagguuggucacccagcucccaaauuccagauggucggcauuuaaaagugaaaacugaaagcauaaaggcacuuagaagaaaauguggaagauuauuuuauaaucucgaaacggggaaguccuuuaaaaguguaagagcuagacaccauaaauagaaugaaauagaacauggauuguaugaauauacaagcaaggucaaaaaauaaacuucaaauuguaaagaaacauuugaaacucauaucacaaacgguaauuuugugaauagauaaagaacuuccauagaaaaaagcaaaacaaaacaaaacgaaacaaggacauaggaugugaacggagagcucacaaaagaagaaauaaaaauggcccugaacauaugaaaagacaaccaaccucacucauaauaagagaacuaugggccaggcgugguggcucacaccuguaauugcagcacuuugggaggcugaggugggaggauugcuugaguccaggaguuugagaccacccugggcaacaaagcaacaccccaucucucucucuaaaaaaagagaacuggccgggcgcgguggcucacgccuguaaucucagcacuuugggaggccgaggcgggcggaucaugaggucaggagaucgagaccauccuggcuaacacggugaaaccccgucucuacuaaaaauacaaaaaauuagcugggcuugauggcgggcgccuguaguuacucgggaggcugaggcaggagaauggcgugaacccgggagguggagcuggcagugagccgagaucgcgccacccuagccugggcgacagagcgagacuccaucucaaaaaaugaauaaauaaauaaauacauaauaaaaaaaugaaauaaaagaaaaccauggauuaaaaauauauggaaaucauuacagaaagcaggucagugguugcucauggccagugguuggggguauuuucuggggaggggcuuuagggaauguauugcuguguaggaauguccuuuaucuugauuguagcuguaauugcacaaauguguaaauuugucaaaacucguugagauauacauuuaaaaugggacauuuuuauuacauaaaauugauuaaaaucaaugcauuuuuccccauauaaaaggaaaaagauaaaagaguuugccuccugcaugugaauugcuaccaccuccguggaggauaacugacaauaucuacuaaaauugcaaaugcgcauuccuggugcccugccaauuccacauugucuguaauggaaaaggauuagaaauaaccuaaaugucugccaauagggaaccacuuaaauaaauuaugaggaauucauacucucaaaauauaugcaguuacacaaaugagugaagaagcuuuugugaaaguugucagaaucauaaucgagucacuugaguuaaaaaaaaaaucugaaaauggaaggcccacaaggcaggguucucaugcguaaauaaccugggaacaaaagucaucacaaaggacucuguaaaaugacaaccuuacacaaaaaaauacuucugugaggacauccaccagcaacugccugucuaacccuggacuugugucacccuuguuauugauccuuguagccaaggaugaucaccucaaagagauuauguaagucuccccauuuuuccuuuaaaaaccuuugucuuccuuuaccucccugaacgugcacaugauuuacuaugguaagcauauucucauugcaaugcccuauuccagaaucaaucucauuuucuuuuggagagccucucucuguuauuuagguugacacuuuuuauggacucauguaggauuauucuaaaaacauaugaucgugugaucacagcaucaugcaaaucaguguguauaguaugcugcuauuugugggaaaagggggcagaaauacuuuuucacacuuuuguaugcaaaaaugucaugguaggauuuauaagagacugauaauauuacuuugcaucugcaaggcaaauaggugguugagggaaaaagaugagcgauaagguuuuaaagguauauauacccuuuuguaucucuuaacuuuuuuauguguaaaaucacuauugauuuccagugccauugauaucugcacugggaagccccuuugaauuuugacaaagacacuguuuuuuguuuguuuguuuguuuguuuuuguuuuuuuugagauggagucucacucuguugcccaggcuggagugcaguggcaagaucugagcucacugcaaccucagccucccagguugaagugauucuccugccucagccuccugaguagcugggacuacaggugcacaccaccgugcggauuuuuguauuuuuaguagagagggaguuuugccacauuggccaggcuggucuugaacuccugaccucagguaauccacccaccucagccucccaaagcacugggauuacaggcgugagcuauugugcccagcugggaucuugacaaagacacuauuucucuccuuucaccugugcuguguauuuuucccucgccuaguucccagaccucacugcuauaugucuucucccuggcaggcaggaugacgcaaaacacggugauugugaauggaguugcuauggccucuaggccaucccagcccacccacgucaacguccacauccaccaggagucagcuuugacacaacugcugaaagcuggagguucucugaagaaguuucuuuuucacccuggggacacugugccuuccacagccaggauugguuaugagcagcuggcucuagggguaagacugggguggugcgggguuggggggcacguuaacgaggugaugaggucaauuaaaauauagagccaaaucuucaaaauuaaaacguuuuauuugggaggagagaauugcaauuuggggcauacacacagaccagguggucuccaguaugucuuuagaacaaagagaagguuagaggcuuauaaaaaggagaaauguuacauauugcccuucaugaaagaucauagguuuuggggagcuggugagcucugaugggugagcgauggcaugaguaaaacuaauccuagaguuguagcaaggucagaagcuguagauaaagcugguuucagguugcagcaggcagcuucagcagccugauuuguagagaauuacauuuugggagcaacauuuugugccccgagugcuuuuugccccuggccucucgacucuguuuuaguugagugugacaagaaugaccccauuuguaggcucagcuuucacaguggaaacucuccuucuucaauaggaugcaaaagaggaaaguggguugaauucccaugagagggacaugagaaaucacuauuuauaucucauucuguguaggaaaaaguuguaaguguccccacagaaauuuggauggaaaggaagaaucgaccuccucuuuggcacagaggagucggucccagccagagguagggcaacaggaagaacagucuagaggcuguuaauucgguuuuauugaccccacauggacugaaagccuacaggugcaaggcaauguguucagcacuucaggccaagcuacagagagaaucccugggcuauaucuaaaaguacucagugaccaucagaaggaacagcagcuacacuaaugacuggaacuaaagguagaucaggugagggagaagcacaucugacauccuugagggcaggagaacccugaauggagaaggaauagguauagacagagguggaagauggacaaaaaagaauuccagguuaaagaauggcaggagcaaaggcaaagaggccagaaggcauagggcaaguucuauaaugguuaagaguaaagggaaugggcuucaugaaugggugauuugggcccauauugcugagagccuugaacgaccaggugaggagucuguccugaaucagcuuugacagugagaacgcugucaauggauucugagcaggaaccugccucagagucaggaggcauccaggugagaaggaucgaggaucugcacucacauaaucauagcagaaauggugaggagacaaaggagucccuguccuucacagaccuccauggcaugggagugaagggguuuggggcauaaggaaagagaggcauucacagcaugcagagaggguugaagugugggugaccaggagaucggagcccugaaagucaggaggagcagccauucgagaggugugugugugugugugugugugugugugugugugugugugguaguaggggauuuggaugugacaaauccgagaugcugguaggauguggagguggugacaguuggguuuuccaggaagaagaggaguucucuucugagucggaguugggugugugaacggcuuauugggguaugacaccuaugaaaugaaaagagggggagcaggauugagcaggaggaaccaucaggcugcaaugcagacucugccaggccagugggggagcucccaggcaaagguugcccacugcaggaguuccacacuggguggagauggcccuugagccacugucuugcuuaaucauuggcuggggggcccuccucagugugugucuucagcuugaaaaauuagggugacccugaaggagcugacaacugcaggcugucagcaaucaaacaagcccuuucuugaaggaggucucagcggcacuucuuugugucugccacagagcccucaagaguguguguuuggaucugaagagaaaggauaggccagaagcucaggucaggcuggggguuuggaugggacaaugggaccucugaaggagaauggggggggaaaagugggaaucuucaggugggaugagaaaguguugaaguugggaaaaauugaugaaggauaaauagccaagccuaugagaagggugaggggagacccaggccagugcugcuucauggauuuuaaggggacagaaucuuccagaaucagagcugcagagaggucaaggcagaggaaaaggagaggagagccaccuagguaggagccaggcagcuggucccagggcagccggggcauguggacucacgggaaggggucugguuucucauccugucuugcaggugacucagauauugcuggggguugugaguuguguucuuggagugugucucagcuuggggcccuggacugugcugagugccucaggcugugccuucugggcggggucuguggugaguaaggaacaggcugugagccuggagggaggcaaguggugaugggcaagaaggcgcuuauggaucuugguuggggcuuuggggaagcgaccaaagucucuggagccaaauggccuuuggccaugaggaggcugcucugggguguagcuaaaacccugucacuuccauuuuucucuugaagacagaugggagggguggggcagguauagguggaauccuggucugugugucagaguucuuugucugucccugggauccugcuucacauuggcuauucugggaacugcuggugggagggugaugauagaccaauucagaagaguaaacuggaggccuuuuucuggugucucuuuucaggugaucgcagcaggagcuggggccauuguccaugagaagcacccgggcaaacuugcugugagucuuggacacccucucuccaccuuguucacugacccccuccugaauucugcuccauuaucugucuucugcccuuugguugucaauaucuuggggucuuucuuggaggggaggagaggguuuccuggacaagggcuggggaagaggagagggauuugaggcggggaccucaugacucuuccaccgauugaaggagcgugugucaugacccucuuucucuuccagggcuauauauccagccugcucacccuggcaggcuuugcuacagcuauggcugcuguuguccucugcgugaauagcuucaucuggcaaacugaacccuuuuuauacaucgacacugugugugaucgcucagacccugucuucccuaccacuggguacagauggaugcggcgaagucaagagaaccaauggcagaaggaggaguguagagcuuacaugcagaugcugagggugagcaggaagaguccagucuucggggacccaucacagcucuuuuuucccagggagcugggggcccuggaggacagagauguaggcucuuugagcuuggacuucaugcugggucuuucauucaggagguuuuaauguaagcuacagacauuuuucagaccucaugacacgaagauucucugaaucaaggagggugaggaacaaagaggagacauuucagagaggagauagugggucacccuucuggcuuuucugguguguugguaucacaguuuuccauuacugaauuaaaaaccacaccaaaauguaguggcuuaaaaugacaacuuauuauuucucacggugcugugaguuggcuggauucagaugagccauucucacucacggguuuucucaugcaguuacagucagaugggggugaaguuauccaagugcucgccgaggcuggaggucugagaugauguaguugcaugguccggagcucagcgggggcugucagcaagagccggcaauggcuucuccacuuggcuugggcuucucauagcacagaaacuggauuccaauggggaguacccuaguugcaagcauuucaggagacagaaaguagaagcugccagaccagcuaagggcuucccugucacuguauagugucacuuucacuguggccaaagcaguucuaggcccuuccagauucuacggguugaaggaauagucuccacuucuugacagggagugauaaguucacucugcagacaagccaacgggauggaagcuguggcuggaaacacagucagcuguggugggagcagcaagcuggauagagucagugccuggguggguggagaggguggugaugugggcagcauuggaguagcugacaccugacuaucuuuguucuucccuuaucuccagaaguuguucacagcaauccgugcccuguuccuggcugucugugucuugaaggucauuguguccuugguuuccuugggaguaggucuucgaaacuuguguggccagagcucccagccccuggugaguugucggggaggggccucugggcagcgugagucuggguggugagugugugggacagguaggagugcggggccaggggcacccgaaccugaggcugggccuggugccccucagcuucuuuccauaugcagcucuccccuuugcugucuggggaauguggccaucaccaugguccugggccaacugucgccgcccugugccucucugcgcccuccucugcucugaucuccccacucuccccucugcccugucccagguguucgucugacuccccuuccucugccaccuuguuuuuuuuuugccugaucugcuuuuccugucaccuuuuccuuucccuccuccuuuccucuuucugcuuucugaguucuaugauacuaacucugccugcauccuuuuccccuaaggauuucuuuuuucuuuuuuuuccagaaugaggaaggaucagagaagaggcuacugggggagaauucagugcccccuucgcccucuagggagcagaccuccacugccauuguccugugagcugccaaagaccccacggggugcccgcaugucccugucuagggcagcccagggcccccacuccuggcuccucacacuugccuccccuauggccgcucuccagacccuccuccuuucuucuccccacauccgcaccugcuguucccacucugggguucucaaguccaugaacagauauuguugcauuuuccacaaugcugauuaaacauaauaaacaauccagaaaagcaguuuugcccagaaagauaugguuucccuuuguuuauacaccucgugcgccaugaaaggccuuucuuugugucgcuauguaugagguuaaaugggagcugauuu

SEQ ID NO: 14636 - RNA, 16398 nt, Homo sapiens
gucauucaauaguuaucacauccaagcacaggacaggauuaggagagagcuaauucacuuuagugguaagaugcccuaagaugcuuucccacagaauuccuuauuccuuccaucugugccuucccuuugcuuuuuuuuugagauggaaucucacucuuguugcccagacuagagugcaauggcacgaucucggcucacugcaaccuccaccucccggauucaagcuacucuccugccucagcuucccaaggagcugagauuacaggcacuugucaccacacccggcuaauuuuuuuuuuuuuuuguagagauaggguuucaccauguuggccaggcuggucuugaacuccugaccucaaaugauccacccgccuuggccucccaaagugcugggauuacaggcgugagccacugcgcccagcccccuuugcauuuuauacaugaaaaaauuagaaaauauuuuguaggcuaacuccugaaaggucauucauaaauagauuuuaucuauguaccucauuccuucacuacuucccacuucaagccaguugugcccuuccugggucucuuuucaaauaguccuugcagggauaaaggacacauuugcucaagaguucacagugacugggcuccuaaaaaggccaauucaagguucaagguucaguaaugcuaccagucaacuaacaguucuaaaguacagaagcagugcacauaauuuaugcauuuuccacuuuguuuaccuucuaacaauauagugagaaaaacacuuccaaggauaagcuaguuccaagacacauauuacaagaaauaguuauugaaaugagccacaacugaagaagccaguaauaugcuuuuguuuaaaaaaaaaaaaaaaaaaaaaagccaggcacaguaguucaugccuguaaucccagcacuuugggaggccaagguggguggacugcuugagcccaggaguuugagaccagccugggcaacauggcaaaaccccaucucuucaaaaauuacaaaaauuagccaggcaugguagcgcuugccuguggucccagauacucaggggaggcugagaugggaggaucacuugagcccaggugguucaggaugcagugagcugagaucacaccacugcucuccaaccugggugagagugaaacucugucucaaaaaaaaaaaaaaaaaaaaaagaaaaaacaaaaaagaaaagaaaggaaaaacccaguauguauacccaaucagcaaauguuucuagaaauauuagaagauauuuugucgggagggaggagccaagauggccaaauaggaacagcuccagucuacagcucccagcgugagcgaugcagaagacgggugauuucugcauuuccaucugagguacuggguucaucucacuagggagugccagacagugggcgcaggucagugggugcaugcaccaugggugagccgaagcagggcgaggcauugccucacucgggaagcgcaaggggucagggaguucccuuuccuagucaaagaaaggggugacagacggcaccuggaaaaucgggucacucccacaugaauacugcgcuuuuccgacgggcuuaaaaaacggcacaccaggagauuauaucccgcaccuggcucggagggucguacgcccacggagucucgcugauugcuagcacagcagucugagaucaaacugcaaggcggcagcgaggcugggggaggggugcccgccauugcccaggcuugcuuagguaaacaaagcagccaggacgcucgaacuggguggagcccaccacagcucaaggaggccugccugccucuguaggcuccaccucugggggcagggcacagacagacaaaaagacagcaguaaccucugcagacuuaaaugucccugugugacagcuuugaagagagcagugguucucccagcacacagcuagagcucugagaacgggcagacugccuccucaagugggucccugaccccugacccccaagcagccuaacugggaggcaccccccagcaggggcacacugacaccucacagggccggguacuccaacagaccugcagcugaggguccugucuguuagaaggaaaacuaacaaacagaagggacauccacaccaaaaacccaucuguacaucaccgucaucaaagaccaaaaguagauaaaaccacaaagacggggaaaaaacagagcaaaaaaacuggaaacucuuaaaaagcagagugccucuccuucuccaaaggaacacaguuccucaccagcaacagagcaaagcuggacggagagugacuuugaugagcugagagaaggcuucagacaauccaauuacugugagcuacgggaggaaauucaaaccaaaggcaaagaaguugaaaacuuugaaaaaaguuuagaagaauguauaacuagaauaaccaauacacagaagugcuuaaaggagcugauggagcugaaaaccaaggcucgagaacuacgugaagaaugcagaagccucaggagccgaugugaucaacuggaagaaaggguaucagcgauggaagaugaagugaaugaaaugaagcaagaagggaaguuuagagaaaaaagaauaaaaagaaacgagcaaagccuccaagaaauaugggacuaugugaaaagaccaaaucuacgucugacugguguaccugaaagugacggggagaauggaaccaaguuggaaaacacucugcaggauauuaugcaggagaacuuccccaaucuagcaaggcaggccaacauucagauucaggaaauacagaaaacgccacaaagauacuccucgagaagagcaacuccaagacacauaauugucagauucaccaaaguugaaaugaaggaaaaaauguuaagggcagccagagagaaaggucggguuacccacaaagggaagcccaucagacuaacagcagaucucucagcagaaacucuacaagccagaagagagugggggccgauauucaacauucuuaaagaaaagaauuuucaacccagaauuucauauccagccaaacuaagcuucauaaguaaaggagaaauaaaauccuuuacaggcaagcaaaugccgagagauuuugucaccaccaggccugcccuaaaagagcuccugaaggaagcgcuaaacauggaaaggaacaaccgguaccagccacugcaaaaucaugccaaaacguaaagaccaucaagacuaggaagaaacugcaugaacuaacgagcaaaauaaccagcuaacaucauaaugacaugaucaaauucacacauaacaauauuaacuuuaaauguaaauggacuaaaugcuccaauuaaaagacacagacuggcaaauuggauaaagagucaagacccaucagugugcuguauucaggaaacccaucacgugcagacacacacauaggcucaaaauaaaaggauggaggaagaucuaccaagcaaauggaaaacaaaaaaaggcagggguugcaaucccagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcagaccuaauagacaucuacagaacucucuaccccaaaucaacagaauauacauuuuuuucagcaccacaccacaccuauuccaaaacugaccacauacuuggaaguaaagcucuccucagcaaauguaaaauaacagaaauuaaaacaaacuaucucucugaccacagugcaaucaaacuagaacucaggauuaagaaacucacucaaaacugcucaacuacauggaaacugaacaaccugcuccugaaugacuacuggguacauaacgaaauuaaggcagaaauaaagauguucuuugaaaccaacgagaacaaagacacaacauaccagaaucucugggaugcauucaaagcaguguguagagggaaauuuauagcacuaaaugcccacaagagaaagcaggaaagauccaaaauugacacccuaacaucacaauuaaaagaccuagaaaagcaagagaaaacacauucaaaagcuagcagaaggcaagaaauaacuaaaaucagagcagaacugaaggaaauagagacacaaaaaacccuugaaaaaauuaacgaauccaggagcugguuuuuugaaaggaucaacaaaauugauagacugcuagcaagacuaaucaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauaaauuccucgacacauacacccucccaagacuaagccaggaagaaguugaaucucugaauagaccaauaacaggagcugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacacaaaucaauaaauguaauccagcauauaaacagaaccaaagacaaaaaccacaugauuaucucaauagaugcagaaaaggccuuugacaaaauucaacaacccuucaugcuaaaaacucucaauaaauuagguauugaugggacguaucucaaaauaauaagagcuaucuaugacaaacccacagccaauaucauacugaaugggcaaaaacuggaagcauucccuuugaaaacuggcacaagacagggaugaccucucucaccacuccuacucaacauaguguuggaaguucuggccagggcaaucaggcaggagaaggaaauaaaggguauucaauuaggaaaagaggaaguccaauugucccuguuugcagaugacaugauuguauaucuagaaagccccauugucucagcccaaaaucuccuuaagcugauaagcaacuucagcaaagucucaggauacaaaaucaauguacaaaaaucacaagcauucuuauacaucaauaacagacaaacagagagccaaaucaugagugaacucccauucacaauugcuucaaagagaauaaaauaccuaggaauccaacuuacaagggaugugacggaccucuucaaggagaacuacaaaccacugcucaaugaaauaaaagaggauacaaacaaauggaagaacauuccaugcucauggguaggaagaaucaauaucgugaaaauggccauagugcccaagguaauuuacagauucaaugccauccucaucaagcuaccaaugacuuucuucacagaacuggaaaaaacuacuucaaaguucauacagaaccaaaaaagagcccgcauugccaagucaauccuaagccaaaagaacaaagcuggaggcaucacacuaccugacuucaaacuauacuacaaggcuacaguaaccaaaacagcaugggacugguaccaaaacagagauauagaucaauggaacagaacagaacagagcccucagaaauaacaccgcguaucuacaacuaucuaaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggacuaaagacuuaaacguuagaccuaaaaccauaaaaacccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuucgcaaccuacucaucugacaaaggguuaauauccagaaucuacaaugaacucaaacaaauuuacaggaaaaaaacaaauaaccccaucaaaaagugggccaaggacaugaacagacacuucucaaaagaagacauuuaugcagccaaaacacacaugaaaaaaugcucaccaucacuggccaucagagaaauacaaagcaaaaccacagugagauaccaucucacaccagcuagaauggcaaucauuaaaaagucaggaaacaacaggugcuggagaggauguggagaaauaggaacacuuuuacacuguuggugggacuguaaacuaguucaaccauuguggaagucaguguggcaauuccucagggaucuggaacuagaaauaccauuugacccagccauccaaucacuggguauauacccaaaggacuauaaaucaugcuacuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaacacauggacacaggaaggggaacaucacacucuggggacuguugugggguggggggaggggggagggauagcacugggagauauaccuaaugcuagaugacgaguuagugggugcagggcaccagcauggcacauguauacauauguaacuaaccugcacauugugcacauguacccuaaaacuuaaaguauaauaaauaaauuaauuaauuaauuaauuaaaaaagaagauauuuugucuuacacaacuuagacaugaacuacuugauaaacacuuucaugggauucucuugaaucuuagauuccuauugcauaauacuauaaauucagcucccaaguacucaaguuaacccaucaguacuguaguauguauacacacagccauaagacagauccuaauuucuaauuuuuuuuuuuuuuuuuuuugagacggagucucgcucuguggcccaggcuggagugcaguggcgcaaucucggcucacugcaagcuccgccucccggguucacgccauucuccugccucagccucccgaguagcugggacuacaggcgcccaccaucacgcccggcuaauuuuuuuguauuuuuaguagagacgggguuucaccguguuagccaggauggucucgaucuccugaccucgugauccgcccgccucggccucccaaagugcugggauuacaggcgugagccaccgcacccguccugaaauucuuaaaaagucucaaacaaccgcagagcaacaguuuugcuuucaaaaaucucaggaacuagguagaaaucuuuaaaauuuuaagccguuuucaaaaaucagccaaagaaaacaguaacacugggcucugacagcuuuacuagauguagaaaccaauuugugccauuuaaugucggacuaccaaaugacaucacucuucccacauggagaucacuaguggcacuaaugguuccaccuuuuuccugugagcccagagcagaggcaaagagcagagcacuaagcaccauaaauccauggagagauacugaucaccaacggcagaaccccacaucagacacacaggccgugccacucgcuugucccccaaugcagacuuaccaggaggccauuccguaggucacaguuuacucacccuguuugguaggaauuuuaaucguguuuauuuaaaucugagagucucuuugucucucuagacgcccaccuaugacacaggugaaaaaucaaucccacucaaaaguaguugggcuguauccuuucugcuaccucauuuguuuacauuuuucaagaaaaaucucaacuacuaucaucuuaaaucuuuaaaggaaaaauucaguuaauuguuuccuuuuuuucuuuuuuugagacagagucuugcucugucucccaggcuggaguguaguggcacaaucuuggcucacugcaaccuccaccuccuggguucaagcgauucuucugcuucagccuccugaguagcugggauuacaggcgugugccaccaugcccagcuaacuuuugucuuuuuaguaaaauuggguuucaccauacuggucaggcuggucuccaacuccugaccucaggugauccacugcgccuggcccuuaacuacuuuuuuuaaacaacuuuaagccuuugguuuccucugaagaaaauauuuuuaacaaaaacacuccagaaauaacaaaagggcugguucuuugaauauaaggaauaacuuuugccuauuuuccaauaaaauugaaaugggaaaggauaacuggacaagagaaaaauuaaaguacaacaaugugcuaacaaaucugaaaauagcaagaauuugucuaggaauuaccaagguuaaucacaaaaacuuauacaugaccaaguaauuuagaccucuacaaucaacuaccuaccuaaccuaaaguaagugcuauacccaaacagcuucaguacuucguucuuucaagccaaaugcucaagaagaaugacagaagcccagugaaaagacagacauggaaaaccagaaaggucaggcagacauauucuaugaguaaaaaaaauguaguaaaaauuuaaaacaagagccgggcgcgguggcucaugccuguaaucccagcacuuuggcaggcugaggcaggaggaucacgagguccggagaucgagaccauccuggcuaacaccgugaaaccccgucucugcuaaaaaagaaauacaaaaauuagcugggugugguggcgggcaccuguagucccagcuacucgggaggcugaggcaggagaauggcaugaacccggaagguggagcuugcagugagcagagaucacgccauugcacuccagccugggcgacagagcaagacuccgucucaaaaaaaaaaaaaauuaaaacaaggaauggauacaauaaauaacauccuaauuugcuuuuuuaccuuaacuuggauaucuuuuuucacucaaacgucccuacugcauuuugacaagaguauucccucaaauagauauaccacaguugauuuaccucaccuacagugugugugcauaguuuccaacuucaauguuucaauaaaaucuuuguacauaaaauuugugcccuguuugaauaccucuacugcaacacguucuuagaaguagaacugcugagucaaaagggccugaacauuuaaaauugguaaauauuaaauucccauacaaaaaggccccugcucagucuauggaauucuaguuauuccauuccaguaggacuccaguuaauacauuuaugauaccuuugaauacugccuuuguuuucacauaagaguaguggagauggguaaaaagcaugcugagauaaaaauucagguugaggcaaaaauaacuuugacaagggugaguguaugcagcagccauguggcaagaucaguuugggucuccucugugugaggugcugugcaugaccucauuuguaccccacaacagauccaauuucuagaaacuaacaacauucucauuuuagaauugaaaaaacugagccagagagguuaaguuauuugccugaagucacacaccaccugguggagccacgauucaaaccuggguuucucuaucuccuaagccagauucauaaaccaguaugaagcucucaauggguauagauaugcuuuaaaauacagccagagcugccaggcacgguggcucacgccuguaaucccagcacuuugggaaggccgaggugggcagaucacaaggucaggaguucgacaccagccuggccaacauaguaaaaccccaucuccacugaaaauacaaaaaauaagccaggcaugguggcaggcaccuguaaucccagcuacucgagaggcugaggcaggagaauggcuugaaccugggaggcggaggcuacagugagcagagaucacaccauugcacuccagcccgggugacaguacaagacucugucucaaaaaaauaaaauaaaauaauguauaauauuuauacaauauauauuuauauaauauuuauauuauauauauauuucucuagagcugucaaaaauauacaugaaagcuuuaaagaaaagugcccacuagaacugucacucgaggggcugccuuccccucuccucucacaagucccuugauuggccuugguaugacuuccugugagucaaaagaaauuucuuuugcguaguuggcaaaagcuuaaaccuaugaucaucaaaaugcuaaaaagggcauccagagacagucaguuauuuuuauuuugaaaaauagggguggacugaagauuaagaacugaaagcaacaacugaaagcaagcaauguuggccgggcuggucuugaacuccugaccucaggugauccgcccgccuuggccucccagagugcuggaauuacucagguaguucuuuauagcggugugaaaacagacuaauauauacuagacauacggucuagaaucauacauugcuuuuucuuguuuuuucugagacggagucuugcucuuuugcccaggcuggagugcaguggcacaaucucggcucacugcaacugcaaccuccgccuuccaaguucaagcuauucuccugccucagccucccgaauagcuggaauuacaggugcacaccaccaugcccggcuaauuuuuguauuuuuuaguagagaugggguuuuaccauguuggccaggcuggucucaaaugccugaccucaagugauccgcccaccucagccucccaaaguguugggauuacaggcaugagccacugcgcccggcugcuuuauuuuucauaaaagugaaaggcaugauuuauacuaagaugauuucuuccuuucuuuaauaaauuuauugaccauaaaauacauguacuaccaugaugauuugggaccaugaugauuuggaacugucugucaauuuuaaaaguuugugcucuuugacuuagaaguucuauuacauaaauucuuagaaguauuuguaccaaggcacagaaguuuauguuuaaaaauuugauugcaucauuacaugaauuagugaaaaauggaaaacugaacuuucugaaaaucuuuauaaagcaccuucagauauagcuaaauaacugucaggugaagauaaaggaauugaaacuuuuaaguugcaaaguaucuuaaacgugcauaagauggguguguacagaugagacagagugagacucugucucaaaaacaaaaacaaaaaacaaacaaaaaaagaacuacccaagaauggguaauuuauaaagaaaaggaguuuagacucaccccuguaauccuaacacuuuggaaggccaagguggguggaucaccugaggucaggaguucgagaccaaccugggcaacauggugaaaccccgucucuacugaaaauacaaaaauuagcugggcgugguggcgugugccuguagucccagcuacucgggaggcugaggcaggagaacugcuugaaccugggaggcagagguugcagugagcugagauugugccacugcacuccagccugggugacagagcgaaacugucucagaaaaaaaaaaaaaagaaaaaaaaaaggaguuuaauugacucaguuggcugggcaggccucaaaaaacuuacaaucguggcggaagacaaauggguaacaagguacgucuuacuuggcggcaggagggagagagagagaguaagggauggggcaagugucacaccuuuaaacccuuagauuucaugagaacucacuaucacaagaacagcaagggggaaauccgcccccaugauccaaucaccucccacugacaagugggaauuacaauucaagaugagauuuggguggggacacagccaaaccauaucaacuaguuuccuacaaaugaaaaucacuuaaacucuauugucucuuccuuuauaucuucaauccccaucauguaccucuuauuuauguaagaguuaacccaaaauucaauucaucaucucuaaucacccacccaucucuaaucauuuguuucuucagcaccuguauaaacagauguacuaaauuuguaccauauuguuuacaacuuggcaaaguucucuggcauacuccauguuuucuaggauaauguaacacacugcaaguauuaauauagcuguuagcuaaaugaaaucucccuucuggcuauucagcauuuuuagaacacauacaucagaagaagacuugccuuccuacuaaacuauuauguggagauuuguguuaggggccuguccugcacagcuuggccagaucacuucuguuucucuucaccaacaaagaacacaaaauaaaauuauuucauucuucacuauuuaagucagaagaacagcaucucucuuuggaagauacuauauaacucacagcccccagugugucacacaauuaccaugugucauuuaucccuuuauggccuuuuuuauuuuauaacuggauagaccaagugaauuaaugccaacacugacuaucaacugugcucaauguuagcauuacuucaucauucugguccuuguaucaagaccauuaaguuaaucuugaccauuuuaaaaaaaauuaagggugggaucuaaauauuuuaucucacuaagaauguccguauuauguucuucugaacaauauacuugggggaagcugguggugauaaagaccuuuucaauggucaaacuaaaccuaauguguaacuuucccagauuuaccccacaguauuuugucaugacuguguaauuauuuguuuccugggcuuuguuccaaaaagaauuuuaugcugcuuauaaaauacacauaaucuguaaagauaaaacaaaggaggugaagaaauaagagcauagggaacugaacacucaagauaagaugaagccaaaaaugcuguuauacaaaucuggcuuuaagcuuccucgcagcuaauuuuuuaaaaaguuaguugcaugauuucccaugacuaugagagaaaaacuauucauuuacuuauuaaaaaaugacuauuccugguacugguuucagagagcaauuccuaaauauccccagagaacacuaauguagcagcauccuccucagagugaaagccuggcccgaacaugcaugugucuuagccuggaacacguccaaggcugcuguugugagaaacaaaaacaaaguuaucuuucugacauagugaugaagggcuguccauguucuuguuuugcugaugagaaauaacaaacccaaaaugaagcuuaagcauaaacuuaagagaaauguugugugaagcuuuggaaaaggaauaguggccaguagauaagggucaaaaggaccaaaauguaacagaaaaaaagggcacauacaugaagaaucaauguguagacuuuaaaauguccuauccuggaaugaaaacagaagcaacagaacuugucaaauagaagcagcagaguuagaagcaaacuaaguguuuuuccacaccaggagaugcugcccuagaaugacagacaaugaugugugcuguuggcaaucaugucuugaagaaaaguugacucaucagaugucugaggcuuggugaagacauuucugaacgucguccaauucccuuugcuccaauuuccuauccaugaagcaucuucuuaaccaaagauuacuuuucaagaaaauuuuccucugggaauguaaggcagcucacauaaauaugcugucaacuuuugccaaucauuaaauuggcucucugguacacuucauucuuauaugggauucagaauaagccaugagccgggugcugugguucacgccuguacucccagcacuuuggaaggcugaggcgggcggaucccuugaggucaggaguucgagaccagcugggcugauaugaugaaaccccaucucuacuaaaaguacaaaaauuagcugggcacgugacuguaauuccagcuacucaggaggcugaggcaggagaaucgcucgaaucugggagguggagguuacagugagccaagaucaugacacugcacuccagagccugggcaacagagcgagacucugucucaaaaaauaaaaaagaaaagaaaucgagacuaaaauaagccuaugcuagaacaagccugugucaggauuuggacaccccaaauaggcagauaauuuaaauuuuuacuugcaaaacucagcaggcagagcaaaaguuauaagccuuuuucaccugaauuuaagucuaugagaccuagguuggaaaaggcccauuagcguuacccagucuuguuacacauuccuuccauuuaaguuaaggucuaguugcauugucugaaccuuuucuuggauacauucuuugggacugaaggauguucacaggacauaagcugcuucccaauggauuugugccagaugccuaucggcaaaacuuccuuuggacuucuuggcagacucucaacuacggcuugaaauaacagaagaacaaagcugcucaacugaaaguuugcauaacuggugaagucugccaaugaguaauuccuaaucaucuaucgugaagacauacaaguaugagcaaacaguaagguuaaguguauuuacuuugugggggacaaaaucuaagacaucacaaaggcauggagacaugcaugucagccaacaugaucagccuccagguaccuggaaggaugccacgguuucccuuuggcuuguaaaauagauacuccuggguuuuuuuguuguuguuuuuaaauggauuuuggucuggaacugaaacuaaguuuacucaacuccaugaccugaacaaaauauugaagucuuuaacauuaaaaaaaaaaaaaaaaaaaaaaaggcaaagaaaguuuuucaccauaacuagauaaccaaggcuucucagagauaauaaaugugcacagugaguuacuuacuuagaaauuguuuaccaacaaaagaguugcacccacugugagaaaucuuaaggaggaagacuaagagacucccugaaacacucaucugauuuaaaaaauuccuuccaacucauaauuuuuuuuuuuuuggacaaggucucacucugucacccaggcuggagugcaguggcucaaucacggaucacugcagccuugaccucccugggcucaggugaucuuccuacuuuagccuuccaaguagcugggauaggcaaaggccaccacccccggcuaaucuaaaaaaguuuuuuuuuuuuuguagagacagaguucucccuauguugcccagccugaucucaagcaauccucuuaccuuggccucccaaagugcugggauuacaggcauaaaccaccgcgccuggcccuuuguuucuuaaagaguaccuuaagccuaaaaaagugcuaaucucucuugccucuuucauaagcagaaagcuagccauuuuaagauuacacuaucauuuuggagacuucugagaagacuccaaagaggcuaucaaaacugaagccagcagcccuugggauuacuucugccaauccaacuguaugcugccaagaccauccagcuaaggcgacacgcacuaugccaauuccagcucuugcucugcuucacuagcugccaauuccuucuucccuacuguuugagcauuucugaaaggcgcguuuccugucauuuauaaacucgaaguuugccaguuaaguacuguacgagccagcugcuaggcaggaacuagagacuuuuugucuguuggaagaaccaacucuuuggcucuggggagacucaaccuggcaaguucugggaagaagagaauauugugggggaacuaguaggcaaaguucuagaauggaauagaggcaagggauuuauccaaagaagagaugcaucauuucuacuuucaugcuacaaagcaggaaugagaaaacaugaguagagaaaugcaacaauucuaaaagaaaaaggaaguaguauauau

SEQ ID NO: 14637 - RNA, 16398 nt, Homo sapiens
auauauacuacuuccuuuuucuuuuagaauuguugcauuucucuacucauguuuucucauuccugcuuuguagcaugaaaguagaaaugaugcaucucuucuuuggauaaaucccuugccucuauuccauucuagaacuuugccuacuaguucccccacaauauucucuucuucccagaacuugccagguugagucuccccagagccaaagaguugguucuuccaacagacaaaaagucucuaguuccugccuagcagcuggcucguacaguacuuaacuggcaaacuucgaguuuauaaaugacaggaaacgcgccuuucagaaaugcucaaacaguagggaagaaggaauuggcagcuagugaagcagagcaagagcuggaauuggcauagugcgugucgccuuagcuggauggucuuggcagcauacaguuggauuggcagaaguaaucccaagggcugcuggcuucaguuuugauagccucuuuggagucuucucagaagucuccaaaaugauaguguaaucuuaaaauggcuagcuuucugcuuaugaaagaggcaagagagauuagcacuuuuuuaggcuuaagguacucuuuaagaaacaaagggccaggcgcggugguuuaugccuguaaucccagcacuuugggaggccaagguaagaggauugcuugagaucaggcugggcaacauagggagaacucugucucuacaaaaaaaaaaaaacuuuuuuagauuagccgggggugguggccuuugccuaucccagcuacuuggaaggcuaaaguaggaagaucaccugagcccagggaggucaaggcugcagugauccgugauugagccacugcacuccagccugggugacagagugagaccuuguccaaaaaaaaaaaaauuaugaguuggaaggaauuuuuuaaaucagaugaguguuucagggagucucuuagucuuccuccuuaagauuucucacagugggugcaacucuuuuguugguaaacaauuucuaaguaaguaacucacugugcacauuuauuaucucugagaagccuugguuaucuaguuauggugaaaaacuuucuuugccuuuuuuuuuuuuuuuuuuuuuuuaauguuaaagacuucaauauuuuguucaggucauggaguugaguaaacuuaguuucaguuccagaccaaaauccauuuaaaaacaacaacaaaaaaacccaggaguaucuauuuuacaagccaaagggaaaccguggcauccuuccagguaccuggaggcugaucauguuggcugacaugcaugucuccaugccuuugugaugucuuagauuuugucccccacaaaguaaauacacuuaaccuuacuguuugcucauacuuguaugucuucacgauagaugauuaggaauuacucauuggcagacuucaccaguuaugcaaacuuucaguugagcagcuuuguucuucuguuauuucaagccguaguugagagucugccaagaaguccaaaggaaguuuugccgauaggcaucuggcacaaauccauugggaagcagcuuauguccugugaacauccuucagucccaaagaauguauccaagaaaagguucagacaaugcaacuagaccuuaacuuaaauggaaggaauguguaacaagacuggguaacgcuaaugggccuuuuccaaccuaggucucauagacuuaaauucaggugaaaaaggcuuauaacuuuugcucugccugcugaguuuugcaaguaaaaauuuaaauuaucugccuauuugggguguccaaauccugacacaggcuuguucuagcauaggcuuauuuuagucucgauuucuuuucuuuuuuauuuuuugagacagagucucgcucuguugcccaggcucuggagugcagugucaugaucuuggcucacuguaaccuccaccucccagauucgagcgauucuccugccucagccuccugaguagcuggaauuacagucacgugcccagcuaauuuuuguacuuuuaguagagaugggguuucaucauaucagcccagcuggucucgaacuccugaccucaagggauccgcccgccucagccuuccaaagugcugggaguacaggcgugaaccacagcacccggcucauggcuuauucugaaucccauauaagaaugaaguguaccagagagccaauuuaaugauuggcaaaaguugacagcauauuuaugugagcugccuuacauucccagaggaaaauuuucuugaaaaguaaucuuugguuaagaagaugcuucauggauaggaaauuggagcaaagggaauuggacgacguucagaaaugucuucaccaagccucagacaucugaugagucaacuuuucuucaagacaugauugccaacagcacacaucauugucugucauucuagggcagcaucuccugguguggaaaaacacuuaguuugcuucuaacucugcugcuucuauuugacaaguucuguugcuucuguuuucauuccaggauaggacauuuuaaagucuacacauugauucuucauguaugugcccuuuuuuucuguuacauuuugguccuuuugacccuuaucuacuggccacuauuccuuuuccaaagcuucacacaacauuucucuuaaguuuaugcuuaagcuucauuuuggguuuguuauuucucaucagcaaaacaagaacauggacagcccuucaucacuaugucagaaagauaacuuuguuuuuguuucucacaacagcagccuuggacguguuccaggcuaagacacaugcauguucgggccaggcuuucacucugaggaggaugcugcuacauuaguguucucuggggauauuuaggaauugcucucugaaaccaguaccaggaauagucauuuuuuaauaaguaaaugaauaguuuuucucucauagucaugggaaaucaugcaacuaacuuuuuaaaaaauuagcugcgaggaagcuuaaagccagauuuguauaacagcauuuuuggcuucaucuuaucuugaguguucaguucccuaugcucuuauuucuucaccuccuuuguuuuaucuuuacagauuauguguauuuuauaagcagcauaaaauucuuuuuggaacaaagcccaggaaacaaauaauuacacagucaugacaaaauacugugggguaaaucugggaaaguuacacauuagguuuaguuugaccauugaaaaggucuuuaucaccaccagcuucccccaaguauauuguucagaagaacauaauacggacauucuuagugagauaaaauauuuagaucccacccuuaauuuuuuuuaaaauggucaagauuaacuuaauggucuugauacaaggaccagaaugaugaaguaaugcuaacauugagcacaguugauagucaguguuggcauuaauucacuuggucuauccaguuauaaaauaaaaaaggccauaaagggauaaaugacacaugguaauugugugacacacugggggcugugaguuauauaguaucuuccaaagagagaugcuguucuucugacuuaaauagugaagaaugaaauaauuuuauuuuguguucuuuguuggugaagagaaacagaagugaucuggccaagcugugcaggacaggccccuaacacaaaucuccacauaauaguuuaguaggaaggcaagucuucuucugauguauguguucuaaaaaugcugaauagccagaagggagauuucauuuagcuaacagcuauauuaauacuugcaguguguuacauuauccuagaaaacauggaguaugccagagaacuuugccaaguuguaaacaauaugguacaaauuuaguacaucuguuuauacaggugcugaagaaacaaaugauuagagaugggugggugauuagagaugaugaauugaauuuuggguuaacucuuacauaaauaagagguacaugauggggauugaagauauaaaggaagagacaauagaguuuaagugauuuucauuuguaggaaacuaguugauaugguuuggcuguguccccacccaaaucucaucuugaauuguaauucccacuugucagugggaggugauuggaucaugggggcggauuucccccuugcuguucuugugauagugaguucucaugaaaucuaaggguuuaaaggugugacacuugccccaucccuuacucucucucucucccuccugccgccaaguaagacguaccuuguuacccauuugucuuccgccacgauuguaaguuuuuugaggccugcccagccaacugagucaauuaaacuccuuuuuuuuuucuuuuuuuuuuuuuucugagacaguuucgcucugucacccaggcuggagugcaguggcacaaucucagcucacugcaaccucugccucccagguucaagcaguucuccugccucagccucccgaguagcugggacuacaggcacacgccaccacgcccagcuaauuuuuguauuuucaguagagacgggguuucaccauguugcccagguuggucucgaacuccugaccucaggugauccacccaccuuggccuuccaaaguguuaggauuacaggggugagucuaaacuccuuuucuuuauaaauuacccauucuuggguaguucuuuuuuuguuuguuuuuuguuuuuguuuuugagacagagucucacucugucucaucuguacacacccaucuuaugcacguuuaagauacuuugcaacuuaaaaguuucaauuccuuuaucuucaccugacaguuauuuagcuauaucugaaggugcuuuauaaagauuuucagaaaguucaguuuuccauuuuucacuaauucauguaaugaugcaaucaaauuuuuaaacauaaacuucugugccuugguacaaauacuucuaagaauuuauguaauagaacuucuaagucaaagagcacaaacuuuuaaaauugacagacaguuccaaaucaucauggucccaaaucaucaugguaguacauguauuuuauggucaauaaauuuauuaaagaaaggaagaaaucaucuuaguauaaaucaugccuuucacuuuuaugaaaaauaaagcagccgggcgcaguggcucaugccuguaaucccaacacuuugggaggcugaggugggcggaucacuugaggucaggcauuugagaccagccuggccaacaugguaaaaccccaucucuacuaaaaaauacaaaaauuagccgggcaugguggugugcaccuguaauuccagcuauucgggaggcugaggcaggagaauagcuugaacuuggaaggcggagguugcaguugcagugagccgagauugugccacugcacuccagccugggcaaaagagcaagacuccgucucagaaaaaacaagaaaaagcaauguaugauucuagaccguaugucuaguauauauuagucuguuuucacaccgcuauaaagaacuaccugaguaauuccagcacucugggaggccaaggcgggcggaucaccugaggucaggaguucaagaccagcccggccaacauugcuugcuuucaguuguugcuuucaguucuuaaucuucaguccaccccuauuuuucaaaauaaaaauaacugacugucucuggaugcccuuuuuagcauuuugaugaucauagguuuaagcuuuugccaacuacgcaaaagaaauuucuuuugacucacaggaagucauaccaaggccaaucaagggacuugugagaggagaggggaaggcagccccucgagugacaguucuagugggcacuuuucuuuaaagcuuucauguauauuuuugacagcucuagagaaauauauauauaauauaaauauuauauaaauauauauuguauaaauauuauacauuauuuuauuuuauuuuuuugagacagagucuuguacugucacccgggcuggagugcaauggugugaucucugcucacuguagccuccgccucccagguucaagccauucuccugccucagccucucgaguagcugggauuacaggugccugccaccaugccuggcuuauuuuuuguauuuucaguggagaugggguuuuacuauguuggccaggcuggugucgaacuccugaccuugugaucugcccaccucggccuucccaaagugcugggauuacaggcgugagccaccgugccuggcagcucuggcuguauuuuaaagcauaucuauacccauugagagcuucauacugguuuaugaaucuggcuuaggagauagagaaacccagguuugaaucguggcuccaccagguggugugugacuucaggcaaauaacuuaaccucucuggcucaguuuuuucaauucuaaaaugagaauguuguuaguuucuagaaauuggaucuguugugggguacaaaugaggucaugcacagcaccucacacagaggagacccaaacugaucuugccacauggcugcugcauacacucacccuugucaaaguuauuuuugccucaaccugaauuuuuaucucagcaugcuuuuuacccaucuccacuacucuuaugugaaaacaaaggcaguauucaaagguaucauaaauguauuaacuggaguccuacuggaauggaauaacuagaauuccauagacugagcaggggccuuuuuguaugggaauuuaauauuuaccaauuuuaaauguucaggcccuuuugacucagcaguucuacuucuaagaacguguugcaguagagguauucaaacagggcacaaauuuuauguacaaagauuuuauugaaacauugaaguuggaaacuaugcacacacacuguaggugagguaaaucaacugugguauaucuauuugagggaauacucuugucaaaaugcaguagggacguuugagugaaaaaagauauccaaguuaagguaaaaaagcaaauuaggauguuauuuauuguauccauuccuuguuuuaauuuuuuuuuuuuuugagacggagucuugcucugucgcccaggcuggagugcaauggcgugaucucugcucacugcaagcuccaccuuccggguucaugccauucuccugccucagccucccgaguagcugggacuacaggugcccgccaccacacccagcuaauuuuuguauuucuuuuuuagcagagacgggguuucacgguguuagccaggauggucucgaucuccggaccucgugauccuccugccucagccugccaaagugcugggauuacaggcaugagccaccgcgcccggcucuuguuuuaaauuuuuacuacauuuuuuuuacucauagaauaugucugccugaccuuucugguuuuccaugucugucuuuucacugggcuucugucauucuucuugagcauuuggcuugaaagaacgaaguacugaagcuguuuggguauagcacuuacuuuagguuagguagguaguugauuguagaggucuaaauuacuuggucauguauaaguuuuugugauuaaccuugguaauuccuagacaaauucuugcuauuuucagauuuguuagcacauuguuguacuuuaauuuuucucuuguccaguuauccuuucccauuucaauuuuauuggaaaauaggcaaaaguuauuccuuauauucaaagaaccagcccuuuuguuauuucuggaguguuuuuguuaaaaauauuuucuucagaggaaaccaaaggcuuaaaguuguuuaaaaaaaguaguuaagggccaggcgcaguggaucaccugaggucaggaguuggagaccagccugaccaguauggugaaacccaauuuuacuaaaaagacaaaaguuagcugggcaugguggcacacgccuguaaucccagcuacucaggaggcugaagcagaagaaucgcuugaacccaggagguggagguugcagugagccaagauugugccacuacacuccagccugggagacagagcaagacucugucucaaaaaaagaaaaaaaggaaacaauuaacugaauuuuuccuuuaaagauuuaagaugauaguaguugagauuuuucuugaaaaauguaaacaaaugagguagcagaaaggauacagcccaacuacuuuugagugggauugauuuuucaccugugucauaggugggcgucuagagagacaaagagacucucagauuuaaauaaacacgauuaaaauuccuaccaaacagggugaguaaacugugaccuacggaauggccuccugguaagucugcauugggggacaagcgaguggcacggccugugugucugaugugggguucugccguuggugaucaguaucucuccauggauuuauggugcuuagugcucugcucuuugccucugcucugggcucacaggaaaaagguggaaccauuagugccacuagugaucuccaugugggaagagugaugucauuugguaguccgacauuaaauggcacaaauugguuucuacaucuaguaaagcugucagagcccaguguuacuguuuucuuuggcugauuuuugaaaacggcuuaaaauuuuaaagauuucuaccuaguuccugagauuuuugaaagcaaaacuguugcucugcgguuguuugagacuuuuuaagaauuucaggacgggugcgguggcucacgccuguaaucccagcacuuugggaggccgaggcgggcggaucacgaggucaggagaucgagaccauccuggcuaacacggugaaaccccgucucuacuaaaaauacaaaaaaauuagccgggcgugauggugggcgccuguagucccagcuacucgggaggcugaggcaggagaauggcgugaacccgggaggcggagcuugcagugagccgagauugcgccacugcacuccagccugggccacagagcgagacuccgucucaaaaaaaaaaaaaaaaaaaauuagaaauuaggaucugucuuauggcuguguguauacauacuacaguacugauggguuaacuugaguacuugggagcugaauuuauaguauuaugcaauaggaaucuaagauucaagagaaucccaugaaaguguuuaucaaguaguucaugucuaaguuguguaagacaaaauaucuucuuuuuuaauuaauuaauuaauuaauuuauuuauuauacuuuaaguuuuaggguacaugugcacaaugugcagguuaguuacauauguauacaugugccaugcuggugcccugcacccacuaacucgucaucuagcauuagguauaucucccagugcuaucccuccccccuccccccaccccacaacaguccccagagugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauaguagcaugauuuauaguccuuuggguauauacccagugauuggauggcugggucaaaugguauuucuaguuccagaucccugaggaauugccacacugacuuccacaaugguugaacuaguuuacagucccaccaacaguguaaaaguguuccuauuucuccacauccucuccagcaccuguuguuuccugacuuuuuaaugauugccauucuagcuggugugagaugguaucucacugugguuuugcuuuguauuucucugauggccagugauggugagcauuuuuucauguguguuuuggcugcauaaaugucuucuuuugagaagugucuguucauguccuuggcccacuuuuugaugggguuauuuguuuuuuuccuguaaauuuguuugaguucauuguagauucuggauauuaacccuuugucagaugaguagguugcgaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuaggguuuuuaugguuuuaggucuaacguuuaagucuuuaguccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagauuagauaguuguagauacgcgguguuauuucugagggcucuguucuguucuguuccauugaucuauaucucuguuuugguaccagucccaugcuguuuugguuacuguagccuuguaguauaguuugaagucagguagugugaugccuccagcuuuguucuuuuggcuuaggauugacuuggcaaugcgggcucuuuuuugguucuguaugaacuuugaaguaguuuuuuccaguucugugaagaaagucauugguagcuugaugaggauggcauugaaucuguaaauuaccuugggcacuauggccauuuucacgauauugauucuuccuacccaugagcauggaauguucuuccauuuguuuguauccucuuuuauuucauugagcagugguuuguaguucuccuugaagagguccgucacaucccuuguaaguuggauuccuagguauuuuauucucuuugaagcaauugugaaugggaguucacucaugauuuggcucucuguuugucuguuauugauguauaagaaugcuugugauuuuuguacauugauuuuguauccugagacuuugcugaaguugcuuaucagcuuaaggagauuuugggcugagacaauggggcuuucuagauauacaaucaugucaucugcaaacagggacaauuggacuuccucuuuuccuaauugaauacccuuuauuuccuucuccugccugauugcccuggccagaacuuccaacacuauguugaguaggaguggugagagaggucaucccugucuugugccaguuuucaaagggaaugcuuccaguuuuugcccauucaguaugauauuggcuguggguuugucauagauagcucuuauuauuuugagauacgucccaucaauaccuaauuuauugagaguuuuuagcaugaaggguuguugaauuuugucaaaggccuuuucugcaucuauugagauaaucaugugguuuuugucuuugguucuguuuauaugcuggauuacauuuauugauuuguguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucaggaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagcuccuguuauuggucuauucagagauucaacuucuuccuggcuuagucuugggaggguguaugugucgaggaauuuauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuugauuagucuugcuagcagucuaucaauuuuguugauccuuucaaaaaaccagcuccuggauucguuaauuuuuucaaggguuuuuugugucucuauuuccuucaguucugcucugauuuuaguuauuucuugccuucugcuagcuuuugaauguguuuucucuugcuuuucuaggucuuuuaauugugauguuagggugucaauuuuggaucuuuccugcuuucucuugugggcauuuagugcuauaaauuucccucuacacacugcuuugaaugcaucccagagauucugguauguugugucuuuguucucguugguuucaaagaacaucuuuauuucugccuuaauuucguuauguacccaguagucauucaggagcagguuguucaguuuccauguaguugagcaguuuugagugaguuucuuaauccugaguucuaguuugauugcacuguggucagagagauaguuuguuuuaauuucuguuauuuuacauuugcugaggagagcuuuacuuccaaguauguggucaguuuuggaauaggugugguguggugcugaaaaaaauguauauucuguugauuugggguagagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacugggauugcaaccccugccuuuuuuuguuuuccauuugcuugguagaucuuccuccauccuuuuauuuugagccuaugugugugucugcacgugauggguuuccugaauacagcacacugaugggucuugacucuuuauccaauuugccagucugugucuuuuaauuggagcauuuaguccauuuacauuuaaaguuaauauuguuaugugugaauuugaucaugucauuaugauguuagcugguuauuuugcucguuaguucaugcaguuucuuccuagucuugauggucuuuacguuuuggcaugauuuugcaguggcugguaccgguuguuccuuuccauguuuagcgcuuccuucaggagcucuuuuagggcaggccugguggugacaaaaucucucggcauuugcuugccuguaaaggauuuuauuucuccuuuacuuaugaagcuuaguuuggcuggauaugaaauucuggguugaaaauucuuuucuuuaagaauguugaauaucggcccccacucucuucuggcuuguagaguuucugcugagagaucugcuguuagucugaugggcuucccuuuguggguaacccgaccuuucucucuggcugcccuuaacauuuuuuccuucauuucaacuuuggugaaucugacaauuaugugucuuggaguugcucuucucgaggaguaucuuuguggcguuuucuguauuuccugaaucugaauguuggccugccuugcuagauuggggaaguucuccugcauaauauccugcagaguguuuuccaacuugguuccauucuccccgucacuuucagguacaccagucagacguagauuuggucuuuucacauagucccauauuucuuggaggcuuugcucguuucuuuuuauucuuuuuucucuaaacuucccuucuugcuucauuucauucacuucaucuuccaucgcugauacccuuucuuccaguugaucacaucggcuccugaggcuucugcauucuucacguaguucucgagccuugguuuucagcuccaucagcuccuuuaagcacuucuguguauugguuauucuaguuauacauucuucuaaacuuuuuucaaaguuuucaacuucuuugccuuugguuugaauuuccucccguagcucacaguaauuggauugucugaagccuucucucagcucaucaaagucacucuccguccagcuuugcucuguugcuggugaggaacuguguuccuuuggagaaggagaggcacucugcuuuuuaagaguuuccaguuuuuuugcucuguuuuuuccccgucuuugugguuuuaucuacuuuuggucuuugaugacggugauguacagauggguuuuugguguggaugucccuucuguuuguuaguuuuccuucuaacagacaggacccucagcugcaggucuguuggaguacccggcccugugaggugucagugugccccugcuggggggugccucccaguuaggcugcuugggggucaggggucagggacccacuugaggaggcagucugcccguucucagagcucuagcugugugcugggagaaccacugcucucuucaaagcugucacacagggacauuuaagucugcagagguuacugcugucuuuuugucugucugugcccugcccccagagguggagccuacagaggcaggcaggccuccuugagcuguggugggcuccacccaguucgagcguccuggcugcuuuguuuaccuaagcaagccugggcaauggcgggcaccccucccccagccucgcugccgccuugcaguuugaucucagacugcugugcuagcaaucagcgagacuccgugggcguacgacccuccgagccaggugcgggauauaaucuccuggugugccguuuuuuaagcccgucggaaaagcgcaguauucaugugggagugacccgauuuuccaggugccgucugucaccccuuucuuugacuaggaaagggaacucccugaccccuugcgcuucccgagugaggcaaugccucgcccugcuucggcucacccauggugcaugcacccacugaccugcgcccacugucuggcacucccuagugagaugaacccaguaccucagauggaaaugcagaaaucacccgucuucugcaucgcucacgcugggagcuguagacuggagcuguuccuauuuggccaucuuggcuccucccucccgacaaaauaucuucuaauauuucuagaaacauuugcugauuggguauacauacuggguuuuuccuuucuuuucuuuuuuguuuuuucuuuuuuuuuuuuuuuuuuuuuugagacagaguuucacucucacccagguuggagagcaguggugugaucucagcucacugcauccugaaccaccugggcucaagugauccucccaucucagccuccccugaguaucugggaccacaggcaagcgcuaccaugccuggcuaauuuuuguaauuuuugaagagaugggguuuugccauguugcccaggcuggucucaaacuccugggcucaagcaguccacccaccuuggccucccaaagugcugggauuacaggcaugaacuacugugccuggcuuuuuuuuuuuuuuuuuuuuuuaaacaaaagcauauuacuggcuucuucaguuguggcucauuucaauaacuauuucuuguaauaugugucuuggaacuagcuuauccuuggaaguguuuuucucacuauauuguuagaagguaaacaaaguggaaaaugcauaaauuaugugcacugcuucuguacuuuagaacuguuaguugacugguagcauuacugaaccuugaaccuugaauuggccuuuuuaggagcccagucacugugaacucuugagcaaauguguccuuuaucccugcaaggacuauuugaaaagagacccaggaagggcacaacuggcuugaagugggaaguagugaaggaaugagguacauagauaaaaucuauuuaugaaugaccuuucaggaguuagccuacaaaauauuuucuaauuuuuucauguauaaaaugcaaagggggcugggcgcaguggcucacgccuguaaucccagcacuuugggaggccaaggcggguggaucauuugaggucaggaguucaagaccagccuggccaacauggugaaacccuaucucuacaaaaaaaaaaaaaaauuagccggguguggugacaagugccuguaaucucagcuccuugggaagcugaggcaggagaguagcuugaauccgggagguggagguugcagugagccgagaucgugccauugcacucuagucugggcaacaagagugagauuccaucucaaaaaaaaagcaaagggaaggcacagauggaaggaauaaggaauucugugggaaagcaucuuagggcaucuuaccacuaaagugaauuagcucucuccuaauccuguccugugcuuggaugugauaacuauugaaugac

SEQ ID NO: 14638 - RNA, 7698 nt, Homo sapiens
cugucgcgacccgcucucugcaccccauccgcuggcucucaccccucggagacgcucgcccgacagcauaguacuugccgcccagccacgcccgcgcgccagccaccgugagugcuacgacccgucugucuaggggugggagcgaacggggcgcccgcgaacuugcuagagacgcagccucccgcucuguggagcccuggggcccugggaugaucgcgcuccacuccccagcggacuaugccggcuccgcgccccgacgcggaccagcccucuuggcggcuaaauuccacuuguuccucugcuccccucugauuguccacggcccuucucccgggcccuucccgcugggcgguucuucugaguuaccuuuuagcagauauggagggagaacccgggaccgcuaucccaaggcagcuggcggucucccugcgggucgccgccuugaggcccaggaagcggugcgcgguaggaagguuuccccggcagcgccaucgagugaggaaucccuggagcucuagagccccgcgcccugccaccucccuggauucuugggcuccaaaucucuuuggagcaauucuggcccagggagcaauucucuuuccccuuccccaccgcagucgucaccccgaggugaucucugcugucagcguugauccccugaagcuaggcagaccagaaguaacagagaagaaacuuuucuucccagacaagaguuugggcaagaagggagaaaagugacccagcaggaagaacuuccaauucgguuuugaaugcuaaacuggcggggcccccaccuugcacucucgccgcgcgcuucuuggucccugagacuucgaacgaaguugcgcgaaguuuucagguggagcagaggggcaggucccgaccggacggcgcccggagcccgcaagguggugcuagccacuccuggguucucucugcgggacugggacgagagcggauugggggucgcgugugguagcaggaggaggagcgcggggggcagaggagggaggugcugcgcgugggugcucugaauccccaagcccguccguugagccuucugugccugcagaugcuagguaacaagcgacuggggcuguccggacugacccucgcccugucccugcucgugugccugggugcgcuggccgaggcguaccccuccaagccggacaacccgggcgaggacgcaccagcggaggacauggccagauacuacucggcgcugcgacacuacaucaaccucaucaccaggcagaggugggugggaccgcgggaccgauuccgggagcgccagugccugcacaccaggagauccuggggauguuagggaaagggauuguuucuuuuccuucgcucuaucccagggcaggacaguaucaggcacuuagucagcucuagguaaauguuuguacagggcacacucuacacaaaauggguaccuuccauuuugugcaacuacagucacagagucgugauccccagauucagguuccccaggcugguaggcuggcaaucuccucucacucaccucuuaugguuuguugugguucuuacggcaguggggcccgguccagaaaucucgaaaguacccagugaaaggggcaagaaugcgccagagaaaugcuguagggggaaacgcuagcaaggugucuaggagaaacagaacgaccaccaaagaaaaccaaaccaaggaguaaacugcaggguugccacagacauugucagacuuuccggccugcccagggcuaauugaaugacaguauuuagaaaaagacaaauagagcuauuuucuuuucuucuucacuguguuuuuuuugcagucucacucccauauuugaaaauucuagucccaauaauuagagauuuagccugaaaacaguuuaucuaaaaugcagaggucucccuauuuuauagcuggugaauucugaaaagaaagugcccacuugguauuucauuaagaagaaacuuacguugguccaguaacuuuaggaugaauucagggauuacauggaaucugagaaauuguaaacuuuauucugaacauuccgaaagucaaaaugaaaugccauauuuucacucucaacauugacaauuaagggaaaaaucaaauccaaacuauuuuacaaauuacauaggauuuaaauuuuguuuucaaaauugguugaucuuaguucuaaaucauuuaauaucuuauuuuaauuacugagauuaaaugauuuuagucauuugaccguaucuaaaggauaagcccuuuagaagcauuaauguuaguuaacauguuuaaauuauauguuuaaaguauugugggguuuauauauuuauuuauuuaguccauauuuuuacuguuuacaagucagggaguaguuggaaaggauccaaaaggggggaagauuuauacuuuuaaaauaaaguuugcuuuuuccuguuucaucaaaaagguauuuaacauccuaaaacacuuuugaaaaagccccaauuuauauagaaucugaaaaacaugaaaaugccagaauuaaauaguaguuguuugugaucccuugaaaucugaucauuuuaauuagcaaaaagcaauaauauuuuauauuccauacuucccagaaaguuaauugauucaaauucuugcuauguuaugccgucaugcagaucaaagagaacuuguacaaacaaaaagauauuaacuguuuuuucuagaaaaaccuuuguuaguuauuuagcuguagcauaauacacaguagaacucauuuuuccgaagaugauugccauaaagcuuuaccauuuuacaaagcucuagcauuuuaaaauguuuuccuaggcauucucucauucagucguuaccucaaagcuuugaagggaguauaauuaucuucauuucacaaaucaugaagcuaaugacauuucauggaagcuauuuuuauaggaauuauggaauuggagcccuccuuugagugucuuuggauguugucaccaccaucaacaggcaguguuaucuccaacauguuugaugagaaaaaaacauaaaggaaagggacuuggguuucauggcaagagauucagcuuagaugggaaugagcuggucucugaggcagaguuuccugucucaucuuuguauaaacuccuucuuagaaaccagcagaggcucuuaauguacguccaucuucuccuucccaccacagacacccacuccuaugugcguuucugaaaauuacagggucauuuguggaugugcuuuaauuuaguauagauauaaucugauaucauuaucuuucuuuccccccgccccccgccaccagcauucccccugcacucaauuugugcuuauauuccuuuugcuguauauauaccccuggcucauugcuucuggaagcugcauuacuuauucuagagugugggucuccuacaauuuauuuauauagcccccuaaaucagugguucucaacugggggugauuuuaugcuccccaggugugauuuggcagugucuggagacauuuuugguuuucacaacuggaggugggcacugcugguaccuagguguauagaugccaaggaggcugcuaaauauccuaccaugcccaggacagcccccauuacacagaauagccagucccagagaaacucagccuuagauuaguguuucuccuuccuggcugcacauuaaaauuaucaggggagcuuuuaaaauacacugaugcugggauccaccccugaccaauuaaaucagacccucugggauggggccugggcuuuagaguguguuuuuaacacuccccaggugauucuaaugugcagccagguuugagaaucuuuacucuaaggacucaaucuuugaaaguuacagcauuguagaggggaaggaugauccagaauuaauuaaagaaggaagaagagugaacaguacugaacuggaugcaagauuaugacugugcaaauccuccuauuucagauuuagguucuuuacugguaaauuggauaaaaaguuggcaguucuuuuacucacuggagcaugaugaagauaaaugaguuacaguugcccuagacuuuuacgauuaguaaaaccaauggauggacagaauaaauaaguauaagcagacaccuauagucuaauaucgcaacuccagaaaaucuuugagaaaaucucacacaugaugggagugggacagggaguuguuuuguuuuugcuucccuugagucucagcaaaagaacagucauagaaaauauuuccaaaaaauuuagauauaauuuugcuuggcaauuagaauauacccucugucagcuuuguucaguuguuggaccuauuaaccaauccauaccagacuaauuuauuucuaaacaaaguggcgaaugguguccaaugccuuuucugagaaagagaaaaauggccucuucaaaagacgcaauuugguauagacuugucuggccguuuuguaguguucuggaguggggagcauauacuacccucacagguaaacgaaaccuuaccuguauguauugucucacccauauccugcuacaggagaaaaaaaaaaaaaaaaaaaaaagaacauuuccauggaucaguuagauuccuuuagacuuacagggaggcuaaaaucacagcauuaggaaagacuuuagcauuuggcaccuugaaugaauauggaaaauauaagacccagggucuguugguagccagaagaauggaugcauuucaacagcaguaauuugcaugcguguaucacuuugucacuuugaaagcauugugacucacauuucacacuggauguucacaaagacucugauuuaagcagggguuguuuuacaaacgagaaaauugggauucaaagacacaggugggucuuggacggcaaucugcugauuuuuuuuuucuaggacugucuuugaaauaucaucuggucuccuuguuaagauuuaaacugcuguguaucaucagaacaauagccaauuaacuaauuguggaaacauuuacaaucaugcuuccauguuuucaaauuuccugucaccuaguuauaaaaguauguaucucuauacauauuauuugugguuguuuaagaaggcaggaauuugacuaggaauuuugguucgguuuaaauaaccuccuagauuauuuauuauuugagcaaaguuuaaauauauauacaaauaauuugaaauaauauuuaugauaauguuucgauaauauaugcuucauacaccuagcuugcuuguuacagaugaacaccugacaauaauguuuaguuuucauaucccaaauaggagacuaucuuccuuuuuccuaaagguuuuuaugccuauuccaaacuugcuuuaaaagacuuuuuuuuuuccagauauggaaaacgauccagcccagagacacugauuucagaccucuugaugagagaaagcacagaaaauguucccagaacucgguaugacaaggcuugugauggggacauuguugcagagcucaaggugcccaggggagggaagucagagacaggugccuggugggaggcaccaccaggcuucuagacuaggggagauuucggcagaaaugaggaugaagaagcaggcagaggagaccucucuuuucauguacucauugucaaaucucuaaacuucuguggaauaacauuuuuuuagcucagguuauuuggugcuccuuugacgauuuuaaaaauaauugacuuuuaacuuagaaauuauauagaauuucuaacauuguuggagucaggggagcauagagugagucccugacucuaaauugaaaugaccaacuguccaucucuggcugggaagaucuguagauuuuauauauguggaguguccagauguccuaggaaaugucccaugugguuuuuacuccaacuuucccaguuuuacaugaagcuguagguaaauuaggugcucuggauuacuuuuugacauauuuuaauucaacuugugucauauagugauuuauuacauucaacgaaugcacguugaaugacaguauucuuaggaguuuaucuguagucucaggacuuucuugcaguuugggucugucuuggaaagaggugcccaccaaugucuaaguguuaaacauugagcuaagguuuucuggugccuccuggacaaggagugcugcugaagaggagccugguccucuuccaucuucauaaccuccugacucuucaguccuugcuuccugucucuaaccacaguaagaucauaguucacaggguccacccacgucuguggcagcuuggcugccuuaaaccaaguucuacaaugucaagaaccaaguuccccagaagaggucacuacaacacuugcucagugagugugacugacguggcucuccaucaaguucucccuagagacucagcagggugacccgcugggccacccaccuucccuucuaaccucccucaguucucuucuaaaauggccagccagcaugaaggguguuaguauagaguugugagauuuguuuucucuaaagggaacaacgauuugaacugagauaaaacuccagugcuccugucccuggaggaaccagcccagacuuaaauagcaaaugcaagggaaacaggcagaaaauuuguaaggguuaucuuuuuuuaauuaaauaauaauaauaauaauuauuauuauuauucagagacaaggucuccuucugucacucaggccagagcacaguggugcaaucaaagaucacugcagccucgagcucccagccucaagagauccucccuccucagccugcccaagugcuaggauuacaguugugagccauaaugccuggccaggguugucuuuaacacuaagcaguaaaugucuuuccauguuucacugacaugcauaugauguuugccacaguaaaaaguuuaggguagacuauaucgacuuacuguuagaaaaauaacaacgcagaccuacuuagaaccuugguuuuugucuuuguuuuguggcccaaggucacacaguuagugcaugaaguaaaauuaauugcaaccugauugacagacuccaucaggugcaguuagaaggagacaaaacuugacggucuugaaguugccuaugagugcuauuuuauuauaaaggucuuauuauagucuaauaaguagcaucuuacuacauaauaaagcuggcaggaaaaggaagcauauuuagaguugaggaacaauaacuuuccugucacagcuucaugugauuucuguaauuuugauuuucaaaagaucgggguguucuucggcuccuuugauacauacagagccuuucaaaugcucucucugauguuugcccaagacgccugucaacaucguggaaugcugcucagcuggggcugugcauauugugccuccgccucacgaucugauauuccacauggcuucuuauuuagaaugccaacaggaaacuuuucaacaguucccggucaucuuucacuucagaucuaaaugucucacccuugcucauaccucaggaaguugggcagcuuuccuuacaugcuuugcuucuuauguuuuacaggcuugaagacccugcaauguggugaugggaaaugagacuugcucucuggccuuuuccuauuuucagcccauauuucaucguguaaaacgagaauccacccauccuaccaaugcaugcagccacugugcugaauucugcaauguuuuccuuugucaucauuguauauauguguguuuaaauaaaguaucaugcauucaaaagugu

SEQ ID NO: 14639 - RNA, 5526 nt, Homo sapiens
guggauucuaucacacccuuuauaauuuacagcaaucuucagugguuaaagcaaaacuguacaucuauaaaggaauucaagagaagugcaggaaaaggaugacaaaagguaaaucccuagcuaccaccagaauguuaucuaucuaaaacugccaacuuacgaauagguaaaacuuaugguaaaauuauaaaggugagcacaacaggaacuggaaucuauucugaagggcaauauaauguacuuccaagaauucuagauuuuuuuuuuuuuuuggagacaguuucacucgucacccaggcuugagugcaguggcacaaucuuggcucacugcaaccuccaccucccaaguucaagugauucuugugccucagccucccaaguagcugagauuacaggugcccaccaccacaccuggcuaauuuuuauguuuuuuguagagacaggguuucgccauguugaccaggcuggucucaaacgccugaccucaagugaucugccugccuuggccucccaaagugcugggauuacaggcaugagcgaccaugcccggcuaauucuagauuuaauagaguaaagagaaaguacuuuuguuacagaccacugguucuaguccuagacccagaaugucaauacaguagccacuagccacuugugccuauguaaauuuaaaauaaaauacuuucuagucacacuagcuauauuucaagggcuuaacagccacaugugguuaguggcuaccacacuggacagcaaaagucuacaaaauauccaucgucacagaaaguucuauuagacagcacuguucuagacaaaauaagcauguagguggcaucugaauaccccuuaaauacaucuggcccuuguuuuugauucuaccaaccuagccacuuacagcgaagcacuagaaaugaaaacaugugguuuauagugcucuuuuuuuccccuauuuccuuauuucugaagguauauaucccugauagaaauguccuuuuuaaaaaauuacauaauuggccaggcgugguggcucacgccuguaaucccagcacuuugggaggccgaggcagguagaucaccugacgucgggaguucaagaccagccuguccagcauggagaaacccugucucuacuaaaaacacaaaauaagcugggcaugguggcgcaugcuuguaaucccagcuacuugagaggcugagucaggagaaucgcuugaaccuggaaggcggagguugcggugagcagcgaucacgccauugcacuccagccugggcaacaagagugaaauuaucucaaaaaaauaaaaauaaaaaaguuacagaaucacauuuuaaaccaccagaagugcuuggguauaacugaccuagaacauggcaguuacucaucugugccaacacagaccuuaauauaggaggcauagaaaugagaaaaauuggccggacgugguggcucacaccuguaauccuagaacuuugggaggccaagguggguggaucacgaggucaggaguccaagaccagucuggccaacauggugaaacaccaucuccacuaaaaauacaaaaauuagccaggcgugguggcgggugccuguaaucccagcuacucaggaggcugaggcaggagaaucacuugcaacuggaaggcggagguugcagugagauugcaccacuguacucagccugggcgaaaagggcgaaacuccgucucagaaaaaauaaaugagaaaaauuuuaaaccugaaaaaaaauuaaaccuaaguuacuacugggcugauuacuucuggguuaaauaauaagauuucugaauuugaaaaccaggcagggccugguggcucacgccuguaaucccagcacuuuggggagccaaggcaaguggacggauugcuugagcucaggaguuugagaccagccugggaccacauggcaaaacuccaucucuacaaaaaaauuagcugggcaugguggcgaacaccuguagucccagcuacuugggaagcugaagugagagaaucgcuugagccugggaaauagagguugcagccagccgagaucgcaccacugcacuccagccuuggcgacacagcgugaccaugucucaaaaaacaaacuaaacgccacaacuagccaagauggaagguugaacacauuucuguaucuaucuuaauauguuuccuguaucauuuccaggaugccaaaaaaaaaaaaaaucaacucucuagccuucacuucaggucuuucucauuaguccagaauuguccccuuguaagcuacuugcuacacugucccugaauaccacuaacuuuauacagucaccaaguccucugcuacaaggccuuucaaagucugaaaucuuuaaaggauuuccaggaugcauuuuuaaauuccccaccagaacucagacuaggacuucaaauaugaauuacagcaagcuuuccacauuucuauaaauaaaaauaagacucauauguuauaaauugcuuucaggccuuaaaacaccuaucuaaucgucccuaucaccuuugagaccauggauucacaucuucucagucuucucacugucccacaaagauacaguucucagcugcaccagcauagauuuauuuucucauuauucuuuaugacuuaccuugugcucaccaucuccauaaaaucuccaaggacuacucuaaauguguauggcacagacuaugcaugaaauaauucaguauguaauuauacacuguuacacaucacaaaacuaugaccacaggcauuccucuguccaugucuggcauaaaugcugcaguucucaaucugagcaaagaaacuaagagucaauuagugaaguguuauucuaguugaggcaguccuagaaaaccaaguaaacaaucuagcaccaugacugguuaacacugcugcacugacauuuagggcugcugcacugacauuuagggcuccugcacuuuuuaaucauuaaaauuugugcaucagucaugaaaucaagcacagucaaaaagucaugaucugugguuuucuuuuuaauuaucuuuagucuugugaucacacauaauuuuaaaauuuguguauaucuccguuacuuuaauccuuuuaaguuggcaaaagcaccauucccaaucaaauacacaguucuacaguuuuguuucugaauggcuguuuaaagacaauccuaaauuauaacuuaguuugacuuagauuguaaagaauucaagagugaaguuuaacuugcuacuauuuuaaaagcaugugaccuuauagaucuguaagaugugagagguguugaauaaucuuuaauauuacacauaaaccacacuaaaaugccuuucaauaaguaaaagaaaccauuuuaaauacagggaauuauaauuagauuggcauaguuaaggccaaaacuauagacauugcuaccuuauuuaucuucaacccuugccuuuaagaggcaaaugaacaugaacacaaaacacaggugaaucuugcuugguucuaagacagugaagcaauuuccccaguauuuaaauauauucacauaaccaguuauauaaaucuaaauauaaaaccaaucuccaguaaguuuuaagauggcacucaccaucuuugugaaaaguugaacauuacuaacgaagucuaaucauaucuuuaaaagggguaaacagugauaccauuuacugaauuggaguuacuauuaaaauucaaaaacugaacauauucauuuaaccacaagccagucuuaguuuuaaaucaggacugcccaacaaaauauucugucagucauucaugaucugaauucugguguaugagaucuauuaaaggaugguacacauaaaaaagucaugagacauuucuguuuuguaauaaauaaggcaguggccaauuauuacucauuaguagcuuuuuugagauaagcuauuaagucugcccuuucuuccuucuucuuaaugccgacaaagaucauuuuuguuccagggauguacuucuugggauucuccaaauacuccaucaguguauccucuccccagaugaugccuaaacaagaaagaaugcaucgguuauuucacacuccugauaguuugccacauguuauauuccugcauuuuguguuguuuuauuuaacaagugacucuuaccuuuguucuuauuggcggcuguguaagaguauccaggggccugaccugucuuccgcccaaagagaccauggagauuuggcccagucuugugcuugccucccuuuucaacgguguggcacugggaacacuucauaauaaaaaucuucuugccuuucucaacaucacccauauuuaauucuaaaaacgaaagcuucaacuuaguaaauuuuuccucagguaacaaauacaguguaaaugaaugaccacucuagccacuuaauuaccaauccauugcuaauuuaugucauuaaauaccagaaugaaucuuguuuugcuuuaauacucuuuauaccaaauauucuuuaauaccaaaaacauuuuuaggaguaccuccucaaaaacguauuuuuguguguauacgugaaggaacguuaaagcccaagcaaagagggaaccuaauucaaacuccaguuucagaagagacaaucauggucacgaagucacagaucugaagcucaagggcgaacacauuaagccaaaaucaccacaaccgcaacuuuuaaaaagaccuaaccauuuaaucuuacuacaauguaaagccaccucucccugaggauaacgcaaagcacacaaauguuuaaaaagcgguccuggcuguuucuaucugcccaggucacaggaguagcuugacacucgaacuugugaaugggagcucaggggcaggcugcacggucccccggggacaucccaacuccccuaccugugaucuccuggggcgaccacgaggucacccguccaggucgguuucaaggugauugaugaaacuccuucuaggaugucagaacgacugacggaagaaacaugugcccacgaaaagaacuggccccuuauuagaagagcaacagcuuuugcccucugaagaagaacgugaagcucuaagcuucggcuuuccaggagggaagucuugccuaucauuuccauagcccuucagcaaccacuacggaagaggccgccuccuccucggaucuguauccaagccgccuccagucccugaccgagaccauaccugucccuaguuagggcuccgccgcaccucaagccguuacucgcccagcucggucugaccacaguccagggucuucacuccccgcccucccacccagcgcgggcuccacucgaaugcuccccgcuuggguuucggucgcucgcaagugcgcgccucccacagcucugccucuaaccaggugcggccuccgcgacccgcucucaccucuuuuuagucgcuggcacaacgaacacucccgcuccgaagccggacguccccacucucuaaguccaaggacacgccgguccgcgcuuaaguaccgguguaagugcaaccaaacucgcuccgcgcucccgcgcccugacgugcggccgagcuggcggcu

SEQ ID NO: 14640 - RNA, 5526 nt, Homo sapiens
agccgccagcucggccgcacgucagggcgcgggagcgcggagcgaguuugguugcacuuacaccgguacuuaagcgcggaccggcguguccuuggacuuagagaguggggacguccggcuucggagcgggaguguucguugugccagcgacuaaaaagaggugagagcgggucgcggaggccgcaccugguuagaggcagagcugugggaggcgcgcacuugcgagcgaccgaaacccaagcggggagcauucgaguggagcccgcgcugggugggagggcggggagugaagacccuggacuguggucagaccgagcugggcgaguaacggcuugaggugcggcggagcccuaacuagggacagguauggucucggucagggacuggaggcggcuuggauacagauccgaggaggaggcggccucuuccguagugguugcugaagggcuauggaaaugauaggcaagacuucccuccuggaaagccgaagcuuagagcuucacguucuucuucagagggcaaaagcuguugcucuucuaauaaggggccaguucuuuucgugggcacauguuucuuccgucagucguucugacauccuagaaggaguuucaucaaucaccuugaaaccgaccuggacgggugaccucguggucgccccaggagaucacagguaggggaguugggauguccccgggggaccgugcagccugccccugagcucccauucacaaguucgagugucaagcuacuccugugaccugggcagauagaaacagccaggaccgcuuuuuaaacauuugugugcuuugcguuauccucagggagagguggcuuuacauuguaguaagauuaaaugguuaggucuuuuuaaaaguugcgguuguggugauuuuggcuuaauguguucgcccuugagcuucagaucugugacuucgugaccaugauugucucuucugaaacuggaguuugaauuagguucccucuuugcuugggcuuuaacguuccuucacguauacacacaaaaauacguuuuugaggagguacuccuaaaaauguuuuugguauuaaagaauauuugguauaaagaguauuaaagcaaaacaagauucauucugguauuuaaugacauaaauuagcaauggauugguaauuaaguggcuagaguggucauucauuuacacuguauuuguuaccugaggaaaaauuuacuaaguugaagcuuucguuuuuagaauuaaauaugggugauguugagaaaggcaagaagauuuuuauuaugaaguguucccagugccacaccguugaaaagggaggcaagcacaagacugggccaaaucuccauggucucuuugggcggaagacaggucaggccccuggauacucuuacacagccgccaauaagaacaaagguaagagucacuuguuaaauaaaacaacacaaaaugcaggaauauaacauguggcaaacuaucaggagugugaaauaaccgaugcauucuuucuuguuuaggcaucaucuggggagaggauacacugauggaguauuuggagaaucccaagaaguacaucccuggaacaaaaaugaucuuugucggcauuaagaagaaggaagaaagggcagacuuaauagcuuaucucaaaaaagcuacuaaugaguaauaauuggccacugccuuauuuauuacaaaacagaaaugucucaugacuuuuuuauguguaccauccuuuaauagaucucauacaccagaauucagaucaugaaugacugacagaauauuuuguugggcaguccugauuuaaaacuaagacuggcuugugguuaaaugaauauguucaguuuuugaauuuuaauaguaacuccaauucaguaaaugguaucacuguuuaccccuuuuaaagauaugauuagacuucguuaguaauguucaacuuuucacaaagauggugagugccaucuuaaaacuuacuggagauugguuuuauauuuagauuuauauaacugguuaugugaauauauuuaaauacuggggaaauugcuucacugucuuagaaccaagcaagauucaccuguguuuuguguucauguucauuugccucuuaaaggcaaggguugaagauaaauaagguagcaaugucuauaguuuuggccuuaacuaugccaaucuaauuauaauucccuguauuuaaaaugguuucuuuuacuuauugaaaggcauuuuagugugguuuauguguaauauuaaagauuauucaacaccucucacaucuuacagaucuauaaggucacaugcuuuuaaaauaguagcaaguuaaacuucacucuugaauucuuuacaaucuaagucaaacuaaguuauaauuuaggauugucuuuaaacagccauucagaaacaaaacuguagaacuguguauuugauugggaauggugcuuuugccaacuuaaaaggauuaaaguaacggagauauacacaaauuuuaaaauuaugugugaucacaagacuaaagauaauuaaaaagaaaaccacagaucaugacuuuuugacugugcuugauuucaugacugaugcacaaauuuuaaugauuaaaaagugcaggagcccuaaaugucagugcagcagcccuaaaugucagugcagcaguguuaaccagucauggugcuagauuguuuacuugguuuucuaggacugccucaacuagaauaacacuucacuaauugacucuuaguuucuuugcucagauugagaacugcagcauuuaugccagacauggacagaggaaugccuguggucauaguuuugugauguguaacaguguauaauuacauacugaauuauuucaugcauagucugugccauacacauuuagaguaguccuuggagauuuuauggagauggugagcacaagguaagucauaaagaauaaugagaaaauaaaucuaugcuggugcagcugagaacuguaucuuugugggacagugagaagacugagaagaugugaauccauggucucaaaggugauagggacgauuagauagguguuuuaaggccugaaagcaauuuauaacauaugagucuuauuuuuauuuauagaaauguggaaagcuugcuguaauucauauuugaaguccuagucugaguucugguggggaauuuaaaaaugcauccuggaaauccuuuaaagauuucagacuuugaaaggccuuguagcagaggacuuggugacuguauaaaguuagugguauucagggacaguguagcaaguagcuuacaaggggacaauucuggacuaaugagaaagaccugaagugaaggcuagagaguugauuuuuuuuuuuuuuggcauccuggaaaugauacaggaaacauauuaagauagauacagaaauguguucaaccuuccaucuuggcuaguuguggcguuuaguuuguuuuuugagacauggucacgcugugucgccaaggcuggagugcaguggugcgaucucggcuggcugcaaccucuauuucccaggcucaagcgauucucucacuucagcuucccaaguagcugggacuacagguguucgccaccaugcccagcuaauuuuuuuguagagauggaguuuugccauguggucccaggcuggucucaaacuccugagcucaagcaauccguccacuugccuuggcuccccaaagugcugggauuacaggcgugagccaccaggcccugccugguuuucaaauucagaaaucuuauuauuuaacccagaaguaaucagcccaguaguaacuuagguuuaauuuuuuuucagguuuaaaauuuuucucauuuauuuuuucugagacggaguuucgcccuuuucgcccaggcugaguacaguggugcaaucucacugcaaccuccgccuuccaguugcaagugauucuccugccucagccuccugaguagcugggauuacaggcacccgccaccacgccuggcuaauuuuuguauuuuuaguggagaugguguuucaccauguuggccagacuggucuuggacuccugaccucgugauccacccaccuuggccucccaaaguucuaggauuacaggugugagccaccacguccggccaauuuuucucauuucuaugccuccuauauuaaggucuguguuggcacagaugaguaacugccauguucuaggucaguuauacccaagcacuucuggugguuuaaaaugugauucuguaacuuuuuuauuuuuauuuuuuugagauaauuucacucuuguugcccaggcuggagugcaauggcgugaucgcugcucaccgcaaccuccgccuuccagguucaagcgauucuccugacucagccucucaaguagcugggauuacaagcaugcgccaccaugcccagcuuauuuuguguuuuuaguagagacaggguuucuccaugcuggacaggcuggucuugaacucccgacgucaggugaucuaccugccucggccucccaaagugcugggauuacaggcgugagccaccacgccuggccaauuauguaauuuuuuaaaaaggacauuucuaucagggauauauaccuucagaaauaaggaaauaggggaaaaaaagagcacuauaaaccacauguuuucauuucuagugcuucgcuguaaguggcuagguugguagaaucaaaaacaagggccagauguauuuaagggguauucagaugccaccuacaugcuuauuuugucuagaacagugcugucuaauagaacuuucugugacgauggauauuuuguagacuuuugcuguccagugugguagccacuaaccacauguggcuguuaagcccuugaaauauagcuagugugacuagaaaguauuuuauuuuaaauuuacauaggcacaaguggcuaguggcuacuguauugacauucugggucuaggacuagaaccaguggucuguaacaaaaguacuuucucuuuacucuauuaaaucuagaauuagccgggcauggucgcucaugccuguaaucccagcacuuugggaggccaaggcaggcagaucacuugaggucaggcguuugagaccagccuggucaacauggcgaaacccugucucuacaaaaaacauaaaaauuagccaggugugguggugggcaccuguaaucucagcuacuugggaggcugaggcacaagaaucacuugaacuugggagguggagguugcagugagccaagauugugccacugcacucaagccugggugacgagugaaacugucuccaaaaaaaaaaaaaaaucuagaauucuuggaaguacauuauauugcccuucagaauagauuccaguuccuguugugcucaccuuuauaauuuuaccauaaguuuuaccuauucguaaguuggcaguuuuagauagauaacauucuggugguagcuagggauuuaccuuuugucauccuuuuccugcacuucucuugaauuccuuuauagauguacaguuuugcuuuaaccacugaagauugcuguaaauuauaaagggugugauagaauccac

SEQ ID NO: 14641 - RNA, 11660 nt, Homo sapiens
uuaaaauccaugauuuucaaaaugccaccaguauugcuaaacguaaaaguaaagccagaaacuuuaggaguacucaaacgcugaauauacagugcauaaugaacagcauuuuauuggggacagccaauaauguccacaaugcucuucucauuuaccuguuaauauuaaaauaugcauagcuuugugaaacugcuuuuaaaaauuuaggggauggugaucuuuuagacaaccaaauauuuauagaacaagauucacacauuuuauguguaaacauuacaccaaguauuuggauacaaaaaguauuuauuuuauaaacuuuauauuuaaaauagaauuguaaucugucuacucacaaaaccuaauuuaaaacaugauacauuuaucucucuagccaauuugauguuacuguuuuacaaacaacacucauuuuguaauuguuuuauaucaagaaccucaacuaaauguuuguuuuaucagaaaacauuucccuuuuauuuuaaagagugcuuuuuaaaugaaggcaccaacaagaacuacuuucagaugguacagaauuucuuauuucuugaagacucugugguugaccacuucuucauuaguuaccugcagcaagacaccuuccugccaaaggaaaaaaaaaguaucugaagaaguuuaucauguuuguccaaaagaaccuaaacaacuucagugguggucuuaggaucaaagaagacucauugguguauagaguaagcccugaguaucacauuccuguaaaggcaauaaagccgggcaaucaaacugaucauaucuaaggaaugaauuucaacagccaaccuacaacuuucucuucaggguaagacacugaacuagaauuaccacauuuaacccaccuauuuaguacuggauacauaccaggcuucauaaugcagacaagacacuucacucaaguaugaacuacuaucugaaaauagauucaaccauuuuugcccuaccuucuuucagucucauccugauaagcauguacaguuacaaccauaaauacaacaaaugucuuuaauaaaaaccccuaguucacucaaaauguuugauccaagaaaugugaauacacaaggguguaacgaugggaaaucucaugauuuauugaacuugcagccuaacuuuuaccuaccauuuuacuaccaacaccacugaaggaaccaagaaaagcuuuauuaaugaucacuuggcuugccucagcuguugaaaugaagcacuuuacagucuuuguggcagcagaauauacuuguccaugguucauaucaaugcuaaaauuccggcagggaaaaaaaugauauguuaagcacccaaaucuucacauggagggggagggggugggaaaagaaggaaaaaaagggaaaaacaaccaaaauaauuuaaguaaaugacagauuggaaaacaggguuuauaaaaauuauucucuugaguuuauaaauuguuaaacucaauuuauagcuauguuaaacuacguaagaaccacuauacugaaagaccauuuaagaguauuaguuuaucuuuuagggaggaaaauuaagaaaggaaaaguaaauaagaucuuaccuaaagaaguuuaacugaagcuuagaacuauuuugcucuacacccucagcuuucguuggcauccuuauaaacuacuguaguuaaaguuuuguagaaacagcacaguuuuuuaagacuggcugaacuuaguagccgucaagaguucucuuguacuagaccugugucccugaagaguaccucgcugggguuauuuccuuuccuugcauugaagaagcagcaucuaaaagaucuaaaaagguguuucuccuugcagagauaucccuuaaguuaucuacauaauuuaauccugaugaauugcagacaacacacuuacaucugaccagcauuuaucuuauacaaauauaacaacagcuuugcaacggaccuuaauuauacuacccacuccuuaacuuauuuaaaauaaaaagucuauaauuacacaauuuccuuuagaauuauuuuauuaaaucauaaauguacaacagcuucuuaacucuacacacgcacuuaaauuuuuuuaaaggaaaaacguuaugucuuauuacaccaugauccuggcuaauagcuuuucaaaacuuugagaaaaaucuuaaaaaagguuucacaugucaccugaaacuuacaaauuuaacauuaucaaagaaggaaugcuucuacacucuuacaaagaccacuagaaagaaacaacaauuaaaaagcuaagaaacugucucaaaggcauuuuuuuuuacaauccuuccuccacaguaagguaauguuauuaaauaauccaauccauucacaaaauggcucucugcaucugcucuggugucuucugccauaucacugcauauuuaugcaugacugagauaagaguuuccuuaacauuguuauuucgauaaccugaagcuguucuguuaccucugggcucucauccucuccuauuuauacagugaagccuguuucaacagaaguaaagaguaaaaaaaaaauagguuaugaaauuauccaucuaaccagauuuuaaggaaagauaacaugauccuaaaaagcuuuuacuccugcagcuaugucucccaagauaauaauaauuguaaaacucaaaagcuacuuacccauggcaaauaggaagaagcucaguaucggcuccucccaccauaacccccacuuccuccacugccuccuggaccauaguuuccuauaauuguuggaacagcaagagaaaacaaacuuacuuugauuucccaugaucagccuaacacuacaguugauucuauuuuauauccauccagucuuuuaaacaagcagauccuaauccuuugcagccaguuagcagaauuacucaggagauaaauuacucggguucauagacauuuuuauuucguggcugacccuauucuuuuaaauaaaggguccuuucacccucucauccucauuuggacugaguaagggauuuuuuuaaaaguacaucaagcccaagacaaagcuaguuuacuccuagcuaaaaaccucaaaaauaagcuaagcaaugguuugaaucaugguuuaaggauuuaacuucaaagacccucauuccaauguauaccacuugcaauguggguugcaacuguauuuagcuguuuaugaguccccaccagaaauuaaacuacugaacacccccaccuccaacaucccuaaucccaauuugaugucauaacugcuugcugaguacuucuguggagauuuaugcaaaauuucuuuauuuucacuaagaccguacauggagcacugcccacaguacaaacuacuuaguauguuaucuucccuuuaagucacaaaaggcuaauccuuuaaucacaaaaaucugaauaaccucaauuuuuauaaauuaccuccaccauaugguccccccauguuccugcuaccaccaaaguuuccacucuucauuggaccguaguuagaagguugcugguuauaauuuccaaaaucauuguaauuuccacuuccauaauuuccuauuaaaaaauuggaauacucagaacaauacaaacauuaaaccaaggacuuaggacaaagcucccauaaaaacaaauaaaagcaaacacuuauccacaaauuuuaugggcaucuagugacaaacauggaaacaaaagaucaaguguuacaaagacauuaauuccaaauucccacauaaagguugcaggugaauuuauuaccuccuccauaguugucauaaccaccuccguagcccccacccugguugccauauccagguccuccaccaccauauccuccucuuccuccuccauaaccggggcuaccuccaaaauugccaccuauuauaaaauaagccuuuaaguaaucacuuaauauuuucaauaccauuuugaacugucuccucacauccauuuccagcuuuccaaguuuccaugugaaauauuuaaugaaauuccucuaaaauagcuucaaggacugaauaacuauccuugguaaacauuugguggcugggguuacucagccaaauggauaacaccaugugcacacaguuaaauaccuguaauuccacagcuuucccucaaaacuaaaaaucuuaaguaucuugaaauacuucauguauauuguggguaaggacugugaggcuagacuaguagugugggcuagagggaaaguaaaagagcacuuccuccuacuggcccaaaagauaaaguuucuauuaugucucucuacgaauuacauaucuuaaaacaauguucucgguugggcacaguggcucaugccuguaaucccagcacuuugggaaggccgaggcggacggaucacgaggucaagagauugagaccacccuggcuaacacggugaaaccccaucucuacuaaaaauacaaaacauuagccggacaugguggcagcaaccuguaguacuagcuacucuggaggcugaggcaggagaauggcgugaacccgggaggcagagguugcagugagcugagaucacaccacugcacuccagccugggcgacagagagagacucccucucaaaaaacgaaacaauguucuuggcugggcgcagcagcucacaccuguaaucccagcaguacgggaaguugaggcggguggauugcuugagcccaggaauucaagaccagccagggcaacacagcaaaacccccacaccucuacaaaaaaacacaaaauuagccggucaugguggcacaccccguaguuccagcuacccaggaggcugaggugggaggauggcuugagacuaagauugcaguaagccaagaucacaccacugcacuccagucugagcaacaaagccagaccccauuucaaagaaaaaaaacagacccaacacuccacacaguauguucuuuacuguaaauagaagugcggacauaaacaaaaauuuacacuuucacauacugcaaaacaaaaauaaaaaaaaaaaaaaggcugggcaugguugcucacgccuguaaccccagcguuuuugggaggccaaggugggcaguucacgaggucaggaguucaagaccagccugaccaacauggggaaaccccgucucuacuaaaaauacuaaaauuagcugggcgugguggugcacgccgguaaucccagcuacucaggaggcugaggcaggagaaucacuuggaccgggaaggcagagauugcagugagcagagacgcgccacuacacuccagccugggugacagagcaaggcuccgucucaaaaaaaaaaaaaaaaaagaaaccauauuaaaaaaaaaaaaaaagcuugugggcugagucucuaacuuguaguuaaauacaagaacucagcuuccucuaaaauuuuaauuauaaaaaguagaacagugagauacacuauuuagucaugccuauugaguggcaacaccagaaaucaagucuauuaccagcucaguuuuaaaugucccuuguuacaaaaucugucaguguguaucagccuuuucuguacgccaaugauauaucacacuucauguuuaaugguaguucacaaccuuaucugcagccaggagcacacuaaacauuuuggaacauuuccguagguuacgcuuuuugaaaguuauccugggaugcuucccaucuaguuacggguuuagacauauuucauauuuuuuccuacauauaccacccccuuagguuuuacucuguuaaauccaguauucuguacuuuuccagagaagcacguacaaagauauaucuagauccaaucauuuugcuugagaaaagaugagauacucugaugguuaucuuuacauuuucauuuaaaauggcacucuauuccuuaggcuauaacagcuaagauggcaaaacuacuuagaaauaacuggaccacuaucacccaagccauuuauagacacuaauauaaaauguuuaaaaacucaaaauauaaaugaaguaaauauacgauauaguuaaguauuagucacauaaacaaaccaaaacguagaggaaaacugaccuccagguccuccuccauacccauuauagccauccccaaauccacguccacugccauauccaucuguuaggggccaaaaaaagauuacguuuacuauaaacuguucagcauuauugcuaauauucauuuucaguucucuuacuaccucagcacaauaauuaagaaccgcagaaaaggacacaccagugcuaccaguuuacccacaaaacaugaaagcauauaauuaaaucuaccgccuaaauuuuggacucuuaacaagucucaaucuuagagauuccauccuauuuauacguaagaaugacacuugaugggggucaaagcuuuucggaugacacuucauguuacauuauuaauccagauaaauacaacuguuauuaauacaacucuauuaacuucuugucuggccaaaucacaagagcuugccaggauacaaucuauuugaagucuuaggaaaauugacuuagguuggauuucuugauucuacuaaugaaaaccuaaucauauuuaaaauaaaagcacacucauccuuuaaacacguagaacuugaaacucaccagauccuccucuaaaguuacuuccugguccugguccgaaauuuccaccgccaccacgugaauccccaaagccaaaguugccuacaauaaaugccccaguuagaagcaagcccuuauauaugaacaaaaauaaagaagaaacagaauuaaaauuaccuccucuuccacuccuagaacucugaacuuccugcauuucuugucuagacaaagccuuucuuacuucugcauuaugaccauugaugguaugguauuucugcacuggaaugaaaaauucagacuccuuuuaaauuaaaucaacaauauuaagcagcuucaaaaguuuaccuuucaauaaaguuacagauguuaacauacacaaaauugaauacacuggaaaaaaacaguacauuugugguuagacacuuacauacgauuuuauccacaggaucauggucaucaaaaguaacaaagccaaagccucuuuucuuuccagacugccuaucaguaauuaucucaaugguaucaauuuuuccauauuccucaaaguaaucucuaaggugauguuccucaguaucuucuuuaauuccgccaacaaacagcuucuucacaguuacaugagccccugguuuuccagauuccuaaaauaguggugggguaaaagucauccaaacagaaaaaaacacaagcauaauucaaagcacccaaccguaguaccauacuucgcuuguauccaccuuaaaacuaccagauauaaaauagcuuuuagggaccuagcuuuugaaaaauaagcuagcuuaagaaaaugguccagaaacccaacacaccuuuaauaagagaaaaaaucuugaguuaaaacuaaauucagaaauaguuucugauuuucagcagggcagcguucuucauguuaaugcacaagacagucauuguuugcuuaccucucuugcuacagcacguuuuggcucaacuacucucccaucaauugaaugaggucuugcagccauggcagcaucaaccucagccauggaugaaaaaguuacaaaaccaaauccucuugaucuuuugcuugcaggaucccucauuaccuuucaaaccaaaggguaaacuuuagcauuuaaucucauuauagcuuauaagugaagucauaauagaauuuuuuacuaugcugauaguuauuuccuccaugauucacuuaacauacagcuaaaagacuaauauccaguaacaauucaguaauuuacauaccacacagucuguaagcuuuccccauuguucguaguaguuccucaaacuuucuucugugguuucaaagcuuaagccaccaauaaagagcuuacggaacuguuccuuuucucucugcaaaggaaaauaccauuucaauuuuuauuuacauuuuccucuuuguaugcaggaaauuaaauucuuaaauaugaggugaccugcuggcagaguaccuuuuuccucuccaaaggaacaguuucuaaaguuuucuggggggaaaaaaaaaacuuacaucaaauuuaaaccauauguuaaacugcauauuaguuguguuacaccaaaaaauugccucagcugaucuacacaaguuucaaagucauuaaugcuugauauaaauuuacucaacauuaaauuaucuuaaauuauuaauuaaaaaaaaaacuuucuaaggaaaaauaaacaaauguagaccgugauuaucaaaggauuauuaaagaaucuuuaccaaaaauuucaacccuacaaccuaaaaacgcaaauuucuauuuuuaaacaucagaaaauaacucuugguucauuacuuaugacccaaaguuuuuauuucacuauucaauaucugaaaaguaucauuuauuuucccuuaacugcccccucugguggugauucuaaguaucucagccaaaaaaacacaacuuuuuacaacaaacacuaaguuucuccauaugacucucaguuacgaaaauauuuaaagauaugcauuagaaauaaccuuaaaaauuacucuuauaaccaggacaaauuaauuuuuaugaccagcagcacucgaagcuuaaaaaguuuaauuuuugguggacaugucuauauuugauauaugacaauacagaauaugaauuacucagcuuaaccauauguacaauaaaauacauucacguggcauaaucucuaagauaacaauuacugaaagcugaagcuuacuugauuggccauguggcaagcgacaggcacaaaacaauuuuccaagucaauaggaaaaaccucagagcugaaaucuuuauaugcuguacuacacagcuguauucugggcacuuaugaauguuaaggaaaccugucuuaaaaguuaacuagguuaaaaaaccucaaacgagagaaagugauauccaggaccaacugcuacaaacgcauaaugcaaacuaaaaagucacacguaauuuucaaucaauuauuuuuuguuccuagcaagcagcauuaauugcugcucucaucccaguucuacggagcucucccuccauucgcaugcucccaacuccuaaaaaguagugguaaaacccaguucagauuuuuuuccuguaguuuucaugacucguaaaaauuaaagaaaaaauuaacugaaaugaucaaacuagcuccuaugagacacaaagcagucuuuugaaaugguuacuugucacgauaguuauuuucauuuuuucagcuaguuuuuauucuuaauugucgucagcacauagguuaucucuaaacugaaauuacggauaauguacauuuauaacaaguuuuacaaaucacuaacaaaaagcaaaaacucauuacuuaccucacaauuuauccaaacuuacccgauguccacuaucgauuuuaaacaauguuauuuuauaaacgugcuuagggucaaagaaaauaaccagguagacccccuucgcuugagaccuuaugcuuaucaauguaauguucaaccaagauugcaaacaaaaugagaaaaguaacaaaguucaaauacagagcggcccaggcccaaaacaguuuugcacaucaauccauacgcauuacaggaaggagccucugaagccauguuuuaaucgaaguauaacuaaggacaaaaucguuauuucacuuuccucguaaucaucuauaaagguccauggaucugucccguaaggguuaaacuucucaguaacaacauuacuuaaaaugagucagcucuacaacuuaaacggaauccuuaagaacaguaaaggauucugacgcgaauaucccucccccgcccagaaaaccaccuucgucccugccccucguggccgauggcuuccaauuuauguuuauuuugccgcgguucaucugucguuuuacugacugcagacccagauaaaaccguuacucaaaggaaaaaaaagacaggaaaaacauaaaaugguuucuuuguccuacggcucgcauugaacccggcccgacgcccuggguggugauaucuucucugaaaccgggcccgcaaacccggagcacccccccuccccgcucuucgguguggcuuccgaacgcaauggcgccauuucaucgaggggaaggcugagcgccuuuaaugaggugcgcaggacucuaaagauccaagcucacaaaacacuccaaauccaccucgaaacgauaugaaaacagcccgagaagaaaaaaaaauaguuaaccacuucuacuucuugauagagaaagcacacuaagaaaauaaaagaguuauaaggaaaacgcugagaggaaggcgagccaugaaaauggcggccgccaaauccgguucccgggagagagggggaggggaagcuccgcagccucgcucacgaggaccugcugcccgccgaaacgcucgccgaggagacgccguggcccccgaagcagcgugcuuuagaaagggaauaagaauucccgccuccgcgccccacuuucaccccagcggggcagcguccgccaugugaaagcuccccaucccccacccccagugaagggaaauggcgccgggaggcugaggguggggaagcuguuuguacgcucaggccuccgcucaagaccccguucauaaaccuuaagccccacugcuacugaauugguccgauuuccugccucucucccacggaggcggcuggccgacuuccacugaggcgccaacggccucgccaugcccuuuucaauaacucauugauuucaaacccguuaccuccaucgcggacucagucgcuucagcccgauuucccgcagccgagcgagaugagagagaucuccgcggacgaacacgaaccggacucguccuggcgcuguagugagaacugccgcugcucgagaaacaacucugcgaggagcaccuccgcacgggacccggcgcugcugcuacugccgcuagagccgcugccgccgcuuuucuagaaccuucccccccacuaacgcgucuuccgcuacgucaggccgucgcguaaacgcccuauccgccgccaauggcgggaaggcucuacgccccaccuuacgccaaaugcguacuccucccacccuugcggccagagacaguacccgacguuacuuccguaaaugcgcucaaugaauugcggaaggcuagaguccugcuaguuacuaccucuuggaauagggucccgcccccugccuuggcgcaaggcaggugagaaacggucgcgcaguuugaaauuaacgccgacgggaggggcuuaauccgcagccuggagauccagcccccucaacccgggagguggucccugcaguuacgccaaugauaacccccgccagaaaaaucuuaguagccuucccuuuuuguuuuccgugccccaacucggcggauugacucggccccuuccggaaacacccgaaucaacuucuagucaaauuauuguucacgccgcaaugacccaccccuggcccgcgucuguggaacugaccccugguguacaggagaguucgcugcugaaaguggucccaaagggguacuaguuuuuaagcucccaacucccccucccccagcgucuggaggauuccacacccucgcaccgcaggggcgaggaagugggcggaguccgguuuuggcgccagccgcugaggcugccaagcagaaaagccaccgcugaggagacuccggucac

SEQ ID NO: 14642 - RNA, 2765 nt, Homo sapiens
ugcuagaggcacagcacgggcauaacuugugguuguguuuuugcuaguuucuuaccucugggccuucuuuauagcuuugccccccaccccacuggcgguggcgcucccgcggcugcacccucggccgccuguugguugcggcgccuccgcggcccgcgcgcaucccccgcgcugcgucccgcacacgcgcgcucccgccgcgucccgcccgggccgcuccgcuggcggcggcgacugggcugcagguagcgagccagccggccucgguccgguaacccauggcaaccgcccugguaacccauggcaacugcgcggcggaaagaaaaaaaagaaccgugguggggcggggggcggcgggcggugaaugggaacaacgaccgcaaagagacagcgauuuaccgcgcgggccugcggcucccggccgcaccugcugcagacggcccgcgaggccccuucccgcgcuacggugacgauucuggcugcuggggaaaagagcaauaagcagaaagcccucgugcagaggggauccgggcggugcacuuggugugggaggcugccuuaaacgccgaugacccucccggccuccgcgugucccggcuuccagggccccgccaggcuggagagcgcgcguggagagggccuugccgccuggggguugguugaggggcggccgcgccggggccggggcuggacuccaggcuuuguucugcagacgcucgcgcccggccggaggaggggcuacaccgugcugccccggccccauggggcccggcccccgaggguccccgcgagcggacgcgguggggccgggcaaacucuacgugcccuaaauuuugucaucugcacacgcaucgcacacauuaguuaaccccuuucccuucuaggcccccgagaaccuaaccugcccggcgggcgcgcggcugcguuaaccuggccccuuccgucuggagagggaggggacggucgcgccuggugguaggacugggcuguguguguguguguguguguguguguguguguguguguguguguguaggggggugauacaaguuuuccacccgcuuuaggcugaggcccuguaagcgggacuguguucuaguacccggaaaaagcgcgcggccugugacacaucaggugccaggccgccggaggacagaagggggcgcugccgggccagugcggaggcugcagccgcccacugcagaacgcgcccuugguugggucuggcgagcugcccgcguaguggagugguguuagggcucccaaguagaaagaaccuguucccuacguaggugucgguuguacuuaagagcaucauuuggucgcucguguauucgcagaaccccuagccugcaauaagaugguucaggaaacacaaccagaaccggucucauucgguacccagcagcuacgugcauacaaguccagagacauguaaugggguggagggaccacgcuaggaaucuggaggucacacauccaggucgaguuuuaacuagcugugauuccaggcacauugugauguuauaaaaaggaaaagauuuggccuggaugauuaugagguccucaaucagaccacucucuguagguguguuacagugacaaauacaaauagcaaagccaucuggaauaccuuuguuuuuuuuuuaaggcaaaggccuaugcaaauauaauaugcacacgcuucugaaagaugauuagaucagcacgguuuaagauaccccauauuuuuacugguagacaagagaagccggcuauguagagaauccuauuuuaauccuuucauaaagacaagaaucuuagaucuuagggaaacuuggcuuauuuucacaaauaugcacguucuggguuccacugcuuauagaggacccgguacuggggagcaugugcucuaaaaccuguuuuagagguaaaacacaggugcugaccugcccugggauccgugcaguacaaucccagcucucugcauagcgguguacugggagcccugugcuuucguuuaauuuuuuuuuaaacaaaagaaauuacagaaaagugcaaauuuaacgugugacauuuaacauuuugccguggcaggcagccuccacuuaaauggggccuuucugcggaacaacaggagccaaaaggccuugugucauggaguaauguaagacacaaucugggcugcaaacgcacaaugaaucgggaaggauuuauguaauuaauugaccagucuuaaccuguuaucgugauguaaggaauuuggaacucauuaauuugggcucugacagauuucauauuagagcuggcaaauauggauugagccucuuauucuuguagcagcuggaauuuccaugacagugaggcuuagugaagaagaccuauugcuggagucaaacugccucuugcuaaucaguagcccugcucuguauuaaagggauaaugaaagaaaaaaaaaaaggaaaaagcauauuaccuaguugggggaguggaaggggcuuguguucauucugcuaguacguggguugagcucaagcauuuguagcugaaccaaacauuaauugcaaucauagaguuaggugauuucucaacaccuugagagaagagaagguagaauggugucagggucagguuugauauuauccaaguuaaagagggauuaaaagacagagccucugaauuucaucugugugcacauagagacuguaugaagaaagagguagaagucuuacgaggggcaaaugggaguuuuuuugguaaugucauauucauaaaugagcgguuca

SEQ ID NO: 14643 - RNA, 37250 nt, Homo sapiens
uauugauggacauuggaguuuuuuagucuuuuuaaagcuaccacuuaaaaugcuucagugaaggggcaggaaagguaaaauuaagacaagaagcaacaucuagaaaaucuccagauacgaaguugugaucuaggaggcaggaaugaagaaguucuggcucugucuugugauggggcacaucuggagugccagaggcuugcauuuugacuacaccuguucuaguuggagaaagaaggaaaacaacuagcauggugaaaccucaacacaccugagcuugguuuacugcaaagucucggggugaggacagauugacagcugguguaugagcugcccaaagguaaacucuuguaauaaagaaauugauggcaugauagauagaagugagauaagugcuauuaaccacagguaaacuucuuucaacagacugcuaccaauucucauauauaacuugcaguacaaaaaaauuaguucaacaacucuauuccuaaaccuuuaaguaagcucugacaccuuaucaaagagcaaaagaguagauuugucuuuuuaccuuggacacaugucaaauaaaaaaccucagcaaaggguaaagaguuuaaaaaagaaauuaaauaccuuaaacaugugauguuuaguacuuuauuaaaugcuucuuuuaaugacaguaucaaggaacaguuucaucuuaggcauucuaagguuaauaaucacauauguaggauuuuaugucauaguuuugauauggauucaugguuucauacuguugauaaauaagaaauagcuuguaagcuaucacagaucaucacuguacuuuaaaaaauggaauauagcugaaaaacgcaaauauauaauuuacaccaguguuacacaaaugugauuuuagggauugacagugaaauguaaguuuuuuuuguuuuguuuuguuuuuugagaugaguagagucacacucuguugccaaggcuggagugcaguggcaucauuauggcucacuguagccucaauuuccuugucucaagcgauccucccaucucagcgugcuaaguagcuaggaccauaguugcaugccaccacaccuagcuaauuuuuuauuuuuuguagaaauggggucucccuauguugcccaggcuggucuugagcuccugggcuuaagugaugcucucaucuuggccucccaaagugcugggauuacaggcaagagccucugugcucagccugauauuuuaaaauguuaauguugcaaaagauuuucugaucugcgugguuaagaaagaaaacuuaauauugcuucugauauucagcuauaaacucagguguuguuuuggagggacugguuuuuuauaucagaaagacaguuaucaauauucaguaucaaaacaguugcacuauugauuucucuuucucccaaucggccccaaagagaccacaucaaaggagaguacauuucaagccaauaagcugcaggauguacaccuaacagaccucauagaaaccuuaccagaaaauggggacuggguagggaaagaaacuuuaaaagaucagcaaacugccagcccacggacugcagaggcugucacagccagauggggguggccagggugccacaaacccaaggaagcaaaguuucaaaauaauacaaaauuuaaaaaaauuuuguauauaagguauucaagguuucuccagcacugacugauacaaagcacaaugagauggcacuuuuagagauagcaacuucaaacccagaaaaggcuaaugagaugaguuucacauggcuaaaucaguggcgaaaacauaaucuuucuuucuuucaagaagguaggaaagcaauuaaguagucaccucaaccuaaggggcacgugauccauucuguaagcaguugggaggacaaaaauuuggucucagaggucuuaccaucuuaauuuggucacuucuaaugaaaaaaauuugaaauaacguuguccaaagauaucuuucuuuguuuuuuuugagacagagucucacucugucgcccaggcuggaguacaguacaugaucuaggcucacugaaacuuccgccuccuggguucaagugauucuccugccucagccuccugaguagcugggauuacaggcacacgccaccacgccuggcuaauuuuuguauuuuuaguagagacgagguuuuaccacguugguccggcuggucucaaacuccugaccucgugauccaccugccuuggccucccaaacuggugggaauacaggcgugagccacggcacccagccagguuuucagcuuuaaaauaucuuuuuuguuuuuuuuuuguuguuguuuggcuaacuccuccuggaaucaccuuucugguuuggcugguauuuuguacagagcaacgagguuucucauaguggagucuuuuccugggcucuguuuggcucucaguaaggcaggccuauacuuuuuccucuccucuauggagagggcaauaugcauuuagcugaaaagucaccuuccgaaagugagaaagggauuagauugcugcuucagagcuguggaauuauuuggaauguuuugcaaaugguugcuacaaaacaacaaaaaagguaauuacaaaaugugcgcaucguaacaugcuuuuaaagacacuugcacaucauaacaugcuuuuaaagacacuaugcauugugcucacauucccuuaaauguuguuuccaaaggugcucagccuuuagcccagcuggaaucuccaggaagaggcagagacaguuuggcaaaaaagaaacagggaaggagggggcugcgaaaguagaaagcagcccccaaauuaaagaucagcccucaguuaaagaucagcuucaggcaggccggccucagguggagucagggacaaagggaggagcagcagcaggguaggacugggguguucuacaucucauucaggucaagcagagucugguacagcauccuuuguguacagagguucuccucuuuguugcauuucaguuuauauuccaagucaucaguugucuuuuccagcuuggcuaccaaucucucaguaaacucagcacgggucucugccuccuugaguuugucagugagaaucuugaucucuuccucauauaugucuucuuuuugagaguauuuuucuucagcaucacuuagacacuucagguucugguccaucagucugaucugcucaucugucucuuggcagcgggacucugccagcucagcucguuccucugugcauuccaagucuccuucaaugaucaccaacuuacgaggcaccucuucauauuuccuaucugccucuucugcaauaugcuuagcuucuuugaguuggauuuccuggaguuccaucuuuuuguuuguuuguuuaagacagagucucacugucucgccaggcuggagugcgguggcgcgaucucagcucacugcaaccuccgccuccuggguucaagcgauucuccugccucagccucccgaguagcuggaacuacaggcgugugccaucacgcccagcuaauuuuuuguauuuuuaguagagacagggauucaccguguuggccaggauagucucaaacucuugaccucgugauucgccuggcuuggccucccaaagugcugggauuacagguuugaaccacugcgcugggcccuuuucuucaucuuuuaaggccugguuuuauuuguuuguuuugagacggagucucacuuuguugcccaggcuggagugcaguggcacgaucucggcucacugcaagcuccgccucccgggggucacgccauucccgggccucggcaaggccugguuuucaauaaccuucauaucucuuucacucucaucagcagcuuucuccucuucuuccagcuuuugcagggcaguggucaggcgcuccugagcaugguccagcuccucuucaaaccugcuggauccuacgauucaaggaggccaccucagccuccuuguucccggcccacuuuucuuccucaacuucucacuggaggcgcucagcucucuccucugcaucaucugccugcugcugcagaaccuggaucuugcacuucacuuccuccaugguggcgaucccagccauggugccgacccagcuacugcuccaguucugguuccugccucuucugcucagcauugcagcugcuucuccuuucuuuuauuuuucuguauuaaguuuuguucccuuuuguuuuuaaagcaacagaugaaaggagauaaaaaugucaaggaaauacugacuugaacuuuauaaauauugguucugauuggggaugauaaagcagguaaaagaaaggagcugaaguaugacugaaggaaucagauuucucuaaccuugauauucaaauuguauucuauagauaugauuauaaauagcaagauucuuuagcauuuggaguuaauuaaauugugaggaaguuaucagggcacauuuuguguucuucauuacucugagaaacuuuucugagguucauugagaaaaauauuuuuaaacucugugaaauccaaguaacucuggaggaaaagcaaauugagcaauuuguucuuuccucuuugagguuugauaagguguaaaaauguauuuaacaaaacaacuucuuuuuccuuaaaaauuuugaucaauaacccugaaaaaguuuuuuuuaauucaauucaguauguuaauuuuaugcuuuccauaaauacauuuuuugaauauuuaagguaacaguuucagaaacauaacugaauagcuugcuuguucuugaacaaagaguuugaaucuaugaugaacuaaauuaaguuaugucuucccaaguaguccacuuagacacugacuuguuacccucuuucucaaguccaguuuuucugagacuggaccaguuacauuaggaucaccuugggucuuuaggugugauuauuguauugugauaaugcuaaaaauauucauucuuuuuagagauacaaacugaaguguuaguggauaaaaugucaagauauuugggauuauuuuaaaaagaaauuaggaugaaggguaaaugaguggcaauguagaugaaacaagacuggccauauguuuauuuauggaaggugagugaggaguaugcgggugauguuauaguauucucucuaauuuaguuuagguuuaaaauuucuauugcaaauaguuaaaagaaucauuuguggucuuguuaaaaauucagauuccuggacuccaccacagaucuuuuaagucagagucucaaggaugaaagauagaaaauggcuuuuaaaguaguccacuugugcucacugaaguuugaggaucacugguaaaaaguuuccuuauguaccucacucauuguguauccaugucauccguguguauuuaguguuuuucaucauucacccuauuuucccauuugcggaaugcaauagcaaguuaaagcaauuauacugaauuuggauaauucaaacuuuaaaauuuuguuucaaagcauucauaaagugaagccaaauaaaauuuaaaaaaccuuuauuuuuaacugaaauaaucaaauaaauacguuggcuuuuuuuuccacuuucagcugggaauggauuacuuuugugaaugucuuaaauuucuucucuuaccagggcaucagcauccuauuccagacaucuacuugcuuucaccaguaguuccuuguucuuucucagauguaccauauuaccaggcaccucugagacuuugcuuaugggauucccucuaauugagacauucaucaauccccucuuuaccugguuaauuucuauaccuucuccccaccgcuaacaccucucacuuauucagggaggccauuauuguauuugcaagguuggauugcauucuauucuuuugugguuccauaauaugcuguaauacaauagugcuauaaugcugaacaugcuauauagcacuuuacacuuugucauaagacucuauuuuucugcccuccucucucucuucagcuagacuauaaagucaguugguuaaagauuguguguuuuaugaucguaucuccacugcuguguacugugccuggcacauaggaaauacuuacugaauacaugacgaacagcugaaugaguucacaaaguagcuaucuaacaugcccaagcaucuuaggaaguguugcagucauucuuuacggcaaaaaagaaagaaagaaagaaaaaaaagcuuccuggauauaagacacacuucuuggucauaaauauagaucuuggaaaaaaguuccugaaaggaggacuaaacuguagcaagaauuugucuuggguauaauaauguugauaaucacuuugcuucuaugcuuagccuuuuucauauaucuuuauuaauuucucauaauuaaauuauaucucuugacccgacuuuuuucgaauauuuuauugugaaaaauuucaaauguccaaaagaguccaaagaauuguguagacugggcacagugguucacauuuguaaucucagcacuuugggaggcugaggcaggcagaucacuugaggccaagaguuugaaaccagccuggccaacauagcuguauuagucugcuuuaacacugcugauaaagacauaccugggacugggcaguuuacaaaagaaagagguguaauggacucacaguuccauguggcuggggaggccucacaaucauggcagaaggugaaaggcacgucucacauggcagcagacaagagaagagaaugacagccaagugaaagggguuuccucuuauaaaaccaucagcucuugugagacuuauuuacuaccacgagaacaguaugggggaaaccacccccaugauucaguuaucucccacugggucugucccacuauacgagagaauuaugggagcuacaauucaagaugagauuuggguggagacccagccaaaccauaucaauagcgaaaacccaucucuacuaaaaauacaaaaaaguagccaggccugguggcucauaccuguaaucccagcuacucgggagacugaggcacaagaaucgcuugaacccugaaggcagaaguugcagugagccaagauugcgccacugcacuucagccugggcaacugagcaacacuccaucucaaaaaaaaaaaacaaaacuguguaguuauguaguguacccauacauccaugacggggauuguacaguuaaaacacagugucccaaaagucuuaguguaguuuuaaguuuuaauaauuucagaagcauaaaugcuacagacuuauaaaaacacccuuuaaauacuuauuuaaauguauuucauacuuacuuaauuuagugaaauuuuuuccccaguggaugagauucuuuuuuaaaaaauccaucccuucaagcauuuguuauuugaguuacaaacaauacgauacacuucauacguuauuuuaaaauauacauuuaaguuauuauagacuauagucacccuguuguccuaucaaauaguaggucuuauucauuuguuccauuuuuuuggcacucauuaaccauccucaucucccccgauucccccacuaucuuucccagccucuggcaacuauuuuucuacucucuguguccaugaguucaauuguuuugauguuuagaucccacaaguaagugagaacauacgauguuugucuuucugugccuggcuuguuuuccuuaacauaaugaucuccaguuccauccauguugcaaaugacugguuaucauccuucuuuauggcugaauaguacuucauuguguauaaguaucacauuuucuuuuuucuuucuuuuuuuuugagacagaguuucacauuuguugcccaggcugcagugcaauggugugaucucagcucaccacaaccucucccuccuggguucaagcgauucuccugucucagccucccgaguagcugggauuacaagcaugagccaccaugcccggcuacuaauuuuuguauuuuuaguagagaugggguuucaccauguugaccaggcuggucucgaauuccugaccucgugauccacccgccucagccucccaaagugcugggauuacaggugugagccacuguucccggccaaguaccacauuuucuuuauccauucaucuguugauggacacuuagguugcuuccaaauccuagcuauuguaaacagugcugcagcaaacauaggaguggaaauaucucuuugauauaaugauuuccuuucuuugggggauauacccagcaguggaauugcuggauccuaugguagcucaaugaucaguuuuuugaggaaccuccaaauucucccuagugauuguacuaauuuacauuccuaccaacagaauacaaggguucccuuuuauccacauccucacaaacauuuguuauugccugucuuuuguauauaagccauuuuaacaggggugagaugguaucucauuguaguuuugauuugcauuucucugaugaucaguaauguugagcaccauuucauaugcuucuuugccauuuguaugucuucuuuugagauaugucuguucaaauguuuugcccauuuuuugauuggguuguuagauuuuuuuuccuauagaguuguaugaguuccuuauauauucugguuguuaauccccuaucagaggaguauuuugcaaagauuuucucccauucuguggguugucucuucauuuuguugauuguauucuuugcugugcagaagcuuuuuaacuugauguuaucucauuuguccauguuuguuuugguugccuguacuugugggacucaagaaauuuuugcccagaccaaugcccuagagauuuucuccaauuuugacuugaagcaguuucauaguuucaggucuuagauuuaaguuuuuuuuuuuuuuuuuuuuuuuuuuuuuugagacagagacucacucugucacccaggcuggagugcaguggcacaaucuuggcucaccgcaaccucugccuccuggguucaagcaauucuccugccucagccucccaaguagcugggacuacaggugcccaccaccaugccuagcuaauuuuuuuggauuuuuaguagagacagaguuucaucauguuggucaggcuggucuugaacuccugaccuccagugacccaccugccuuggccucccaaagugcugggauuauaggugugagccaccuugcccagccagauuuaagucuuuuaauccacucuuuuuauuugauuuuuuuauauggugagagauaggggucuaguuucacucuucugcauauggauauccaguuuucccagugccaucuauugaagagacugucuuuuccccaguguaugcucuugguacuuuugucaaacaugacuucacucuaggcguguggaucuguuucuggguucucuauucuguuccauagagcuauugucuuuuuuugugccaguaccaugcuguuuugguuacuauagcucuguaguauaauucaaagucagguaauguaauuccuccaguuuuguuccuuuugcuuaggauagcuuugguuauucugggacuuuugugguuccauauaaauuuuagaauuuuuuuguauucuggggaaggauaucauuaguauuuugauagggauugcauugaaucuguagauugcuuugggugguauggacauuguaacaauauugguucuuccaauccaugaacauggaauauuuuuccauuuuuugguguccccuucaauuucuuucaguauuuuguaguuuucauuauagagaucuuucacuucuuuggcaaguaaauuuccggguauuuaauuuuauguguauaagugggauuacuuuuuaaauuucuuuuucauauuguucaccuauggcauauagaaaugcuacugauuuuuguguguugauuuuguauccugcaaauuuacugaauuuguuucucaguucuaauaguuuucuuguggagucuuuaguagguuuuuccaauuauaagauuauaucaucugcaaacaaggauaauuugacuucuuccuuucuaauuugggugcccuuuauagcuuucucuugucugauugcucuaguuaggauuuccaguacuauguuaaauaacaguggugacagugggcauccuugccauauuccagaucuuagaggaaaggcuuucaguuuuuccccauucaguaugauaccgugggucugucauauguagcuuuuauuauguugagauauguuccuucuauccccagguuuuugagggauuuuaucauaacaggacguugaacuuuaucaaaugcuuuuucaggaucaauugaaauaauccugugguuuuuauccuucauucuguugauaagauguaucacauugauugauuugcauguguugaaccauucuugcauccagggauaaauuccacuuagccaugaugaaugaucuuucuaacguauuguugaauucgguuugcuaguauuuucuugaggauuuuugcaucaauauucaucagugguuuuucuuuuuuugaugugucuuugucugguuuugguaucaggguaauauuggccuuguagaaugaauuuggaaguauuacuuuuucuucuauuuuuuggaauaauucgagaaggauugguauuaguucuucuuuaaauguuugguagaauucagcaguaaagccaucagguccugggcuuuucuuuacuggaagacuuuuuauuauggcuucgaucucauuacuuguucuuggucuguuuagguuuugaauuucuuucugauucagucuugguugguuuuauguauauagacauuuguccauuucuucuagauuuuccaauuuauugucauauaguugcuuguaguaaccacugaugauacuuugaauuucugcaguaucaguuguaaaugucuccuuuuucauuucugauuuuauuuauuuggauuuucugucuuuuaguuuggcuagagguuugucaauuuuguuuaacuuuuuaaaaaaccaacuuuuuguuuuauugaucuuuuguauuuuuuucuucaucucaauuucauuuauuucuguucugguccuuaguauuucuuuucuucuacuaauuuuggguuuggcuugcucuugcuuuucuauuccuuuaagaugcaucacuagauuguuuauuugagguuuuuacccuuuuuugaugugggcacuuacagcuauaaacuucccucucaguacugcuuuugcuguaucccagagguuuuaguauuuuguuuuuccauuaucauuuguuugaagaaauuuuucaauuuuuuaaaaugucuucauugacccacuggucauucaggagcacuuuguuuaauuuccauguauuuguauaguuuccaaaauuccucuuguuauuaauuucuaguuauauuccacuguggucagagaagaugcuugauauuauuucaauuuuugaauguuuucagacuuguuuugugaccuaacauauacucuauccuugagaaugauccaugugcugaggaaacgaaugcauauucuacagcuguuggaugaaguguucuguaaauaucuauuagauccacuuggucucuagugcagaguaagacuaauggugucuguugauuuuuugucuggaagaucuaucaaugcugaaaguggggcguugaagucucuagcuauuauuguguugggguguaucucucucuuuaccacuaguaauauuuucuuuauauaucugggugcuucacuguugggugcauauauauuuaaaauuguuauauuauuuugcugaguugacuccuuucucauuguauaguggcuuucuuugucucuucuuagaguuuuggucuuaaaaucuauuuugucugauauaaguguagcaacuccuguucuuuuuuaguuuccauugucauggaauaucuuuuuccaucccuuuauuuucagucuauguguguuuuuacaggugaaguguuuuuuguugcuguuguuuuguuuuuuuguaggcaacagaucgaugggucuuguuuuuucaucuagccaguguacguauuuucauaagacaguuuaguccauuuacauucaauguuauuauaauaaguaaggacuuacugcuaucauuuugcuauuuguagucugguuguuuuguggucuucucuuccuucuuucuuuccuuccucuuuuagugaaggugauuuucucuggugauaugauuuggacucuuacuuuuuauauuuuguguauccauuguauguuuuuugguuugagguuaaaaugagguuuacaaauacuaucuuauaacccauuuauuuuagcuugauaaaaauuuaacaguguuugcauaaauaagcagacaagcaaaaagaaaacuaauaggcugggugugguggcucaugccuauaaucccagcacuuugggaggcugaggugggcggaucacuugaggucaggaguuugagaccagccuggccaacauggcgaaaccccggcucuacuaaaaauacaaaaauuagccaggccugguggugugcagcuguaaucccagcuacucgggaggcugaggcaggagaaucucuugaaccugggaggcggagguugcagugagcugagaucgugccacugcauuccagccugggugacagagugagacuccauuucaaaaaaaaaaaaaaaagaaaagaaaaacucuguggcuuaacuucaucuccccacuuuuuaacuuuuuguuguuucuauuuauuuauuuuuuugagacagggucuugcuuuguugcccaggcuagagugcaauggcgugaucuugacucacugcaaccucugccuccaaggcucaagcaauccucccaccucauccucccuaguagcugagaccacacaggugcacaccaccacacucagcuuauuucuuaaaauuauuuggagagacaggguuuuccauguugcccaagcuggccuugaacuccuggccucaagugauccacccuccuugaccucccaaaguacugggauuacaggcaugagccauugugcugagccaguuguuucucucucucucucucucucucucucucucucucuauauauauauauauauauauauauauaaauauauauauauauuuauauacauauauauuuacauauauauaauagcacuaugucuugaaaaguuguuguaguuacuauuuuugauugguucaucguguagucucucuacuuagcauaagaguauaacaguuacaauguuauaauauucuguguuuuuuuguguacuuacuauuaccacugaguuuuguaccuucuggugguugcuuauuguucauuaauguccuuuucuuucugauuuaaguacucccuuuaacauuucuuguaggacaggucugguguugaugaaauuccucagcuuuuguuugucuggguaagucuuauuucuccuuuguguuugaaggauauuuuaaucaaauauacuauucuagggcaaaaguuuuuuuuuuuucuucagcacuuuaaauaugucaugccacucuguccuggguugugagguuuccacugaaaagucugaugccagacauauuagagcuccauuuuauucuauuuguuucucuucucuuacuucuuuuacaauucuuucuuuauccuugaccuuugggaguuugacuauuaaaugccuugagguagucuuggguuaaaucugcuugguguuguauaagcuucuuauauguagauacugauauuuuucucuagguuugggaaauucucuguuauuaucuccuugaauaaacuuucuaccccuaucccuuucucuaccuccucuuuaaggccaauaacucauagauuuucccuauugaagcuauuuucuagguccuguaggcaugcuucauuguuuuuuauucuuuuuuucuuucgucuccucugugcauuuucaaauaggcugucuucaagcucacuaauucuuucuucugcuugaucaguucugcuauuaaaggacucuagugcauucuucaguaugccaauugcauuuuucagcuccagaauuucugcuugguucuuuuuuguuauuucaaucucuuuauuaaauuuaucugauagaauuuuaaaugucuucucuguguuaacuugaauuucuuuccguuuccucaacacagcuauuuugaauucucugucuaaaaggucucauaucucuguuucuccaggauuggccucuggugccuuauuuaguucauuuggugaggucauguuuuccuggaugguauugaugcuaguagauguucuuugguguuugggcauugaagaguuuaaguauuuauuguagucuucacugucugggguuauuuguaccaauccuucuugggaaggcuuuccagauauuuuaaaggacuugaguguugugaucuaagcuguaucugcuuuagggggcaccccaagcccaguaacacugugguucuugcagacuuguagagguaccgccuugauggucuuggacaagaucaggagaauucucuggauuaccaggcagagacucuugaucucuucucuuacuuucucccaaacauacagagucucucucucccucucucucucuuucucucucucuguucugagcccccuaaagcuauggguggagggacacaagcaccucuguggccaccaccauuaugacugggcugggucaggcuugaagccagcacagcacugggucuugcccaaggcccaccacuguaacuacuuucuggaaacugccuguguuugcucaaggcccuggggcucuacaaucagccaguggcaaagccagccacgccugucuccucuccuucagggcagcaaggucccccaaguuccuguggguccagugaugccaucugggaguuagggaccagaguaaaaaaccuuagaagucuaucuaguguuuuauuguacuguggcugagcuggcacuuaaaccacaagaugcaguccuucccacucuuccuuccccuuuccaaaggaggagccucaccccauagccaccaccaccacaggccaccaggaauacugucagacuacugcugauguucccuuaaggaccaaaggcucuuaagucagcuuguggugaaugcugccuggugugggacucacccuucagggcaauggacucuccgcuggcccagggcagauccagaaaagccauccaauaaucaaguccuggaaucggggaccccaggagcuucuuuggugcucuaccccucauguucaugcuguuaccugaagccagcaagucucagaggcucauccaaggcccuugauguaguaccugaguaucacuacugguuauucagggcccaaggguucuucaguuagcaggggaugaaugcugccaggacuggguccuuuccuucaaggaagcauguucccuucuggcccaggguguauguagaaaugucaucugggagcuagggccuggaauggggaccucaugacugaccagcgcucuuuccuacuguggcugagcugguauccaagaugcaagacaaaguccuccccacucuucccucuccucuccucaagcgggagaaagaggagggucucuuuugaagcugugagcugugcagccugggguuaggggauggaugauaccaguuagacacucccuuggcugccccaauuggugucucacuaugaugcaugccccuccacuuuacuaucucugggccuaguucagcauuaggacucaucuaaaaguugcagaaaggccuagacugccuuucagguuuauuuggagacacagaguacuggucggcagugcuaagguuugugggaacucaagcucugaccacugggaucagugauucucuucuggcuagggcugguuuaaaugcuuccuuugugggugagugucaguuuggucugguuuuccuuucugcucuaccaggacagcacuugaguucagugugucacaauugcuguguucucccucccccagugcccagaagugcucucuguaccacaccuccauugccaggacuggagagguggcaucagggauucaagacuguuuuuucugucucuucagugccucuuucaaugauaugaaguuaaaaccagguacuaugagugcuuaccugauuuuuggcuuuuaugaagguguuuuuuuuuuuuuucuguguagauaguuguucaguugguguucuuguggaggagaugaucuguggagccuuuuauuccaccaucuugcucuacuuccucccuaauuuugugaauuuugaguuauaauauuuuaauuuuaguuuuuuguuuuggcaucuucagaaggcugaaagaaaaaaauaaaauuaacaauuuacuagucaaaauuuacaaaacuaaacaagcuaaacauuuaaauaaacuuucaaaugauuuuuaagaagcuuguaucauuuauauuucugaaauuauuaaagcugaaaacuauaguuaggauacuaucaacagagugaaaaggcaacccacggaauggaagaaaauauuuucaaaccuuguaucugauaagggguuaaauagccagacuacauaaauaacuccuacaguucaacaauuaaaaaaccaaacaaccagauuaaaaaacggacaaagaacuucaauaaacauuuuuccaaagaaaauauacaaaugaccaauaagcauaugaaaugaugcucaaaaucuuuaaucauuagggaaaugcaaaucaaaacuacaacgagauacuacuucauaccuauuaagauggcuauaauaauaauaauaauaacaaaauagaaaauaacaaguguuggcaaauuuguggagauaccuuggaacccuugugcauugcugaugggaacauaaaaugguacagccacuauggaaaccaguauggugguucuucaaaaaauuagagauaaaaugaccauaugguccagcaauucuacuucuggauauauacucaaaagaaacaaaagcagggacucaaauagauauuuguacacucauguuuauagcagcauuauuuguaagagcuaaccuguggaagcaccugaacugucuauagacagauaaauggauaaacaagagguggcauauacauacaauggaauauugcucagccuuaaaauggaaauucuggugcauauuacaauaugaaugaaccuugaagauauuaugcuaagugaaauaagccacacaaaaggacaaauacugaauuauuucacuuauacaagauaccuagaguagucaaauucauagugauagaaaguagaaugguuaccaggggcuggaggaagggguccuggggaguuauuguuuaauggauaugggauuuaaguuugggaagaugaaaaaguucuguagauugaugguggugaugguugcacacuaauaugaauuuauuuaaaaccacugaacuguauaucuauaaaugguuauaaguaaauuuuauguauagauuuuacuacaacuaaaaaaugcuguuuuugaaauguugagcaaaauuuuaauaauacaguaaagcaaauuuuucuguuauaauauuaauauugaaaaagaggaaaacccucaaaaauuacaagggaaauauacccauugguuccucuuaaagaagauagggaauugucaaacaacugagucagacaacaguuuaguuuaguucgugaccguuugcugugguaaagugcauauggaaagaaaguaauggagaauaauugcugacucugguaaauucuuucuauauauuccaauuaauuuacccgucucucuuuuuuauuucuuuuuugucaguuugaaugucuucagacaugaauagcuauuccauggauugcaaguaacauagcacuuucaccaaaggcagaauuuguacauaugguaauuuagaaaagagacaauuuagcuuccuaguguaaauugccaugacuaccaugguuauacuucuuagaguugggggcaaauaagauugagauaauuaugaaaucacuguuuuggccuuauugaguuaguuuuuucugaaaagauuucaaauugagcuuauuauuuaaaaucucacaaaagucuuuauguagugugcaguaacugcuacagugaugcugagcuuaaaggaaaacaaauuugggcauuauaaacauauggauauauaauguucaaccuuuauaaaaauuaaagauccagaagacuaaaaugcaaauuauguauauagauagucuugacgacucuaccaugaaauaaacacugccuuagagaucacuaucauguuuccuucagcuucagaacaaauugauaugauguguuaugcugucuuccuucuacaggcagcaauaggaaaugcagauauuuuauacuuguagggcuucccaaagacaaaaugagaagauaccagaagauuaacagccaucucaccuguaauccuagcacuuugggaggcugaggcaggcagaucacuugagaucaggaguucgagaccagccuggccaacauggugaaaccccauaucuaauaaaaauacaaaaauuagcugggugugguggcaugcaccuguaauccuagcuacuugggaggcugaggcaugagaaucacuugaacuccggagcuggagguugcagugagccaaaaucaugccacugcucuccagccugggcaacagagugagacccugucuguauuaguuaggauucucuagagggacagaacuaaugauauauauguauauauauaaaggggaguuuauuaaguaguauuaacucacacgaucacaaggucccccaguaggcuguccgcaagcugaggagcaaggaaaccaguccaagucccaaagcugaacaacuuggaguccgauguucgagggcaggaagcauccagcacaggagaaagauguaggcugggaggcuaggccaguccuguguuuucacauuuuucugccugcuauauauucuggcucugcuggcagcugaauagauggugcccagccagauuaagggugggucuucuuuucccagcccacugacucaaauguuaaccuccuuugguaauacccucacagacaaacccaggaucaauacuuugcauccuucaauccaaucaaguugacacucaguauuaaccaucacaagucuaccucuugucaacuugaacccauacacaucuccugagaucauacauaaucuucaaauaaagauaauaguaaggucauaauuaugccuaacauaauacaacuauucuucauacaaccggaaauauaucaauccccaacccaaaugcuauuacauaaaguuaacaauacuuagaugcugauauuaagucaauaaaucuuaugucacaugacaaagggaaaaggaaauaaauuggagauauuuucuugguauaaguguguacauggagguaaaaucggggugguuccaagauggccgaauaggaauagcuccagucuacagcucccagcgugagcaacacagaagacaggugauuucugcauuuccaacugagguacuggguucaucucacuggggcuuguuggacaguggguucaggacagugggugcagcacacugagcgugagccgaagcagggccaggcaucaccucauccaggaagugcaaggggucagggaauuccccuucauagccaagcaaagcuguggcagauggcaccugaaaaaucaggucacuccuacccuaauacugugcuuuuccaauggucuuagcaaauggcacaccaggagauuauaucccgugccuagcucagagggucccaugcccacagagccuugcucauugcuagcacagcagccugagaucgaacugcaagguggcagcaaggcugggggaagggugcccgccauugcugaggcuugaguagguaaauaaagcagccaggaagcuugaacuggguggagcccaccacagcucaagaaggccugcuugccucuguagacuccaccucugggagcagggcauagccaaacaaaaggcagcagaaaccucuguacacuuaaaugucccugucugacagcuuucaagagaguagugguuuucccagcauggaguuugagaucugagaauggacagacugccuccucaagugggucccugaaccccaaguggcguaucugggaggcaccacccaguaggggcagacugacaccucacacggcuggauaccccucugagaugaaaccuccagaggaaugaucagacagcaacauuugcuguucagcaauauucgcuguucugcagccucugcugcugcugauacccaggcaaacagggucuggaguggaccuccagcaaacuccaacagaccugcagcugaggguccugacuguuaaaaguaaaacuaacaaacagaaaggacauccacaccaaaaccccaucuguacgucaccaucaacaaagaccaaagguagauaaaaccacaaagaugggggaaaaacagaacagaaaaacugaaaauucuaaaaaucagaguaccucuccuccuccaaaggaacacagcuccucaccagcaauggaacaaagcuggacagagaacgacuuugacgagacgaguugagagaagaaggcuucagacaaucaaacuucuccgagcuaaaggagaaaguuugaacccauugcaaagaaguuaaaaaccuugaaaaaagauuagacgaauggcuaacuagaauaaccaaugcagaggaguccuuaaaugaccugauggagcugaaaaccagggcacgagaacuacaugacaaaugcacaagcuucaguagccgauuugaucaacuggaagaaaagguaucagggauggaagaugaaaugaaugaaaugaagugagaagagaaguuuagagaaaaaagaaugaaaagaaaugaacaaagccuccgagaaauaugggacuaugugaaaagaccaaaucuacgucuguuugguguaccugaaagugacggggagaauggaaccaaguuggaaaacacucugcaggauauuauccaggagaacuuccccaaccuagcaaggcaggccaacauucaaauucaggaaauacagagaacgccacgaagauaccccucgagaagagcaacuccaaaacacauaauugucagauucaccgaagucgaaaugaaggaaaaaauguuaagggcagccagggagaaagguuggguuacccacaaagggaaguccaucagacuaacagcugaucucucagcagaaacucuacaagccagaagagagugggggccaauauucaacauucuuaaagaaagaauuuucaacccagaauuucauaugcagccaaacuaagcuucauaagugaaggagaaauaaaauccuuuacagacaagcaaaugcugagagauuuugucaccaccaggccugcccgacaagaacuccugaaggaagcacuaaacauggaaaggaacagccgguaccagccacugcaaaaacaugccaaauuguaaagaccauugaggcuaggaagaaacugcaucaacuaacgagcaaaauaaccagcuaacaucauaaugacagggucaaauucauacauaacaauauuaaccuuaaauauaaaugggcuaaaugcuccaauuaaaagacacagacuggcaaauuggauagagucaagacccaucagugugcuguauucaggaaacccaucucaugugcagagacacacauaggcucaaaauaaagggauggaggaagaucuaccaagcaaauggaaaacaaaaaaaggcaaggguugcaauccuagucucugauaaaacagacuuuaaaccaacaaagaucaaaagagacaaagaaggucauuacauaaugguaaagggaucaauucaacaagaagagcuaacuauccuaaauauauaugcacccaauacaggagcacccagauucauaaagcaaguccuuagagaccuacaaagagacuuagacucccacacaauaauaaugggagacuuuaacaccccaccgucaacauuagacagaucaacgagacagaaaguuaacaaggauauccaggaauugaauucagcucugcaccaagcuaacuuaauagacaucuacagaacucuccaccccaaaucaacagaauauacauucuuuucagcacuacacacaccuauuccaaaauugaccacauaguuggaauaacgcaauccucagcaaauauaaaagaacagaaauuauaacaaacugucucucagaccacagugcaaucaaacuagaacucaggauuaacaaacucacucaaaaccucucaauuacauggaaauugaacaaccugcuccugaaugacuacuggguacauaacaaaaugaagguagaaauaaagauguucuuugaaaccaaugagaacaaagacacaacauaccagaaucucugggacacauucaaagcaguguguagagugaaauuuauagcacuaaaugcccacaagagaaagcaggaaagaucuaaaauugacacccuaacaucacaauuaaaagaacuagagaagcaagagcaaacacauugaaaagcuagcagaaggcaagaaauaacuaagaucagagcagaacugaaggagguagagacacaaaaaaccccuucaaaaaaucaaugaauccaggagcugcuuauuugaaaagaucaacaaaauugauagaccgcuagcaagacuaauaaagaagaaaagagagaagaaucaaauagaugcaauaaaaacugacaaaggggauaucaccaccaaucccacagaaauacaaacuaccaucagagaauacuauaaacaccucuacgcaaauaaaccagaaaaucuagaagaaauggauaaauuccuugacacauacaaccucccaaggcuaaaccaggaagaaguugaaucucugaauagaccaauaacaggcucugaaauugaggcaauaauuaauagcuuaucaaccaaaaaaaguccaggaccagacggauucacagcugaauucuaccagagguacaaggaagagcugguaccauuccuucugaaacuguuccaaucaauaaaaaaagagggaauccucccuaacucauuuuaugaggccagcaucauccugauaccaaagccuggcagagacacaacaaaaagagagaauuuuagaccaauaucccugaacaucgauacaaaaauccucaauaaaauacuggcaaaccgaaucuagcagcacaucaaaaagcuuauccaccaugaucaagugggcuucaucccugggaugcaaggcugguucaacauaugcaaaucaauaaauguaauccagcauauaaacagaaccaaagacaaaaaccacaugauuaucucaauagaugcagaaaaggccuuuggcaaaauucaacagccuucaugcuaaaaacucucaauaaauuagguauugaugggacguaucuaaaaauaauaagagcugucuaugacaaacccacagccaauaucauacugaaugggcaaaaacuggaagcauucacuuugaaaacuggcacaagacauggaugcccucucucaucacuccuauucaacauaguguuggaaguucuggccagggcaaucaggcaggagaaggaaauacaggguauucaauuaggaaaagaggaagucaaauugucccuguuugcagaugacaugauuguauaucuagaaaaccccaucaucucagcccaauaucuccuuaagcugauaagcaacuucagcaaagucucaggauacaaaaucaaugugcaaaaaucacaaacauucguauacacugauaacagacagagagucaaaucaugagugaacucccauucacaauugcuucaaagagaauaaaauaccuaggaauccaacuuacaagggaugugaaggaccucuucaaggagaacuacaaaccacugcucaacgaaauaaaagaggacacaaacaaauggaagaacauuccaugaucauggauaagaagaaucaauauugugaaaauggccauauugcccaagguaauuuauagauucaaugccauccccaucaagcuaccaaugacuuucuucacacaauuggaaaaaacuacuuuaaaguucauauggaaccaaaaaagaguccacauugccaagucaauccuaagccaaaagaacaaagcuggaggcaucacacuaccugacuugaaacuauacuacaaggcuacaguaaccaaaacagcaugguacugguaccaaaacagagauauagaccaauggaacagaacagagcccucagaaauaauaccacacaucuaccacuaucugaucucugacaaaccugacaaaaacgagaaauggggaaaggauucccuauuuaauaaauggugcugggaaaacuggcuagccauauguagaaagcugaaacuggaucccuuccuuacaccuuauacaaaaauuaauucgagauagauuaaagacuuaaauauuagaccuaaaaccauaaaaacccuagaagaaaaccuaggcaauaccauucaggacauaggcaugggccaggacuucaugucuaaaacaccaaaagcaauggcaacaaaagccaaaauugacaaaugggaucuaauuaaacuaaagagcuucugcacagcaaaagaaacuaccaucagagugagcaggcaaccuacagaaugggagaaaaaauuugcaaucuacucaucugacaaagggcuaauauccagaaucuacaaagaacugaaacaaauuuacaagaaaaaaacaaacaaccccaucaaaaagugggcgaaggauaugaacagacacuucucaaaagaagacauuuaugcagccaacagucacaugaaaaagugcucaucaccacuggccaucagagaaaugcaaaucaaaaccacaaugagauaccaucucacacuaguuaaaauggcaaucauuaaaaagucaggaaacaaccggugcuggagaggauguggagaaauaggaacacuuuuacacuguuggugggaccguaaacuaguucaaccauuguggaagucaguguggugauuccucagggaucuagaacuagaaauaccauuugacccagccaucccauuacuggguauauccccagaggaauauaaaucaugcugcuauaaagacacaugcacacguaugcuuauugcagcacgacucacaauagcaaagacuuggaacuaacccgaauguccaacaaugauagacuggauuaagaaaaugugguacauauacaccauggaauacuaugcagccauaaaaaaugaugaguucauguccuuuguagggacauggaugaagauggaaaccaucauucucagcaaacuaucacaaggacaaaaaaccaaacacugcauguucucacucauaggugggaauugaacagugagaacacauggacacaggaaggggaacaucacacaccagggccuguugugggguggggggaguggggagggauagcauuaggagauauaccuaauguaaaugacgaguuaaugggugcagcacaccaacauggcacacguauacauauguaacaaaccugcauguugugcacauguacccuagaacuuaaaguauaauaaaaaauauuaaaaaguguguacaugcacaaacauguuuuuaauaaaagaaggaggaaauacucaugacaauuacaguacuuguuucugcaacuggucauaugguaguagcugguauugaugacugccuucuucuacuacccauucuguguaucugcuuugccuucagcaaguaccucagcagguugugguauuuuccaugguggggugacccaugccuucauuccggaaggguuuggggccauuuguuguaguccugccuggacugggcuguuguaguuucccauugaucuuaaucacagggcaugguaauaccaagagacgcccuaaugcaucuccuguauuccaugcauacucuucuuuaucucugcuguggaguaguagacugauuucaucuugauagucggggucaaucuccccagccaacacucuaacucccaucuuagccuguugacuuaaaggcaggaggagcccaaaguguccagaugcaauuguaacuuuccaguuuaauagaauuguuaugguguuuccuggugguaguguuccucccucuggaacuaagaccucuaggccagcaggauguaaugcugugggaacaggaagcaaaaauuuugcuaguggaucacuaggggugguagugaguggugccacuuccacuuccaccccuugauuccuggaccugugaauccuggcuaugggagaaacaguaccauauguuggacacugacucagagcauauacagccuucuggagaacuuuaccccagcccuuccagguauugucaccuaguugauguuguaauugugacuucaaaaggcuauuccacuguucuaucaauccagcugcuucaggaugauggggagcuugguaagaccagugaauuacaggagcgugagcccacugccacacuucuuuagcuguaaagugagugccuuggucagaggcaaugcuguauagaacaccaugaugguggauaaaacauuccaugaguccauggaugguagucuuggcagaagcauugcaugcaggauaggcaaacccauauccagaguaagugucucuauuccagugaggacaaacuucugccauuuccaugguggaagagguccaauguaaucaaccugccaccagguagcuggcugaucacccugaggaauggugucauaucgagggcucaguguuggucuccgcugcuggcaaauugggcacucagcagucgccauagccaggucagccuuggugaguggaaguccauguugcugagcccaugcuuaaccuccaucccugccaccauggccacuuuguucaugggcccacuggacgaugacaggguggcuggggaaaguggcugagugguguucacagaacgggucguccuauccacuuaauuauuaaaauccuucucugcugaggucacccauuggugagcacucacaugggauagaaauaucuucacaguuuuugaccacucagagagguccauacacauaccucuuccccaaauuucuuugucaccaguuuuccaaucaugcuucuuccaagucccuggugauccagccaaaccauuggcuacagcccaugaaucagcguauaaucgcacaucuggucauuuuuucuuccaugcaaagugcacagucaggugcacugcucaaaguucuagccacugggaagauuucccuucacugcuguccuucaggggugugcuagaaaggggcuguaaugcugcagcuguccccuuuaggguggugccugcauaucuugcagaaccaucugugaaccaggcccuagucuucucuuccgcugucaacugaucguagggaacuccccaugaagccaucggugcaggcucggggagagaaggcagaguggcaggaguggagaccaugggcauuugagccacuuccucauguaacucacuugugccuucaggaccugcuugagccugaucccauauauaccacuuccauuugaugauggaauccugcugugcaugaccuacuuuauggcuagaugggucagaaagcacccaguucaugaugagcaguucaggucacauggugacuugaucauucguagucaaacauuuaguuuccaccaaagcccaguaacaggccaauagcugugucucaaaaagagaguaucugcagaagacagcagggccuugcuccaaaauccuagaggccucugcugugauucacuuguggggccugccaaaugcuccaaacagcaucccuaucugccacugacaccucaagcaccauuggaucuucugaguuauauggccuaaguggcagagcagcuugcacagcagcuuggaccuguugcagagccuucuccuuuucuggacgccacucaaaacuggcagcauuucgggucacucgauaaaugaguuggaguaacauucccaaaagaggaauguguugcuuccaaaauccaaauaggcccgcuaggcuuugugccucuuucuugguuguaggaggggccaaaugcagcaauuuauccuucacccuagaaagaauaucucaacaggccccacaccacuggaccccuagaaauuuuacugagguagaagauccugcauuuuaguuggauuuauuucccauccucugggcacacaaaugucucaccaauaaguccaguguguuuacuacuucuugcucacuggauccaaucagcauaaugucaucaugucuucaauguaauggaccagugugauaucuuguggaagcaaaaagcgaucaaggucucucugaauaagauuaugacacaaagcuggagaguugauauaccccugaggcaagacaguaaagguauauugcuggccuugccagcugaaggcaaauugcuucuggugggccuuauggacaggaauggagaaaaaggcauuugccaaguuaguggcugcauaucagguaccaggagauguguuaauuugcucaagcaaugaaaccacaucugguacagcagcugcaguuggagucaccacuugguuaagcuuacgauaauccacugucauucuccaagauccaucugucuucugcacaggccaaaugggagaguugaaaggggauguggugagaaucaccccccugcaucuuucaaguccuuuauggugacacuaaucuccacaaucccuccaggaugugauguuguuucugauuuacuauuuuucuagguacaggcagcucuaauggcuuccauuuggccuuucccaccauaauagcccucacucuaccagucaaggagccaauguggggguucugccagcugcuaaguaugucuaugccaauuaugcauucuggcacuggugaaaugaccacaggaugaguccggggacccacuggacccacuguaagucagaccugagcuaaaacuccauuaauuaccugaccuccauaagccccuacuuuaaccagaggacuacaaugacauuuugggucccuuggaaucaacgucagcucagagccaguguccaguaguccccaaaaagccuaauuauuuuccuuuccagaaugcacagguacucugguaaaagucuggaggccuccauggggaaggaugggagaaagauuaacagcauaaauugucgguaguguagugggauccuuccucaagaggacccagccuccccuucauucaagggguucuggaucuguaaacugggccaagucuggaaauugauugaggggcugugauucucuguuuuuauaauucaaauuagucuuuuguccauucaauguagaaguuuucugcuuauauaaauuaaguaggaaugcaguaggcuuccuaucaauuuuacuucuaggaacacugugauuaauuagccgaugccagaccucuacagaagucaggcuauucugauugcugcuuugccucugcuguccauuacaguagcuugccuuugaugguugagugcugccacuuggcccuugccaccucgggauuuaauuauucccauaguauuuaaauuuuguaguugagugacugugguuccuacuguuagaucugacauacagagaagagcaauuacagggcucuucaaaguugcaacugcugcccugaaaaaucuguuucacaaagcauuguucaaggguauaucuucuagacccucccagccgggaugaguaggucuaaagugacuaauccacucuaccuaaacucaaucucccuaaaccuuuggaucccuuccucuauauuaaaccaagggagaucaggcuuuuccaccucacucacagugggccaucuuuuaauccauauuuuagguaaccaagcaaauaaacuauuuuagccuuuuuuaacuccaugagcugcaacauuaaaugcagaaucccuacuuagugggcccaaaucaauaaauucagccugaucuaacucuauguuccuuugaccauuaucccacacccuuaauauccauucccaugucuguucuccagauuucugcguauauaaauuagaaaacucaagcaguucuuuucgaguguagugcaccuccucaugggucacacucugaaccucaccucuaggacuuuaauuauggguccagaaauaaacagggguguuggggguggcuccugaagagaaucaacauuaucuugccuggcaacugccucaggggaggccaucgcaguugccucaggcacugcaggguuuaucuccucagacaaagguggaaaggaugauggcagugugggucagggaggggauauugucacuacuggggauggggaagcuguuucuucuagcaaaaaagguucaucagaauuuacaagcgcaguguccccaccuucaucagggccacacguccccauuccaaguugcagggucccacucuuuuccaguuaaugcccucacuuuaacaguagacaccuggugagguuaugccugcaccuuucuuugcaagucagccacuugcuugauaagagcuaucuguuuuuccacaauuucugcucuuucucuacaggagauaaaacucccacucagggcaaucuuagcggauuugaggcucaguaucugcuucugaagccacgaguuagaaucuuugaguucaucauuuucuuucaucacuguccagugaucuuaggagcaaccaaccaacuucauuauguucacugguucuccauauauagucaaagguauuauguacagagucacuaaacuccuugucucucaugaguggcaaaucaggagugucaaaugcauuuauuuuguauaacucucuaaacaguucacaccaaagacuaucaguguuuuccauacuauuagaaguacaguccuuagcauuuuugggucuaaccauauuaagcagucaacugcagaaaccccaaaaccaacaaaagaacuccauccuuaauauucuguuucucuaggaccacuccugauaccaaaaucuguauuaggguucucuagagggacagaacuaauaggauauauauguauaaaaaggagaguuuaucaaguaguauuaacccacauggucacaaggucccacaauaggcugcaagcugaggagcaaggaagccagccugagucccaaagcugaagaacuuggagucugauguucaagggcaggaagcauccugcacaggaggaagauguaggcugggggcuaggccagucuagccuuuucacauuuuucugccugcuuuauauucuggcugugcuggcagcugauuagauggugcccacccagauuaaggauuuaagcauuuuccagcccacugacucaaauguuaaugcuuaaggguuaagcauuucccagcccacugacucagauguuaaucuccuuuggcaacacccucacagacaaacccaggaucaauacuuugcauccuucaauccaaucaaguugacacucaguauuaaucaucacacugucucaaacaacaacaacaacaaaaaccuuagccaucuuggccuuaagauuugaauauuguguuuuuuauggagaagggagugaagaaagggaauugggugagaauuugaaaaagggguggaagaggacauguuuuccugccuguggaaauccauagauaacaaauucauauuguggaaaguuuauuuuuaaaaauacuuugaaauuagcuuuuaauguauaucuguaaacucaaagguauucacuuuguuuuuauguguuucugaauugauuugccaccugccuugggcccaggauacaugagauuguuugagucaucauuuguccaacaggcugcauucugaauuagggauucaaaccauuuucuugccucccagagaaacauuugagauuucauucacgucuuucuuguuaccaaaacaaaaauuugaacucaaaauccuuuugagugguaaggcucuuucaaauaaaaaguaugacuaucauaauauuguauauauacuagcacgcacacaauauguauaccuacacacauauauaauuuuuaagacucacuauuuaaaacaaaaucugaaauaaugugucccucuagaucccuuuuggaaucacuaacuauagauuuccuucaguuaugggcuacagugccugaaugugcugaacccucuuaggagagcacggugguaaacucuucugagugucacuguuccuguuauugauguugauggcagagccuucuaauucuaaccccugcugagccuuuagaaaccugguagauuguuaacaugauuagcaggaguucaugaacucugcucuguauaaaugcaaaauccuaaccuuugauauggaauuggcauuaaaagauuucuccucauauucaaaaauauuuuaauagcuuaaauuuaaaaaggacaaacuuauagaagcuuguuggguuuuaauauuaugguuucuacuauauaaauauugcauuuucaaacauaauauacuaagagaauuguuauagaauuuuauuuggcaauaugcuuauaauccucccaugaccauuuacaaauaaauaacaaauguuuuucuauacauuaauggaagcaauuuagaaauauuuauuuauuuacauaaaggaaauguaugguagcagcacacuggaaaucagucauuuggaaaugauuagaacugauaguccuuaaaggguguauuuaucacucauuaaauuaaggaaauguccaaaggaacaaugguuacauucgauuuacaguuuagauacucaguugcauauguuguaguuguaaaucaaguguguuuuuaagagguuauuuggauauagaggcuagaaaaauuuccuggugccacuuuaauuuuucucugcuuguuggacaugaagagagggagacaaaggcucucagaaagagaaagacgggcuggugaaggacaaacuaaggugagugagaugcugaguuccuuauuucuaguacaaauuucccaccaacuggagagcauucaccuguauacuuaaagaacacuugaauaaauaaauaaauaaauaaauaaauucaagugcucuuuaaguauccucuaaauacagagcauugugggaagguucuauuucuuuuccaauuuugugaucaaggaacaagguuccuuuuucuaggggggaaaagugcacugaauuaucaaaggaguggucgucuaucucuuccuccuuccuucugucuuucugucucucugcccuguucccaucggucucucuuuuaagcugaaggaauauauucugcccuuauucuagcuaugggcuaagucacagggcaagacuacaugggccuaaagaguucucucugggaaaggguggcacuuucuggaggguccugggguucuuucuuuguguggaaagcugaauucucuugacaucauuaacauuucuugaguauuugguaaacagcugggaacaucaaaaggaauaagagccaaugccuaucuuuuacaagcucacaaugucagucucauuuguucagggagaaaaauacauaaaccaguacuugcaguguaucuuuaaagguuccccaauagagguaaggacuaauaaucccacagguagguauaaguaaucuauugggcagugagggaaagcuuuacagaggagugacauuggagcuuaaucuuagaguaugaaggagcucaccaggcagggaacaacauuucauauagaggaaacaaaacgugcaaggaaucaugaagaaacaugcugugcuuggggaguggcacauaaccgguuguggccaaacugcaggguuugaaauaagguuugugagugcagagggggaaauuguaagagaugaggaugucaaggaacacuucaucaauguuauaaaaaaccuuguuuggauuuggauuuuuauuuugagaaucagagggaacccauuaaagguuauuaaaguuaguaaaaaagaaaauauuagauuuaugcuuuagaaaguucacuuugguacaaagauuggccagaaaaaaagaucagaaaugaaaguuaggaauccagggaggagaugaugaaagcuuuguauaagacaguggcaguaggccagacaugauggcucaugccuguaauuccagcacuuuuggaguccaagaugggaagaucauuugagcccaggaguuugagaccagccuagacauagcgggacuccaucucuacaaaaaauuuuuuaaaaaauuagcugggcaugguggcucaugccuguagucccagcuacuuuaaaggcugaggugagaggaucccuggagcccaggaauuugaggugacagugagcuaugaucgccacugcauuccggccuugguaacaaagugagacccagucucaaaaaaaaaaaaaacaaaacaaagaaacacaaaccaaaaaaucccaaaaaacaguggcaguaggauuggaagauagguacagauuagagagagauucuagaaguacauucaauagcaguuggugauagaucagauuugguaguuguauuagaggaaauaaugaagaaugacuucagaacugcuuugacugggaacugguaaaguauggugggaagagguuuaggaggaauggagauaacuuugauuuuagaugugaucaccaaucaguuacugauggccaauuuggcuuguggguuuuagaagagagaaugguuuaaaaagguacauuugggaguugcuaucauuuaagggguaggagaagccauagaaauaaacaaacuuguucaucuagagcuucuggaaugagaagagaaagcucuaaggagucagcccugggaaauaaucagggagggcacaggagaaggaggacuagaauagagguguccagaaacccaaagggccaaggaguuccaaggagggaacagucagcagcauugcuugcuguagcaaacugcuccugaagugcuuuuccccaggcugcccacccaaaaggggugcucucuuggaggcuaggaagagaacacuuccacuugaguaaauguuuccuucucucucuuucucuuacucucuuucuccuacccuuugauucuuuuuuuuuuuuuuuaaucacgauuccuuucugcagugacuuuuggguuccuuccauauccuuaaaaaacacaguacuugcauugcuaguucaaaaguaacaugcugaaacuugagcuaagauucauuucgcuuucaacacagaauuuuucucuacagaucuaguucagacucacuucucugcuguugaaacuugcuuuuaauaagacaguccuccagagcccaaaucucacugugaggagaggauacacgaccuauaccagggcucaggcugcacugaagucuguucagccacuuggagucucuaccuaaauucuguaucauuguuucagaggcaacgcaaguguaacaaucguugauuaaggacagggccggggggcgguggcucacgccuauaaucccagcacuuugggaggccgaggcgggcggaucacgaggucaggagauggagaccauucuggccuguacggugaaacuccgucgucucuacuaaaaauacaaauauauaaauaaaauuagccgggcauuguggcaggcgccuguagucccagcuacucgggaggcugaggcaggagaauggcgugaacccgggaggcggagcuugcagugagccgagaucucgguggcucacgccuguaaucccugcacuuugggaggccgaggcggguggaucaccugggaucaggaguucgagaccagccuggccaacaugaugaaaccccguuucuacuaaaaauaaaagaaaauuagcuggacaugguggugcaugccuauaaucccagcuacucaggacgcugaagcaggagaaucgcuugaacccaggagguagagguugcagugagccgagaucgugccacuguacuccagccugggcaacaagagcgaaacuccgccucaaaaacaaacaaacaaaaaacaaaaggagaagagccaggcguucuuuucuaauucccagguucccugaaacuucuuguuacgaaaauaguucuucaucagaucaaaaggaaacucagucuuuuggguuucacacaaacaugaagccaucagccuuugugguugaacaucccacacaccgaguauugagaaauuuuucuauccaaugucacugauccauagaaaauaaguaacaaagaaaaugauccaaacuucuuuguuuguugguuuguggugucacccaggcuggagugcaguggcaugaucauagcucacugcagccucgaccuccugagcucaagcaauccuccugccucagccucccaaguaccuaggacuacaggcacacgccaccacacccugcuaauuuuaaaaaacuuuuuguagagauggggucuuguuguguugcccaggcuggucuugaacuccuggccucaagcaguccugcaguguuggacuccuaaagggaugggauuacaggcaugagccaccaugccuggcuucaggauccaaaguucuaucagaugugaaaaaaguugcaaagaagaaaucaagacucaaaauaaaagaagaagaaaagugcuaacauauuuuucaggcaccuaccaugaaccagacaccugcuauguauuuaauauuauuuuauucaauccuuaaacuccaugagauaccauuccacccauuuugccacugcacuccagccugggcaacagagcaagauccugucucaaaaaauaaauaaauagaaacaaaaaaaguuaaaaaguggggagaugaaguuaagcuauauaguuuuuauuaguuuucuuuucuuuucuuuucuuuuuuuuugagauggagucucgcucugucacccaggcuggagugcaguggugugaucucggcucacugcaaacucuaccuccuggguucaagagauucuccugccucagccuccugaguagcugggauuacagcugcacaccaccaggccuggcuaauuuuuguauuuuuaguagagcggggguuuugccauguuggccaggcuggucucaaacuccugaccucaaaugauccaccugccucggccucccaaagugcugggauuaugggcuugagccacuacacccagccuauuaguuuucuuuuugcuugucugcuuguuuaugcaaacacuguuaaauuuuuaucaagcuauaauaaauggguuauaagaugguauuuguaaaccucauuuuaaccucaaaccaaaaaacauacaauggauacacaaaauauaaaaagagaccaaauaauauauuagauaaauuauccaaaucaaacaaugaauacauaauggacugagauucaaacccugacaguggcuccaaggccuauguucuuauaaucaaaaaaagaagguggcagaggagaaaaagauaaaaauggacaggaggaauagcaauauuucuugcuuucucagcuucuuucuugccagcugucagaaaguuuucuuucuguugcccaagaaucccaaacaauuugccuuauaucuucucuuauggauucaggcuggaguuuacccuugcccacaauccccucauccu

SEQ ID NO: 14644 - RNA, 1185 nt, Homo sapiens
uagcagcacgacuuggccccgggcgcagggagccgugcuauaaaaaaccgcuggaauuuacuggcagcuacaaauauuugcuuaacuugcgucuggaguugggggauuuuccggggagaaggagaaugagugagggcugcaagcugauucucaggagccgggauccaaaaggagaaaggcuugauaggcuagaaaggaaaaaggcugggaucuuucuuuuccagggaagaagaaacuuggggugucgcuuaguuucugcuccuuggccuccuccagagggcccaagacuccuccacucugggaauguugggaagggaacgaggaggcaaaggggagcuugggucgccaauguuuucuccgcuuuaggacugauguuugccaaaagagcccugagaugggguaacuucccacccagcuccuucuuggaccuuccugcucccaagagagguuugcacaaaaaauuucaggcaauuugccccauccaaccaugcuggauuucagaagcugagcuuguuaggaaguuaauccaccuuguuggggauaugacucaccuccuccaaaugaaccccuuguggccaagccaaggggggagggaaaacuuuguguggaacacauugcguguguguguguguguguguguguguguuuagggugagggaccaacaguaacaccccacccagcaagucacaacuaaaauccuggagaguucuuuacuccuuuccucucccuguuucucaggcacuucccagcaagccacccccacuucuuuacuucuuucccccaguuacagaagguucccagaaccuccugucuuggacuuucuaaggugcuguuauucggggcaacuaucaaauucuaccuguuaaaacaugauggauuagagggggaaaaaaaaccccuccaggaaccugaaaaaccagcguucaucuccaugaccacaguuugaacucuccuuccaacuuaacgauaauagguucugucuuagaaacugcuauguaauuugauguaugggggucauuuggcucccgacgagggauggaagcacaagccauaaaauccugccagaguuuccugaucuuugugugcuguuguuguuguugauauuuuguuacuuggccuauuuaccugcuucagaaauaccaaguaaaggauaacccugaaaaucuaaaaagcaguugaaaacc

SEQ ID NO: 14645 - RNA, 7468 nt, Homo sapiens
gcggagguagcugaggcugcaguaccaaacggcggccagcagauggcaguguggcuccaugcaagaggcuuccgcgccgccaucucccgccuccgcgacccuugugaaguuccuaagaugucgacuugacacgagccuuucuggaaugggagccccagauuuuagugaacagccgcccuauauuuucugggcugcucaagccuggcuagaagccucgcugggaaacaaggaaucggcgggggcuugcccgacccucaccgcucgcgccucccugaccccaucccgggggcccagugcugccgggcugcagcuguccgggcggccgcggggcugcagcuccaggcgcgggcgcggcuccagggucaccguccucagcugggacaggccugacacagccaggcgccagagagccccggcugacuggcggacacaggaggaacgccugcagccccagaacuugaugaccgcccagagggugugcacggugcgugccgagggcucacaccgugaccgcgggguccgcggccgcccaggaggcccccgaaaccugcgaccugggucagggcccggcgagccagaacccaagacagagccaggaccccgggacucggcuggcuugaaucgagacaauaaaauuaggcggugaaaauugggcguaaaggcaaucucggugucugaccacuguagguauaggggccgggccgaguuggcugggaggagaauccugggggacaaaccagggacugcuuugguuauuuuuuuaaugugauguuuaauauaacaaucacaccguagcaccaaaagugucgcacacaguguggaagccgcccgggcugucucuggccgcggcaugcccuccgcuguacaggaaccgaggcugcucuggcguucacccaucaggaggccagaagggaggggaccccaauccaggcccagccucucccagacccuaggcggggaacacgcuucggccuccucucgggugcgcgcaucagccacggaugucgaaugguuccagaggcaaaacgcaaaagcaaacagagaaccuuucgaaaggccccggagcccugugaacacgcuacacagugcauuuauuugggucguaauagucuccgccaagcccacaaaauguuuacgacccgcaucccagugcuuucacgcuguaaaacuggggacuggauuuugguugaugucucucccggguguuuguucucucuuuccuuucacacacacacaauaucucuccuuucucucucucccucucugucucucaucucauauauacauauacauauauauauggauagauagauagauagauacagauauuacagacacacaccuucauuacauuuccguauauaauuucacaacgucugauuguaagaaggguuuuauagcuucccugggagucaaccguggcuuuguauucaagccgcagauagagagcucaauuuauguuaacugcaaauaaauagugaagucgcagauccguggaugcagagagaaagcucgauuuguguaacuacaaauaaaugaagucacagaucgguggcgacugcgucucuccacugaucacggaggccucagguaggugcaggccgcccagggucucccaggccuggguggacuguccaaaggcuccucccuugcccuuggcaggcugguggcugggagucugcuuuuccucugggaagccugggaguggcuuccccgcugcggaccuucacccaggcaagaccccgcaccaacccaaucucauuuguacacgacagguacgaguuugucuuugcacccaggcuagggaucacucacucacuggauggggaacagaugcagcuggugagagaggcaaggguggaaaccuuuaggaagcaauuugccugccacccaaaucucuggaaggcgcuguucccugccuagagcuggcuuuaccuucauaauugaauuuaaauauugguauuugguaacaagaagcagagugaacacgcucugccaguagguaggaaggaagcucagggacggcaguggaaaaugucuaucuaaacauagcucuacugauuagaaacccgccuacaugugccugcuucaggcugagggucaaugaguauuucugugaaaauuaucucacauaaccuagugcauuugugucuuuucagucaaauaaguagagaaccaaugaauagagaacacacaguuaaagaagccuuauugaaagccugauuuuauccgaccuuuucguuuuaaaucagaccacagagggcaagaggggagaaggaagccuggaaacgaaagggagguuucgguguccgcaggacucggcccaguuggcugacuuggguccauaaaggccgaagccuugcgggcaguauccgcauccuccuuggccggggcagaggggcagugcguccugccagaaccuccuggacgcgcaucgggcaaaaccggagcaggaaugagccgguggcgagggcacccggcccucccuuggcgaagugcguuccuucccgcgauccccgaaaucgcucccugcucgggcuguuggacugggcagguucuacuuuaaacaccagcucuguuggccccuucagucgcuugagucuagacagacggcggcggcgggggccuuggucuuuucucuuugcgucuugcugugugucaccccaggaaaaauuuauuggucuaaaacggucuaauucugccucuuugaucuccuagccuucuuguuugcuucaucuuccuuuaacuuucuuggguuuuuauuuccuuccagaaggcgaugcgacugggauuauuuaggucuuuucuuuuugucuuacucccucuauucuccaucggagacaagguaucaucugauccgccauaaaggcguccccggauguugucccucacuccacaccccuacccccaggcuuccguggcccgggaggagacagcccagcgcccaccugccccaccagcccccgccuuccuacccaagccccggugguucacugcgcaggaacuggggcuccguggcgucccgaucugaacccucccuccaccuuuuguauuccuggggcccccugagagggugcgguaaacggggacggccuggacccucugaaagugaugggaagugcucaguacacaaggaacuaaacucuacaauuuacaggagaauuuccggggcaauuccauugugaggucggguuuaugguguguaaucgagcugagcaguaaaagguggccgggcuuccagcgcagccgggcaguuuaugaggcguuuaggggaaggguucuccccaccauccuccaccgagcggugggcggcaggggcuucagcuggugcaacauggugcaggggucggaggccuggaagguaggaauuggaggccuggaugggaggaagugagaccacugugcgcucagcuccaugugagcugguacuuggauaggugaagccuccacagcuggguggccuuuagggggugguuuccccuauuuguuuucggugucuucaaaagaaaaggaaguccacaguggguugcagucccuagacgccagagcccccucuccaaauccgcucuaaagcauguauuguucccaggcaccccggccuaccccagaaaccuuccaguauugggagugccuggaagggugcaggcccgagauuuuuccaagcugggggaaacagcccuggcuccccaugcgccagaggggaaccagaaguuguggaaaggacaaaggaaucuuuagcaauuuaucggacugcuggagccagccaggugcccaggagcgaaggcacagagccugcagcacuacagcguccgggaggagggaggggaaccccacguuaauaaaucuguuggcaaaugagucucauuaauagauaaauauuucacugcuuccuuuagggcggauaaacagugugccuccgauuaaggaaaggaagcugggagacguugacuuuauucgaaccacauggcuccaguuugcgguggcaaucucucugcagcugcaagagaugcugcgccuuccccgucuggauccgagucuaaguccggccugucgcccacuggaccugggugagagaagacuugggcagagucgaucugcucauagcugaguccugcccacaaggccaccgcggggcaggcuguugcgggggacagagacccuuccagggucugggcaggcggacaggagagggauggggaggaucccaagcuugguccagggcucacuagcaggagucggcgggggggcgggguggggggugcugcguggggccgggccgccuggcguccgcagaccccagugcggagguuggccgccagcugggcgcucccgcggagccuccaggucuuuuuccgcgggacgcgccaggcccgccgggcgcgggcggauucuuuggccgcauauuugagccucuugcccuuccauucuaggcggcugcgggcccugcggagcgagaccaccugugaggacugcugagauuggcggaggcggucaugugggcggucacgugcugcggcgagcuccguccaaaagaaaaugggguuugguguaaaucuggggguguaauguuaucauauaucacucuaccucguaaaaccgacacugaaagcugccggacaacaaaucacaggucaaaauuaugaguucuucguauuaugugaacgcgcuuuuuagcaaauauacggcgggggcuucucuguuccaaaaugccgagccgacuucuugcuccuuugcucccaacucacagagaagcggcuacggggcgggcgccggcgccuucgccucgaccguuccgggcuuauacaaugucaacagcccccuuuaucagagccccuuugcguccggcuacggccugggcgccgacgccuacggcaaccugcccugcgccuccuacgaccaaaacauccccgggcucugcagugaccucgccaaaggcgccugcgacaagacggacgagggcgcgcugcauggcgcggcugaggccaauuuccgcaucuaccccuggaugcggucuucagguaggcgcagucgcuaggcgggccaggcuggcggagcgggaccgggagcggggagcgcagcgcuggggagcgcggagcgcggggcgcggggccggaagagcggagccaggcuguugcgagccgguagccccgugacucccggcgcagccuuucugguuuuaauuggagcggaggcgccauugcguggagcccauagcauuguauguaaaugaggcucauaaaacuuuuuauggcccaauuaauggguucgauccucguaaauuuauuuaacuccauuugucuuggaauuuuaacauuaaguuuguucgcuauucugucucucuuucucccuccucugucacccucccucccuuucuucuucucucucuccucauuuuccuugcugccugacauuucuuucucaaaagcuaggagagccaagcccuccagggccucucacccgacccugugccaggguccauuucaagaugggggcgagggaaugaggacagagggucggggugcccuaggaagguccuggggaugagggcucaggcugcugggaagagucgcccacuugccuagcaaggcaggggaauggccgggcucaucuuugaauggcaaaagugcagcguuucccacuugcucacacucuauauuuacaguuuuccuuugucagaggaagcaggacauuguggaagcuuagccggcuggaaaggucgguuguaaaguugagauucugugccuuugcucauuacagagcugccugcgcgucuggcacugcaguuggggucuuucccuaacacucccccuccuccccuagcucaguucggggccuggggcagagggggaugcucgcuggggacuaggccaggaggaaggugcgggcucugggacagcagccuaacgagugcccugucuacuugucuguccuuguguucaugugucugcaugucuguucucaggaccugacaggaagcggggccgccagaccuacacgcgcuaccagacgcuggagcuggagaaggaguuccacuucaaccgcuaccugacgcggcgccgccgcauugaaaucgcccacgcgcucugccucaccgagcgccagauuaagaucugguuccagaaccgccgcaugaaguggaagaaagagcauaaggacgaagguccgacugccgccgcagcucccgagggcgccgugcccucugccgccgccacugcugccgcggacaaggccgacgaggaggacgaugaugaagaagaggaagacgaggaggaaugaggggccgauccggggcccucucugcaccggacagucggaaaagcgucuuuaagagacucacugguuuuacuuacaaaaaugggaaaaauaaaagaaaauguaaaaaacaaaaacaaaaacaaaaaagcaacccaguccccaaccugcacucuacccacccccaucaccuacuccagcucccaacuuuuguggacugagcggccgcagagacugggucgccuuggauucccucugccuccgaggaccccaaaagacacccccaaccccaggccagccggcccugcucuggcgcguccaaaauacuaccuagcacaggccucugcucgaggcacccccaaacuaccuauguauccagccccagagggccuccauucccaggaagucccuauguaucccaacacuggcagacacccagcaccacccucccagacccgcaagaaagugaaucucacuacuaccuacuccccuaaaacuaccuauuuugugcuggcuggcuugccugcuaccuagugccgacugcucccaggcaaguccccugcugcuuacagcccgcagcuuuuggggucccugaggcugcccugagaaugugcugagguccaggaucaggguauuggcaucuauuuaaaucgaaaaauaauauauuuauuccaaaaagcauccuaagugcuugcacccuagaaucaaucccuccuucucuggcuuggcacccacagcucaggcccaucaacccccacuucuggaggggaauguuccugagcuggcugcagaucuguggguuagcuucugcuuagcaggacuguggagaugcuuccagcuucgcuguccuuuccucuggcuccuguaucuuacuguucagcuguguuaaauauguacgcccugauguuuccuauaauagcagauacuguauauuugaacaagauuuuuuuuuaucauuucuauagucuuggaguucauuuguaaggcagugucuugacuuggaaaggauguguuaauggggugacuuuguagcaugguauguugucuugaguuaacuguaguggguggggagguccaaugcccuccgcaaugcccuucaucuccuguguuguccuguacccugcucagcuccauccugggguucagggaaggcacacuucccagcccagcuguguuuuauguaaccgaaaauaaagaugcguggugacaaagaaaa

SEQ ID NO: 14646 - RNA, 4305 nt, Homo sapiens
cacaucggugcgggccucccagguuccggagcugcggggucucuuaggcgaggcugccuuuucccaaaccgaacuugccuuccauucaugccacuuguaguuuuuuccccagcugggauucacggagcgcaaccaggcuugcagcgcucaugguuagagccucugaggcuggagcacagggcugggucgccagccgccugcgccugggaauccugauugccagcugaugagaaaggcgggcugggcgcgcgugugcguggggucgagggccggggaccgagcgcgccgcacaaccaaccaggcccucaaaaccuucgcccugguggcggcuggccgcucccuccuggccagcuccuccgugggguccucguagcaaaggcgaauuuaaggguugcccgggcgccccucgcuccaggcggguagcuguggggaccuacacccgcgguacucccugagcggccggucccugccuggagugcccugguagggccggcggcggcuccguuugggacggauccugcguugaauuugacuuuucgagggcggccgcggguaaacucgccucucccggggaccgcagggauuauuuacagggagcucgccaaccaaacacaacagucuaaccuuuccaaguccucguaaauuuuuacagcugggagccacggcgaggcaaacgaaucuguuggucguuuccgacuucccgccagccuguguggcuucugaaacaauaacuccuuaugaaauaucauaaauauagauuuaaauacaguagagcgacaaugcgauuuggcugcuuuuuuauggcuucaauuauugucuaauuuuaugugaggggcuccgcuggccgcacucgcacgcgggacccgcgccuucuugauggcgugauuaauugugauauaaaauaguccgcuuaagaaguguguguauggggggggagacgggagaguacagagacaaggcuagauuugaucuuuuaaucgucguuggccacaauuaaaacaaaccccaucguagagcggcacgaucccuuuacauaaaaacauauggcuuuugcuauaaaaauuaugacugcaaaacaucggaccauuaauagcgugcggagugauuuacgcguuauuguucugcuggacgggcacgugacgcgcacggccaaugggggcgcgggcgccggcaacuuauuaggugacuguacuucccccccggugccaccaaguuguuacaugaaaucugcaguuucauaauuuccgugggucgggccgggcgggccaggcgcugggcacggugauggccaccacuggggcccugggcaacuacuacguggacucguuccugcugggcgccgacgccgcggaugagcugagcguuggccgcuaugcgccggggacccugggccagccuccccggcaggcggcgacgcuggccgagcaccccgacuucagcccgugcagcuuccaguccaaggcgacgguguuuggcgccucguggaacccagugcacgcggcgggcgccaacgcuguacccgcugcgguguaccaccaccaucaccaccaccccuacgugcacccccaggcgcccguggcggcggcggcgccggacggcagguacaugcgcuccuggcuggagcccacgcccggugcgcucuccuucgcgggcuugcccuccagccggccuuauggcauuaaaccugaaccgcugucggccagaaggggugacugucccacgcuugacacucacacuuugucccugacugacuaugcuugugguucuccuccaguugauagagaaaaacaacccagcgaaggcgccuucucugaaaacaaugcugagaaugagagcggcggagacaagccccccaucgaucccaguaagugucuccucccuucaaauccgccgccgccuccacgccggccucccggaucugcuggcccgccagguuucucucgagccugccuucguccucgcuggaagccucucgaguuggggccaggagccagaaguugguguuugggacgccucagauagggccccaagucuggagagcagugaagagcggcccgcagggcuacgggagaggaggcggcugcugcagcgagagggggcggggcgggcacuucgggacgagccaagacuggccgccccucuccuuggcugcccaggcccaggaccgagauacuuugggccguucuucgaaagcagugcagcccagagagccuuuuguacaacuagauuguccgugagcggcggcagccagggcagccggagcugggacgcugggggagacggccgauuccuuccacuucuugccuucggccaguggcggcguaaauccugccaagaugaggcugcgggcgacccgggccacaaggguccccaugacagauuauucaaauaagccacagacgugaucagcggccuuagggcgcccugacggcuugcccagcuccgaaggccuuccaggaagguuaaauaaggaguggggggcguagagggacagguugggaaagaaagacgaagucagugaacgggacagaggaauccuaaucuugcuacagaacacaaggcagcaugcuuucccucugcguggcaaggagaccuguuuccaaauuucauucuauacagcguuuugagagugggaggaaggagaagggggacaagaggacagaguaggagaaaggaaggucucggaggggagggcgagccaaaguuuuacugcgugcaauuuuaagugacugucugugcgucugucugccaggguuccauuguguccgaggccugacugccuuuccuaaccaguucagcagaguucugcacuucggccagagaccccaugcaggaggcucauuugccccagcgggaugugcgucuucugcuccuaaacccaguguuucucuuccccgcagauaacccagcagccaacuggcuucaugcgcgcuccacucggaaaaagcggugccccuauacaaaacaccagacccuggaacuggagaaagaguuucuguucaacauguaccucaccagggaccgcagguacgagguggcucgacugcucaaccucaccgagaggcaggucaagaucugguuccagaaccgcaggaugaaaaugaagaaaaucaacaaagaccgagcaaaagacgagugaugccauuugggcuuauuuagaaaaaaggguaagcuagagagaaaaagaaagaacuguccgucccccuuccgccuucucccuucucucacccccacccuagccuccaccauccccgcacaaagcggcucuaaaccucaggccacaucuuuuccaaggcaaacccuguucaggcuggcucguaggccugccgcuuugauggaggagguauuguaagcuuuccauuuucuauaagaaaaaggaaaaguugaggggggggcauuagugcugauagcuguguguguuagcuuguauauauauuuuuaaaaaucuaccuguuccugacuuaaaacaaaaggaaagaaacuaccuuuuuauaaugcacaacuguugaugguaggcuguauaguuuuuagucuguguaguuaauuuaauuugcaguuugugcggcagauugcucugccaagauacuugaacacuguguuuuauugugguaauuauguuuugugauucaaacuucuguguacugggugaugcacccauugugauuguggaagauagaauucaauuugaacucagguuguuuaugaggggaaaaaaacaguugcauagaguauagcucuguaguggaauaugucuucuguauaacuaggcuguuaaccuaugauuguaaaguagcuguaagaauuucccagugaaauaaaaaaaaauuuuaaguguucucggggaugcauagauucaucauuuucuccaccuuaaaaaugcgggcauuuaagucuguccauuaucuauauaguccugucuugucuauuguauauauaaucuauaugauuaaagaaaauaugcauaaucagacaagcuugaauauuguuuuugcaccagacgaacagugaggaaauucggagcuauacauaugugcagaagguuacuaccuaggguuuaugcuuaauuuuaauuggaggaaaugaaugcugauuguaacggaguuaauuuuauugauaauaaauuauacacuaugaaaccgccauugggcuacuguagauuuguauccuugaugaaucugggguuuccaucagacugaacuuacacuguauauuuugcaauaguuaccucaaggccuacugaccaaauuguuguguugagaugauauuuaacuuuuugccaaauaaaauauauugauucuuuucuau

SEQ ID NO: 14647 - RNA, 6512 nt, Homo sapiens
caaaggcaauuagaccauugggaccauuuccgaccuggcgccgcgaagcccgggaagugacaagguaauuuggaccucugaccgacgugcaaacuggucggagggcugcagcacccgggcugcccaagugggccgcaauuuuacgguccuuuauggacuccuggcuuccgcgccuccaugccucuuacacccugccagccacaaacugcccggaucggcguuugaucuugcccucgccuggggaaagugucuuccccgagcaauugaagcauuccccgagcaguugaaacacugggugcuuggggugagcuucgaaucccccaaguccaggacuugcauccgcccccucagcaccccgcacucaaggcacugcugucacccucagucccgccaaugccagaacacaguaggagacccccgccagaacgcagauagcagagagaguugcucagguggguccccccagccauccugcccuaggggaagggagugucuuccuccuggccugcgccgaagugaagggugggcgcagugggaggcccggggagcggaggggcacgguggcuaccuuugcugugcugguacucggcguucccgguggcgcaguccggggugcagcucaccucgauuucuucauagaaauccgacucgguguccgagcuacuggguugccccuguccggagaggcugucgacugagggggccggggguccugggccgagcauggccgccccagcuaccuggggcucggcgcccggccccgccgcgcugccugcgaguccaucuaccggcuccuccuccgggccucccccgccgcgcucccggguggccggagggacggcccgagggcucaggcaaccacggggcaccauuuucucgggcggcuccggcagcgggcugcccacggcuucggacaaauuugagacucucuugccaaccagagugccaagcugacccccauccagaaacacaaccauguccuuucggcucuccaucccggggcucuccggugggggaggggaaagccccaagugaguuccuaaccccggcucccugggucuccagcggccggacggaucuugguugcaagagggagaaagaaaggccgggugccugggagggcgcggagcugcuggagcgcggucuggaccgcgaccgcggcgguggcggugggagcuagggucaccuugugaagcgagcgcuccucugugccgcaccgccucugggaggaagccccauugcccucuucuuucuaagcugucauccuccugcugcaaucgucauuacaguaccgcuggugacgccacucggcgagcgcaaguggauaaauagaaacgucugccacagcgaagaugaaaggaaacccgcagcuaauggcucggcagugaugcgccaggugugggccucgcucgauuggggaggagagugugaaaacagacagagagacacacacacugagagagggagacacccaggcagaggggaugcaaauggaauuccgcagaaagaaaagagagcuuaacgcgcgcggcgaguuccgcaggggcagcgggacucgguaauuaaauaagcuuuugauuuuuucuuuuauuguuguuuugacuuuuguuuucuuaacuuggugccuugaucuaacaccgaugaaagaauccauaacugcauuuuagaagugugaagcccggcuuacaagccucaauucugucggcauuauuacaacugucugccccuggcagcuaaccucaaacuggcugaaaagucuuuuuacaagcuacggaaaaauguauucccccgccccaaguugacuggagagcuugaggcugggccaucuuuuccucuuuucuccucccucucccuacccaccucugucuccuuacuccugcgaaccaaacuuugcuauuuuucuucccuaaggggcaagaaauaaauaccuuauuauuauuuuuuaauuuaaagacccgccuuggcuucuguaagagugugugcugauuucuuuuaaauaccuccuucccaucuagauggccuuaaguuuuccacagccuggcuucaucuugagauggcuauucguacaagaagucgcuuucccguuugccuggaccucgccugcacuccagguauguuggguggggagaguuucuaagaguugucuuuuuuuuucccuugcccauauuuuaaaguauucguucagaaucagcgaagucuccuggaaagagguuuuucgaaugaagaggcgccaggaaugcggccccugcuguggcaguacuggaggccccuacuugggagaaggcaguagcuuucaccgcgcuauuuugggcagggguucagccuccccgaguacaaaaagguugggguucauagagguuugacucauaagguccucucccaagucccugccuaggggcagugguaccugucuccaaaaguggauggcguuugagguagaagagagugaagucgcugaaaaugcccuaaaacagcaaguaaguagggacucugaugaagggcuggaggugggggcagggguuguggaacuuaauaucuggaagcugccauaggccucucuuggcuccucucccagggaagaagcugguauaaaacuccuucaaacugacccuuuuugagcuccaagcaagugugcuggggccaggugggugggcugagucuauccccacauugcugagagcaggaggugggcaccuucuaugcucaaccccccuuucuccgccuccucccgaagagcuucuagcccuaggcagccagcugcaaagggcagcccagcaccucccuccuuucugugucccuagcaaagccccagcuuuuacagguaaguccucuuccgugaccuuuuuaucuguuaucuccuacuuuucucuccuccuuuuucucuuucuguauucuucuccuucuuugcuucucuccuccaucuuccuauccauaggguuaaggaagguagaggaaguaagggguccaaagaaagacaaaguuuccucuucacuccggcuuuccacuucucuuucagucuaagacgauguucauuaaucuugccugggggcggaggcagcgggauccggaagguaguguccacauagauauuucuacuccuugggacuccugaagccacuauaugcugagcacugcuagccccaaaauccagggaaauguuuuagaggugagaggaucaauugggagugaggggagucaaauccuagaaccuuuuccugccuuggagagcuguccagguauucuaucuuucucuguccucccuaccagcagccacagccugagggagcaccuggcuugcucucuuuccugucaauggcaagcccccugggcaucugucuuagagcuuccaagguugccuacucucuauagggcccuccagcacugggccuuugaggugcccacccuccuuuccuccuugagcgcuuaaccuucucgugaguagccugcugcccccaucuccugggggcuggguccucagagggacuccuggcuccccaccccgcccccagcucugcauucaaugggaauccucuguuugauccgcuuuucuucugggugagaugaaagccgaguaggagugagagaucaaggagugccacuuagucugcuuccugggucgggcccuacggagcagggcuuacaucccgcggagagggcuggauggagcugaggaccggcuuuucagagggagguugccucccuugggcuccagaucugaagcuucagggacacauccccucagcccaaagccuuccccagcccucucccgacuucugccccgcucuuucaaagcugacuggccagucuuaggagccuagggaaccacacccacccccgccccuuuccaccggcgcauuagggggaaaacguuuuaaccaaaugucacuucuuccaaaagcauccuuucaucaaccucacauuaagagcgguuggguuuuuaaaggaaagaagacaaaaaaagagaggacuggauaagaacacuguuuugguuuuuugggcggugaauguggggggaguauuuaauaacaucguuaucacugugucgugaagguuauucgcggcacggcucgagaaggaagguaaauuccgagagcaagugaagcccugcacaaccccauuaagccugggcaaucccaugacagcggagagggggugauagcagcugagguggaggccgcuccaggcccggcggcuucucauuucucgcggcgggggacacccaucccccaccugccacacggcaggccccccgucccuucccccgcuggggcgacgggcuccgguccagccggcuccucucggauugaaauucuccggacuucaaaagcucccagcuuggcuuccgccggggcugggcuggccuggcccgggccggaggggggugggugggaaccccggggaggcgacggagauaagaugcgcgggucguuuuaaauggaaucggaagccgggcauaggcccccagacgcgcgggucagcuggaacagcuucgcuccugaagaaaaccgggcucggaaaagcggcgcguguggggccugccuccgcagucugcccgcccggcucgggggagauggcccgcggccccgaucacccuccccagccugcagcgggccuuucaacggcgacagggccccgagaagggagagagcgaggaguccugagccgggggccaggagcuggcuugucggcucaggugucggugaaaaugugaucaggaaaaaaauguuuucgcuucucuuugguuaaaaaguaagaacaaagggagcuuccuucuaaacaauaagcguggucuggcugucgugaauauuagucuugggcccuccgucaucuuccaggccguggugggggcgccagacugcuggguccucgcgguggggacagccggaggugggugguucugggacccgcuucccccuucugccuuggcagcugcugaugcccuuuugggaaccuagugccacugcugggugcaccccuggggaauaaggucgaguggaucucacacuugcagguagaugaggguugaccacuccugucaccuccuugcacugcaguggaaucugcugagaaagucgguggcagcuguguaacuguggcaggcaccguggaacacuuucuccuucagacagggggaaacugcggcuucuggaacucugauuuugaagagugcccccuccucuccacccuccuggaauggagggccagguccugggaggcagcugacccugcugcacuccugccuguacaccugucugccugggcuccuuaaggccagccugguagcuuccuggcccugugcuaaggaugucugguccacauccccauucccaccacuggcccauccuagggcuggaggacccagggugagacuggcagcugaagaccuccccaagcucaagguuugcugccaccucagccacugacuggaagggcccagugcaguuuguguccaagagcaauucuccaacacccaagcacccaaaggcucagacaucucccuccucaacccuagcagagaugcuauggauucuucuucuucauuauuguccugaaguuugcuuuuauuacaaagaacaucaacacccauuucucauuuaaucuaacaaucucauuuaauuuaacaguccuuuaaaaggccucaagaguccacagugcauuuuuuccuacaguuguagaaugacuaguggucuugacucagauagcuaggucagggcugagugucaaaccaagcucagucucccuuccaaggccaugucccucccuggccuucagggaugccucaacccccagcaaugcuuuaacucuccauaaggcaacccuccacaaagccucagccuuuacugggguuuaggcaggucugugggccucucagagagugucccuccugcccuuagaagcaccugcauggcuggaaggcucagggcccacacagcuggauggacuaguccucacccugccacccccaucccucacccacaccacacauacuuuuccaggagggcaaagagaaaucccucuuagaagucuggaguucccacaugauaagagcagucacugcucuaagcguuucacauguauuagcucuccagccucacaacaggcucugaggaagacagcaugaaucaucucuauuuuguggcugagaaacccaaagcacagacagaaagcugauguguaaaugagcaucaggauucaaccccucccuccagcucaaaggccacuuucacaauuugagaauuaggaaggugcuaagcauugccuucugagacuucucuuccaaaaauuuaucuugugauuuuuugugaccaaggccucuucucuaccucauuucuagauuaacucauggaggggguugggagagccacccucaggaauguaggguaggagaacugcucugccgaagcaugugggaagggucucagggccugaggccagaaugucagaaauaucagugcagcugcugauccuggagacccuaagagacaaagcccagucccucucugaccauugca

SEQ ID NO: 14648 - RNA, 5171 nt, Homo sapiens
auguaaagugagaauuauguccagcuuuuauugcaauaugguuaacgaaucauaacagcaaguucuuugggcuucaaaggaaaaccccaaaucaaaccaaauucauucccuacaggaagaaccacuaccucucagucagggugaagcuugcauugggguuacacguucuccucuuccucaaaaacuggcugcaaggaugagugugggagugaggauuugggaguggcucuaaacaaacccugguggaggccacagacaggguccccaaaagggacagaaggcucccacugguaucugaaagucaagcuccagugguagcuugggaagaaaaugagagaaaguuguaaaauacccaaugcaaaggguagggccagaaaguuccuggugaagugaaggugaacaagcaaaggaugaaaauugccucuaauuuaccgccagauaccgagagagggaggugaaguucccacucccuaagcucuucccugggcgccuuguuaacagcucagcucuggggucaguggccagcuccauggugaucauuauuacacauucaacauucacaaacccuccucgcacacaucacuugcuaaucagggugugugcugggcccagggaaaaaaggcuuggccucauagaagcggcaaagggcuccuggggcaucugcagccucccuggccaacaaaaaagugggggcagggagagauggagccgcaaguugagaagugucacaaagcugggaaugaggaaagagaucaggugcuggcagacgccagacccagaagaugcuguguagucgaggcuccaggucccaugccaaggggcuggauucucccugguaguaaaucaucucucacucucuccuccaaaugacugguauguugccauccaccagccccuugucaugccuuggaaaagcuggcaaagauuaaucucuaccugcucugcauacacagcauuuuguucagagagacagcaauuucccuuuccagugcuugggccuuggcuggggagagggggcccggugagaagggagugugagguggagggugaggggccgaggggccgagggacuggauauugguugcuguugcugcuaaguuuuguuuagcuuuggagcuacagccucgacccugguggggggcgguggguccggaggcugccccggaggaaggucucucaagcucugcuucccuauccccacuccugcuccccaaacgcgccagccaccgccacuuccuaggcuuuccaauucuugcggccggaucccgcugguccuuuuccgcccucuccuuucccccuuggcguccuaggggcgaggagcgaggagcgaggagcgaggcuggcugagucccggggccggggggugaccccacgggcgucauggagccggcagccagccggcggccccuuaucuagugaggggcaccuccucccucugguccagcgcgacggaggaggccuugcugagcaccgagggcgcgaaggugaggaaggaguccgagcgggagguggaggcacaggugaaguccgaggcggcggcagcccggggcgccagcccguuggccgggccgcugugacaggcgaggcaggagcaggggccgccggcagaggcgcccaguccgugcgcgggcccgggguagagcggcggguggcggaaggcgcacagcaguucgggccgcggguagggcugcgacagcacgcggaacgugucgagcgggcgcagcgagccgcugaagggcgaggcggcggcggaggcggcggaugcggcgcccaggcccaccggcgaguaguagggcaggggcaggugcgaugggaagggguagggcaggccgcccgcggccgccgcauggcucaucauguaaguguagaaggcgggguccgccgggugcggccacgucauggccaggcgcugccgcuuguccuucaugcgccgguucuggaaccacaccuggggagaggagcggagcagguucaguagcuggacuuggcccgaugcucagaggccaguagucuggucccgcuccggggacaguguucgcagggcaggaacagccaaagcagacaccagccggguagagaccgaccccaccaccaccaccuggagcuggaaucccuccgagagagguuuggggagugacuccagcccgcucccuccuuccuucugcccagguggccaggcccccggggugccagaggccaguguguguaugggaggagcagugaaaggacauggacucaauuggucugcggccgcagagagcguguccccagaaacuuccuugucacccgcacaggcacucuauccccuucccccacgcccaccccuugucuauuuaaccaggaaagggacagagucagccacauggcagcaaugccugccuaggagcugucacgagggucaaucugcacgcgccgggcagggagaccccaggcccagauuccuggccugcguuucagggaguuggcaguuggcauuuacuucccgcuaaauaggugcacacccgccuccccagccuggaccccgcauaccuugauggugguuuccggcagguuuagggcggccgccagcucacaucuccgcggccuggauacguaguucucccgguagaauuccuucuccagccgcgcaaucugcucucgggugaaggcggugcgguaacgacgcaucuggucacuggcgcugcacgccagggugccuugcgagccgcccccaccacugccgccguugcucuugggggucucgcucccuccguucggacugccgaccagcgccucggagccggacccugcacagcgaguccagagcacaggcguguacagacacagacacacaaacgccauugaaguggggcuguaggccuaaggugggagggugauuugggaagggacacccugucagccaccucaguaacuguuucugcuaggguacugcggccucuggggaacccaagaagggaaaauaagggccugcccuugauuggguagguagaggucuuuggggaggccuucccuuccucuaaggcauccuggguacagggguucccagccgcccuucccaccugcccuggagcauaggugagauuucugccucccguuggcagggcgugcacuucugacaggcacaugaguugagaugcaccuuugugcuagaggguuguaaacucugggucaagugcauuguaguaugcugggcauucagagaguuuccuugcucuuaugugugacgggcugccagaacaggugugggaauguguacuagguuccguguauugcagggcuggagugagaaugcauguugaguaucuuauuuauuaccuuaguauaugugaguggaguccagguuguucugaggguuaugggaaggaggcugggugaaaucggugauaagauaguaagggguaggugcagguauucaacaaggcguuggcugccaagaccaggggguggucuuucucccccccgcccccaggcucuuuccacccacuccuacaguucuguggaggagugucugcuggugggcuccccucuccucccccccaccaacccgcgcccaguuuucuacccccuucuggggaggugauuguuggcacagagggaaacucccuuccgggcuauccaccccuuucccauuagccuuugguggggagggguucuccaguuaaaccagccccccuuugggccuaccucugagaaggguggggcuccagcccccugcagcuccuuuuccuuuggguggagaagugggacuaggaaggaaaggggaaggggggaggacccgaucucugccuuuucaaaugcaaccggagaccaaaggcaauuagaccauugggaccauuuccgaccuggcgccgcgaagcccgggaagugacaagguaauuuggaccucugaccgacgugcaaacuggucggagggcugcagcacccgggcugcccaagugggccgcaauuuuacgguccuuuauggacuccuggcuuccgcgccuccaugccucuuacacccugccagccacaaacugcccggaucggcguuugaucuugcccucgccuggggaaagugucuuccccgagcaauugaagcauuccccgagcaguugaaacacugggugcuuggggugagcuucgaaucccccaaguccaggacuugcauccgcccccucagcaccccgcacucaaggcacugcugucacccucagucccgccaaugccagaacacaguaggagacccccgccagaacgcagauagcagagagaguugcucagguggguccccccagccauccugcccuaggggaagggagugucuuccuccuggccugcgccgaagugaagggugggcgcagugggaggcccggggagcggaggggcacgguggcuaccuuugcugugcugguacucggcguucccgguggcgcaguccggggugcagcucaccucgauuucuucauagaaauccgacucgguguccgagcuacuggguugccccuguccggagaggcugucgacugagggggccggggguccugggccgagcauggccgccccagcuaccuggggcucggcgcccggccccgccgcgcugccugcgaguccaucuaccggcuccuccuccgggccucccccgccgcgcucccggguggccggagggacggcccgagggcucaggcaaccacggggcaccauuuucucgggcggcuccggcagcgggcugcccacggcuucggacaaauuugagacucucuugccaaccagagugccaagcugacccccauccagaaacacaaccauguccuuucggcucuccaucccggggcucuccggugggggaggggaaagccccaagugaguuccuaaccccggcucccugggucuccagcggccggacggaucuugguugcaagagggagaaagaaaggccgggugccugggagggcgcggagcugcuggagcgcggucuggaccgcgaccgcggcgguggcggugggagcuagggucaccuugugaagcgagcgcuccucugugccgcaccgccucugggaggaagccccauugcccucuucuuucuaagcugucauccuccugcugcaaucgucauuacaguaccgcuggugacgccacucggcgagcgcaaguggauaaauagaaacgucugccacagcgaagaugaaaggaaa

SEQ ID NO: 14649 - RNA, 137497 nt, Homo sapiens
gggcacccgcccccgagcggugagagcgcgugcgcgcgcgcccuucuccgugggcgagccagccagucccgcugcacacgcucgcagucugugggcccuccgggaggcggcggaggucaccgcggggagaggggcgggcgcagcauggcagccuccuuacggcuccucggagcugccuccggucuccgguacuggagccggcggcugcggccggcagccggcagcuuugcagcggguaaggaccucacgccuccucccccuuguccuucuuucggccgcucgcuucuucuguccagacggccgaagaagucuuuucucgggaggcccugcgguugggcuggggcuuaaaaaacaauauuuuggcugguacuaaaggccuguccuuuucugcggccgccacucacuccgcgaguaccccccucugccuucccucccuuucucccgggcuccugaugaacggguucagcgcccuuuucgggauuuaggaagagguggggaagagcuugggcugaagagaagagaguauuugggaccccggcaugcugcuuuggaguuaggacuccgaggacguuuggagcgcccaacuccaggagcaacccgcacucaccccagcgaccccuggucuuucagcgcccccagggugcaccuuggguuggggacacacuugggcagcagggccugauguuuaaccaccugaguccgaggggauggccuuauuacacaagcgguggcuguacaagccaggcaguaagucuuucagcaaaguuucagucacccuugaccagcaagacgggcuuccccccucuacuguaaccuaaaaaaaugucauuuuugucaaauuaugaaccaaaacacguucagcguccucaagauugugggcagaauuaauccugccucccuccucucauaccaugguaaauuguggaagcuagccaugaacuuacaaagaggcaguuuuuagagccaggaugaagauccacggagaucuaauacagucuuucauacuccgcacgagggacaugaggccccuuggaugagugaaucaggauauucccagcaagaccuagaaaguuguuaucaguuguuccuaauuccuuaacuuucuaucacaccaggacuccucuuuaauugaaaaauugguugauuugugggggcacugccguugucuuccucaaacugaaaguuugagaguuguaacaaugcaucguuuagcaagaucauacugaggauuaauaacaaaaaaaaccuuggcauuaauuuuuucuaaucuuugcuuaaaaaaaaaauaguggguuaggauuugagccccuuggccccccgcccuuuuuuuuuuuuuuuuuuuuuuuugagacagggucucugucgcccaggcuggagugcaguggcccagucacacugcucacugcagucucgaccuccugggcucaggugauccucccaccucagccucccgaguagcugggauuacaggcaugugccaccacgcccguccaauuuuuguauuuuuaguagggacggaguuucgccauguugcccaggcuggucuugaacuccugcgcucaagugauccucccaaagcguugggauuauaggcaugaaccacuguggcuggccaggaauuguaagaacuuucucuuacaauucuuaacagcuucccauucucccccucagugaaaccucugaauuuccuuucuggcuggagaagaacagaggcucggugagaugcaagagaccagaugucugauacagaaccacaguaacaagauaaaaacucagaauaugccaaacuugaauguaaccacuguuugagcuucauauauugagcuacaaaaaugcuuccgacuuuugagauaacccuaaaagaauagacacuuuuccacaguagcaccaguuuucacaugaauucacaauucuuucaguucccauuagccaaggaagacauauuugcuguuuagugguuuuacaagguguucuaaugguauuuuaaugaacccuugauguaccuuuuagaguuaugaaaguucuuaccaauucauggugaaagagccugaggccuaagacuguaauacgugccucuguaaacugggagggccuaccucagagugcugauuagacuacuuuggcauauggucuuguacuuuggguucuuuggcccaaagguaauugucagaauauagauuucugauaaauuuuaaauaguucuuuugugaugaagugguuaaaucacuuaagcaauuuuuuuuucucuugaaaaaaauuuuuuuuuuucccucggagucuuugucugucgcccaggcuagagugcauuggcgcaaucucagcucacugcaagcuccgccucccagguucacgccauucuccugccucagccuccggaguaccugggacuacaggcgccugccaccacgcccggcuaguuuuuugguauuuuuuaguagaaacgggguuucaccauguuagccaggauggucucuaucacuugaccucgugauccgcccgccuuggccucccagagugcugggauuacaggcgugagccacugugcccggccuuucuuuggaauuguuuuaaacauuuaaauuucuguuaauuuuaguuuacugcaaaaguguuaacuuuucugacauuagauucuuaaagaguagaaaaaaaucugccugcaaguuuggagucaaaugacauuaagaaaaagaaccauguucagauaguaaugugugauguucugaauucuguuggauauuuguaguauguuuaagauguuuauaucauaugaaugauaauauuauaaggagcuauauaauuuacuguuuaaaaaaaugaaaccugaaaguugccgguuaguagcacaucuuuuuaacuuuuuuauaaauacauuuuagagacaggucuccccguguuguccaggcaggaguacaauggcaccuacuuagcucacugcaaccuugaacuccuguacucaagugaucuuccgccucagcuucccaaguaguuaggauugcagggugcaccacgauaccuagcuaauuuaaaaaaaaauguuuuuugagacaaggcuaguugccuacuacgcuggucuagaacuacuggcgugaagccauccucuugccuugaccucccaaaguguugggcuuacaggcauuagccacugugcccagccugccacaucuuaauuuuuaaauguuuguuuguuuguuuguuuguuuauuugagauggggucucucucucucucuuguccaggcuggagugcaguggugcaaucauggcucauugcagccucaaccucgugggcucaagcaaucccccugccucagccucccaaguagcugggaccacaggugcacaccaccacaccuggcuuuauuuauuuauuuauuuuuuuuguagagauggggucucaccauguugcccagccuggucuugaacucugggggucaacugauccuccugccucagccucccaaaguacugggauuacagucaugagccacugugccuaagccuaauuuuaaaauacuuaaagcauugaaaaggaaauagaagaaugagaaauguuaaaguguacauguauuacuauuucaucaccuguuugauaaaauuguguauguuauuuuagaagguaauuaaguuuaguuucagacuuauuuguacagagaagaaaaucuacagcuauaggcccucuacaaaaugucacguugugacucuacagcuuguacauggaaaaauaaaucacaucagaucaucuugaggugaccaccugaccaaagguagaauggaaaaauuagcaucauguauagaaacaggaauacaauuuuuaauauuauugguccuuuuuguauaugugaaauuuacuuucaaaguagcauaacucauuggauaaaucaaauauauaauggcaguuuuucccuuuacauuagcuucuagggcugcacaugaaguucugaaaagcugcucaugguccggggccuaaaaguugacccuaaacuugugaaauuacauaaggagcguauuuauuacuaaaauaaguugacugaaaccguaaaggccuuuauagagaaagucgucacccuuaguuuaguaacuguuaauaguaaagcagauagagugcuuaugacguaguauuaugugauaaaauagauauaaaaaauguauuaugugauaaaauagacauacauuguauagaaaauauaaccuuaugauauaaugaaaaaugcagucaaaagacugaaaguccaugcaaaauguuuuuuuuauuuuuguguaaugagauugcuuccccuuacaacuguauacuuuuucauucuaguuuucuacaaugaaaaugcauuacuuugaauagaaaagaagccucagaaauguaaaauaauuaacuuguuaccaauuuuugcauuuugacacuuagugaaaccugcuuuuugauagcacuuaagguuaucaagauacggauaacuccccuuguuacauuggagaaagaggucauaaucgguaaauuugcaucuauaaauuuagaaacaaacuuugccaaguuuucuggcuaguuucuuuucauucguccucaguaauagacacuaaugcuaguuucuuaaccagugaaccaguaucaccuuuguauuugguugauugauuuucucccagcuugguuuuauuuauguuuuaacucuacuuuuuccacgcacuacugucagaaguuauuuaaagagagaugcauuauuuagguuugagaguuuuuagggcaauaaucauuccauuauacucauggauuucugccccuuugggugcaaauuauuuuauauuugccaagcgcuuauucagguguuucaccuuaacuaaaagcuuucuuuccccagauacagggcuucuccuacagucaucuauacuuuuuucuaucucuuuggcucuuguaacccacuaggcaaaaaggggcaguuggcauaggacuugaccuguacugcuacaacuugaccauuuuugguaagaguaacuaauacuuauuaucaaucgugugccaggcacuguuuaacgcuuuauaugcaucaucucaaguaaucuuuacaauaaucuucugaaguagguacuuuuauugaucaaauguugucuagagaaguuaaguaacuuguaacuucaaugguauacaucuaagaagugaacuuaucaggauaggaaccuaggccuucccaacucagagaaaauuuuaaacauuaucaccaucaauagauaacuuauucucuuuugacaucaggucaucuaauuauacuggccuuucuuuaacuuugccacagagaaagaugaaauaaagagagcugaguccuuugaaaacuuuaucuucauucacauucauguuggcccauccaacauggccucauuguucuuaacuucuucagcuucaguaacaucagcacucuacuucaguuuuucuaggaucuuaguaguaggagugauucucuugcugagauuucaccagcagaacuagucucugguugauuuaaccuccucugugauucuuguucuaacaaacauacuguuacauaaugcucaucaccugguccuuugacucccucccuuuuccuccaaguacauagacaugcuuucuuguuuccucauuucauaaggucucucucuagguuugucuguacccauucucaaacuuauuuauaauuaggaauuucacugaugccuaauacuguuuuuuucagccucuuguuguauuucuggauaaauccauuguuguggucuguuugugccuuuccccagcugucacuuagcuuggugauauggagagucacagaaguuugcugauuagauacaaugcuuucauuaaucucuuguuuauuccccauuacauuuucagauuuuccacagcauuuccagaacuuuaacuuagggcuggcagcuccugaaccagucauuuggcagaaggaugccauuaccauguauuaguuuagacaguuugaaacuugaccucggaucuacgggaaagaauauuggagagucaaccugcaauguguaaugguugcugugacacuguuuaccuuuacacaguccacuuuuaucagcagcauuacuuuguaauugcuuuagaacuggcuuuuauucccauaugcccauuugaugaaacuuaccuaguuuauuauucauucacauagcauauauuaaauuucacugugccacuucauuuauuucauuuuauuauaaaaguaguuacaaaaguuacaugcucaugguaaaaaaugggaaagguuauaaaauuaaaaguaaaauuuucuucaacuccgacccaguaguccaacucuccagguguaaguacuguuucguguguauccauacagaaaaucagaaaaauuaaugcauauguaucauuuuuucuucucuuauacuguauccuauagauaaugcucagcauuuuuuuuccacuuaauaacuuauccuggagauuuuuuccuauaauuuuagauaaaugucaccuuuuuuuaaacauuugcacauuucauuguguugauuuacugugaauuaucaaguguccuacaauguacauuuaguuaugaauuaagugcccuauuaauauauaauuaguuaugaaugaagugccuuauuaauacauaguuauuugcaguuuuuuggcuguuacaaguagugcuguaauaaacuauaucuuuguguuguucagaauuuaauacauaguagggauugcuauggcccauaguugggcaccuuguuuguaaauaaaauuguauuggaacacagccauacccauuuguuuguauguugucuauggcugcuuucaaacuagaguagaugaaugaaaugguuguaacaccauuucacaauggcucacaaagcugaaaauaauuuacugccugacucuuuaagacaaaguuggcuggccccucauguguaguauauauucuuagaaauggaauugcuaggucaaagaguaugcauguuuuaaauuuaaauucuaaauaaaaguucaaauuuuuuuuugccaaauuaccauccaaaaggucgaccuaauauacaauuugacaguauaugagagcauauguuuucaucaguuauuucuuaccaagaguaguuuuuaucaaagaaaaaacuuauccaacaggugaaaaaugguaucacaucauuuuguuuugcauuucucuaauuaugacaaguuggguauauuuuuagagguuuucugggggguaauuuacauauuuucuguugucauuuugugauuuuugccuacuuuaaaaaauuauucauguuuuucuuccagauuguaaaguuauuuuacauauaaaacaaaguagcucuauuuuugucauguguuagaguguuuuucuuauuuguauuuuaucuguuugugauauuuuuuccauauagauaugcuaaucuuuuuccccuuguuuuauuaugaaaaauaugaagcagaaaguauugaaagaauaauauaacugacauccauauacucuuuccuuagaaacaaguuguuaauauuuugccacauugacuuuuuuucuuccacauauauaccuaucccgcuugaaucauuugaaaguaaauugcugacaugacacuuuaacccuaaugcuucagcaugaaucuaagaaugaggauauucuccuauguaaccaaacuaccauuauccuaccuaagccaauuagcagugauuccaugguaucaucuaauguacaauuugcauucaaaauuucauuauuuucuuaaaggcuagcuuuuuuuuaaagucaggauccauucagacuucacacuuuacauuugaucuaucacuuuaguacuaauugagaacugucuucucuuguuuguuucuauauauaugauacugacuuuuuaaaaacagcuuuauuagcaauauagugauauaugauaaguuguacauaaaguauacaguuugauuaguuuugauguauauaagccggugaagcuaucaucacagucaagagaguguggcugggugcgguggcucacgccugcgcuccuagaacuuuaggaggcugaggcccacugauugcuugagcucaggaguucgagacuggucuggccaacaugaugaaaccucaucucuacaaaaaaaugcaaaaauuagccaggacugguggcaugugccuguagucccagcuacuugggaagcugaagugggaucaucugagcuugggaaguugaggcuguagcgagcugugaucaugccacugcacucuagccugggcgacagagugagacccuguccaaaaaaaaaacacaaaaaaaugguaaacauauccaucaucauaccccugagauugauucauaccucuggaauauacaaauauuuguauauuuuucuugguuauagauuucuagcuugauaguuguuuuuuccuucugguauuuaaaaaauguugcaccacugucuucucacuugcauuguuucugaugagaaaucugccuuuauccuuaucuuuuucccuuucuacauaguguguccuuuuuccuguggcugcucuugugcguuugauugugaugcaucuuaauaugguuuucuucauguuucuuguauugggguucauagaguuccuuggaugcaugggguuuguaguuuucaucaacuuuggaacauuuuuggccauuuguucuucacacauauuuucugccccacuucucucuucucauuugaggacucuaguuacauauguguuugggugguugaagcugucucacagcuuauugaugcucucuuuauuuuuuaaauuauuuuuuucuuuguguuuugaauaguuucuauugcuguaucuucaagguuauuaaucuuuccuuugguaucuacucuucaguuaaucuucugguauaauuuucaucucacauauuuuaguaguagauuucaucucaagaaauuuaauuuguauugauaaaaauaucuuucauaauucuaccuuuggaauauauagacuacaguuauaauuuuuaacguccuuguuuucuaauucuaacaucuguuucagcuuaggguugguuuugacuuuuugacuuuugaguauacacguucccuugggcuucagagagguucaacuuuggccuucagccucuucauacucaucuggugauuuuauuaacuuuuacaaauuucaccucuuaacuuuugagacaaauggcuaccagguauaucucuuuuuucucauccuaucacugaaaccuuggucaugguauuucuuuuuuuuuuuugagacagagucucacauugucgcccaggcuggagugcaguggugcgaucucagcucacugcaagcuccgccucccagguucaugccauucuccugccucagccucccgaguagcugggacuacaggcgccugccacuacacccggcuaauuuuuuuuguauuuuuaguagagacgggguuucaccauguuagccacgauggucucgaucuccugaccucgugauccgcccgucucggccucccaaagugcuggcauuacaggcgugagccaccacgcccggccggucaugguauuucuaauagucuguuggacaucuuuucagcucauugacaguucauaguuacccuggguaaaacugagccagcucuccuugauuucuucacuuagguauugauaacacuauucucuuacugucauuuuggaccucacccuuauuuuagccuauaauccaauccauuguuuuauccuuuuacuucugucuuugaaauaguuuuuauaccugucuuuuccuguggcuaccacacuuuauuaauuuugacuuuguuauggacugaaauuuuauguccccacaaaauuuauauguugaauuccuuuuuuuuucuuuuuugagacggagucucgcucugucacccaggcuggagugcaguggugcgaucuuggcucgcugcauccuccacccccuauguucaagcaauccuccugccucacccuccugaguaacugggauuacaagcacaugccaccaugccuggauaauuuuuguauuuuuaguaaagacuggguuucaccauguuggccagguuggucucaaacuccugaccucaggugauccacccacuuuggccucccaaagugcugggauuacaggcgugagccgcugcgccuggccaaaauuccuaacccucaauauaaugauauuaggagcuaggcccuuugggaggcaauuagaucaugcggauagagcuccugugaauaggauuagugcuguuguacagagagacaugagaguggcuucucuuucugcucucuaccaugugaggauacagugagaaaauggccaucagcaaacgaggaaguggaccuaccagacacuggaucugcugucaccuucauguuggacuuccuggccuccagaacugugagaaauaaguguucguuauuuaagccauuaugguauauuuguuauaguagcucaaacuaaggcaucuagaggauuacugucacuuuuauauuggucuucuugccuccaggcucuuuucuucaaguucauucauuguacacugcugccucauuucuguuccuaaaguguaagucucaucugucauuucucuugcccacuguuucaauaacuaccucuugccuacaaaauacaaguuguuuagcauccuucuauccuuccacauuaugguugcauuuuuuuuuuaaucuuaaucucuugcuguuuuguuucuuugugcauucuuuaggaagaauagagggcaguaucauacaauguuuacaaguggagacucuagaauuagaaugucuggauuugaaucuuggcauuacaacuuaguaaaguauuagguauuuuacuucaacucagcaucaggguucucagcuguaagaugggcuucauauauagcauaugguaauaggucuguuuauaaagugcuuagcauagugucuggcauguaguaaaauugcaguaaauauuaacuauuacugucauuucuucauggcucuucuaguuccuuguauauauucauguuccuuuuucuguauggaguuccccuccuccuuacccuccuauccauuugaaauccuaccccuuguauaauauccaggucagaugccacauuccucaaguucccacaccaugaauucucauuuuucaucagcauuguguuuuuaucuuuaacugucuuauguuaguguuuauguacaugguuuauuucuucuugguuuuaagcuuguugaaggcaaggacugugucucuuaccuucuuuggcaucucuuuugguacaugugauaguugcuuaguguuuguugaauuugugaaugaauugugguucuacgugaccauacuuaugaauuguuugaccuagagugaauugccuguuaaauuaacugucuuuaaauuauaaucuuccuaguugcugaaguuuuuagauugcuaaauuacaccuuuucaaccuuaacacaguaaugccacauuuucuuucuggcuauuauugcuaguuuguuuaugagcauuaguuagaguucucugaugaaguguacucauucuguuuaauaucaaaauaaaauuucaguuuggugucacuuuucugucauugaauuccuugcaggccagaaagacaaacuauaccaguguacuauuauaccaguguacuauuauaccaguguauuaaacuuagcgccuguuaaaugauguugcacagaaaugacacccacauuuaauggaaguguuagagucagucauuaaguuaaaggaauuaaauaugcuuccaacccaagaagaccucuaguucuuaagcauuagggcuucaaauaauuugcuuuuaacaaaucucauuccauucagauucaguucagggaagagcagauuaaguucaguugaggggaccugaaacuuaaaagagggacugugauuaguuguugcacuacaaauuuuaaagcuggaguucuugaaagaaaaaagaaaaagaaugcugggaaauggaagagcaaggagaguuacuucucucuuuucccucacuagacugugagcuuuuaaaggacagggaccauacguugcuugugucugucucugagcucugucauaguacuucaugcagugaauauuuauugaguggaguucuaaaucuagaaagugaaaaauugcaucuaacgcuauuuccauaguacuguaaagccuccccacucuguaacgcauuacuuugauucauaugcccacggaguaauuucaaaaagucuuauaugaaaaauaaaagaauaaauaaaaccuguguaguuuuuaaggcuuuuuuuuuuuuuuuuuuaauggcagccuggucaacauggugaaacucugucucuauuaaaaggacaaaaauuagccaggcaugguggugcgugucugugaucccagcuacaccggaggcuaaggcaugagaauugcuugaacccaauaggcagaggcuucagugagccgagauugcauuacugcccuccaaucugggugacagagugagacuccgucucaaaaaauaaauaaauaaauaaauaaauaaauaaauaaauaaauaaauaaaaauauaauaaggaagucucucuuuucugaaaguucagaguuguuagaccaagguccugauacuguuacacuugccauuuaaagccuauggagguaucuccccuuucuaccccaggaccaccuuuauaaacuggugauuccauucuccuggguuuaacaucuuuuugaguuuuuuuuuuuuuguaucauuggaggggaugguuucuguaacugugggagugggaagguaaaaaguuuuuccauucuugaagcugguccaagacuuacgucuuuuugaauacuuucugucuuuuauacacauuauuaagggagauaauauggaauacuucacauuauaaguaaauuacauauuagguguuuuauaaaugauaacauuauuuaguuuauuguuaaaaaugguaaaagaauguuauacagguacaaaacaggaaaaaugcuuaaaauuuugugaaugugccccagaaaacuaaauaauuagaaguuagucugccugcacauuguugauaacuuuaaaugugguuagguccauuaguuuaaaauuugccuuuuaaaaguuaguggguuuuuuuuuuaauaaauauuauuauuuauuuuugagaugggaucucacuguguugccuaggcuguucuaaaacuccugggcucgagcaguccuccuaccucagccucccaaguagcugggauuauaggugugcaccacugcaccugguuccugaaaguuucuuuuauuaaaaaaaaaaaaucuaacaauugacuugcuaauauuaaaugaauguuuacaauaaaaaauguuauuugccccuauugaaaauaauguauugaaaucaguguguucuaggucaguggcuucaaagacuccaguuggauucauuggacugggcaacauggggaauccaauggcaaaaaaucucaugaaacauggcuauccacuuauuauuuaugauguguucccugaugccugcaaagaguuucaagaugcaggugaacagguaagaccuuuucuuuagauuuguuuuagauuuugagaaugaaaaaugaauauacauucaaauaagugacagcuucuuagaaguauacccaauggaguuguaaaccuaauucaguguuaauuuuauauauauguaaucauucauccaacauccagauuugcaguaaaggagaguucucguuagacauucagggguaucuauucuuuggcaggugacuuggaacauuuugcacauuuggucagagggccuuguuuuagcucuguaucaguuuucugagauaguaacuuuacugauugugcuguuaaaguaguuaguuugguggaaauaaccuccuguguuauuaaaagcacauaugucuuuaaaacaagaguaggcuuagagauauaaagcuuaguuugaguugaagcucagauacaugcuuucuuacugggggcaaguuacaucacuucugcugauuuccucauucuuaaaaugugaacgaugacaaccuaugccauuagguugugaagcucaaaugagagaauguaugugaacauacuuugaaaacaucauauggcagcacuuugugaauaauuauuaguuauuggccauaaaccaggagacagccuaaaaacacuauguccuauaaugaagaguugaguuauaguggaucucuaguguuuuuaggcuaucauucauguuuaaagaauuuugguaccagaguuuaucauguuggaugauaacaucugcugguuaagucuugaguuguuuggauuuguuaaacuuuaucaauaacucaaauuacaggagaccauguaucaguauccgaauauaguuuguuuuuucuagauaugagggaaauucuucuuggucaaguuguagagugguaacugaggauagugugugaucccagaacagagaauacuaaaaaauuccugagaaaaaggugagaaaaaaauuacacagccagcuucuagauaauagacuugaaaguaaauacugaaaaaugcuauaccuaguuacagaacagcuuuagguaacuuagaagccauuuucagaacuauauaucugaaucuuuuuccuuuccaugguuuuugugccauauggaaauugcagcaguauagugugaggauggaaguaugacuuuggaacuuuucaggguaguguuguggcugcuucugccuguucagucucugaauacggauauuacacucccaguauagcaggcuuacaggcuuaauuaauguagggacuuaguagccuuguuggagagauuugaucagucguauaguagagaaucugggaaaggcggccuuuuaccaucuucagagauggugagcauuucaaguugauauucagucugagaugaaccaauuaguaguuauuuugaggagacaguuauuacuuuuugggauaacacaucuauuugguauugccauuuuacagugguuuaucuguuaguaagaguaacaaggguacuugaucucuaaacagaggaaauaucuucaauuaaaaacagaauuuaaccaaagagugggguaggaauugaauggggacuauuacccuagacuggcaaagcagaagcuugugaccuuuuacguuguuacagacacagguacucuucccucuaugccuguaguacuuccagcuuguauguggaacgacuguaaugaucaucacugcuuugugacucucuccugcuuuuucccagaauucuagagcuuucugaugcucugccugaauuaccucauacucugaaguuaccaggcuuaccucuguuucccaacaaguuucuuauuucuuuaguguugcuaauuuuagguagguaugaaggaaggcugccuuaagaauaaggcuuaucccugcaugaaggagauauuuauguuuugaaagggagagaaaagaaucuaauacaguauuuagugagcaccuacuaugugucaggucuuuugcuaaauauuuuguauguauuaucucauuuuaucuuugcaacagaagugcuaucaagaagccaaugcuuggagaagcuaaauaauaucccuaauguuauauagugguucuuauuaucugcaguuucacuuucuacgauuucaguuaccuauggucaaauguggucugaaaauguuaaguacaaaauucaagaaauaaacaauuuauaaguuuuaaauugcaugccguucugaguagcaugaugaaaucuugugcuguccagcucugucccaaccuggaugugaaucaucccuuuguccagcgucuccaugcugcagacacucccuggcccauuagucacuuacuagccgccucagugaucggguguugugauaucgcgugcuuauuuucagguaacccuuauuuuauuucauaaugguccaaagcgcaagaguaguguugcucgcauauuguuauaauuguucuauuuuauuguuguuguuaauuucuuacugugacuaauuuauaaauuaaacuuuaucauaggaguguauauauaaagaaaaacuggcugggcgcagugucuugugccuauaaucccagcauuuugggaggccaaggcaggcggaucaccugaggccaggaguucaagaccagccuggccaauguggcgaaaccccggcucuacuaaaaauacaaaaauuagccaggcgcgguggcgugugucugugguuucagcuacuugggaggcugagacaugagaaucgcuugaguccaggaggcggagguugcaauaagccgagauugcaccacugcaguccagccuggaugacagagggagacucugucucaaaaaaaaaaaaaaaaaaaaaaaaugcugggcgugguugugugugccuguagucccagcuacuugggaggcugaggugggaggauuacuugagccuaggagguugaggcugcagugagcugugugcuccagccugggugauggagugagaccuugccuuaaaaagaaaaaaaaacaaaccagaaaacauagucuauauguuuauauaacauagucuguauaggauuugguacugucugugguuucaggcauccacugggagucuuggaauguauaccucucagaggagggguuaccacuguguagugaaugaauagcaagagccaaugucuaaacaaaggucuuugacuucggaguuuugguucuuuuugaaauuaaugugaaagacauuuuugaguguguguaugugacaucuguguugaugauucugaaauguagcuaccuguuaaccuauuuauaaacuagauugcuggaaaauaaggugccuagaucagucaagccacugaucauuggucucccuugccuucucuugugugguucuguacccacggaguuacaauuuaauaauauuuaucuauuguauggguuguuuaguggguugaauaguggcccaccuccccaacccccaaagauguccuauaaaauuguuaggagaaaacacagagguaaaucuuuaugacuuuggauuuggcgaaggauucuuagauaugacaccaagagcaugagcaacaaaaugauaaauagguaaauuggacuuuaucaaaauuaaaaacuugugcuccagagaacaccaucaauaaagugaaaaacaauucacagaaugggauaaaauauuugcaaaucauauaucugauaaggaauuuguaucuagaauauaugaagaagucuuacaacgccagcauaagacaaguaacucaauuaaaugggcaaaggauuuuaauagacauuucucccaggaagauauaugaaugacccaguaaacaugugaaaagaugcucaacaucauuaggcaucguagaaacauagucagaacagccgggugagguggcuuaugccuguaaucccaacaguuugggaggccgaggcagguggaucacuugaggucaggaguucaagaccagccuggccaacauggugaaacccugucuuuacuaaaaaugcaaaaaaaauuagccaagugugguggugugcaccuguaauaccagcuacucaggaggcugaggugggagaauugcuugaacccaggagguggagguugcagugagccgagauugccaccacugcacuccagccugggcgacagaguaagacucugucucaaaaaaaaaaaaaaaaaaaaaaaaaaaucaaaaccaugagacacacccacuagaaucuagauuaaaaaguuagauaacaauguguuugugagguuguagaaaaguuggagcccucauacacugcuaguggaaauguaaaaugguacagccacuuugggaaagaguuugggaguuccucaaauaauuaaaaguuuagaauuaugccaugacccagcaauuucacaccuagcuauauacccaagagaaauaaaaaauuuguauccacacggaaacauguauuuagcaacauuauucaucaucacgaaaaaguggaaacaacgcaaaaaucuaucagcggauagaauguccaaacaaaauguguuauauccauacaaugaugauuauucaguaauaaaaagaaaugaaguacuaauauuugcugcaacauugauaaaccuugaaagcaugcugcgugaaggaagccagucacaaaaaaccacauacuauagacuuuuccugaaaguccagaauaaggaagucuauauagagacacaaaguagaucagugguugcuuagcgcuggggaagagggaaaguugggcauagaggaaugauagcuaaugcguauaagauuucugauuuuuuuuuuuuuuuuaaauggagucucacucugucaccaggcuggagugcaguggugcgaucuuggccuacugcaaccuccaccuccuggguucgagugauucuucugccucagccucccgaguagcugugacuacaggcacgcgccaccacgcccagcuaauuuuuuuuuuuuuuuugagauggagucuugcucugucgcucaggcuggagugcaguggcgcaaucuuggcucacugcaaccuccgccucccagguucaagcaauucuccugucucagacuccugaguagcugggauuacaggcacaugucaccacgccugucuaauuuuuguauuuuuaguagagaugggguuucaccauacuggcuagacuggucucgaacuccugaccucaggugauccacccgccuuggccucccaaagugcugagauuauaggugugagccaccgugcccggccaauuuuuuguauuuuuaguagagacgggguuucaccauguuggccaggauggucucgaucucuugaccucgugaucugcccaccucggccucccaaagugcugggauuacaggcgugagccaccaugccuggccagguuucuucuugaaaagauucuaaaauugauugucaucaugguugcauauaucugugaauauguuaacagggccuuugguauacuuuaaaugggugaauuguaugcgaauuauaugucagugaagcuauuaaaaaagauauauucaaguucuaacuccuaguaccugugaaugugagcuuuuuggaaacagggucuuugacgaucuaaaguuaagaugagaucaucguggauuuaggguggacccuaaagcuaaugacaaguguccuuaccagagacagaaaagaagacacagagacacagaggggaaggccauaugaagauggaggcagacauuagaguuaugcugcugccagccagaaaauaucaggagccaucagaagcuggaaaaggcaaagacagauccucccuuugagccuuuguggggagugugucucucuugacaccuugauuucagacuucuggccuccagagcugugagagaguaaauuucuguuguuuuaagcgacggugcuugugguaacuuguugcagcagcuguggaaaacuaauguagcaaacauugggaaucuacaaaauguguagguuuugaaucuuucuauaccacuuaguaucugugcaaucuugggcaaguuuuucagugucucuauacgcuuguuuccacauguaugaaggauaaucauacuguuuucauagacuuguuauagggauuaagugaguuaauuaugcauggagcuuaaaguagcauuuggcacauauuaaucacuguauguuaauguuaacuauaaauuaguuucugugugccuuaguuucaccucugcuguacacagcuguuccucuucucaugcuguccauucaacagguaguaucagauauucucuccuuuuuugugaagaaaaguuacuuuuuauugcucuaaucacuauggguuaaggcuacuguagacuaccuuagcaaaaugggauaggaccuucauuaagucacuaauguaacagauguuucucgagaacuuucuaugugccaggcacugggaauauagcucagaacaagacagucacagucugugccuuuagggaccaauaggugguguuagauuaucaaauuacacaaauaugugauuccaaauugugauaagucuaaagaaaaaguaaaaggucacauuaguuuuuaguaaaauauguguuacauuaggugagagggugguuaggggaauucucucuaaagacuagacauuuggccgggcgcgguggcucacgccuguaaucccagcacuuugggaggccgaggugggcggaucacgaggucaggagaucgagaccaucccggcuaaaacggugaaaccccgucucuacuaaaaauacaaaaaauuagccgggcguaauggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaacuagacauuuaggcagacagcgaaagaauaaguaggauuuauccagauuaagaaugaggacaaaggagcaguuuccucaaaaaguggagccucagucuuugcugaagacuuuuacuuuaggucaacagagauagcuugaguaacuaccaaaugucuaguaguuuaccuaaugcuguugggaaauaaaacagguugaguuggaugugacgagguguuggauaugucuuagguggcaagaccaacuaauacugcaaggaaguuucuauuguaauuuuacuauaauuaagugcuaaggcaauuuuugaggaagaaaaaaauaagcaacucuuaaggaucauuucauuucugauagggaauuacaggaagauugcauguaaucuuuacucacccaacaaagauuguaaaaugaaaucaugaaggacaaggucuccaagauuccugcauaaaaauuugaggguuccaggacacagacucaguuacuggguuuuccuuuuucuucuuccuugcaauaugucacugggugugaagaaggaaagaagguggguucugggucggugcuccucccagauuagugaauaauagcgaagacuuagcuucuugugcacaguugccacuccucccccaauacacaguggggaaaauucugugugugguucacccugaggcaggaagccuggaagacagaaucuucuugccucucuuccucacaucucucauucucuuaagcaucuugacucuaagagguccucugaguauugauuuuaacagcaguggaaggugggacaaugugaaauucagaugaaugaagugagaaagguaaagggugaaaaagcuuugguccugagggcaacagaaaaugaaagcauuuguugauaaaugauuuacguuggcagcuuagagaguguuuugaacaguggccaugucaucagaacaagugugauuuccuaagagcacuacuuuaaaagguaauauuaauuuggaugaauacguucugauauauuaaaaugucaacauucuuauuucauagcuauguuuaguuuuuuaaaauguuggauaaaagaaaaaaugaauuucauucuauuaccauaaggccaagacacgacuugggaugagauggaaaaguaugugugaaacucugaaacuuuuugccacaauagugcccugaaggguggguuuaaagguuaaaaaauucagcguauauuugaguugacucauacauuuuuaaggacggguguccauuuccucccucuguguuacuauaucaagucaagcugaugaagugagagccaaagaaaacaagcccaucccccaacaccccaccaagauugcagaaaugcugguuaguugauuucuaaugucagcuguucuuucagugagagauuugcagggaagaaaaucagauguuguuuugaagaagugcuuuuguuuuuuuugaaagcaaaaacugagaauuuauuguuucauguauuggaagaguuggggaguggccugaccucuggcagagcugaauuuagugacauagauacagccagauucuuuucuuuucucuuugcuucuggagucugcuuuucuccaucaggcuccucucucccuucaaggugcaagauggccaccugccguuccaggugaagaaguauuuuagaauauuaugacccuggaggcuuuucuucaagcuuuaguaaaaccguagucaugcaccucauaaggauguuuuggucauggacugcauacauaaagguggucccauaggauuauaauagaguauuuuuacuguaccuuuuguauguauagaucauuaaauguacaaauucuuacauuauguuacaguugccuacaguauucaguacauuaacguugcuguacagguuuguagccuagaagaaauacacuacaccaugaaggucuguaagugcucucucugauguucgugcaacaugaaauagccuaacaacugucaaccuuauuaaaauaaugauucagaaacugugauuagguauagaguuuauucaggcccaaaagguggaaaauggccaccuggaagcauaaauucaaguugccuugaauauauacgauuagcagauguuacaagugauuuuguuuguucauuucuuuugagacagggucucucucugucacccaggcuggaaugcaguggcgggaucauggcucacugcagccucaaccucccagacucaagugauccucccgccccugccucccaaguaguugggaccacaggugugcaccaccaugcccagccaauuuuuguauuuuuguagagacaggguuuugcuuuguugcccaggcugggcuugaacuccugggcucaagugaucagcccaccuuggccucccaaaguguugggauuacaggugugagccauugcaccuggccccagguggguuuuuaaggaaaaaagaagaggcaguuccuaaguuguuuaacaagaguuuacauuaacauaaauuauuaauugacuguacauuguucuuuguauuccaaauuccaggaauaugacaauaauaagggaggcagcuagucaggaacaaaaaugccuuuaagcaauugccacugggcacggaggguggcggugaccaaaguccuaugcuuacgucucucugggccugauaaauuuugcaaaccucacauaguucagacuacuucaaguuauuuuucuuuucucacaacgcauuucucagaacguaucucuuuugcuugacuguacguggauuauuagggaaauaaaaacuuugauaaguuuaauauguuuuacaggacuacuuaauagcuuguuuaugccuuuaaguguuaaccuauucugauaaggcauuuauaauugguugaacuuguuauuuguggucauuuucauaaaauauguggacguuuccguaucccuuuauuuuuuuuaauuuaaaaacaaaaucagagggaaguuuuuauuauauaagcauuuauuaaaauaaguugggcagaaugauggacucagaaaaugaguguguuuguagggcagccuccaaggcccacaggaagcuugcaguugauguuuuuuaacuuuuagguucggagguaauugugcagguuuguuauauagguaaauugcaugucacaggaguuugguguacagauuauuuugccacccagguaauaagcacgguaccuggcagguaguuuuuugauccucacccucugucccucccuccccccucagguagucucaagugucuguuguuccuuucuuugugucuguguguacucaguguuuugcucccacuuauaagugagaaugugugguauuugguuucuuucccuggauuaguuugcuuaggauaauggccuccagcucuauccauguugcuguaaaggccaugaucucauucuuuuuuauggcugcauaguauuucaugguguauauguaccacauuuucuuuauucagucuaccauugaugggcauuuagguugguuccaugucuuugcuauugugaauagugcuaugaugaacauacgggugcaugugucuuuauggugaacuguuuauauuccuuuggguauguacccaauaaugggauugcuggguugaaugguaauucugcuuugaguucuuugaggaaucaccacacugcuuccacaguaacucaucuaauuugcauucccaccagcgguguauaaauguuccuuuuucucugcaaccuugccagcaucucuuauuuuuugacuuuuuaauaacagccauucugaguggugugauauuguaucucauugugguuuugauuugcauuucacuaaugauuagugauguucagcauuuuuucauguuuguugacuguguguaugucuuuuuuugaaaagugucuguucauguccuuugccuacucuuuaaugcaguuguuugguuuuugcuuguugauuuaaguucccuauagauucugaguaguagaccuuugugggaugcauaguuugcaaacauuuucucccauuagguagguugucuguuuauuuuuuguugauaguuucuuuugcugugcagaagcuguuuaguuuaauuaggucucauuugucaauuuuuguuuuuguugcaguugcuuuugauaucuuugucuugaaaucuuuuccagguccuaugucuagaaacaguauuuccuagguuaucuuccagguuuuuauagcuuuagguuuuacauuuaagucuuuaauccaccuugaguugaauuuugaguaugguauaaggaggguuccaguuucaguuuuuugcauauggcuagccaguuauuccagcaccauuuauugaauagggaguccuuuccuuauugcuuguuuuuuuuuuuuuuuuuuuuuugacuuugccaaagaucagauggguauaggugugcagcauuguuucuguacuuuauucugucccauuggucugugugccuguuuuguuccaguaccaugcuauuuugguuacuguagcccuauagaaaaguuugaguuugaaguuggguaacaugaugccuccagcuuuguucuuuuugcuuaggagugccuugacuauuugagcuccuuuuuugguuccauauaaauuuuaaaauaguuuuuuucuaauucugugaagaaugucauugguaguuugauaggaauagcccugaaucuauaaauugcuuugggcaauauggccauuuuaacaaaauugauuauuccuauccaugagcauggaauguuugugucaucucugauuucuuugaguaguauuuuguaauucuuguuauagagaucuuucaccucucugguuagcuguauuccuguauuuuauucuuuuuguggcuauugugaaugggauuguguucuugauugggcucuuggcuugauuguuguugguauauaggaauguuaguuauuuuugcgcauugauuuugugucuugggacuuggcugaaguuguuuaucagcuuaaggagauuugggcugagacuaugggguuuucuagauacagcgucaugucugcacacagggauagguugacuuccucucuucauauuugaaugccuuuuauuucuugccugauugcucuggccaggacuuaaguacuauguugaauaggagugaugagauagggcauccuugccugguuccgguuuucaagaagagugcuucuaccuuuugcccauucaguaugauguuggcuguggguuuguuauagcuuaucccuuuauuauauucguguuucuguuggaaacagaugcaucauuucaacuuuuagcaucuuuuuaaaaaacguaacugauaauaaugaucagaucuuaauauuuuagaaauuuugaaucaauaaauugcgaaugcagugauuuaaaaauauaaaccccggaaccaaacugucugggcucacaucucagcucugccauuugcuagcugugugacuucagauuacuuaaccuuucucugcuuaaauuucuuauucuuauauaaaauggggaugauaagaguaccuuucucuuagcccaaaagaaccuggcacauagaaaguaccauuacugcugcugcuacuacuauuacugcugcugcugcuguuacuguaucuaugccauauuucuccaaaaucuuuauucuccaacauaccccaaacaccacugucucagcugcauuauugaguccagaauauguugaaagagaauaauagauguauuuucauucuugauuauagccaaaaggccaagaagugauauguagacauauuucuaaaugaaagaaugaagauacaaauuaaaaccaaacuaggagguaaagugauuugacagcauuccuguuuaagagucugcucugcacugccccuucugacccaccuuuauuuugcagaagauacugguuuuucuuuuuaacuuaauccuuagcaucaaggacaugugacuugugcuucauuuucauugucuaggauuuuccuuggagaugcugcugaucuaugccaaaagucugggauguaugcaccacuucugugugaguuuauucugauugaacuaggcuuaauuagauucucuuuucuuuuguuuucucuuuaaaaacuuggaaaccauuuuguuguuccugaguuguaaggcugaacauguuugcuuaaguaaaucucuugggaucuaaucuggcauccacucaggucuuguuaaaugagagcuuuaaaagccucuugcugagugggcuccaucauuguugaccaaauguuucaagauguaggcacaaagcgcuuuugucaguuuuucaaguguaguuuaauuuugaaguaauugugcuuuucuacuuuuaaaguauuuaaaaaguacuuuuaaagaguacuguuaaagauuaaaaaacacaggaguggcaaguuuaacaagaucacauucuucuuguuucuuuauaaauuucuguuacccaucugguuuacuuggaagcaaugcugaacuuaacuuaugugacuguuuuaucuagaagaggcagcaagauuuuucucuucauguaaagcaacuagguaacauuugucuucuuccaauggauauguaaaaaggggguguagucccuucagauuacucuuggcucuucaccccccuccucaugcugcaaagcagauuuuuuguuauuaaacagauuuuuaauuuauuuuagcagauuuuuaauuuauucaguccucugcucuuuauauuacacacccaccauugaugcauacuggcauacagauaaaucaaagucuaauucagagaaauuggcugcaagaauucuuaaagacuauauugugguuuacacagaaaccaauuuccuguagucaaaauugagauaauagaagaguagaauuaucuuaauucauaauaguauaaguaugaggccguuggaauuagcaggagaucugucuggggcagccuugacaaucagagcagagccaugucccagagucagccaggccaaugaccauccccaguuauggagguguugaaaaccugcacggugaaaguccugcaaaugcugugcauugugcugaaucauugcacaugcuuccaguccccuuagccccuuuucaugggaaccauaccuucuuagaacuugagauuacuaaauaugaaaaauaucugucuaaguuuccuuuuuacuuuggagauaggaacccugagagauaacccaaaucacuguuuuuauuuuauagauuuggaaacugaagcuggagauguuacauaguuuacacaaaaucacccaugacuucuuggcugagcugcaacuuaacccgggucucuggcuucccaaauuaguguuccuuucacugauccaugcugucuuugcuuauccauucaauuagcaaauguaauugaaggacucuaauuaguuuggcuucuaaaggcuuuuguaguugaugucagacuggcaacaagguugguuuguuuuuccucccagcuuuugaguuguggccagauuuugucagucaauuauuucagggucuugaagucaucacauggauggugagauuguuugaaugucuguuuaucugucugauaaacaugccuuuguaguacaaauuagagacuguuaggauguaccaaauacacacacacacacacacacacacaugcacagagagagagagaaagagagagaguguguguuauuagguauagagcaguuguggccaguacaguggugacauuccagcuaucacuacuguuguguauuucuuccgggccugugagcuuugauacuacuuuccuauacaauugagggguuagcaguauucuggcaaugcaaccaucucaagaagcagaugcuagggaugcagggggcugauuggccaccccaugcacuuggcaagugcccgaauuggcacugccaguuuaugggauuaagaaacuuggagcugugaaacauccuuagaccugugagcuaauuguuggugcccuucagggccccucuaaaggaguuauguagauggaauuuaauuucuuucagugggagagaacucaauuccuaagagagaguugaaauuaacucuuagaccucaggucuuacugaugucccuuaaaggucuggaaggauggagcugcaauagaaggaaaguaugccauuguuuugcauuguguuuauuagaguaggaugaacaaaugggacuaaguaacauauauuugguauaguauaggaguagagaaguaugacuacuacaacuuuuuuuuucuuauuucacugagcucuauuuuucuugaguaaacuugaacuguuugccaggaaauaguugccucuucuagagucucaauauuuaugaagguguaggaaagguuuucaugcaacuuaagcgcuuauuucuuuguaauuugauggaaaauuuuuuaauuuuuagaauuauuuguagcaaguccucauuauauaucaaaauauacagguugaauguaucucauuguagauuauaaaaugcuguauugucuuuagagugaaacauuaaaagagaauaucuuuuuuuguuguuuuagggucugagauauuuuauaauaucauuuccuagcuuguuaauacacaauaugccaggauacuugauuuacugaaauuuuaaagagugacuuaugaaacugcuuuuuguuaaagcuacauuuauccugaauuugauuuagaagcugauagucucuuguggaaaacugaaauguaauuacuucuagcucuuaauauuuagauuacacacucuguuuggcuuccuauucuuuuacuuucaucaaaugcacauaaauacaaaaagaacauguguaaacuucugccacaugaaaagcagaggcauuccuauuuguaagaugcuuacaugucccuucacauuuucuaguagaaauacguuucuacaugcauaauguauguagaaauauguuaguuuuuacauauguaacucauucuggagagaaauccucaauaaucugccugaucgucuuuugucuuuuuuuaaugaagagaaaaaaggcuuugcagaagauguugugacaguugggaugccggauuucuuuucuuuuucuuuuuuuuaagagacaggucucgcucuguugcccaggcaggcuggaguaugguggcgcgaucauagcucaccguaaccuccaacgccuggacuuaaguuauccucccaucuuagccucccaaggagcugggacuacuggugcgccccacuacacccagcuaauuuuucuauuuuuugguagagauggagucucaccguguuacccagacuggucuccaccuccuggguucaggcaauccuucugcuccggccucccaaagugcugggauuacaggcgugagucauugugcccagcugauucuuucuauuaaaggagaguuugagucaaggaaggagcuccuggucucuccugaccucuuugguugccaguuggcuggccagguuuaucaaggugaauauguggaaaagagccagagagcuggggaugggggaugugaguaacagugcaucuacucaugcaugcaccuaagcaaacaggauagacagcgcaauuuuccuuugcaguauguucguggucauuauuaaagcagaaaugaggguugagagagugcccugaugccuauucauauaucuuuauucuguauguaguuuccacguaaguuucgguagcucauacuguuagccuuccuggugguacuugcagucauuguaguaaguguuuauguccuuguccugaccuuuucuuuucugaaacagacuuuucuuuucugaaacagauacuuucuucuuuuuuuuuugcuugaaaauacagacuggaggaugguggggacugggacuugagauuuuguuaggggauuuugcugcccaccaaaucacugaugaauccuacaguugaguuaccagcguuguuguacuagaauauuuuucuuagucaaaguguauaccaaagauuaugcuguuuaggaauccaacuuggaagaacccaugagaagugugucuguucccaggacugcuggguuuugcccuuuuacccucaacucccuucacacuuuuaaaaauaaacgauagauuugauuucacagaaacugcaucuguauauguauaaugaugugccuuuauuuugggcaguaagcuuuuuuuuuuuuuuuuuuggucauuugcaaacaaggauuagucuuuaugcacugucacuguuauaggcaugcaugaaaaguggauccuguuugugcucuagaaacugcuuacauuuuaauuuaaauaaugugccuuugcaauuuuuuuuaaagguaguaucuuccccagcagauguugcugaaaaagcugacagaauuauuacaaugcugcccaccaguaucaaugcaauagaagcuuauuccggagcaaaugggauucuaaaguauguauuucucaccuguggauauuuucuuguuaugauaguucaugaauuucacauguuagaacuauuaggaaauuacaauuguguuuguuaaaccuuucuauacuguuuuuauuucauaaagugaauaguguggugguuuucucauuguaaaaggcuuauuuuuucacugaagucaaguaugugacaauguguauaaaauuuuuugguuccguuucuuuccuuuaacucuugcguuaaacuuacccuuucacuaguaacauguuuaagagacuuuuaaagcuuacauuugaaacugcaacuguuaauaauauaauuuucuuacagcuuauagaaauucaggaaaaggguuuuaugaaaaauauagccaaacauuggaaagaacaccaucguuuaacauuuuauuauacgaaaaaaaguuauguccuguggguuaguacguuuguaguaagaacuuugggaaguuggaauuaaagguuagcaguagcucuuuaacccauuuaugucagagguugcaaauuuuuuugugaaaaaucagaccuuggcaaugaccuugaguaguaggauguacugcuugagcaguaggauguaaauaacucccacaaacuuagcauaaauggaacacuaggcauaaauggguuaaguaaaauacaguuuaggucaguuuccuaaucagugccugucuucccuggcucugagaaaccuuuugguuaauugcugcuuauugccaaacccuugcgguuauguuaggaugauagugauugaauucccagcuuaguuuugucaugucacuguuucuauuccuaacuuauuuuguuguugaauuucagcaaagagcuagagcaaacugguagacacuguagucacaagaagggcuaaaagaaaggguguaauuucaggaaacuguaauaugugaaauuugaaguuucugguaauugaauuguguuggaaaacuaaccaacuuggaaggaagcaaaagacacuuggauauuaggcagaaaacugauaagauaaauguuuagauuucagggaagguuaaaagacacucauuuuggauggagcucucagggccacagugugugugguccagaggcauccuagcuguccuguuaccuagccuguuacaguuaugguccugcuuuaccucugaaagaaaaguuacuaaaaacuucugaggagacauagcccuacauuuguuaauauccuuugcuaaggaauauggugacuagcuaucagaacaguuugguccagggaguguuuuuaaaaaguuugacuuuacauugaacuauaauuugcuucuuaugggugauucuuuauuuuuuucugggugaggaucauuuccauacacccagugcauguauaauuuuugggaugauuuuccauuuguugaaagguuuaagaucuuaaaauauuaagaucacagauugauaaacuuaauucuuauucuuuuaggcuaaagagaaaccuacauacucuuggaguaugcuauuucucuucugugaaauauacccaacaauugcauuugaauuguaacaauucauaugucuaaaauuguuguuuaaacaauuuuuaauauguauauuuuucuuuucuuuuuauuuuagacgaggucuugcuauguugccuagucuggucuccaaccuguggccucaagugauccuucugccuuggccuccuagagugcugggguuacagccuuaagccaccaugccugguuauguuuaaaccauuuugugugcuauuuuuuuaauagaaagauuuuuccuuuuaauaguuuuuaucaaugauuuuucuguuuucuucuucaguauuuauauuuauucaguuuuaauuuucuuaucaugauuccaugcccucuggguuaguauaucuauaguaagaacuuuggaaaguuuggccaggcacaguagcucacaccuguaaucccaccacuuugggagacugaggcaggaugauugguugagcccaggaguucaagaucagccuggacaacauggugagaucccaucucuguaaauauaaaauuuaaaacuuagacggguaugguggcaugcaccuguggucgcagcuacuugggaggcugaggugggagacucugucuuaaagaacuuuggaaaguuugaauuaaagguuagccauacccuuuaaauaaauuauaauuuagguuagaguuuccuagcuagugaagauagacacugccuuauaguguauauauauaaguuacccuaaaaagccaaaaagacugugagauuuccagauucuuucauauauuuuccuuucuaccugcuugauauuuuauuuugucauuaaaguuacaauuauaaaauaauaugccaucccaacacaaauggcuagauuuuaauugcuuauguuuauucuucauuguggaaauaacacggauauaugaaauuugcaguauggcuuguuaaagacaaauaaauuacuuuuuaaagauccagcuacuuuacagacaaaaauuuaaguccuaucuaauacccuuuuaaaguuaauagguguuuuaaauugcuuacaucuuagcuucauguuuauuauuaugguuaguguguaguucaucugaaaucagaauuuauaccauguaguauauuagguuuuauuagguuuuuuuuggaucuuuugaaagaguuuggguuuacuuuugaaguacaauuggucucaaaaagaaugagauuuuuaaacguguucuaauuaauaauguuuuuaauacuaaacuaaaauccuccuugauauauggcagcuuuucagcagauucuaauucuguagguaguugcaugaaauuuuuacucagaguuguaaacuacaaauauuuuuauuuauuuacuuagaaaagugaagaagggcucauuauuaauagauuccagcacuauugauccugcaguuucaaaagaauuggccaaagaaguugagaaaaugggagcaguuuucauggaugccccuguuucuggugguaagugguagcuaaaauauaugcaaaccuauuuauguuugucaaaaguagcaauuaugguuuuguuguaccauaugguuuuguaguaguuauuuuuagacuuguuacaggauucucauuaaaaauaaagccaaacugauacguuauuuaguacucucaagucuaaauaacuaacauuguuagucuuaaauucagauaaaaaagugucauaacuuugaaguguugugaauuuuugguccauuuacuguggauaggaauacaucaguuuuuagaaaauuuuuuuuggaacuauugaaaaaaaaaucagcuuaaauaauccuguaacuguuaaagaaauugaacaagugggaaaaaaagaaaaacaauuguuucacaagggaagcauuggcucagaucauuuuacagaugaauauuaccaaaauuucaaggagcagaucaucuaaauuuuauacgaacuuuuccagagaacaggaaaagaggaaauacuucccaauucauucuguaagaccuuuauaacucugauauuuacaccagauagaaauguuauaaaagagaaaaaauaaauauagguuuauuuuagucaugaauguagauguaaaaacuuuauauuagcaaacugaauccaaccauguaugaaugagauuaaacacuauaaccaaguuuccuuuagcccauguaugcugagauggcuuaauuuuagaaaaucugugcauauaauuuaccauguuaacaugguuaaaagucauaugauugucucaauuagaagaaaagacccacuaaugaaaugcuaaaaauuuacuauuaacucauacauuaauagcagguaucuggguaguuuggaauggcaggauuauaguauggcuucucuguaauuuccaaguuuuccaaaauuacuguguaaucagaauuacuguguacacauuuauauuauguauuuguagcaguauagcaguagacagcagaauaugaauuuuauuccaguuacauuaaacuugauugugggcuuuagaauuaaaaaguaacauauaauaauuuaaaucauuucguauuuuuuuauaaagaacuuaaugaucuuguagagguaccuuauaucccaaaugauuuuugaauauagguggaggaauaaauaauugcuggcucuucugauuguuauauugaauuacuuaaauaggauuuagguauaaaaauuuaugaugugguauagguacuuugauuaaaaguaccuacaaaauacuaauaagcaguuuuaagguuggcguuaaugugguuuuuauuggauggaauuaauaaacugaacagaucuuucuuagagugguucugcaguugaauuugaaaauugguaugguacaaauguucuugccauugauugauuuucuuuggucucaagaguacaaccugaaauuauaaucugauaauaaaaaauaccaauuugauuuuuaaacauuauuuuaaccuuuaaaauauaaucuuaugagaaaacuuugaaauuacucuuuuguucuuaucaagcaauuuuuaaacuuugguuuguuguuuuaguguacaaaaaugcuaacauaacugaauacaccugaaccugcauauguaguagauuaaaagcuuugugcagggaugauuugugguaauuuauugguugacacaugaucauuaugagguuaaccaguauauaauagcagcuuauuuauauuggucuuauuguuauuauguuuauauuuuuuaacaugguauguuacaaacuguuccaccuucccacuuaaaauaggcugguuuaaaaauuacuguauuuuaacuaaauaaaguuaaaccaaaguguuauaggaccacuagguuugauugcuuguugcaugauaacagaccaguaugcagacacaaugggaguugcaguagagaaagaguuuaauaauuguagggcagucaaaugagacagaggaaccuucaaauccuccucccuccaggguuuggggauggagcuuguaaagggucugaacagguagggcuaaaauguggggauugcugauuggucaagaagcaagggggaauuccugggacagggagaugaagaaaccgcauuccugugcagaguugguugguuccuugguugaggucuugagacugguuggcuucagccauucugcuggaauucaggaccugaaaaacaccauaagcaauucuuggguaaaaagguccagugucagagauucuguguauaggaacaaugggggagcagguggucagcaugccgcaugacccuugguuaguuaccagcuacagggaaguggguugaaguaccccagugcacccuggucaaugccugacuauaauucugccuaaagccuggcuuguaguucuccaucaacucugugagggugguuucaaaagggauguggggaaagcauggcuuagauacccagaaugggcccacaguuuuauagaaguccaguguucaucagucuugaaacauggaaucuuugagaucauuugaacaaaacuugaagaauuucuccccaucccuuucucccaagucuucaucuauuuccuauuccagacuuuaaaaaaugcaucauggauuuauauauagguacguacaaauagaguaguauucuaaaaguguaaaugggaacauacuauacuucuauuauccuaugguuaguauuuuaaagagaaguuuuuuuaaaaaacucagaugaauuuaaaauaguaaugauuuuugagaagcaauugguuucuucagucaagcguuucccccuacuuccugguaaguauuauucuggggaguaaaguaagaauuauuacuuaaucauuuuucuagccuauggaauaacagauggaaaguuuuccucagguuucauuuugauacuuauuagacccacuguguaauggcuccuguguacauuauccuuauuagaaagaauacaauuguauuuaagugcuauaugacuucuuuuaaaaaucgaaaguaaugcuuaaacuguuauguuuaucauccugaaaccaaugugaagaaccacuuuaauauuuguguaguuaucacuuuauaguauagauaguaguuuauaaagcacuuuggcaugccucagccuauuugaugcuucuuuuuguuuuaauuuuaauuuuuguggguauauaauagguguauauacuuaaaggguagaugaaauguuuugauacuggcaugcacugccuaauaaucacaucauguaaaaugggguuggugcuucuuuuugaagcugucaaacuguacaucuuuuuuuuuuuuuuuuuuuuuucugagacggagucucacugugucacccaggcuggagugcaguggugcaaucuuggcucacugcaaccucugccucccagggucaagcaguucucccugccucagccucccgaguagcugagauuacaggcgccugccaccacaccuggcuaauuuuuguauuuuuaguagagacaggguuucaccauguuggccaguuuggucuugaacuccugaccuuagguguucugcccuccuuagccucccaaagugcugggaauacaggcgugagccaccaugccuggccuuaaaguguacaucuuuaucagagcccacaucacgcuauauuuauaggcuaugauucucuuccucuugaguuuaagcuuuuuuagugcagggaguaaguuuuuuuccccaauuuuuaaaauuaaauauugaauauaugugcaacauauuuauaaaauauaugugcgguauaaaguguaaguauacauugaacuaauacguacccccuacucaguuuaagaacuagagccuugcuauuuauuaccuuugaaguucuuguuucccugauccuauuuucuuuucucucugaugagagguaaccagcauccugaauuuuaugucucauucccaugcuuuuuuuuuuaaguuuaacuccauauguuuuuauuucuaaacaguaguuuauuuuccaccuuuggaacauuauagaaauguuccauaaugagcauauucugugacuugcuuuuucacuuuacacuguauuucugaguuucaacccugguguuacuagagccacuggcuuacuugguaccugugugagaauuagaaagggcaccucucuauaccaaaauagcccuucaggugagcagaacgaaccuuuguauaaagaaaaagguaugccuuucuguagacacguguagccuuaugucaggguuugcgguuugacacauugaauguagauuaaaugucagccccugcucacccauuuggcuagaugcccaugugcaguacauaaaauguauugccauuaugugguuguuacgugcaguucuuucauuuuaacugcucugugguauuguucuauauaaauacaucacuauuuuuucuuucuauugugauauacauuuggauuauuuccaaguuaaaaaaauauucgcauucuuacacaccauggaaaggugucuuuuuagucucuguuuuuccaguguaaugcuuagaacaugguuggucuucacuaaauguuuaaaaacuugaguugacuucaacuggaaaaacaaccaugugaaauagacaggauaagcagugauacucccauuuuaccaaggguggaaguaacaccaagagauauuagauaacuuaccucaagaccauacuguugaucaggggcagaauugaaggacugauaugaugguucuuuaaugcauauucuacuguauuaggaaauaauauuuucuagaguucucauauauuucaagagggaaauaaagauugcuaaauggaagaauuagugaccuuagggcuaagcagcagaugaacauuccagcuagacccaaucuaaagugcuuaccuacagaauugugaacaaguaaggccacuaaauuuggggguggguguuauauguagcaguaaauaacugaugcagccaauaaaguugauauuuccauaauuauauagaaguauuuaauguugcuuguauuaucagugugcuaccugugcuuauuuaguacaaguguuauaaacucuuucugaaggagaauuauuguaaugcgguuuugauaugaaggccagcuuuaacauuacuauagccuuggaauauguuuugaagucagguaauguggcaucucuagccuuguucuuguugcugaggauugauuugaauaaucgggcucuuuucugguccguacaaauuuuaggauuuuuuuuuuucugauauugugaaaaauaacuugguaauuugguagagauugcauugaauauuuagauugcuguuggcaauauggucauuuuaacaauauuaauuuggccgggcaugcgguggcuuaugcuuguaaucccagcacuuugggaagccaaggcagguggaucaccugagcucaggcauucgacaccaaccugggcaacaaugugaaaccugucucuacuaaaaauacaaaaauuuggcuggccacgguggcaugcgccuguugucccagcuacuugguaggcugaggcgggagaaucacuugagcucgggagguagagguugcagugagcugagaucgcaccauugcacuccagccugggugacagagugagaccuugucucaaaaaacaaaaaacaauauuaauucuugugaucuaugagcaugucauguuuuuccauuugguuaugucaucuucaauuucuuucaucaguguuuuguaguuuuucuuguagagaucuuucaccuuguuaaauuuauucuuagauacuuuuauuuuucauagcaauuauaagugggauugcuuucuugauguucuucucggcuagaucacucuugguuuauagaaaugcuacugauuuuuguguguugauuuuguauccuauaacuuuacugaauuuauuuaucaaaucuaagacuucuggguugaguuuuagguuuuucuagguguaagaucauaucaucagcaaaaagggacaguuuaacuuccuuuauuccgauuuugaugacuuuuauuucuuucucuuuccugacugcucuggcuaggacuuucagcacuauguuaaauaggaguggugaaaguggguaucuuugucuuguuucaguucuuagagaaaaagcuuucaacuuucccccauuccauaugauguuagcugugaguguguuguauauggccuuuauuauuuugagguauguuccuucuaugccuaguuuguugaggauuauuaugaagggauguggaauuuuaucaaauacgcuuccugugucuauugagaugaucauacgguuuuuguccuucauucuguugugauguaucacauuuguugauuugcauagaaccauccuuauaucccugguguaaaucucacuugaucguguuguauuaucuuuuugauaugcuacuggauucuguuugcuaguauuuuguugagaauuuuugcaccuguguucaucagguauauaggccuguaguuuucuuuuuuuguuguguccuugucugauuuugggaucagggugauuccagcuucauagaaugaguuagggagaauucuccccauuucaguuuuugggaauaguuucaaaaagauuaguauuaguuugguagaacucagcugucaguuugucugguccuggacuuuuccauguugaaagauguuuuauuauucuuuccaucuugcuaccuauaaugucaguucagguuuucuauuucuuucugauucaaucuugguaggucguauguuucuagaaauuuuucauuuccuguagguuuuccugcuuuuuaagcguauaguaguucauaauagucucugaugaucuuuuguauuucuaugguaucaguuguaaugugucauuuuucauuugauuuuauuugaggcuucucucuucuuuuccugguuaaacuagccaaugguuuaucaauuuuauuuaucuuuuugaagagccaaauuuuuguuuuguugauccuuuguauuuuuaagucucuauuucaucuagcucugcucugaucuuuauuauuuauuuucuccuguucauuuuauguuauguuaugaucuuugggcauuuauugcuauaaacuucucucuuaguacugcuuuugcuguaucccagagguuuugguauguuguguuucuguuuucauuuguuccaauaaauuuuuuuaauuuccauguuuucuuauuuuuaacuuuuuuaaaaaaaaauaggcucuugccuugucauccaggcuggagugcaguggugcaaucacagcucacugcagccucaaccuccuggacacaagggguccuccagccucaggcucucgaauagcugggacuacagguguguaccaccacaccugucuaauuuuuguagagauggauucucacuguuuucccagucuagucuugaacuccugggcucaagugauccuccuaccuuggccucccaaagugcuggccucccaaagugcugggauuacagccaugagucauggugcccagccuuuauuuucaucuuaauuucuuagucaaccacaguggucauucaggagcauguuuccccgccaccccacccguguauuuguagaauucuucuuuguauuaauuuuaguuauauuuuauuguggcgcgaagagauacuuaacagguuuucaguuuuuuguuuguuugagaucgagucucgcuuugucacccaggcuguaaugcaguggugccaucccggcucacugcaaccuccacaucccagguucaagcgauucuucugccucagccuccugaguagcuggguuuacaggcuugugcugccacaccuggcucauuuuuguauuuuuaguaaagacgggguuucacuguguuggucaggcuggucucaaaccgcugaccucaagugaucugccugccuuggccucccaaggugcugggauuacaggugugagccacugcgccuggcuguuuucaguuuuuuaaaaguuauucagacuuauuuuguggccuaauaaaaggucuauucuggagaauguuccauauacugauggaaaaaauguauauucugcaacuguuggauaaaaugugcuguaaaugucuguuagguccauuuuguguaaacuccaguuuaaauucaacguuuuuuucuugacuuccugucuaggugaucuguuuaacauugagaauuggguguugaagcccccaacuauuauuggaucucucuuucagaucuaguaauauuuguuuuaugaaucugggugcuccaguguugggugcauauauauuuggaauuguuauaucaucuugcuggauugauuccuuuuucauuauuuaaugcccuacaauuaaugauugucuuuuuauuguucuuuauuuaaagucuguuugauguaaguauaacgauucuugcuugcuauugguuucuguuugcauggaauaucuuuuuccauucuuuuacuuuagcuguguauguguccuuauuagugaggugaguuucuuguaagcaguuggauuguuuuuuuuuuuaaauccauucaaccuuuauguaucuuuuaagaggauaauuuaaucuguuuaguuacuaucaagguuauuauugauaugcaaggcuuugucccugucauauuguuaauuauuuucugaugguguuauauauuuuguuucuuuccuuuucucucauuguuagucauuauggcaugguggauuucuguauugguaccauuugaguccuuuuuucuuugugugauugcuuugcuggugaguuuuauacuuucauguguuuucaugaugguaaaugucuuuuugcuuccagguuuaggacucccuugauuauuucuuguagggcugggcuagugguaaugaauuccuugagcauuugcuucucuagagaagacuuuauuucuucuucauuugugaacaguaauuuuguuggauacaguauucuuggcugccaggguuuuuuuuuuguuuuguuuugguuuguuuuuguuguuguuguuguuuuuccugucagcacuuugaauauaucauccuauucucuucuggucuauaaaguuucugccgauaaaucuucuguuagucuuaugggggucccuuuauaggugaccagaugcuuuugucuugcuguuuagcuuagacuuuauuuauuuguuuauuagaaacaaggucucagucuguugcccaggcuggagugcaguggugugaucaaaguucacugcacccuugaacuccuggguucaagcgauuccccccaaccccaaccuccugaguagcugggaccacagguacgcaucacaaugcccagcuaauuuaaaaguuuuguagugauggaaucucaguauauugcccaggcugaucucaaacuccugggcucaagcgcuccuccaccuuggcuuccuaaaguguugggauuacaggagugagcuaccauauccugcuggauucgacuuuagacagucugauuaaaauguguagugaagaagaucuuuuagcauuguaucuuucugggaauuggugaaccuccuguaucugaauauuuaaaucucuugcuagacuuaggaaguuuucaccuauucuuucauuaaauagauuuucugaucuuuucacuuucucuguggguuuggagauacugaugauuuguauauuuggucacuguauguugucccaaaugucaugaaugcuuuacucauucuuuuuaauucuuuauuuuugucugacugcauuauuucaaaaaaucuaucuucaaguucugagcuuuuuaucuucuccuuguguaguuuauuguugaagcuuucuaauguauuuuauauuuccuccaauaaguucuuuaguuccagaguuucuacuuguugcuucuuaaagauaucuaucucuucgguaaauuucacauucauauccuuaauuguuauucugauuuguuugcauuguguuuuggaauuaaucuguuuuucacugagcuucuuuaaaaucaauauuuuaaauguauuaucuggaauuuugaagauuuuuaaaaauuaaaauauauuguuguagaauuguuguauuccuuuggagaugucauauuuccuugcuuuuucauguuuccuguguccucauguugauaucugugcaucugguguaacagucucuuccuccuauuuuugaauuuacuuuuuauaggggaagacuuuuucuuaaagguguaucugugguuucaugauugagcagggcucuuuggcuuugauuacgguugcaugcaguauuauagucacugcaugguuuccuuggcuguaaauagcuuuucugguaucuguuauuuccuuggaggguuagggugaaguuauuaguggaagcuguggugaaguugugguguggacugggaagccagguaggccaguguucaggcccuagugguggcagcagugggcugugcaugcuuuguuccccagggcaauugauacaguuuggauauuugucuccccaagucucauguugauauguaauccccaguguuggaggugaagccuggugggaggucacgggggcagauuucuuaugaaaguuuaacaccauccccuuggugcuguccuugcaauaaugaguaacuacucaggagaccugcuuguuuaaaaguguguggcaccuucccccuucucucuugcucccacucuggccauguaauaugcccacuccgccuuugccuuccacuaugagaaaaagcucccugaggguuauccaaaagcugugcagaugcugaugccaugcuuccugacaaccugcagauccaaaagccaauuaacuucuuuuauuuauaauacccagccucagguauuucuuuauagcaaugcaagaacagccucauacaugcuggcaccugugucagugguuaccaguggaccaauucuugggcuuucacauggcuuacuccaaugccaguaguggcagcgggggcuggguaggugagcagguucuuaugucacuggucagcuggagugguaugggcaauggcaauaguggugguuugauuaccuucugggucccuaucugcgugggcuggugauggugguggcugcgauacugguuguggcugcaauacagggucacccccaacagccccagacauguugcuaccaggcuuuucugccgucuauagcagcaaugcugccaugcuauacagagugguguaugggcccugccuuugcaugugagccuuagcauggaggccaugcugccagugggauuucagucaccacucucugccccggauagguagcccuccagcuugccuggcccagccuccggugauagcaggagcaaguguacagagcagggggaaggguaccaugcucugugugagagcuugaucacagaggcugcuccaccaguaggagaagaguucacucuuccuuugcaaagccaagcacaggguuugugaauugcugggcuuggagucauuucucacagccccagacagggagcucucagacacuguagagugugcuucaguuuccuuugucccagguacugccuuucagcgcacugcaccauuuuuuuccuggggaguaguauacccuguggguuaaagcacuuuggacccagccagugcugugccaccacagccauucaggucuugggggauggugaaugacccaggaugaguuuccugucuggugcagugccugcccuugcaggguuuccagaucuccaccugcgcuagugucaggguucauguaaguagaggagcucucuugugguucauaucgcaacaguccauugcagagacguggacugcugaagcucuuuuacuuaccguuuuccuguaauagggagucccucggggcucuugguugaucuugguuaagcuggcugcuuccuuucuucucuuucuaugccucugguguuugcugugaauucacccuuggacucuaguguucucuucuauuugagguauuuuuauuccuaauuuuggcucuucuuucuggagaggguggcugucugguaucugucgucagccauuuucaaccagguaacugaguuuugaccaaguuggugaaaauuuaauauaaguuguuauaguguuaggacugcugagaucaaaugcaguguugugucacuuaauguuaagcaauugcgucauuguucuaacaucauagaguguacuuacacaaaccugaaucuaggcuauauugccauagucuauugcuccuaggcuauaaaccuauacaacauguuacuauacugaauacuguaggcaguuguaacacaaugguaaguauuuguguuucuaaacauaucuaaaccuagaaaagguacaauauuaaauacaauauaaaagauaaaaaauggcacaccuguauagggccacuuaccauaaauggagcuugugagucuggaaauugcucuggaugagucggugagugaaugugaaggcccaggacauuacuguacacugcuguagacuugauaaacacuguauucuuaggguacacuaaacuuauaaaaaauauuuuucuucaauaauaaaucaacuucagcuuacuguaacauuuuuacuuuacaaacuuaaauuucuaaaaaacuuucugacucuuguaauaauacucgaaacagcaacacauuauacagcuguacaaaaauauuuuuuccugauauucuuauuuuauaagcuuuuuuucuauuaauuaaaaauuuuuuuuuuuuuaccuuuuaacucuuuucuaaaaaaggaagacaugggggcugggcgcaguggcucaugccuguaauuccagcacuuugggaggccaaggcgagcacaucacuugagcccggaaguucaagaccagccuggguaauauggcaagacuccuucucugcaaaaaauagaaaaaucaguugggcaugguggugugcaccuguagucccaucuacuuaggaggcugaggugggagagucgauugagccuggaagauugagggugcagugagucgugauggcaccacugcacuacagccuaggcgacagaaaaacccuauauuaaaaaacaaacaaacaaaaaaaacaacgaagacaugaucacacacauuagccugggccuuuccuaagccuucacauucacucauuugauauuacugugcugugugguuuggauauaugagcccuccagaccucauguugaaauuugauccccaguguuggaggagaggccucaugggaaguauuugggccauggagguagaucccucgugaauagauuaaugcuauuccuuggaggugaggagugagugaauucucagucuuaauucccacaauaucugguuguuaaaaugagucuggccccuuccccuucuuucucuugcuuccucuuuugcccugugaucucugcacgugcuggcuccccuucacuuucugccgugagaggaagcagccugaggcccucagaaaaugcauuggugcuagugccaugcuucuuguguagcuugcagaacugcgagccaaauaaaccucuauucuuuauaaauuauccagccuuggguauuccuuuauagcaacacuaaaugguaguccauuuagacacacugucuuucacuucuacaucuugucucacuggaaaggucuucaggggcaauuaacaggcauggagccauaaugucuuaagauaacaaugcuuucuucuggaauaccuccugaaggaccugccugggguuuuuuuauagcuuacuuuucuuuaucaauagaaggauuauacucuauuuacucuaaaaauauaguaaauccauaaacuaguagcggaguuguuuuauuuucauuagcaaguauuaugugcuguacauaauuguugugugcuacacuuuuauuugacuagcagugcaguagguuuguuuauaccagcaucaccacaaacaugaauaaugcauugugcugugacauuacuaggugacuggaauuuuucaguuccgugaugaucucaugggaccaguguuguauaugcagccugucauugacugaaaugucauuaugcagugcauggcgguaguaugucuagcuguuaaacgucucuugugcuccuagacuucaguuuuauuauuagaaaggaccuuacuaauaauuuaauuuaacucuauuaacauuuuauagauggaaaaaucgagguucaaagaggauaagugacuugcccaggguucucuagguuguuagcaacucuaggacuagaaucaguuuuccagcuaaaucuaauguucuucccacacuaugucacaccuuccucccuucagucucguuccuugguggccuccugucuucuucauagcagucauaguuaucagaagggauucucauaacuccauuuguauccauuuuauuuaccccggcaacugcuucccuaucuccuauguugcuagcugauaggcacuggcauguaguaaaaacagggaaucgccauauuuccuaguccucagaggcuauuuuauaaucuuaacauuucuguuaagauuagaggcuuaacauuucuguuuuagauucacacgagaagaaucauugagaagccacuauucuugaaucuggagaacucaggagagaucagaucaguccuauuagguuagguccauccuggaauguuuguuaacuggcucuaaggggcauuuguucuguggauggauugggauggaaccaguuuuuggggucuuuccugauugagauccaccugacuagugcuguuucaucaaauaagccuccagagaaagaaaaguaaagugauaccuugacauaucuuuaacauguuuuaguuuaaugggauaagaucuguuuuuagauauaaggauuugugaauugaacagaauuauaguugaaagcaaagggaugagaggauuuuuauauagcaacaaugauaguaugaaauccaugcuauugcaaggacaacuguguuaugcuuauguuugugccugucucuucuacuagacugaagagggcagacaccaugucuuauuuaauuuuauaucuccaauguauaucuccuuguagacaauaaaguaugguugguugaaucaagaaucuuuucuucuuuaaaauucaagacugauguuaaauauuuugagccuucuugcgguuauucaucuuucugaagcuguccuccagguuaucuccagauuauuuaccucucugugaaguguaagcuaacugccucuacauuuuguuaucagucagguagcaggcauauacuauguuuaaaauguuguauuguaauauuaggugccauuguggcgagugugauuaugaucaauuuaguggggaugagauaagagagaaauacucagaacaacuuaaagaggaaguucuuacauuaaaaguuuagaauuuagaaaaacauacuaauacuugcaaauaguuacagaaguauuuaacaagcagaaauggaacuccucauuaccaguuuaaucucuaacagcauucuaggcacuauaaagaaacaguccucaucccaucucgguugacuuuuauuauuuacacuuuuaucucauagucagcuuucuggauauuuaaagagagaauaacacuagauuuaggccgggagcagugacuuacgccuguaaucccagcacuuugggaggccaaggugggcaaaucacuggggcccaggaguuugagaccagccuggccaacauggugaaacccugucucuaccaaaaaauacgaaaauuagccgggcaugguggcguguaccuguagucccagcuacucgggaggcugagauggaagauucacuugaaccuggaagguggagguugcagugagcugagauugugccacugcacuccagccugggugacagagugagaccugucucaaaaaaaaaaaacaaaaaaaacccacaacaacaacaaaaaaccccacuagauuuaaucuauacagcugauuccaggccaacagaaggacuuuuaguucuggaaauggaaaguuucuguuaaagaucaacuggaaauuucuuaaaauuucuucccagcaacaaccuggggggaaccaguggaauuuggaauuagauuugacaguuccuuaguacauauucuuuaaauaaagaagaaagggaauuaguucauauaauucuccuaccaccuuuauuuuuuuguuguugugcuuuaucugucuaucuaucuaaacgaggcucuuucuaccauccagggaaacuucuuucaauuuauucuuuuauauauauauauauaaaacaaaauguagaggcacuuagcuuacacuucaaagagaguuaaauaaucuggagauaaccuggaggacagcuucagaaagauaaauauauaaauauaaauauaaauauauauauuuauauaaauauauuuauauaaauauauauauuuauauaaaauauauuuauauaaauauauauaaauauauuuauaugaauauauauaaauuauaauuuauauaauuuuuauauguaauauauauaaauuauauuauauauauuuauauauuauguaaauauaauauauauauuuuuggauauauauauccuauauauauaaaauauauauauaauauauauauaaauaauauauauauauuuuuuuggagauggucucugucauccaggcuggagugcagugaugcaauaauagcuuacugcauccuugaacuccuggguucaagcagucuucugcuuggaauaucuaggaauucucuggaauaucuaggacuauaggcaugcaccaccaugcccagcuaauuuuuaaauuuuuuuuguagugauggggucuggcugugcugcccaggcugaucuccaacucuuaggcccaagugauccuccugcguuggccucccaaagugcugggauuacaggugugagccccugugucuggcugagccugguacuuuuagaaagagauuacaggcugggcgcgguggcucaugccuguaaucccagcacuuugggaggccgaggcagcagaucaccuaaggucaggaguccgagaccagccuggccaacauggugaaaccccgucucuacuaaaaaauaaaaaguaucugggcgugguggcagucaccuugaucccagcuacuugggaggcagcagcaggagaaucguuugaacccgggaggcagaggcugcagugagccgacaucgagccauugcacucaagccugggggacaagagcaagacuuuucucaaaaaaaaaaagaaaaaaaaaaggaaaagaaaaagagaauguaacuuuaaaaaucaaggucugcauuucuuucuucaacaaaauaucuuguacuugaaauuauuuauauaguccuuauaagauuaucuacuuguuucugauuauacacuuuaaucucaucuucuguauuaugcugacagcaucuucaccacaagggacuugccuuauuuuccaguucauacaaagaaggcacuagggauaaggcuuuaaagauacucaaaguccuuugccucuugaaacuuauagaggaauagagagaguuaacauaaaaauaauuucagugauaauugcuaugaaggaaaaaaaaaaggaagaguaacaguuugggagauagaaaguauugagagugcucuuuuggauaguggaugggaugcccuuucuggggaagugauauuuaagcagaaauuugaaugaaaagguuuagagaagaguguuucacugaaaggaguugcucuguaagggcucugaggcauugaacuagcuugguguguucauggaacauuuaucuuuguaucaccagacuuagcaguuguuucacucagaguuuguucaauugaauaaccuguaccugacuccccguaugucuaauaccaugccuuuguuuauuaguuuguuguuuccaaaguaaagugaacugggcuuuauauaaauuagcccaugacacaggucucauaaguaugaugcccuauuaacuugugcaaaucacauuuuuaugaaaguuguaauccuuauuuaaugucucauguuguuuagucaugccauuuuggauacauacacgugugugggugggugggugugugugugugcgcgcacacacgcagugggucugcuaccacaguguugguuccaacuugaucagcucucgucuauaaugaaugcuagacauacagcaaauuaaaacuaaauuaaaaacuauugcuagugacuaaugaccaaauacuguucagucugcucccagggcaucauuauagcugugcuugaauaauugaagaauaaacucacugauugccuaauacaucuguagauuugcccagagaccuuaaguugaagugacucugaaguggcgcuuguaguuagccccaggcacugcauguuggcacgccucauugauuugcuaaacuguauuguucuagguaggaauuaaugucaaaauuaaauaauugaacuuguguguauguguuuguauaacaguuccauaccagaaaaccaaauuuuauacucuacuuggcugaguuaaguuuuaguaauuuguuugaggcauucuuagaauaagcacaaaaccuauuaagaaauuucucuuagagagguaggcuugcuugguaaaucucagugaguuucauauagacuucauuauuguuuuuaaaaucaaccaugcaggcuuggcccuuacugcucacugaacuggauaccuacuguuuuuccacuagaucuguaucuaauuuaugguaaaaggaccacaaaaaauuauuucuauuuuggcaccuaacacuauuauaguuaagggucuuuuggcauuuccauuaaaacguuuucuuagagaaguuuauaacuuggcaguuuuacuuggcuuugggcugaaacauugcuguuuuuguccaaaagcaaauucuuccaucaaauuucauauaacugaaauugccuugguuuauaauguguggagggggaagggcuaucagaauaggucuuuuuuugauacucucacaagugcuucgauuauacaguagucuuguaugugauauuuauucuuauguuuuauucuuaccucaguaagaauuuauuuuuguuacacacaaugaauaaguucuggagagcuguuguauaacauagugccuguaguuaacaauaucguguugaguauuaaaaauuuguuaagaagguagauaccaggauagguguucuuaccacaaagcaaccaccaccaccacauuuggggcaugaggaaacuuuuggaggugauggaaauguuuauuaccuugaaugugguggugguuuuauggguauuugcauauguccaaacucaccaaauuguauacuuuaaauaugugcaguauaucaauuauaccucaauaaggcuguuuaagaaaauuuuuaaaaaugauuugaaauauuuugguaaaauaauucaucuccauggguuccugucuuuaaagaguuauaguacuauuauguauuuuaaaguuacuuuuggccaggcgugauggcucaugucuguaaucccagcacuuugggaggcugaggugggcagaucaccugagaucaagaguuugagaccagccuggccaacauggugaaaccccauuucuacuaaaaaaauauaaaaauuagccgggugugguggugcuugccucuaaucccagcuacucaggaggcugaggcaggagaaucgcuugaacuugggaggcugaggucgcagugagccaagauugcacagucuacuccagccugggcgacagagcaagacucugucucaaaaaauaaauaaauaaauaaauuuuuaaaaacuuacuuuuuaauuagcaacugcuguuauuuauuauaaaauuuaaaguacuuagugcguugacuauuauaugaaaggcuugaauuacauuaucuuaaaaaaauuaaauaaaauaagacuuuccuuggucugacuugcuauuauuuaaaacuuuaguaacucuuauaauuaaaguauaccuuacuuugagggacaaauccauuuccuuagaaaugaguuaagauucaucaguacuaguacacagaacugggucaauuauguuagccauuuacauuuucccauaauuuuacuuaucacucuguauccauaaaguauccuuucugucucuggagaauaucuuuagccugggauuuucuacaguuugcacaaguaguucagaaauguuugguaaauaaauuccaaggguuucuuugaaauuaguccugaagaagaggugcccauaaaaaucucuuuuuacauucuuuggcaugccuaagacugccuugcaacaguugucauagacaguaauucauauauaagguguuaaguucuuaacacauucaaagaagacuggugacucacugcccaagauaacaugguugaggcagcuccagcaguuugucgccuaagaaaauuacagaagaauguguuagagaaggcaaggugaucacuuuuacaguauuuuuuauuauugcucucauuauuuauuguuaguaauaauuacuauuauugccaacaacaagcuacuuuauuucuaaaaauuuacuuuugcaguuugcaauuccuuuaucuccagaccugaaggccaaauuuuaauugcacuguaauuuccaaucaaguaaccaugacaccagcuguucuugccaggcucuauucugugguagagggggaaccuguguucucuuuacaugguuaugcuggaaaguauauggauaaggcagggguccugccugaaguaaucccaggguauuuuuaauguccuuuaauugccauucaggauguaagucagacacaauugggucuggucacaguuuaggacuacugagcccuguuuauauaaaggugaauuuagcaaauaaaucugaagcuauuacuuauguacaauuuauuuuucuuuaacaucuauugauuucuaagcaaugugaaacuaguuccaguauacucuauguauuauaugucuucauuuuguuuuguuugugaucccuggauagcauuggcagugaggugggaggaggagauguaauugagaauuugacaagggccuugcuaccauaaucaaacugaaaccuuaucagacuuauuugaaguuuucaagaaguccgauuuucuugagguuugauaauguuaacagaugaaaaguauaugacguuaaguuuuaagucugucuuucuauguauuugccauaaaauucuguuuugcauugcuugggugauguaguugugaacauuuuaaauuuacaugcaaauuucauaguagucaucuuuccuucagguccaaggaaaguauggcagcagauaugccuucugucuuuugccuuggagggauuuugaccugaccugaagguagaagauuguuguuuuuuugcauuuagcuuagguuaccuacagggauaggaaagauguggauuucuuuuaaaagaguacuaagaauuuuaacauuaguaucugacaucuuuuugcuuugaguuauuauugacuguuaguuuugguuaucauaauuguuuaucuacuacagccucuaggaggacauuguaccuagggagauuuuaaaaaaucaaacuuaguaugaggccagaauacgaauaauuuuaucauuaauuacauuucauuuccccuaaugcuucuuaugugugagaguaguacuuguucuuaagugaccaacauauuuaauguacuauguccauauauuaaaagaauagaaacuagucuuggcagacacugaaauaguuaauuggcuuuuacagccaagauaguuuuauaaaacuuugugaaaauuaagaaacgggaagaaaaguauuuuucuaugcacuaauggcauauuuuauuaacccuuuaccuuaggcuauaacauuuuuuuuuuuugcagcauucuuucauuagauaagcagcuggaggaaggaggcuaguuaguuuacuguaauuguuaaauaucuacaaacauucagauaguuaaaauaauuauuuccauauaaaauccuggguagaggugagguuuuucuaaaaauaaaugauaauuuugagaaaggaauaagagcagcgacauaauucugacuuugagaccuguaaucuuugauagcaaacuuuuuuuguuuuuuuuugagacaaagucuuggucugcugcccaggcuggaguucaguggcgugaucucagcucacggcaaccuccgucucuuggguucagaugauucuccugccucuuccucccauguagcugggauuauaggcaugagcuaccaugcccggcuaauuuuuuauauuuuuacuagagacaugguuucaccguguuggccaggcuggccucgaacuccugaccucaggugaucugcccaccucggucucucaaaagugucgggauuauaggugugagccauggcgcccagccgcagacuuuuaaauacagcauuuagaaagguuugaugacaucuuauggucuuuaauuggacugaacuuuuacauucuuauuaguacacauauaaaaucaacagcuuuucaugauucggcauuuacaucuuaaauccugcacuuugcucuguuaggaaauagagcaacacuggauauuucaagcuaauaggaaaagucuacauuugauacagaaaaguuaccuuacgcaauauugaggagcuagugaacaaggguuagggggugggggugccagagaccagagcaugcaagaaugagagagagauuacauuguccucuuccauuuuaguugguaguuucuacugaaaacuguaaaguuuaacuuuuuggaauuguaacuauccaaagugggaauguaaacuauauugaacaaaauuuauuuagccuguuaaaaagucaaccuaaaacuaugguuaauuaguuuauauuauuacaucacuuuuaguagagacucaacaaucagugcagaguaagaggagcuauuaucaggugagcugacugcuacccauauggggcuuuaagauaaugaugaguuuaaauuuccucuuagagcuaagugagaauaaaacuggaggcaauaaauacucuuggccaaagccauuaaaugaaaaagcugggaauucuccagcucuugacuuaaauuguuuguuuaucagcuggcgccuagucuggagucaagagcuggagauuucuaucugugacagaacuuugaaacucuugcaggacacuuucauuucaacuuaagguaacuugaguuuauagcuuuggcuuuaaagauuacuaaugauuuacucauuuccuuaccauuuaaccagaguggacuuuuucccaggaagggaucuguguuuauuuagggccuuugucugcggagggauuaaaaggcagcccaccagcauugugaacuugauggucauaaaaggucaccaaaacacaccauaaaaacauucuuaccauggaauuaauuauacaguguaauuuuacaaagcaacuugguuacuccaucuuacccccucccccauauuuaaacauuucaacuuuuaaaaaguaaaucuuugguauaauuuugguuuaugaaaaaaauguuuuaugauguuuaaaugcugaggaaauugucaugugcauauguacaguuuaauugcuuaaaaaucuuaaaauuuuugaaaugaaaaugaucauuuauuguuaaacugugggaugaauaacuuguuugggaggagguuagaguagucagaagaguugguuaguauuucauagaacagcucaguuuccaaaaaccuaaguccagcuaagaauuuaucugugccaccagguggcauugcauccaaaccugcuaaugauaaaaggauuauaaaauauauuauuuuuuguuaaagauauaacgauuuuacuuuugaaguugacugaaaacuacaucugauaucaagguuaaguaucugcaaagaauugaaaagauuucuaaacucuaaauauuuguuuuuagguuguugauauuaaaacgaaaguaaaugaaaaugaaauauuuggaggggauugcuauuuuucauuuaguaaaauaagcauuuaacauuuggcuuuuuuuuuuuuuuuuuuuuuuuuuuuugcuugucuaaacacuggagaggggaauccagcguauaaaaauucucacaaauauuucaaauccccgccccccaccauguggcaagauuccaccccccucccugggucuuguaaaaaaaaaaaaaaaaaaagugucagcagguuuuacuguaugggaauuuuuaaaaagagggagaaaccucugaaaggugcaaguugguccuuuucacaagccuaacuaugagauucauuaggcaguucauguucaugucuuaaaagcuguuuuugggaaaguaaauucuugaguuuccuguacuguuuuucagggagucuuuauagucuuuugaaucagcucauuuuaaaacagugauaauguaaaaagcacaauaaaaaaaggcucauuauaaauuuuauaaaagugugauuuuuuucauuaaaauacguauucauguucuauuuuuaugaacccauaaauauaaguuaauaaacuguagcagaaacaauuaaauuacuuaauacagcuauccaggugauaggauauguugucagaauaaauaaagcucaguguauauucuauugauuuuuauucuuuuaaaaaauguauucaccaugcagagugauguuuaaugcuuagcuuugaucauuuagcaaaaagcuuagugcuacucauuuuauacucuugccucuucugaggcuucuuaaugugcacaaccuguuuuaagaaauguauauguuuucaaaguaaauguuugaccucccaccuugauguucccacuuaaaagcaaaacccuccccucccuuauauuuugaauaacuugaugagaauguguguuguacuaaaacuaaauauaugcacccuucaguauuaccaaaagagaccuuuugguuuuaaaaauuaggaaauuucacuuuugaaaguagucuagacaaagguacucaugacauuugacccugaaauuuuuacuuuuaaacuugaugcaacagucugcuucuuagcuuuguuguaugcuaauauuucuacuuauuuaacaucaaaaagcuguagagguuucucuuuauagauuaugccuguguucuggaauugccuccugcuguccaugaauugcuucuuggcuuguuguguuagaauuucucaccagggucuuuugugagcuauguagccaacauuaaaaaaaaaaaaaucaaauuugauagaguaaacuggacuaguaaaaauuauacuuacuauucauaauuauaauugagguuucuuggcucagcauaucaauuuuaugcaguaagaguaagcacauacaaaucucauguaaugauaugcauacauauaguugccuacaaugacuguuuuucuaguuauuucuauaauauuaaaaugauuuuuuugcugaaauuccagaaaucuaaaaacauugaaaaauaaugauaaugagaaaaacaauucuuacuuguuaggguauauguuauuuaguaaugaagcauuuagauuuuggauucucucauuucaguuggaaauaguauugguguaagugaguguugccaugggaaccuccacauagauauaaaaggcaauacugucuaaguggaggaggaggggcgauguacugaaauaccacuggccuaaaugaucuauuuuauguauguguguuggugugggggugagagcuaggaugaaaaggggagagaaaguacuacagaaaguaaauguuagcagucaaagcaauuuacucacacuuuuggauucuuuuagauagaaguguuuuaaagcucgaaaugugauucuuaauuauugguaucauuugcacacacuggggagucuuugcauaucuuauuuuuaauguacaguggaauauguuuaacuuacuugguuuuagauaaaauuuaauuuagugaaauuugagaguuaggauuucagucuuugaaauggcuuuauacauguuauuaaagauguuauauuuaauucuuuuuaaauaucugaaauuuagaaaaacugauuaggacacaguuaauguggcuuucaaagaaaagcuggcauuuuggcuuuauaguauuuuuaauacuagauuuuuaguaauuuucuauaaauauauaggcaaggaaacaaugacuuacuguaucugcauguguaauauuuuaugguuaaaaaaauaaagaaugaaaacaacaaaaccuaacauaaaaucuuuuuauaucccuuaggagcacauaaagauuguagagauagagaugauuagagaacaaccaauuuaacugcaugcaaaguaacauuuuuguuuuuuguauguuuagguuacaaaaaaacaaugaaauugugcccaaccugaguuagccugguaaaaugcagcagcaucaucauugcaguuuuaacacuauggauucugguugucagauacaaauauaaaaaaaagaagagauauuaacugacaaaaacuguuuaaacuuaccuuuuuagucaauccagagaaaaagcugccaagguaauaaaacauccagaaguuuuuaaguuaaaacgaguaauuuaaauuaaaaggggugagggggcaugagcaagcaagggagaagaaaaaaggggugaaaacgacaggcacuuugcuuccugggccuggcuguaucugauguaaauuaaccagcaguggggaguguauuguuuccaacuccacauaaacaaugcuggguaucucuuugggaaugggugggugcugggauggauggagguuguugagaagggaacuggcaagcagaguuuauaaucuauuaguggauuuuuuuuggcaugcgaaacauaguaggaaagaguaaauaaugagaaaguacguuugcauguaaaauugaucaagugaaaccuuaaaaugaugugaaauaauucauaauuguuagagaaugcuuauuugucaguaaucuucagguuuaaaaaaauuuuuuuuaaagacugacgccuuguaauguaaaacguucagcaaugaagauacccaguuuuaaguguacuuuuggcauaguauaucagcuuagcucuaaacauggcuucuaaaaacuaaaagacuaaggaaacuuguauuucuuugaaaaauagguaacaagagggaugaaaagucaaguuuauuuuuaaaaauaagagaaugaaaguaagagcuacaacauccauguuguuuuucuguuucaguuuuugccugcugcuuuuucuucccugcacucuuucuuggaauaaaaucugauagucuuaacggaguggaaagugugaaaaugcacacagccuuaucaauaaguagauucaaaacaucucuaaucaccuuaaaguuuuauagugcagaauuuucuagaagucaacugauuaauuaaguaccuuuugugugucaguuuaucacacuggguuguuucuguauuuuaaaacauuucauccuuauagcauccccaugaaaugcagauuauccucuuuuuuuuuuuuucagugaggaaguugagucucaggaaggcacaauaggacaauaugcaauuuuaagaauuagccugauuuagcaaaaauaagacauuuuagguagaggauuuucaauauuauugcaggagacuaauacauucaaguuuggaguuucuuuggguugcuagaauaacuaaaaggcuuugguuuguuucauuuaaaaacaaaauagagaaaaauacuuuuucuuguucuaucgauaucacaccauucaaugaccccacucccacacaauacccacaaucaaaauauagaaagaauuauuagcuaaccaaaaaaaguucacauagguaaucuaaaguaauuuuauuuuugguuuuaagugcuuuaaucuaguuaacuaaaggaacaaaaagggcaaacauguauaaacaagugaaaaccagaauuuuuaaccuucuaacauaauauccuucauaggucuuuuagcaauuggauuauuaaaaagccagaauaccuuauuuaguuauuaaucauaauaugaguacacaggacagcuuuacguauuuuccccuuuaccuuaaauuuuuaaauuuuuauuuuccaacauuacccaguuaaaugcacuuuuauaacuuuuuaaauacccaaaauugaccuuuacaaaauaucaaugagaauuucaguauucaacauuaaucacugauaagcuuuuuuuuagcacguuuauaguauagguauuuaacguuaauacaugauuaacaguguaucaagcuuauugcacaaucauaauaaaauacacuauucagugcuaauuaggcauugcaauuaucauuugguguuguacugaaagaauuauauugguaacugaugcuuuucaucuuguuaguauuuuuaaucccucucaauauauauaaucuuucaguaguuucaucaaaagaaaucuguuccaacaacuuuaaacagaggaccuucaagagugugagguguguguaauaguuuuaucuugaagagaacucagugaaagauacuuucuagauuauguuaaaaagauccaaucaaccggcccauacucaucaugauuuaacuuuuacaguuuuauacauagguuucauugaaggcuguaagaaaaucugauguuuauaacauuuuccuuugccaguguuugucugaauuuugcaaagaucaaguauccaaaguacgaaaugcuaguguauuuuuggaaaacaaaccaaaacccacuuacccaauagauuuuacauauucuaagaacgagaauucaguagucugguaagucuggcuucauaacucauagauuucuugcaccaaauaagauugucagcaguuuggaaagaagaguaaagaagaggcucuucuucuuacauugguguguucaaaaguaaaauauaaaccaguauuuuuguuacuauagcuuagagcacuaaagaagagccaucuaccaguuuccagauuguuuuagaaguagugucugaagaccuuuucauuucaacuuguucuuauucuaaagauuccuggcucguuauauacuaaauuguuucuagaaaugcuuacuagauagguugcugugaaaggaaagguuucgaaaaggaugaguagagaaaauuacuuuugaaaauauauucugacccucacccuuacugggauaaaguuccaagggaauaaggauuauugcuagccagaaaauugcccaacuagauagugaugaaaacuggaguuuagccaacucuuauuuuugugugauuuuacucuuuuccugugguugguuggauuggcaaagaccuuuaguggguuguuugauuauggcaggaccaaggucaaguuuagcuuugccugacuucaaugauguuaucuuuucaaaccaaaaugccuuaugauaaugagauucuucauuuaaaaaaaaaaaagaacaauucuugaucuuuaugcauguuuugagugauguguuuuuugaagauagaggcuguaacuuuaaaaggguagauuguuauauucuaggaaguaugcuaagugaacauaugacaguguuuucaugaaggagagaugauaugggaaaaccauagcaauaaaggugaagaaaaauaagaaaugugaaagaagacccauucuguuuuuguuguuuaagggagagaacucccugaccccgucaaaacauuuuagcaucugagaaauaagaaguuacuuaucucuguuacuucuuccauaucccauaguaacuuaaacuuugauuuuuuuuucccauuggcaacaaaaaugugauauagcauuccuuuuacuuaugucugaauuuugaauuuuuugugugauuauaagacaauauauacaauuauaaaggaccaacaaacauuuacuuacaauuuuccaugcaaaccuuuuuugaagaaaaaaaacuucccuuaaaaaaaaacugaauguuuuaaacaauugguauuugguuuuauuuguauuauuuuacuuucuguuguucagcuguaaucaauuuuuuuuuuuuuuuuuuuuuuuuuggagacagagucucgcugucacccaggcuggagugcaguggcgccaucugggcucacugcaagcuccgccucccggguucacgccauucuccugccucagccuccccaguagcugggacuacaggugccugccaccacgcccagcuaauuuuuuguauuuuuaguagaggugggguuucaccguguuagccaggaucgucucgaucuccugaccucgugaucagcccgccucggccucccaaagugcugggauuacaggcgugagccaccgcacccggccaucaauuuuuaaaacuaauuaaaaauugaaauacaaaggauuuaaaacaaaguuugggaagggaaauugaucuaauuggcucugcuauuuuucugcauuuucuauagaaauuccuuuaaaaaauguucuuucauuuuaauccuucuuuaaguucaaccuaaggaaugcauuugauaaacuuuuuuauuuggauccaaaauaacaacucugacggacuaauugguacauacaucauaugugaacacauuuuugauaugauguuugcuuucugaagggguccuuaauuauucccuuuccguaacgaacuaaaauuuuugaaugggagcaaucacauaucauuguaagauguucugcauuugacauagaugauuauguuacuguaugucgaguuugaauuguacucacuuuaugccucuugguggucauacuuuuucuuuuuuuuuucagugcucacucaguacauaaagcuuguaugggaaagaaguccuuguuuccugucuuuguugguauuuguagguuccuaaucuucuaagagucuugggauguagaucuguaccucaugacuaggguuggguaguuuuuauggugaggaagaggggaaaagauaguauugaagcaauuccugucuaggucugcaaagugcagauugcauuucucuugcagugguguuagguauauggcccuuuuuugggaaaguguuuggagaccuuuaucuuucucuguuuuguuguggcagauggaguuguccucugguauuuuugcuagguaugauaaauguuguacuaaaacugcuugguggaaguuuauucuggaaagauuacuguucguuucaguuuccugaagaaaauggaaucauaguauucaaaccauuaagcaaacaaguccacaagcagaccagcaauaauaauguguacuucuaauugaugcuugugauucuuauuccuucuuuaaaacaaagguuuaggaauaaaaaccaggauugauuauuaguuuugucuaaaauaaaacaaaugguagaaauagucaaacauuuuucuucauaacuucuagagagaaauaucuagauaaugaaggauugcccuuauuuuauaaaagaaaauaaaagcaaagaaguuaugugguucuuuuauauuccagaaauaaaauguucaauucucccauucauguagcauagcaaucuuuaguuuuauucugauuaguuugacuaauaguauuuuuagauaauuguguacuucuaauagcuuuuaugcagucuguaauuuaucuacacuuguguugaaagcuguuagccaccacuuaccuacuggauggaaauaaauuuuugauugauuaaauucucccaacaaauaaacuuguugcuaaaaacaaguaggagauucuaaucacauugcuuggcauuuagagacagaguuucuuucuucuuucuugggugauucccacugcagaugugcuuugacacaacugggaguaaauuuauagccugaacugagucuguggggugauucgcaaacuuuuauuauccuccaucucagcuauuugccauuaauauuuucuuauacuaauacagguaaucaaaauuugaucuuggaucugaaacgcccucuucaaauuccuuuauauuuuauuuucuaucuuauagguauucuuuccuucaguaguuaggagcaaaauaagauagcagcagcaucugcagucuuaagccccucuuuuuauugguguuggaggaaaguagugaacuaugaucaaaacaguaaguggucuuagugguaucuggaguccacucaugucuuugacuaugauuauggcaucugagauacaggaugcaaaggagucugguuugggggauucugguagugccucuuauagugguguagccucuguacccagcacauuauucuaagccugaaaauacaggauuauugacuccgagcaucaugauuguuuuuuuuuuuuuacugagucuaugggaagcucggagcuacacuuugguacccaauaauaaucaucguuuuccccuggccuucccucuuucugugugguuucuauuuucacuugugucuuuagcuuaaaaaauauuuauuuagucccuacuaucugguaggcacugagaauacaaugguauacaugagagaccugccuuccuuccuuuuagugcuuauagugcauauguuucugucaucuuacagauuaucucaaaauccuuuuuggaaguaaauauaugaauuauagggccaucagguuuuugugcuacgcugucucuuuuuaaaaucuuucucuauguacuuuuauuccugccuuaauuuuuauuuucuuugcuuauuuuuuccgauuuuuuaauaaaauuaagacucucuacaucuacuuuuuccuuaacacuugccuuaauauuuaaaaaaaguuuuuauugcauauauaugcauauacacacuuuuuuaaaaaacaaaugggauuuuuuugcaaauuacuuuuuuaaaauuucauauaucuuuucauauauacagcuugagcauaugaaaucugaaauuugaaaugcuccaaaucugaaacuuuuugaguacugacaugauguucaaaggaaaugcucauuggagcauuucagauuuuggauuuuuggauuugggaugcucagccaguaaguacaaugcagauauuccaacaucugaaagaaucuggaauccaaaacacuuuuggucccaagcauuuuagauaagggacauucagccuguaauaaauuuacuuuauacuuucaaauuacuacaaaauauuuuauuuuguaggcagacuucugcuauuacagaggcuacucugaauauucuugcagagauauuuucauguaaaugcaaauuuaucaguaggagaaauuuuaagaaaugauauuucuaggucaaagaguauguguguuuuaaauuuugguagauguugccagucuuuucaucaaaguuuuuacuuccaccaacaauguaggagaauguugugguccgaauguaucccccagaauucauguguuagaaacuuaauucccagugcaacagucuugggaacuuuugggaacuguuuagaucaugagggcucugcccuugugaauggauuaauaauguuagaaaagggcaugguggagggaguuugguccuuugguccuuuuuugccuuuaugcccccuucugccaugugaggacacagcaugccuccccuccagaggacacagcauucaaggugccuucuuggaggcagagcuggaacccucaccagacaacagaccugcuggcaccuugacuuggacuucuuagucucagaaaugugagaaauacuuuucuguucuuuauaaauuacccagugucagauguuuuguuguaggagcacaaaaggaaaaagagcauuuauucauacauuugcaacaaucuguuugggggaacugauacauuaucuuuacauuucuuuucuagucuaauaagaaguaaaaaauaguauagugugguuuugauuuucuuuucuuuuuuuccuccaaauuacgaucuuguuugagcauuuuaagaacauuuauuagccauuuauuugccuuuuuaaaaagugauugcuaauuccuguccuuuaugcguaauuuuauuagauuuauucauucagcagcuauuucuugaguacuuacaguuugccaggcacugugcuaggcauugaucuuuucuaauugguauguaugaguaucaaaugcucauucauuuauucaauaaauauuaucugucauauaccaaguacuagucuaggccugggaauauagcgguucacacacacacacacacacacacacacacacacacacacacacaccugcccuuauggaaauuacacuguauuuuuauuuauuuauuuauuuugagacagagucucuuucgccuaggcuggagugcagugucacaaucuaggcucacugccacggucuaggcucacugcaaccucugccucccagguucaaaugauucucaugccucagccuccugaguagcugggauuacaggcacguaccacaaugccuggcuaauuuuuguacuuuucauagagacggggguuuugucauguuggccaggcuggucucgaacuccuguccuccagcaaucugcccacuucagccucccacagugcugggauuauaggugugagccacugcgccuggcuggaaauuacauuuuaaugaguaugaauaugcguggggagauaaaaauguugcaaauauuuucugccaguuuguccuuucuuuauucaguuuaugauaauuuuuaaaauacagaagcuuggaauuaucauacaguugaguguaucagucuucuccuuuauggcuucugaguuugguguccuauccagaaaagguuuacugucacuaaguuuguaaaauuaaaaagaaauuuauguacaucuucuuuuaguuauuuugugauuucauuuuuaaaaacuuaaauuuuuuauuccuuugcaguuuauuuuaguugaaggggugagcguagaaaucuagauuacuuuuucuuuuaaaaauauauuuaaugaaagucuguuuuuuuacccuaauuucaaaugccccauuaauuucauacacucaguuccagcauguauuugggucuuuuucugagcucucuguugauaucucauuguugaguguuuccugaguaggacaacuuuccguugcuuuauuuuacugucuggaaggguaguugucuuucauugcucuuuuucccucgcucagaauuuuuuagacuacuuuugcuuguuuauuguuccaaagagacaugaaaaucauuuuaucauguuccucccaaaacauuguuaauauuuuuguugggauugcacugaauuuauggauuaauuuauggaaaauugauauauuuacacaacuaaaucuuucuauuuaagaauaagauauacucauugauuucuuuuugugugucucuuacuaggacuuuaaaguuuucuuuaggcugggugcaguggcucacgccuguaaucccagcacuuugggaggccaaggcggguggaucaccugaggucagaaguucgagaccagccugaccaauguggugaaaccucgucucuacuaaaaauacaaaauuagccaggcgugguggcucaugucuguaaucccagcuauucgggaggcugaggcaggagaaucaguugaacccaggaggaggagguugcagugagcugagauugugccacugcacuccagccggggcaacgagcgaaacucuguuucagaaaaaaaacaaaaaaacaaaaacaucuuuauguaacaaccuaaacauuucuucaacagcuuauuccaaagucuuuuuaucuuuguuguugcugguauuauuuuauuuauuuauuuauuuauuuauuuauuuauuuuuugagacggagucucgcucugucgcccaggcuggagugcaguggcgcaaucucggcucacugcaagcuccgccucccggguucauaccauucuccugucucuguugcugguauuguaaacugacuucucuuuuauuaaaaaaaaauuuccaucgauguuuauacauaugagagguauugauuucuauauauuaauuugaacucuacuuccuuuuugaauucucuuauucuacuaguuuuucaguugguucucuuugauuuucuaggucuaaaaaugaucauuuugugccuuuuuuuccuaaaucauauugccucuuuuuguaaguuuuaucucucuuucuuaacugguuauuaaacauuugguuaauacuuccagaauaauauugaauaauaguagugauaacaaguguccuugucauguuccugacauuaaugaaaaugcuuuuauugaguuaaucuuaaacacagugguagcuuugguuugaaggagguuuuugaaaaauuauguugaagaaauaucuuuuuuuuuaaauguauguuugcauuauucauuuccucaaccaauauuauguuucuaguaugagucaguuacugcauuggcccuggaaagugagcaaucagaauaggcacaaucccugcccuuggaacuuacagucugggggaacugauacagguugauuauugcuuagccaaaaugcuugggaccugaagcguuuuggauuuuggaguguuugcagaauacauacccggaugagcaucccuaguuugaaaauccaaaaugcuuuaaaaucuaaaucuuuuugagggcugacaugaugcucagaggaagugcucauuggagcauuucggauuucagauuuuuggacuggggauccuuucaaccuguauuaaucauauaaucauaaaaacuguaccauauuuugcccugugcuacagcaggguuacauugaaccauaggaguauuuaccuaagguggauuuucuuggaggucaggaaagucuuguuggaaaaaguaccauugauugugaccuuaaaggagaguaugaguuaacuaggcacagaggaagagcaugcugagcaccugguggcacauuuuaaacagggaaguaugguguuggaugaggcugaagagagagguugggcuggacuaucaagaccuuuuucaccauguuacuaauuuuguucauaugcuaaaaaccauugaaaguuuuaaguaaggagacagcauaaucagauuaggauuucuaaaagauuaugguagcuauaguguggaaaacauuuuagagacagggugugaguaaaagcugggagacaagugagaggcauuuguaguaguccaggcacacacggaugguagcuugagcuagagauauagauauagagaaaaguugucgcauguuuuuuuuuguuuguuuuccuaaaaguaccuuaaauuuaggcuuuacaagaagucagccuauaacauucaccaagaauaacucauaggaugaauggggccaggcgaagguguggcuuuugggauaaaaaauaaccaaguuggucugaguacuuuuuguuuuauuguuuuuauucucauccugcuauuucuucucaucuuuccuauuuugguuucugaccuaaaaauucagucucuuuucuucagauagucucuucguuaucuuaaacauucuuucauccagcaaacauuugaguaccucuuguaucaugcauucugcugagugcugaggaaaaagauaaauggacccucagggaccucaagaucaucauaauguauuaggugagacagaugcauauucauaaaaaacacauugcacuaaauguaacacacaaaaugaagcuguugauacauuugaggcaucauuuggaagccuuucuggaauaggugagguucaaauuauguuuuaaaagauuaauagagauuuuccaagugaggaaggggaaggcuguuuucaggcaaagggaauauagcauuuacaaagauacagaaaugugaaauaacacaauguuuuugcuuaaauauggaaguuugauauuucuggauuuuggcauuucugguuguaaauggagaggaaagugggaagagaugagauuagcucgauugacaagacacucacaugaagguucuucuagaaucacuguauucagaaaagcauuuacauugauugggggauauaaaaggcuagcaugagaaauuaacauagcaauguauuuagauuuuagaagcccacaacuccauuuaaaagaugcuguuuuuaccuagguuaacaaguaaauuguuaaacuaaguuucaaggggacagauuuaguuguacuuuuagaaaauacugucuuuauaaaugccuuacauuguguguauauguaaaugcuugcagauaaaauaaugaaaguuaaacaaaauaaugaaaguucccacgcucuucacugaaggcagucagaacuugugguggguuaggugauaauuuuuuuuuuuuuuuugagacggagucucgcucugucgcccaggcuggagugcaguggugugauuucggcucacugcaaccuccgccucccggguucacaccauucuucuaccucagccucccgaguagcugggacuacaggcaccugccacaacgcccggcuaauuuuuuguauuuuuaguagagucaggguuucacuguguuagccaggauggucucgaucuccugaccucgugauccgccugccuuggccucccaaagugcugggauuacaggcgugagccaccacgcccggccacaggugauaaucuuaagugagcugagagggcucagguccucaccaacuuaaaauuuacuucuaaggagagacuuggagagucucugagauucguagaguauuuuuuaaaugauguuuugaucguacccauuuaccuaauugaauuuauauggugccucaauuuagaaaaacugaaagcuaaacuucaaauuaaaaauguaagacuuagaugagaccauuugauaccaaaauaugaugguaucaguuaaguuccuuauaaaaagaaaaaucaacuuuucucuugcaguguuaauauuuuuccugagauccugucuccugccuuuaaccauuucucuguuauuugagggagauauucaaggauugaagcgaacagagucccucacugaaaggcuggaaauauaauuucacuuaaccguaccugguaguaucuucuuaaaugguauaagaaagugcuuuucuaauucaaaugauucaaauaauauuugcuaauauuaugaccaaacuuugaagaaagugauaguuguauuuuauaggauuaagugagauccuuaucugggacuaugacgggauuaacagauaccuucagaaugcuuuacagcugagguguauguagauagauguagagcucuaaagggauuagguggguggugguuaagcaauagcagaugucccuuuuaaaaucuucaaacuagaggucuguuaaguacagugcuuauuuuuugcugacuugguuccaugagaaaccuugauguuuuuuagugcuucugaaaguaucaagaagaaacuauucagaugguuuggaaauuuggggccuacucuuuuugcuuuguaaaauggacaguuuuggauaagcaggaaauucugacugaugggcagcagaacaauuaauugcaguauagaagugcauuagguauagugaaaagagcacuuacaugagaaaucugaacucagaucugaguucuuuuauuuccucuaucuguugugugacuuugggcaaauuaacuuuucugagucucaacuuuucuggguguaaauaaaagugaugggacuguuggugcugagucuaaaugcauugcuuauuuugagacuuaaaugaaaugauguaccauugaaucucuuggagugggcauauuccuuucucuaaugccauuuuuagggccugacuuuuugugaaaaucaaaugagauuuugguguuuucuuuuuuucucaccaaaauccuaaccucagggcugacuuuaucagaauguucuaauguaaucauuguggaaagauacacauuaguacuuacuugagaauguuguaacccaaaucagaacucuuacucugguucacaaaacaggacuucuagaacuuugagaagaggcaguuuggugugaugggacgaucacgggauuuggauucaggacuccaauguaggucacuuacuaguuguaugacuuggguauguucacauauacccaaaagucaaccacagagucuuugccacagaaaagguugcucagagaacauaacucucuucauuuuauauacagagaaguauuuccccaaauugccuuuuuacugauugucuuacaaucaaguacuugauuucaguuuuccuuuuaguuucuaccauacauuugaagacaguggaguuagaaucacuuucucugaugcauagugggcauauauccuaguuauuuaauaucucugugccuuucuacaucuguaaaauaggcauuauuauguaacacauaccucaaggguugauuucuuaagggucuagaaaagugucugauccacaguauguacugaauaguguuaauuacuccuauuguuauuaaaaucacuauuggaauuauuaaggggaaaaugugaauuucucauuuagucaauaagaauuugagagcuagcagcauaguuuaaggauaaauucuaguuacucguuuucuacuuauguauaaagauuugaaggaaaagguuuuauucacuauaaaaauuaaaacaaaaaaauuaagguuuuccuaauucaaauauaagcauuuuagugauuuuuaaaaauguaauagaagcauacuuacccuuuuuuguuaaucugaauuuuuaaguggaaauauaacaugcugauaaaaccauuuuauaacauaaaaauacacauuuucaauauaccuauauuaccuaauaaugccauucccacauuuuaaaauucauuccugugggauagcuauuugucccugcaaaugcagauaguuccuaauuuucauacauauuauucacauacuugagugaaauaguuugcuuucaguuuuaacuaguauaauuuaaaaaaacuguggucgggucucucaaaacauaagagauacugauuuuaaaaagugguuacaaaugaggcauuugaaaagcaauuccuaaacaauuggauuuuagggguuuaaggccaagcauauaggcacucuacuuuuucauuucugaucaagaacagaguuaaaaaguaaaaauaauuagagaauauaacacuuugugcuuuuagaguauugauugcucagauggaauugaggaaauuuuaguaauuucuagaagcaaaauuauagaguuaguaaaaucaucuuagcagagaauaagaugguuucaugauauauuuuaaaauacucuauacugggccaggugugguggcucaucccuguaauccuagcacuuugggaggcugaggcaggaggaucacuugaggccaggaguuagagaacagcaugggcaacacagcaagaccuugccucuacaagcaauuuuuaaaaucuuagcugggugugguggcauacaccuguaguccagcuacucgggaggcugaggcaggaggaucacuugagcccaggaguuagaggcuacagugagcuaugaucaugccacugcauuccauccugggugacagagugagaccguaucucuuaaacaaaagaaaauaaaaaauaaaaacuguuuaccaaaacuucuugccuuguauuuauccuggaccuccuuuccuuacacauuuuccaaguucacuuagcaaaugaagcaaaccaaaaaaaccaacaacccuccauuguccauaagcuuuaaaccugaaacaugguuacauuugacuugugccuggccagcagccuuuucauuuuuuuaguuuuguaaucaacaguuaacuguuauuuucagaguaaagauccuaaagauuugugcauuagaaacauuucuuggggacugauguccagauaucacuguguaaucccuauuuuagcuaaauuucuguugguauuuguaucauugcaugauucauaaacagacauuacuuauucccuuucucuucuaaacugcuauacucuacucauguuguggaaacugcuauuuugaaaguguaacuacugauggacucuuuuucucuuaccuccucaguugauuaaaaugucucauuuuaugaugagguugcuugggugagaaucuuggaauuacagcuguaccuuggaauuuuuucucaguugucuugaauggauuagaaaugguuaaauggcuucaaauacucaucucaaccuucaaaucacugauggguuaaaaugaguuauugaaaaagaacgaaaccuccuaauuguagcgguaaggcgagaggguauaggcaguggggagaggaagugcauguguuugggaguggcaugacuagggcuagagggugcaggggaggggagaauguagacaaggcagugagcuaucucacaugaacuuuaccuaaugaaauuucuugucacuucuuuucuuuuuauuuaaaaguagguauuaguaaaagcuacuacagcauuuucuccuaauaauucauuuuuuuuuguccaauauaacuuguuauaccagauuuuccuuucggucauuaagauuuaaauuucauauuucugguaguaaaaucaucugucaaguguggggaaucugcagcuuuaacaccacuucaugucugauuagaagguuuucuuuugcaauuaauuuuccucucagcucuuuguggagaacaguagcccacugcagagagguuagaauacuguggacuuuggcuguucaucuuuaaugauacaaggagguagcaaagcaagaauaaaugagguacuuuuuggugagcaaaaaaugugaacugucagugugagaucgguucuaggagcaguuagccagcaguaauagggcacacuugaguaauugaauuugcauaacaaggcuugcugaagagaucugacaggcauagagauuugucuagcuagagagcuccagauggacgugaccaugcagcagcuggguggcacguugcgcagcauggacggcaccgcccagacuggcagcuggacccuggcgacugcagggcuguggcacgccagcugguggcuucugacagccaguggcccuguuagagagccuuuuuauaauggccugucaggguacuguaccugcagggacuggcaggagaaugucacaagucaccagugaggguuguuaagcugaauaaaucugucccaggaaagucgagguggucacuguuggaaccacaaagcuaacgccucacaagagugauuucccuccuuuucuaagagugcuguccucuuuucuuuuugucuccuccuccuccuccuccuuuuucuucuucucugucucuccccuuccccuuccccuucauuucuggucaagaacagaguuaaaaaguaaaaauaauuagagaauauaacacuuuaugcuuuuagaguauugauugcucagauggaauugaggaaauuuuaauuucuagaagcaaaauuauaguuaguaaaaucgucuuagcagagaauaagaugguuucaugauauauuuuauucaugaaaccaucuuuaaucaaccccuuccccucccucccucccuuccuuccuucuuuccuuccuuccuucucucucucccugucucucuuucucucuuucuuuuuuuccacauugcucuacacugcaguugcucuggauuauuguaauauucuuaaaaccuugaaacccaguugccaaacuuccugagagcucauguagacuaucaguuggaauggaaagaauguuccuuuuuguguuuuccuucuguuuuugcauauuugcaacaagggcauauuugcuuuuguagaaauuggugauaaucuaauaauuuauauugaauguauuguucauagggaaaaaacauuuuuaaagaauaaauugcagagaaaaugcgugaacugaugugaagucaguuuguuaagucaccucccccuucacguccagguggacugaauuuauguggaggaauuacauaaccaccuaucuucuuagauuagaauagaauagcauggaagaaggccagcuuucugccugcuguuaauaaaguuuacaucuguguucuuaaauugagaauuuugccaucuuauaacauuuucuccaaaaaaauuuaaaaaaaaaucauguaccuagaaaauacaaccauuuuuaagggcaggaaaacucuagauucauuuuucaguaaacagaaaacuuaaauguuacaagccccaaacucacucacuuuuaggacaaccaaaaucuggugaaaccaauuuauacacuuccuuugagugugugucauugacauuugaucuguuucucuuugaaucgucuuacaaaugcuuuuuacuuuuucauucuuuuccuaauuauuucucauaucaucccagugaauuagacaggguaaauaauaucuucauuuugaugagaugaaaugugagccacaaugaaggcaaauauauguagugucuccuggcuaaucuggggccacccagucuuuguggcagucaggaugguucugaaaaguuauuauguuuaacccucagauuggcaaagauacaaaagucuaguccuagcauagauagggaagauguguagccucauagacugcuuuggugauguaaguuauuugaaccaacucagagaacaguuugguaguaugcaucaaaaacuuuuauacauacacacacgugugugcauauacauacacauacauacacacguguguauauaugcacacgugugugcacaugcaaauauacacacguacuuuuauacauacauaugugugugcauauauacacacauauauacauauauaaaaaacaugcacaccuguauguauguauaaaagcucuauauuuauaggucuauaaauuuaccuaguaauuuauguauguauauuuuuacaaauauauauaauuuaccaaguaauuccacuuuaagaauuuauccccccagaguaagaauauguguaaagauuuaacuauaagaauguacuuuuagcauuguuaagaacauugguucucaguguacccuccauggaucccuaggaggccauaaagugaaaauuauuuuucuaauaauagaguaauaauacucauggugcaaaaggaauggugaguaaaacugcugcccuuagcaagagucaagacagugguaucguauucuuaacagcuacacauaaagcauuccacuuaauguuccuugaugaagcauuaaaaauuauuaauuuuauuaaaucuuaauguugaguacaugucuuuuguauauuuuauuugauguaauggaaaauaugccccaaacgauccugcuacaguugguauugggguugucuugagaaguauuuaggugauuguuugaguugccagcuauacuaucugcauuuuuguggaacaccauuuuuauuucaaagaauaacaagacaucuuauagaaagaaaaaagugagucuuacuucaaggaaagcaacugaggguauuuguaaccaaugauaaaacuggaucuuucaaguaaaaauuagaauuuuggaaaacuuguaucugaccauaugaacuuaacaacuuucuaauccuuaaagacuuuugugaaaagauuguuggugcaguuaaagaaugugaguuucuguuacuguauacugggaauuuagaauaucugcauaacuaacugaacgaguauuuuccaauugaccguuguaugauguuaccaaauuaugccuagauaaaagaugcaaaguacaaaauagagggauagauuuuaauguaacauaguauaaaaaguucuuuccacauugcaacaagccuuuaagaaaccaccauuugucagguuuggguuuaauauaaaagaaggauauccacaauuaucugaaaaaguuauuaaaauucucucuuacuuuuuuaaacugcauuaucuauaugaggucagcuuuucuuaauuucaaccaaaacaacauauaucugcuucugcauuuaaucuacuaugaaaauccagcugucuucuauuaagccagaacuaaagagauuugaaaaauugucaagcagugcuacucuucucacuaaauuuuguugcuuguuauuuuucccaaaauauguuaauauguauuagguuuaugauugauguuuuuaagucaauugagaaauguuuuuaaaauuuguuuugauuucuaauacaguaaauaccaauagauauaauccacauaaacaaaagcuuuuguguccucaaaaauauuuaaagaguauaaagaaauccuaagaccaaaaaguuuaagaaccacugguuuaaaaugaugaggccuuggaaauaacccaaauguccaauaagggagaauugauuaaauuacauauuaugaaucagugauguagauaaauaucugacaugaaaauauuuuacaguguuguguuaguaguaaaagcagguuuugaaacaauacaugaauuaaugucacaaaaaguuauuaauauauaauaugcuuaauauuguauucuauaauaccuagguauuagguagcuuuuucuugaaaaggaagguagaaaaaguuuuuuugaaguugucauaacaguauuagacugcaucaugagauacuguuuccuucuggcuuuuggugaagguauuugcuuuuuacuaguuuuguaacauuggccaagucugaauuuuguucuccuuacuuuaaaaaucagaucaagguuguuaacagaguaagcuguucaauguauuuuacuucccucuaacaucuccuuagcuuuuaaaauucuguauaauagcgguguaucugugacaauuaaugcuuaauaaagcuucccuugaagucaaaauaagggucuuuugaaaacaagaacacaucuuguaaauaucaucuuauuucugugaaaaaaaaguuuuguggaauaauagcuguaauacagaaaguaaauuaucaucaugcagaugcuuauugguaaagauagguaagguagcuuaugauuauacacuaaguacuaggccagguauuuuguaaaauugcugaguacuuuacagacaucaucucauuuaauccucacaaaagcccugugaggucaguacuguuguuauccccauuuuacugauguggaaauggucucauaaagagguuaaagaauuuguccuacucauuuguagagguagagcuaauucagacaugagccuggcugacuguaagguuugugcuuuuuauccauauaauaaucuccaaccaaagagaaaugaaaaaccaccauacggacacaaagagcagcucgcccagcuucuuacucugggaaaccagauugauuuugagguggggagaagccuggauaaagucccauacacuuagaucucuaggccauaaagauucauuccacagcauucaauuagaauaauguaaauauguaaaacccagugccugguauaucauaauuauuuaguaagugggagugaacuauuacaauaauucuacgacuaagccagaaauuagguuccuguucauaaaauaggaaaagaaaaaaauucccauagucccacaaucccuuacuugaaacucuuggagucaugugaguuuuguuuuagaauuauagcaagguaauauguauauuuaccauaugcuauguaacauccccagcagagaccagggcagcccccuguaaucaaaacaccaacaauuucugcaaugaaauauaugaauauucacacuaagcagaagaaaugaagacuauagccuuaaaucaguucagguaaaguuuugcugccaaaugagugaagaaaaacucuuuugcauuucagagcuuauuguauaagaguugaagggaagggauuguguacuuguaaagcauacaacaacauuucaaggagaauaaagaagcaauuacuuuacuaaguugaauagacaagugauaguucuguucaaaagagacuguuaauccuaagucaaagcaugaagucuuuuuggccucugauuucaaaugcuaauaauuacauccaaagagagaaaacaagcaucucuuauuuuaucuucuuucaaauaaguaugcgucacuuuaaaugaaguuggggacuaaaaucaaguacuauauuuuuuuucuagaggaucuguguuuaucaaagaaaacacaagaagcuaaauccauuugaauuggguuuuuuuuuuguagauuccuuuuuguaauagaaucucauuuuuuuaaaaugagaauggaaaaaugauauucuguaugguggucuuuaagugcugaaggauccacagagucuucugaacuuugaaagaaacuaaguuuggccacuccugagcaaaaguaaucuagaaaaagcgauaaguauauaaggugauggauauguuaauuagcuugauuuaaucauugcacaauguauacauuuaucgaaauauguuguauaucauaaaucuauaaaauuuuuaucaauuaaaccuuaauaaauuuggaggagaaaaggaaaucuaccuuccauccuuccguaaaaggaauugaauaauucuaaaggaagggaauuucaaauuuuaggaagauaagcaauuauaguugauggcaguaccuguuguagauaaaacugaagcagaauaauuaaacaccugcuucuuuaucucuacccucuucauguccuagcuuccuucccuacugguuuauauuccaccguacaugauuacacauccucagcuuccucguucuuccuuccucuauugaauuugaccccaccccuggucaaauccaacuguucauuugcucugcauuggcccuugaguagcugaacaugguuggaguaaauggaugaccauguuggucuggcuugaauuuuaaauuaaugaucacuaaucccaaguuggcccuuagggcugcuugacaguuccccuucauuuccuuaguccauucauucuuuuccaucaccuaaacaauuauuucacaccuucucuugucucuaugccucugguauccucacgcagugucagcugaugaccuuuccuuuuuacuuucacugagaauagacacagucgugaaagaacuuccacaugaucgccuaccccuuaaccugcaugcauuuguaugcauguacucugccuauccuccuguuagaauuggccaagcagcaguggucucugaagucagccuuucuacuucugcuuugaucuccaccucucuuaccuucuuccccauuaaaucaauuucuaggaguuguuccuuaauagguaguugagauugagaaccacucugcuagaauguaaacuccacagaccaaagauuuguucucuugcucauugcuguauucucaaugccuguaacaauacauaauccaauaguaggcacucagucuuguguuuaauggauagaugagugaauggauaaaugaacaaaugaaucuuucugguaaaaaagauauaaauugcaguacaagcucugaagagcuuaauaaauaaucuuuccuuguguuuuaugaucaaauuggagcuaaacuguucaucuuacaauguucauuuaaagaguuuucugcugauuuacuguaacuauccucaccugaaaacuuuuccuagcauuuuuaugcacacaguccuaguuaucuggauuuuuguuguuguuguuguuauugggaacugagauuuuucugauuucuaagugguuaagcuuugcuuuucaaaugaauuucucugguggcaguuucacaagugaauagaucuguacaaauccagaacuguucauuuuacucauuacugcuacuuggaagaccugaguucaacugccugcuccaucacuuuuucucacugaagugaaucugggcaugauucuuguauugagaaaugccuaguauagucucaauauaauugauugcauuucuuucauuaaaaucaggggaaacauguuuguuuccuugacaccuguguuucaugaaaaaucguagaaaacagccacauguauuuuaauuuaguucuauaucucuuuucccuuaauccuaauuuguagaaguguggcuguucaaacagacucucauguauuuugaaauacaugcagugcgguuuuuguaugggagcaaguacuauggauuuucuugggcuauaacuuaguagcauggcaguagguuauagaaccaguccaugaauccugcaguucuuacuaaugugagucaaaugguauuaugguaaagauaccucgcugcuuuuuugguggcuguguuuuuauuuguaggacaacccuaaaauagaacucagcuaggucauuucuaaacguaauguugugguggauaccccagaacaaacaccauuaaugugguuagucauuuacuuggaaagcuauugccagggcaaacucagagccacuagagacagaaagcacauaaguaaaccugcuuguuaaaguggagauacagaguaacucagcaauguaauaauacgaaguaaugguuaaguauucaguuuauagaaauuugacucagauguuucaauaaaauaucuguuuuuguaaaucaaaagauaacuaccuucauugguauuugggaccaaaguuuuuccuccuucacuuucugcccuuuuggaagacacaguaaaaauagaauucaugaaacauuucuaaauaauggguguauagagauucucuuuaugugugguaucagugcucugcuauguaauuauuuguuauauuuuaaauuucaauuuauguguucucucuugcccccuucagccccgugccacauaauuuuuguuuuugguggaaccauucagccuuaaauacuuuuaguauauaucgucugagaauagggacauaacuccaaaacuacuaucacacccaagaaauuugacuuugauucagugccaucuaauauauaacccauauucaaauuuucucaguugucccccaaauaacuggauuuucuaauuuucuuugauccagcaucuaauaaaaguucauauguuacauuuaguuguuuuguuucuucaucuuucuuuaaucuaaaacaguucccaugcccucccuuuaaaaauaaaaauaaucuaucuugacauuucuggagucuagaccaguuauuuuaugaaauguuccucauucuugauuugucugauuauuuucuuacuguuaauuuuagguuaaaucuuucugguuaccauauagagucugauuauuuuuuaagaaguguaguauucaguuauagagaaucuugacuuguucugccugcuugcaccugcuuuucuuagaguccuaaccucucaacucaggugcaaggaagcagaguuugacuacuuuuguggguacugaagaccuagcuuauuguaacaacaaaaaaaaaugugguuuuauuuuuaguaaaaaucaguguccaauaugcgcucuaaauauaaucugguuauuuuugaaauuuauguuaagaaguaagaauuuggcugggcgcgguggcucacaucuguaauccuggcacuucaggaggccgagacaggcggauugccugaguuccggaguuugagacuagccuaggcaacauggugaaacccugucucuacuaaaauacaaaaaaaaucagccaggugugguggugggcgccuguaaucucagcuaucaggagucugaggcaugagaauugcuugaaccugggaggcggagguugcagugagcugagaucgugccacugcacuccagcuugcgcaacaaagcgaaacugucucaaaaaaaaaaaaaaucuaaacauugaacuuuagaaccaaaaugaaaucuuacuguaacccuaauguacaauacuaagaaaacaaauauuuucauugacauauugaacuuauaaaauaauguaucuucaaaaaaaagauucucuuaguuuuaacaaauauucaugcuuaaguaaugucuucagcuccacauuuucagaacccuauuaacucucacuuagcaaaauuagcauacugaacucucuaaacuauuuaaugauuugauuuauauauguucauucuaaugaacaauggaugcuaauaacaguauucugugaggaguaagguuuuuuuugaggucagcaguguuuagauuaaucagguugacauuucuugcuggugggucaugaacuguugauaauagcauuaaauggugauucaguuguugcagaagguacaacucauuauccagcuacuauauuaaaucauuacagaaacaauuggcacuccacacccauguguucugcagcaaugguacaucagggaaguauauuuguuucuuuuauuuacaucucaaauuuuuuuggaggcuuaccuacauucuuaaaggaugcuacagcauugccacuacuuuagggaacgaggaugauuaucuugacugauuuggggggaugaagggauauauaauccuuuuaauaacacacccaaagucuucucuuuauauugcgagccuuucugaaaccuuguuuucauaaugaguguaccuggguugcaaguaauaaaaacaaauauauuuauggauuuuuaaauuggguuuaaauuuaacauaaauuauuauuacaaggauaugggucuuuuaaaaagauuuguauucauuuuaagagagaaaugaugcuuggccaggcacaguggcucaugccgguaaucccagcacuuugggaggccgaggucggcagaucaccugaggucaggaguucaagaccagcauggccaacauggagaaaccccaucuccacuaaaaauaaaaaauaagucaggugugguggcgcaugccuguaaucccagcuaccugggaggaugagguaggagaauugcuugaacccgggaggcggagguuguggugagccgaaaucaugccacugcccuucagccugggcaacaagagcgaaacuccaucucaaaaaaaaaaaaaagagagaaaugaugcuuggaaaguucacaaaugugcuguagaaguaauuucuuccgaaaggucauuguuauagaaaucucuuuaagaaaaauuuaagagaugagcuggauuuguuuuuuacaguuguuaaucuauugccuuuuaagauaaaccuuaguaauuugguaugcauugaaucagaaauuguuggugucuuugaauuuuaaaaucaaguauguuuucagugugucccguguguauaggcagugaauagauaguagcaugacaauuguauuaauguugauuucauuucuuauuggauaguaaagaauuagugaagucaguuucuaauuauuaauaaaauaccccaaacacccagccccacgguuucacaaauaggugcucgaucauaauuuguuaaugaaugugugacacuuggguagaagcaggagagcuuuuuggcauuuuguauuugccagaauauacuuuaaggagcuaaguauaggaaaaaggaauauuucccuuuauaaugaaaaggaauauuaacaucuucaaaguaauugccuuauuuaggguaaauagguucuucaaaucuaugcugacucuuuaagagaaacaauauagcauuggaaaauuaugggccacuagaggucacuguuuaguaaucaacuuuuaaugaaccagaacagucaggagagccaauaaauuacaguguggauuuuucuaauuaugaauucauauuuaaucauucaaugacaaguuaacuuuggaaaugguuuuguguacuuugcauaugugguuaugcuaaugcacuauuauauuucucugauguuggcccuccaucauuagaauagaacauugccaaaggcuuuguuauauaaucuuaauuacuaauuaugagacauaauuaaccuuguuaccgccuccacauccacacaguuuuuggaaauaaaguuuuacucuaaauaacaauuacuuuuaagugaacauagguguaaugguuaugaucaguuccuccuccucccucaugucuugucuuccugcuucauucuugguuuccguugcucccaucccuuucucugcugucuuauuucuuuccuucccuccuuuggauuccuuuuccacuuuauuuugucagugauugaauguuucuucucaagcuuuccagccuugauucaaugaguagaagaaugugacuuuuacugcauauguuaaaguaauccuagggugggcaacuugagcugagccaaccagcagugcaaaggaagauuguaugcauauaagcaagcaugcugcugcugcuguugcugcgagcagauggcugucuucaggcuguccagcccagaauccauucaggaaaaagcagauuuccguacuuacaugauaaaaacuguuuuccuccuuacaggcuaggcuaguugcucaagaggaggccucaugaucuuagggaaaaaacaacaugugcacauguguuuccuuuuuuugaaaacagcccugugcauuauuucuuagaaagcaggcacaucacaccauugcucggacuuccucuacuucuugcugcuuuuaccaucccugcugcuaugccacugcuauacaguuauauccaccucacuguucugagauuucagucugcccaagauauacuucugauaaauuguucagaaacuuucucugguuccugaugcucacccaguccagcccagucuuccuucucagccugccauucaaggcucuccacacucuggauccaacuuacuuuuccauucuuauuuucugcuacuucuuuccacaugccuuaaauucuaaccaaacuggacuauucacuaauucuuaaauauuuaccuuauuuacucaagucccaauguagaugccaccuccugugaucucuccuuagguaaaagucacccucccugugaagcaccaugacagguuagggucucaccuacauuguaauuacuguauaccuauguucucagcuacacuguaaguccagagauucuugacaaauaaaucaagagugcuaaaauuuccaauuaaaaaaccuauuuggcagaguaucuggcuuucuaauuuuauucugggaaaaguaaaauaauuuuauaaugcuaagguuuguaauauuagggaaggucaugggauauccuagaacucucaucuacaaaagauaagauaagccuuuguccaauaaguugagcucugucugaacacauaagaauaguagucagcuugcccuucucgauuaccugcuuuauaauaucacugggaauacaaacaguucucuauuaaaucuccuaaaugagaggaaaauguauuuuauaauuuaaaaugguauguucauuuuguauguacauagcucuauuuugaagaaauugaguuuuguuaaaacagucuuuugcuuauaacagcuccagauugcuuguguuuugguaaaaauaagagauguggaagauacauggauuuugaacuugaacuauauuuugggggcucuuuucaaguauuaguuccaguggcugaguacaguauguaaauuucauuauuauuagagggggaggugugcauaaccacuuuuuuucucuauuagagcagcaauaauaaaguuuugcaugucugaaccuaucuauguacuuaguuaugacagaagcuaacuugcaagcuuguuuguuuacaaauaaaaaagguaaagaguuaccuguuuggaguuuggaauguacuuuccuuggaaaaaauauuuucuaauauauuuaggucccuauuauuuucaaccucacauauauugagaauaucccuaaauuauaacacaauuagcaucauauuucugugggaaaugauuucagagauucuucgugggauaccagccccuccuauccuauccuuugaggaaaaaaaaaaucaccugcuaucucuuccuccccuuuucuaagcugugggaucugaaauuuucucuggggauucaccugcuuuuccaaaauuccaacuaucuaauuucuaaagagauuuucuaacucuguauuuccaucacagacuuuucugauuucuggaucugcauuuuuauuuauuggacuccuucaaucaagcucauuuuuggagucaaacuuuuucauuucaguaaaaccagcucuagcucuugguccucuauaguauauuacaauuucaguuuuucuaaucuuuuagguucaaauucugaaaguagcacuguccaauagaaauguaauauaagccacauguguaauuuaaaauuuuuuaguagucacauuagaaaaguaauaagaaacacaggugaggauaauuucaggaauacauuuuauuuaacccaguauaucaaaaacauaauuucaacauguaaucaauauaaaauuuauucagauacuucacauuuuuucauacuaagucuuugaaauauguguguuuuacacuuaaagcacaucugaaugugaacuagcuauauuuuaaguucucagcagccacauguugcuaguagcuacucugugggacaggacacagccuuagagagucugccgcuacauuuuucucuuagccagugacauauucugguucugcacuaccugucaaaguuuguuaaauacaugcaaggaaauuuacagaauuuuucucguuccuuuuuuccuauacuucuuccacuccuguuuuuagaauaaugcauauaucagccacuuuguuagaauaagucauggucuuugcucucaagaagcucauacucuagucuagucuagacgaugucuaaucagugagaugggcauggaaaaagauacuguguuacaguauggaucgguaauugccauaacagagauauaaagaaguuccaugauaagacgaugauguaguuagggucauccacauuuaccagaucugauugcuaggcaguugcuuuccugaagaaguaauccauguuuaccauguauuauggggcuggaugaggacauuccaagaagagauaguauucaaaguugagaauuagaaaagggcauggcauguuugaagauuaaaugagagucaguguaucuggaguuuuguuuguucuaaauucagcuacuuacaauuuucugcacaaauucccuacuuuuuucgccuuuaugcguuugcuuuugcagaucacuuuacacagaauuucuuucucugucccuagucguuucuuaccaguauauauaaucuuaaucaucuuucauggcccauauugaucugaucuuuuuagugaagcuucuuuuacucuucuguuguaguuuuaugccccaaaugaaugugauauuucucuucuuggaauuuugaacauuuuaacuuuuguaugacaauauuuuguguauuaaaguuaauuuuauaaugcaguaauagucuggcucaccaaaucaaauucuuaauuugagcaagaauugcauauuaauuauuuuuguauacccugaagagcugagaguggguuccuuguauacagaagauauucaguaaauacuugauucguggauaauaaauauuuuuaugagauauuuaaaacaaaagcacaaaauugaagugaucuagagauuucaaguaccuaauguuucuuguagauuacuuucauggaaagucuucauuaacaugauugacugcuguauguaguuggaugaaauuucuugauuucauuuguaaaaauagaugucauaaaagcaacauucugcuguaauaaugaaggugcuaaugguaaagaugaaaccuguuuuauuaugagaaaacaguuaaaaguaucuuggcauaaaaauacaauggaaaucacucuuuacuuugacauuuaaggaccuguuuuguuucuuuacauagccaucuacugcuucuggcaauaugguagacuagguauauuaaaauacccugcugcuauaaaauaccgguggcuggauaaauuacaauaaauguacuuuuaaaugcacuuuacauuucucauuagagaauggagaucuucagugaccaaauaaucgaguaguaaucugaaauaagaauaauaaauaaagccagaagcucuggcugaccuggaagcaaaugcugauuccagaaaacaggggcucuggacguuaacauuugugaguaaaacaaucaugggguaauggaaaccuaggcccuaugcucacacaaagugagaaagccaacccuuaggccccaacaaagccaaaugcccaaagaggccauaacuucugggagaaaggguguucuauggaucguaagccugcuaguuaaagaaucuaacuaggaaaucugucugucuaugcugguuacagguugagaaauaaaguauauuaguuucuccugaaucuuuacaauaguagcucugaauuuaugggcauagaguucaaauuuaaauuacucauccaauugggaagauacucaaccaauaauuaaauuuaagaccuuaauuugguagggcuagaacuugucauccauagaagaauaaaaauucuuucuggagaaaaucauccuuaauccaggaaucuuagaacucauaaauaucaaguacaauaaauguaagcucacaguuaaaaaaaaauuaccagacacaaagggagacaggucaccagacaagccaacagaaacaaaaauauucaaucucuacgaacuguagauacugauguuuccaaaacagaguaugaaaugacuauacauaaaacauuuaaagaaauaaaagauagccuggagcaguggcucaugccuguagucccagcacuuuggguggcugaggcaaguggaucaccugaggucaggaguuugagaccagccugaccaacauggagaaauccugucucuacuaaaaauacaagaaaauuagccgggcaugguggcacaugccuguaaucccagcuacucgggagucugaggcaggagaaucacuugaaccugggaggcagagguugcaguagaccaagaucacaccauugcacuccagcuugggcaacgagagcaaaacuccgucucaaaaaaaaauaaaaauaaaagauagauugaaaaugaauaaggauccagaaaaugucagaaaugaccgaauuuagaaaaaucauugaaauuuaaaaauuaauagauaaaugguauaugggagcagaagagagagaauuaguaaaugagauaucuaaagaaauaacccaaagguacuacagaaagaguuggaaauggaaaauaugaaagaaaaguugagacaugaauagaaagcuagaaagaaaaaguuaugcaugcaucuaauuggaguucuagauagaaugggaagagaguggucaacaugaugauaucugagaauuuuucagaauugacauaaacccacagaaacaggaaggacaauguauaucaaauaggaguuuaaauuuuuuuaaaaaagaaaucuuacuaaauacaugauaguaaaacuacgcaguaccaaauacaaacguguaaagcagcugggaaaaaaagacacauuaccuauaaaagaacaauacagacugauaccauacuuucuuuuuacuccccccaccgcccccagcauuauugagguauaauuuauauacaguaaaauuuaccuguuugaaguguagagauugaugaauuuggacaacuauauauagucguguaaccgucaucacguuuaaggcagaggggaguuucuaucacuccagaaacuccccgcaugcuuuuuuguagucaguuccuuccucagcccuagguaaacacugauuugcuuucugauaccauaguuuugccucuucuagaauaucguguaaaaauaucauguaaauaucauguacauaugcauguagaauucauacaauagguagccuuuuguguuaauagcagaccuccuaagaacaacugaagccagaaaacaguagaacaauaucaucaaaauacaaguaacugucaccuuagaauuugcauccaacagaaccaagaaugauaguagguuccaguugugguuaagaugaaguaaauauacuguccuuucucuccuacugaaugugucuaaaaaccuugggcagagugccuggagaagcugucugaggacucugaaagguaaaugauagcaaauagacuggagaaggaaaauagaacuuuuaaguacaaaagcucuggcaaugaguuuccuggauccuuuccccacuuuuuguaucucccagucugaauucaaagacagcaugaauccuaggacugugcacaggugcaaacaacaagaauuccaagggaaauuucugauccaaggagcaggaagagaggcucuaugagacagagaaaguggaagaaaugcucugucuuguuuuucuucccucccagcucugccauaugauccucucuucugaaccugcaguuuugugguggcagcagcagccaaccagacacuuaaaaauccaagggaagugaauccucucugaucagaggaacuaugguccaaacaguguagaaugauuccuauugcuuuuuucuuuuuuuaauucucuugcuguuuggccccagagacagaucuaguugcaggaaguacaagacuuucuagucagaggaccggguggcagugggggauggaggugggguaguagagugucagagaguggggcccuucacagauaagagggagcucauaaagggaccgcaugauguuauguaugaacuucugggcccacccuugagccauacaacauagaucugacccuaaacagcauaccaaguagcugugggauagauagcccacccagauaucaggcuggcuccuggcugaugcacaucuaggacagauucaaauacauccuguucuucauagaauuggagcaagacccagagucucauagcaucuuauaucccaaauguucaugauaugauacaaaauuacuugacacaaaaagaaccaggaaagucugauuaagucucaagggaagagacaagauaccaacccugagauuacccagauguuuuauauuaggcagugauuuuaaaacagcuguuauaaccaugcuuuaagaaauaauaaucucaguuaagaaaaagaagcuauaaaaaagaaccaaauggaaauuuuauaacuggaaaauacaauaauuagaaauuugaagaaaaucacuggauauguucaaaagcagagugcuugugacaaagaaaagagucaguggauuuggagacagaaauuacaugaauggaaauuaucuaaucagacuaaaagaagaagacuguaagaaaauggacagagccuugggauccccugagauaauaccaagaaauaucuaacauuugugccaguggaguuucauacagagaugagugugguacaaaaaaaaaaauuuggaaaaaaaaaaagguggcugaaagcuucccaaguuuagugaaagacaaacuuagagguuuaagaagcucagugagccccaaauacaauaaagaaaucuaugcccagauuaucauaaacuacuaaaaaccagacacauagaaaaaauguuggcugggugcuggcucacgccuguaaucccagcacuuugggagacuaaaguggguggaucacuugaagucaggaguuugagaccagccuggccaacguggugaaacccugucacuauuaaaauacaaaaaaauuuaaaaaaaaauuagcugggccugguggcagucaccuguaaucccaccuacuugggaggccgaggcaugagaauuggcuaaacccuggaggcgaagguugcagugagcugagaucauaccacuguacuccaaccagggugacagagagagacucucugucucaaaaaaauaaaaggcuauuuaaagaaauaaaauuguuugagaucagcuagaaaaaaaaaugaugcauuacaggggaacaaugauugcaacaacuucagaaaaaaacauguaggccaaaaggccaguggaauaacauuuuugaagcacugaaaccagaauuuuauaugugacaaaaauaugcuucaggaaugaagaugaaauagagauauucacagguaaaggaaaacucagaaaaauuaucuccaguugaucugcuuuaccaaaaaaaggauaaaggaacuucuucagguaaaaggaaacugauaccagagagaacuauagaacugcaggaaagaagagaaacagaaauuguaagcauuuggauaaauacaguauuuuuucuacuuuuaaguucuuaaaaauaugugugaugguugugauuaaaaauuaccaaugccccuugacuuacagugggauuacaucccaguaacuccugcauaaguugaaaauauuguaaguugaaugugcauuuucaacuuaggauggguuuaucuagauguagccccauggaaaaucaaggaguguacugaaugcauauggcuuuuguaccaauguaaagucaaaaaaaaucguaaggcaaacuaagucgaaggccaucuguaaaacauugguggaauuuucuauauauguaaauguaauacagaugacaacuauaauauuaaaggcaguaauaguaaauuuucuacauuucacuugaugugguaaaauauuaauuuucaauggacaugaaaacuuuaguauguauauuguaaucccuaggucagucacacacgugugcacgcacgcacacacacacccuauacaaagaugcaauagauaaaauggaauaucaaagaaauauucaaauacuguaaugcagaagaaggugggaaaggagaaagagaggaacuaaaaacauaguggacaagcagaaaauaaacuaguagacuuaaauccaaaccuaucaauacuaacauuaaauguaaaugaccuaaauacaccaacuaaaaggcacgauauuaucagauuggauuuaaaaaagagaccaaaauguguuuacaagcaauccacuuuaaauauaaugauguagguagauuaaaaguauagaaaaagauauaccauguaaauacuagucaaaacaaagagcaaggaaaauuaccaaagguauagaaggacauuacauaaugauaagagucaauucaccaagaagacacuaacaguccuaaauuuguagguaccuaauaauagagcuucaaaauacaugaaauaaaaacuagcagaaugaaaaggagaaaugaacaaauccacaauuauuauuggagacuucaacacuucucucucaguaauggauaugacaaguagacagaaaaaucaacaacaauauaaaagaauugagcaacaucgucaaucaaaugaaccuaauugacauguauagaacacucuaugcagcaacagcagaaaacacaugcuacuucagugcacauuuaccaagauggaugguauccuggaucaaaaccacccuuaacaauuugaaaagaacuagaauuaaacaaaauguauucuuuaaucauaaagauuuaaacuagaaaccaguaacauauauauggagauuuacuccucaaauauuuggaaauugaauaacacauuccuaaguaaucuaugggucaaagaggaaaugucaagggauauuagaaaauauuuugaacugaacaaaaauauaaauacaacauauuuguaggaugcuccuaaagcagugcuuggaaggaaauuuauaaaauuaaaugcuuguauuagaaaaggagucucauaucaguaauuuaaguucuauugugagaaacuagaaaaagaaaaguaaaauaaaaccaaagcaaauagaauaaaggaaauaauaaagaacaaauuaaugaaauuggaaacagaaaaacauuaaagaaaaucaauaaaacccaaggcugcuacuuuugaaaagccagccuaaccaaaaaauaagacacaaauuaccagugucaggaauggagcacuguaaggaacucaauugacauaaauuuugcaguguaaaugaaauggaccauuuuuuuuuugagagccacaaacuacuaaaaauuauuuaaaaagaaauuaaagaaugaauuuguaguuaaaaacuuucugaaaaagaaaaacagaagccuagauguuuuuuugugaugaauucuaccacauuucuucuuauuuaaagaaauagcaguucuacacaauuucuucuagaaaacuggaagaguaugcaguauuucccaacucauuuuuugagaccaguguuacacugauacuaaaaccagauaaacuauaagacuaguacagauuaguauucuuuauacuguacacauaaaaauucugaucaacauauuaagaaauugaaucagcaauacauaaaaagaacaauacagccaugugggauuuaucuuagaaugcaaaucuuguucaacugaaaucagucuuuguaauauuaauagucuaaagaagacuugaugcuaauauccauauguauauauauguauacagaauauaauguauguaugacauauagaugacauauaucuguaugucagaauucaacauccauucaugauaaaagcucucagcaaacuaggaauagaagggaacuuccuaaaacugauaaaggcauguacuaaaacaaaaacaaccuauagcuaacguuauacuuuguagugaaagacuaaaugcuuucccccugagaucagacaacacaggauaucuacucucacugcuuagucucucacuagaaaucuuagccaguacaauaaaguaagaaaaauaaaaagaaauaaaacuauucauauucacaaaugacaugauuguccauguagaaaaguucaaggagucuacaaguaaaugcuuauaaacaguaaaugaguuuccuaaggucauagaacacaaggucaacauacagaaauucaucauauuucucuauacuagcaaucaacauugguguuuuaagauauagaguuuauuauuaagcagguauagugaggccaacagaucaggacaccacuaccauugagaagauaguuuauuacuuacaguucccaagaggaggggccgugucacaccacacaaggccauauggggaugcaucagggucgaucaggaggcagaaggaacagaaggaaaacgugggcaagagccuuuguugugguuuccacaugaaagaauggaugaggcaggguaagcaggcuuaggcuuggcuaguuugaauaauuucagcaguuuugggguguaggggcuaucucuaagugucugguacuuggcccuggggugauuagagcagagaaauaguggcuuggagcauaagagcucuauaaugcagguaguuggggaugugagcuuuagauugguugguuugcauaugaaaggcacgcuuaaagguuagucuuuuacucucucuaggaauugauuagcccugggagggguagucucuccaggaucagcaagggcccagauuucaaaacaucagaaauaaauuaaaaggcauaauuaaugcaauugguaacugacauuuaaaacauuauuauuuacauuuguuucaaaaacuaaauuacuugcuauaaaucuaaaugugcagaacaugugaaaacuacaaaaguugaugaaagaaguuaaagaagaccuaaauaaaugaaguguacuguguucauggauugauggauuugaagacucuguguaguaaagaugucaauuucccccaauuuagcacuauuacuuuuuauugcaucuauagagaaauugacauuaauuuuauauggaaaaacaaaauaacuaaaauaaccaaagcaauuuugaaugugauuaauaaaguuggagaagucacauuacucaauuuucauacuuacuucaaagcuauacuaauaaaaugugguauuagugaaagacauagagaucagugaaacagaagagaguuuaaaauaagacucgugaauguuuuuguuuuuugacaaaugugcaaaggcaauucagggagaagggauggucuuuucgacaaaugauaaacaauucuacauauauuaagaaaaaaagguuguugaucuauagcucacaucuuauauaaaaaauaacucaaaaugagcuaaauguaaaacuuacagaagaaaauauaugagaaaauccuucuggccuuggguuuggaaaaaauucugugauauggcacccaaagcauaauucauaaaaaauaauugauaaauuguacuuuaugaaaauuaacggccaggcacgguggcucacgccuguaaucccagcacuuugggaggcugaggcgggcagaucacaaggucaggagaucaagaccauccuggcuaacauggugaaaccccaucucuacuaaaaauacaaaaaauuagcugggugugguggcaggugccuguagucucagcuacuugggaggcugaggcaggagaauggcgugaauccgggaggcagagcuuacagugagccgagaucgugccacugcacuccagccugggcgacagagccagacuccaucucaaaaaaaaaaaaaaaagaaaauuaacaaacuucuccucugcuaaaacacuguuaagaggcugaaaagacaagcugcagccuaagagaaauguugcaaacuacauguucaaccaaagccauguagccagaauguauaaacauuucucaaaagucaacaauaaaacaaccaacucaauuagaaaaugagcaaaagauuucaacagacaugucaccaaagaaaauacaugguuggcaaauaagcacaugaaaagaugcuugacaucauuaccauuaacaaaauucaaacuaaaaccacagugaaauaccaguacacaucauuuauagaauggcuacagcaacuuuuaaaauacaacaguuuaagugcugaugagaauauggagcaacuggaaugcucauauuccuaguggagaugcaaaauagcacaaccacuuuggaaaacaauuuggaagcuuuucauaaaguuaaacauacacuuaucuaaguuuccagcaauccuaccucucgguaaaccuucaugcuagccuggauaaaugaaaacuuguguacacacaaaaaccuguaccugaauucaugauccacuaaaacugaaaacgacuuaaaaauccuucaaugggugaauggauaaacaaaccguguaaccuccauacagggaauauuacucagcaauauaaagggauaugcugcugauacccacaauaacagguaacccaaaggcauuguaugagugaaagaagucagugugaaagguuauauucuaugauuauguucauauaacauccuggaaaggcaaaaccgugggaaugaacaacagauaguaggaucaggaguuggagaaggcaagaggguuugaccacaaagggguagcaugagagaacuucugggggugagagaauuauuucguauccucacugaugauggugguugaaugaauguauacuugcuaaaacuuguagaacuuuacacacacauaaaauuuaauuuuacagcaugauaauuucaaaauaaaaaaaggaaugaugauuaaacauagacauuuucaguaaacaaagacugauaaaauuuaacaccaagagauguacauuaaaagaacaucuaaagguuauccuuugauccuaaaggauccuaaagggaagucugagauaugaaaagaaauggcaaaggcugagugugguggcucauacccauaaucucagcacuuugguaggccaagacaggacgaucacuugaucccggaaguuugagaccacccugggcaacauagcuaagcauugguggcuugugccuguggucccagcuacucaggaggcugagguaggaggaucacuugaaccagggagguugagacugcaguaagucaugauugcaccacugcacaucagugugggcaacagagcaagauccugucucaauuuuaaagagagaaaugauaaacaagaaauguaaacacagaauuugaauuuaaauggucuauaagauuggguaauuuaaauuauuuggauaaaucugaaaauaucuaaauaaaaauaaaauauaaauuguggaauuaaagaacuaaaauacugaacagaaguaaugugugagcaaggaaugucuaaaggucuucuguucuaugaaagauagaucaagauuugauuaacuuuucaguuuaacuucaaguaugcauggugaaauuuugaaaacaauaaaaauaaaguauauuauuuccaaaccaguaaaggaaaaaagaaaacagaaacaacuccugaaucaauuuaaaaaacaagaaaggaggggaaauaaaaaucacauagaggaaaagcacaaaguaaaauaguaggaaaaaauggauuaaauguacccaauuaaagacagauuuuuaucauguuggauuuuugaaaacuccugcugaaucuuauuuauaagacacacaccccuaaaacauaaagacucagaaaauauaaguaucuuuuucuuacauaccaugcaaauuccaaucaaaagaaauauggauuuacuaauaucuaauaaauggguuaauuaauuaaauguaacaguucuuaagauuaaaaagcacuguuagggauaaagaggaucauuacuaauuaaaaggcuuaaaaagauaugacaauguaaacguguauguauuguaccuaauaaccucagaaauguauaaagcaaaaaauuguagaaccacaagaagaaauuuauaaaugucuacugucacagugggaccuuucaguauacuucucucaguugaugaucaaacaacaaaaauauugguaaauauauagacuugaauaaauuugaucagguggacacauguagaaccucauauccagcaauugaagaaauguauuucucaagacacaucaaaaaauuauuaauaauugaccacacaauaggccaugaagcaagucuccagcaucaaugaaucuguaucuuauagacugcauucuuugacuacauuguugacuacaaugcaauguaauuaguaguaaaaauacaauuaaaaccuauacauuuaaaauuuagaaucacauuucuaaagaauuuauuuuuuuuagucaaauaagucauauaagaaaaaauguuagaacucaacaguaaugaaaauccuguauauuaaacugggaugcagcugcagcaggacuuuuaagaaacugagaaugcaaguuuugaguggaauuugaaaauauaaggggcaaggugaguauuagaaaacuuaaauuuuuuccaauauaaaguacacagugaaaacuaaaaugaacucaacaagaagugaauaacccaguuuaaaaauggacaaaggauuugaacagacauuuccccaaagaagauacacagaugacuaauaagcacaugaaaauaugcucuacaucacuaaccauuagggaagggcaaaucaaaaccacaaagagauuacacugaacacucaugagaauggcuacuauuaaaacaacaaauagaaaacaagugguguugaggauguggagaaauuagaacccuuuugcacuguugguaggaauguaaaauagugcaaccacuguggaaaaugauauuggugguucugcaaaaaauuaaacauguaauuaccauaugauccagcaauuuuacuucuggguauaugcccaaagaauugaaagcacauauguucauagcagcaguacucauaguaaccaaaagguggaaacaacccaaauguccaucaguggauaaauggacaaacaaaaugugguauaugcacguaauggaauguuauugagacaguauucucaagguuaaagaacaaaaugcagcucuuugcucuuuuuaagaaauaccugaaacaaaauuauauuaaaggcuaacaauaaaagaagaaacaacgauauauuuauuuuggguacaauauacacuacucaggugacaggugcucuaaaaucucagacuucaccacuauacaauucauccauguaaccaaaaaccauuuguaccccaaaaguuaaugaaauaaaaaauauuuaaaauaaaugaauaaaaggcugagugcaguggcucacacccguaaucccagcaccaugggaagcagagacagguggaucacuugaggccaggaguucaagaccagccuggccaacauggcgaaaccccgucucuacuaaaaauacaaaaaauuaggcgugguggugcacgccuguaaucccugcuacuuggaagguugagacaggagaaucgcuugaaccuaggcagugaagguugcagugagcugagaucucaccacugcacuccagccugggcaacagagcaagacucuguuaucaaaauaauaauaauagaaauguaaacaagauuugauggcaacaucauauuacagaaacuaaaacuuagggcagaauuugugaugaacagggaugucuuauaguggaacaaaacugcacaacuugugaagaggaaacaaaauuaugcacuuuuaugcauacagcauuauuauauaucagugaauacauaaaggcaaaaucuuuagaaauuuacgaguuugauuuaaaacuacaguuauauuggacauuuauaauaguucucucagcauuugacagaucaaaaugacaacacauauaaaaguaauuaacagugaugcuuaguuuaauagaauacuacaaauagagaauauacuuucuuaucacauuuccauggggagaacuggccacagauaaaacguuuaaagauucagaaauagaaaauccugucauauucccuaaucacaagggcauauauaguuuuugugauucccuacucauaggguuuuuuuguuauuguuguuuuuugagacagagucuugcucugucaccuaggcugggcugcucugcaguggagugaucauaccucacugcagccucaaccuccugggcucaagugaugcuucugcuucagccuccuaagaagcugggacuguagguuugggccaccacaccuggcuaauuuucuuuauuuuuuaaauuuuuucuagagaugagaucuugcuuuuuugcuuaagcuggucucgaacuccuggccucaagcaaucccccugccuuggucucauaaaaugcugacauuauaggcaugagccacugugcccagccuaaauacaguuuuaagcugugguuuuggguugauuugugggcucccaaaauucauauguugaaauccuuaacccaaguaucucagaauaugaccaucuuggagauacgguccucacaaagguaaugaaguuaaagugaggucauuaaggugggccuuaauuuaauaugauuguucuccuuacaaaaaggggaaauuuagacacacacauaaaaggaagaugaugggaagacacagggagaaaacagucauccacaaaccaaagagaaaauccugaaacagauccuucccucacagccauccaaaggaaccaauccugccaacaccuuaaucugagacuucuagccuccaggacugucagacaguaaauuucuguuguuuaagccacccaguuugugguacuuuguuaugauggcccuggcaaacuaauacagcuaccauuucaaacuugaaaauauucugcuggauaguuuuaagaucagagaaguuuuaagcuaaaauaaaugaaaaugagaacauuuuacauaaaaaauaugagggcuccuccuuuccugaaugcgauuuggcccccuuauaaagcuaaaacuguggaagagauuuuauagacuaaaugcuuguguuuuguuuuguuuuuguuuuuuguuuuugagacugggucuugcucugugguccaggcuggagugcuggagugaauauggcucacuacagccucaaccuccuggacucaagcaauccucuugccucagccuccuauguagcugggaccgcagguggauugcuugagcuuaggaguuugagaccaacuggcaaauggcaagacgccaucucuacaaaaaaauacaaaaaaguagcuggguguggucaugccugucuguggucccagcuauuugggaggcugaggugggaggauugcucgagccugggaguuggagguugcagugagucgagauuguaccaccacacuccagccagggugaccgagcgagacccuguccccccaaaaaauggaaaauaagcagauccucuaaaacucaauaaacuagaauaaaacaaauauaaaucuauuuaaauaagaagagaaaugugacaaaugugguaauuggaauuaauuaggaaauuaguuaacaacaagaaaaauagagucauugaauaaaaccaagaacuggucuuucagaagacaaaucuuuaagaaguuucaccaagaaaaauagaaaccauaagcaucaagaauaagauaagagauugcacacagauauggaugaaauaaggaauuauaaguuugugggcagaaaaauggaaaguccagaagaaauaggugauuuucuagaaaaaaauguuaccaaaauugauucaagaagagguaaacacaugaguaaacuuccaacgaccagagauauucagacagccauuacuaagaaggaacaaaguaaagaugguuuuaaaagacaaaucuuauguagucuucaaguaauacuuaguucuuguauauugugcuacgguuugaauguguccucuccaaaauucagguguuaauacuuacuggccaauguaaagauauuaagagguggggucuuuaagaggugauuaggucaugaggguuccuccuuuccugaaugggauuaggcccccuuauaagaagcuuaauggagggauuuuguucugcuugcccuucugucuucugccaugugaagacacaauguuccuccccucuggaggggauacagcaacaagcugccaucuuggaaacagagagcagcccucaccagacaacugaaccuguuggugccuugaucuuggacuucccagccuccaaaacugugaaaaaauacauuucugcucuuuauaaauuucccagucugugauauucugugauaggagcacaaaacagacuaagacaauauguaacuauauaauauaguuuaauauuauucuugguucugaggucuagaauaguacuuaacaaauuuaacaagaaauguguaagaccuauaugaggaagaugacaaaacuauaaaggcaaaauaagaucugaauaaauggagacaccacuuaucugcuuggaaaagcauguaaacauguccauucucuugagauaauauauaaauuguaaugcaaaaccguguuauuucuuaaaaaaaaaaccuuaagcucaucugggagaauaaguaaauaaaaaaugccaauuuuuuuuuuuuuccuuuuuagacagggucucacucuguuguucaggcuggagugcaguggugugaacaugccucgcuauagccucaaccuccuaggcucaagugauccuccugccucagccuccugaguagcuaggaccacaggcauguguuaccauguucagcuaauuuuaaaaauuuuugucaagacagggucucaccauguugcacaggcagguuuccugggcucaggcucuauccucuucuauccuccuuuauccucuauccuccugccuuggccucccaaauauuauaggcaccugcccaaaaaaauuuuuuaauaagacaauuaggacuccauaaauaucagaacacaguauaaaguuacagugauuaaaacagcaucauauuuguucaagaacagacagacugggagacagaguuaaguccccaaacagaccuuuguauguauagguacuuagaaucugaguaaggcaaucagaucaguggggaaaugaauucuuuaauaaauuguguuaggacaauucauuguggggagcagaucccuacuucaccccauacacugaaaauaaauagcagauggauuaaauaacugauuguuuuaaaaaauguguaagaaggccaaagaaaugucuaagagaauucuuucaaaaucuuagaaugaggaaaaccuucugaagcaagacaaauaauaaaaaaccauuaaaaaauuaacagauccaagaauugaaaacacacacacaucuuugugacaaaaagaaaaguuaaaaggcaacaacagacugagggaaauuauuugcaaaauauauaacagaguagacauaaaaucuauaauuaacaagaaaaagaccaagaaucaggagaaaaguaaagaaacaugauaggcaguuuacugaagaggaaacccagugaacuauguaaaaagauacucgacuuuucuagaggacacagaaugacuaucguguaucaagcauugcuuauguagucuuucacaguccugucgaagcagauauuauuaacaagugagaaaacugagucuuagaauuaguaacuuaugguggacguuuuuucaaauacuguaauuuaucaaaguggaauguuuuuugcauuaaguuaaaauccuuucuguauucucuaauucacgacuaucuuuaaauuuuguuuucagaauacacuugaagguguuuauuuaguaugccccuugaagagaaagggcaaggaaagaaaugcaguuggcuacccuugaucaugugacccuaacagguuaagcuuucaggacacacacuugcaugcauauauauuugacuugagaagauagacaugauuuuuacgaggauuuguuucuguucuacuuuggcaaauacugcaugaaucaugucucuagauuuugacuggcuggguacuuuuuuuauaugccugaacuucuugacauaguauugaauugucuuucaagugauccaaauaaauaauacauaucuauacauuuauaucacuguaaauuuggaaaugcugccauaaguggguaaugguaacaucauaacugaauggacaugcaggagaccaauuuggggucuauuugaggagaggguagggggacaaaagguguuuggacauguugaauucauugugcuucugagggccaguaguaagaauuagcugauagauaguugaaauuuugacucuagacuuggaacugacaaguugagucuugucuuuguacucaguguucuacugaaacaaguuguauguagucaggagguggguuguauuaagggcugaggagggagaaggccauuauccauaauagguuuauguauuuggcuuagucuuuauuuaaaaaaaaaaaaaaaaaaaaaguagagcaagaaauguuccuuuugcugugauugguucucaugaaaccggaagaacaguucuccccacuuaaauuaccaccauuaagcagugguugccuuuaucacauauacagaauucuguaaaaauuuuauuccaagguuuuaguccuugaaguagaccaaaaauaaaauaauuuuuaaacuacuucccagaggaguguuuuucugcucaauaaggaaacagucacauggcauucaaacucuauacaagcaguacuguguccuuuguccucacgcaaaucugguuaguuaccuuuccuuaauguuauguuaaugcaccaucagaaaugguugcaaaaggcuaugcauuggcugaggggcuaccaagaauggcagaguggaccauacucaacucauuguaggaguuggcacccucuucaacuguaccccaaccccaaaauaugagaguccacauuuucaagggauuuucacaugaaagagauaauuccugguuagccaaguguagcuuauuagcacagccuucucuuaaucuuuaguuuucugcuguccccaguuuucuacuguuugcugccggguuaucaucuugccuuuugcuuauuucuucuuacucucuucccucucuccucugacagccauuacuucuguauaccuacccucaaaguuauaacagaacucaugugaauaaucaguucucuuuaaaauagagggcacaugauuauuaugccuguuuuucuucucaagcaaacuagacagggaauagggaugggaggauacccagaagggugugguauuggugguaauuggauuacugagaauuugguuauuggccuuguuuuacuuugugauuguuaaugcugaaugaaaggaugcaugugaaacuuacaggaaaauagccaacuccaaucacagaaauguuacaaaccacguguugccuaaagaaaguaaaauagaaggacauaaugauuacaagcuauuuggcuuuuuuuuccucuuauuuggcuuuuaaaaaugacuuuuggcugggcgcgguggcucgcgccuguaaucucagcacuuugggaggcugaggcaaguggaucaccugaggucaggaguucgagaccagccuggccaacauggugaaacccugucucuacuaaaaauacaaaaauuagccagcugugguagugggcgccuguaaucccagcuacucaggaggcugaggcaggagaaucacuugaacccgggagguggagguugcagugagcugggaucgcaccacuguacuccagccuaggcaaaaagagcgaaacuccauaaacacaaacaaacauacaaacccagcuacuugggaggcugaggcaggagaaucgcuugaaugcaggaggcagagguuguagugagccaagaucacacccuuguacuacagccugggcgacaagagcaaaacuccaucucaaauaaauaguaaaaauaaaaaugacuuuuaaagcugaaagauacguuauuugcaagacggaguuuuaaaaaucauauucuccaggggcauuaaguuaacugucuuugugcuccagcuauuuagcuuucaggaguuuaguguuuuauuguaaaccgacauugugcaccaucuugaucugaggugaaugccaaggaauugcuuuuuaaagugauuuuuagaauaaaagaaaaccauuucaucucugauuugcccucccuuuaaaaaccccacucugcauuucugucuuacggcuucuguacugcaucaguccuccucaagccagccagcuccaugcggaacauucuguugcucuuucagcauaagcaggucuauugugauauuuaucugaauucaggcaaggcuaauuaaaagagcugcugacaguuguugugaucugacuuugacugcagcuugauggucauuauggguaaauaaugaaccaggucugcaaauguagcagcugccaacuugggauagaagaacggcuauugcuuccaauuuaaggaucuaucgaccgcuucucuucucccugcagaucuucugcagaaaacuaauguuuucugcugcuguguauugugguuucagcuguuucagauauagccuauaauuuccuucuuuaauauuuaacuuaggacauuauuagcuuucagaguuaacaacuuuucuauuuugaagaaucucagcuuuguccuuguguaggcuuuagcuaaucagcuauaguuuauuuauaugcauuuaauuuguguguugugcaggaaauggcuagucuguaagagcaagguauagcuuuauuaagauguuucacaaucguauauagguaucucuucuaaaaaaagagauagaugcaugucccuugcuuuuguuuucuuaaacaccuaccaaaucucaguuuugaauuuuguucacuuugucaauggcuuaugaaauauuuugaugcagagcucuauuuaucaauucagaggaacugcugcagugacuuucauuaaaaugcaauacugaauauauugucacuccaucaugagcuuuuccuuguccuauuagcaaguaggaacaggugcauuaagguaagagagaaggcaaauugcauucauagauuaguauucuuccugcagauuuuucauacuugugaaauacaguuucuggauuuaaaagucauauucuagaauuuaacacaagccagcacuuaacaacacaucccuagcguuuauucaacugccauagaaaagacugucugcguuauguaaagucugaggauacaguggugcuuugugcauaaugcagcagagcuuugagaucuugcugggaggaaaugaucccaaacaugccccugaaagacaagccuuacucugaaaaauaaugaugaaaaauugcuuauuucuucauguauuugugucuguguuuauuucaggaaaagcuaacuaaacuuuguuuaucugacuccagaagagugcugugaguguuuuugcuuuucuguuuccagcuuggauaaugccagaaauaguguuaacaagggguuauguuaugcuggcuuauguuaaaccagaucaccccuaacaugugcaaagccauucaucugugucaccaaaacccaagagaacaucugacauggacucugaaacagaaacagugaucacuuacaaaucaaacauggcacgcucuaaacugauugugcacggcaaucuuuucuagaaaggacaacuaauugaacaugauaaaguguaaaguuaauuaacacccuuaaauuuguugauuacuuucacgggauuauauuguucguugaguagcagcuuucugucccagcugucgccuuuuucugcgaaugucgcugguaaacaauagagacaccauagcaagucguaaauggucccugugacagcagccccuugugaggcugcaucuguagaaaaugauuagaacaauugcauuuuaaagauggcucacauugcagcccaagucccauugguccucuucuugaucucuuuugauggcacacugguuaaaacauuuaaguucuuuugaguaaauuaagugauuuacuauguuuggcuauauaucaauggaagugcuuugguggcaauguuuuuacaguauuaaagacaaauauaauuugaauuguacuuuuuaguuuuccaucucuucccucuuuggauuugaagccuucuuucuaauagucauagaauugaaaaugaucuccuuauuuguaacuugggaguaguucgucuaaguuaucagcaccugcaucaugguuuaucuaucauaauucuuugggucagcuuuucaguaaggcuaaauuccaaauuucagcucuuuccuacuguuagaucaaagacuucgacauguuuaagcugaaugaauuuacuuguuauguuuaaauuuuuuauaacauuuguguaauagcuauauaccuuuccaauguauuguuucauuugagugucaaaguuaguauggccaguguuuuuaucacuguuuucagaugaagaaaccaagauugagagguguuauaacuuguccaagaggugugacccugcacugugauuucuuuccaagucuuuuaacucaaucacguuuuucacuuuuaacuccucauaauaauguccucauacauguacacuuagcuuaugcauguuuauguagcaguaagugaaaaugccauuaccacauguaaagaaucaugcugccccaaaguugagcuuuuaaaaaaguaauugacaaaaaaaaauuguauauauuguguacauguuauaaaauauguauacauuguagauuggccaaacugagcuaguuaauuaccucacauacuaaccaucuguguguauguguauguguguguuuggugugguguggugaaguuacuuaaaaaucuacucucaguaauuuucaagauuacaauaaacacauugauacuaaaaagagcuuuuugauaaacuagaaaauauuaagucuuaaugagucuuaaugaguauucuuggucauuuuauuagccauugauaucugccugccuacuaagaagaaaauuaacauuuaucagacacaugccaugugcugggugcaaagauucaaacagcucaugacaauaaggaucuuaauaagacacaccagaaaaaucauugauuagaguaguguaagugcuuuauuagagauaucaccaggaauguuuuaagaauagagaaaggggggucaugaaauacuucugaguugucaugaguugagucuugaaaaauaagcaggaguuagccaggcaaagaaggcagagaaggguauuucaugugagggaacagcccaagauaggcaugggugcaugaaaaaucauugcacauucuggccauugcaaauaguuuucagugugcauugagugguaguuuuuguugcaaggguuagaugaggagaccagagaaguaauuaggauucacugacaaggaaaauaaagauuuaaaaaucagagcucauuuaaggagagaagagaaaauucauugcuuccuacaacugaagacagaagagaggguacagugaguuauguaguucuccuuuuugcugaagcauaaauauacagguacuucagaaagaauaacuuaauggagaaaaaaugggaggaacuuugagauuauauaagaaaugcuggcugggcguggugacucaugccuguaaucccagcacuuugggaggccgaggcaggaggaucaugaggcaaagagaucgagaccauccuggccaacauggugaaaccccaucucuacuaaaaauacaaaaaaauuuagcuaggugugguggcacgcgcccauagucccagcuacucgggaggcugaggcaggagaaucgcuugaaccugggaggcagagguugcaaugagcugagauugugccacugcacuccauccuggcgacugagcgagacuccaucucaaaaagaaaagaaaagaaaagaaaugcuaaguaauagugaauaauguuuucaguuacugguuauuuucauguuaauguauaacuuaagccuugagccuguuuucauucuuauaucaaauaaaacugcccaaagauuaggagacagauuagcauaaauguuagaaugaggugauguaaguuuuacuucuuuuauagguauaaggcuaagauuagccugaaaaggguauaaagcaagaaccaagcuucaauucaguuuaucuugggaaaaaaggucacuauuuuugaugcaaaaaugugaaaacauuguucauuacuucauuuacuguuccugcaugaaguuccaaaugagaauuuuuaaaaaauauguuaacugaguucaaggaaaauauaugcuugcucucaaauagaguuucccaagacuuguaggauacucagaucuauauuugagauuuguugugagauacuaugguuucuuuuuuuauucuuaauacugauuuuguuuuccuuugaaaauucgauuucauuuuuuaauugacaaaaauuguauauauuuagcauguacaacauauuuugaaagauguaaauauuguggaauggcuaaaccgaacuaauuaacauaugcauuaccucacauacuauuuuugugauaaaagcacuuaaaaucuacucucagcaauuuucaagaauacaauacauuguuauuaacuauaaucaccauguuguacaguaggucucuugaacuuauuucuccuuauuucugauuuucuaaaagcucucuauuuuuuuugcucugauaagcaaacccacauugauugugaagagugguggaguauuaugugcauuuagauaacaggcagaacucagcgucuaauaaaaagcauaccagauuacuugcucaguucauguuaaacugcucugaacuagauucacaaauggauucagaauaccuguauucucaucaguuuuuauaugccuaccuacaguugacagcaagaauauuacucuucaagaacaauaucuuguuuuuucaccccuucucugagaauucauuauucuuucaaugacgaggguugaaaaaugaaaggaaagggggaaucaggauuugguggcgauugcccucauucaucugacacuugguaugugaugcuaccuuuuggcauuuucuucugguuauacaucucuuuucccuaauuauauuuuggauuuuuugagugcaaagacuagguuuuauaucuaccaugaccuuaguuuuggacugucugugauggucauauuucaaguaguuucugaauauaacagaaaacaaguccuuauuuuugauucagcaaauauguuuacucguugaaucuuuacacauagcacagagaucuagcaaguuguuaaaggcacugaauaaauauuugcugaugauauuuuuccucuuuggaccuuuguacaacuguaugcccucuaauagcaugaaucugacuuuuuuauuagcuauauguauuuuccuuaucccuucccccaccuccauucuccaacuucucccuccccccaaccaucacaagcacaagauuucaaacuccuugagaacaaggauuguuucuuccucauucucaggguugaggaccacugaagaauggaucuccagugaucacauuuuugaugucaacuauaaguagguguggaagggaagaaagaaggcaguuuagcaaauggaguccucuaugauacuuuuuuuuuuuuuuaagagagagagaggcugacuuagaggauuugugcuuagauuuaaaagugcuucuccacuauaaggcuuauuaaaaucaaaacagacuaccacgagaagugacagaugucuaucacuuuaaaaucaggguagucagcuacccauuuugcauaguuugggcauuugcuuuuucauuuauuuguacaaaugaguucaauguuucugauuguaguauuaugggagagaaacacuagagacaucaucacaggaaaguguuagaaaaagcacuaaaggcagccacaaauauuuaggcuuuuuagaguuaauguaguuacaugagaaaauuuucuuuuuucucauuuggaacaauuuuuuugugcaaaguaaaacaugccauaguuuuguguauuaauauaauaaaugugggaaaguggaugauuaugaacuugaaaacccaaaauuaucauagaauuucaaaagcuuaaaaggaauucagugaugauuuucucuaaccacuucacauccuagaugaagaaacagggugagcagcauuuaaugacuugcuggaaugauagaaaugcuuugucuguaauccuuggcaucuugugcauaucuugugagagcaguuaucacaugguauuacagucguugucuguuuccuugagacuuuccuucucucuugccuccugagaaucucuuauguacuagagcuaguggaugugagugaaugagccaacaaucacugcccucauggagguaguguuauucuaggggauacagaccagaaacaaaugaaacuguuaaagaggugauaaaugcuaugaauaaaauugaagcaggaaaaggagagagugaugagaugcuauuuuagauuguuagguugaguggucagggaaggccucucugaagaggugaauuuugaacagaggccugaaugaacuaaacuauaccagucaugaguaucugggggaagaacauuucaggcaaaaggaauagcaaguucaaggcuuugagaugggaacauacuucaccuguuucaagaacagcaaggagugcaagguggcuggaaagcagcaagugaugggaagaaugauaugaaaugaaauaggagagguagcccagagccacaucauguagggcuuuguaggacuugggauuuuauacugagagggcuaggaagucuuuggaggguugggaauagggaacaaacaugagcugggugaacuagauuuauauuuuaagaggauuccucuagcugcuauauggagaacagacuacagagacaagaggagaagagaaauaaaguaggagacuauugcaguaauccaggcaggaguuaccuguagcucagaccgugguaguagggauggacagugagagaaguggcugaaucaccaguguguaccuucuuaggagcagggacauuugugauucauccuucacccaagggcuuaccacagggccugauucuuagcaggugcccaguuaauuguguugaauagauaaaacaaaugcagauuucuugucuuucccauucacuaugcugccagagaaagauuuugcaagaagucuucacagugaugucaucuuaacauaguggcuguagaccacuaaaguucuucuugaccugugccagccuacuucuguuauuuauaggugcggcccaaacccgcuaauacuuaaaaagaggggcuaaaauuaucccagagaagacaauggcuuaaguaacuaaauaggaaaaugcccacuucacaaauucaaguuaaaaaguaguaagcccuuacauuuaaauagcauuuuuagcuggucacggugcucauaccuguaaucccagcacuuugggagaccaaggcaggagaauugcuugagcccaggaguuugagaccaaccugggcaauaaagugaaaccccaucucuaccaaaaacaacaacaacaacaacaaaaacaaauagccaggcacaguggcacaugccuguaguccgagcuacucgaaaggcugaggugggaggauugcuugagccugggaaguugaggcugcagugagcuaugaucaucacacuccagccagggugacagaguaagacccugucucaaaaaauaaauaaauaaauagcauuuuuauuuuacagcauacauucacauauucacagccaaucuaugaagaaguuauuaauacuuuuccuguuuuauacacugagacucagaaguuaaauaauuugucacacaauuugccagcaaguggcacauccccaaaacaaaauauaacauuuccagaucuuuuacccuuucuaccaugcuauuuaucagccaaccauuuguugaguauaucaugcacuauaauagauaauggggaugcuggcaagccaugaccucagugcugacuuuuuaggaaguuuauaauggaggaaucagacaagaaaauccaagauuuuaauaaaguaugauaaaugcuguaauagaaucaagcacaggguggauuuugguuuuguauauauaauuaauaaaauauauguaaaauaaguauuucuuucaguauucuagcaacuacccgaguaugcauuguguguuuuucuauuuuagaaaauggacuagaaucaaaauggcgugucauuguaauaaauuucuucauuuuugauagacauaaacaucuauacaaugucuccugaaauccauaagcugucuuacacaguuuuagagucgcagcuuucuagguauucuuuccuaaguucaaaaugguuacauuuauuucaggauaauuucagucuuuuuguuuuguuuuugagacagggucuugcucuguuguccaggcuggagugcaguggugcgaucucagcucacugcagccuccaccuucuggguucaagcaauccuccaucucagccuccugaguagcugggacuacaggcacaugccaccaugcccagcuaauuuuuguauuuuuuguaaagacgguuucgccguguugcccaggcuggucucaaacuucugggcucaagcaguccaccagccucaaccucccaaagugcugggauuacagaugugagccacuaugccuagcuaauuuaggucuuuggcugugggacuaggcuugauaguguuauaugauuaaaggaauauguaugagaagauaagauuugguuccaaggaaugucaaaacuuuagaauuacccauuuuaguuagaugcuuacuuugggauguagguuaugaugaagucggaaauaauuaugauaccacaucaauaugaggaaagagucgaacuaccacagaccucugaauuaaaagauaaauuauucuuucuuuuguggucuucucuugcuuaagcaacuuauuucugcuuuuuaaaauauguguuugaauaagugagaaaguacaccugucaaaagacuaaccagcugagaaccauugucagcauuaauuuuuuuuaaauaaaugacuccgaagcuauuuagcagucuguaaucuaaauacaaagcaaaacuauugaucuaugauggauagugcuggauuugcuuguaagcuuugacuuaaaucgucuacuuaauuucucuaggugagaucaacaggauuaggaggaauggugguuauaugguuuaaauaaaaaugucuagaaauugagcgaaauaauuauaaaacauuaaugguuuaccaucuugauaaaguaaacuagaaacuaacaaaacagcagucacuuuaauguuauaagaauguuugaaugacauagauuggcuaauugaaagcauuuuuuauaaauuggguuuuuguauauaauccaaagugaagauauuguaaaaugguguaauuuaaccauaugugugagcaucucagguuuucauaacaugugggcacucacucuuccaagauuguuuggcuagcauaaugcugacuuuuuuggcuuuuaauaauugcuuaugaauaguauaaacuguaaaauagaaagcuauuugauuugacaauagcaaaauauucacaauuugaaugaaauagguaucucuucacuugggcuuuuaaaaaauauauaaauacuguauuucauugaacacauuaaauccaaaagcaggccauuaccugcagcugucuaauggccagauuugauacauacuacagacaauuacaguuucuuuguucuuacuguacuguaaaauaaguucuuccacauacuugccugggaaguuuugaaaaauaaagccuaacuugaaaauuaugaaucaagauuucuuucaauauuaaaaacaguaauagcgcucuugguuuuauuuuauaguuaauaaaaauuuagaugaaugaagcuuuuccucucccuuuuaggacaagucuagauuauauuuucugugcuaaauugaagguucuuucuccaaucauuagaaugaaugaacaugcauuaagccucuguuaaaagcuacuaaggaguagugaagucaguguuaaaguuuauuucuucuucuugcucauaucacuaaaaauaaauugcccaaaagauguauagcaggaaggaaaagaaaaaucaaauaauauugaaaaguacauaugagaauaaucagucaaaauaagcaaaguuuuccuugccuuaaaaaaagaaucuaccaucugaaaugccuacuuguuuaaggaacaaagagccaggucucccucuuuguagaucucacuuauagauaguauuuggagagugggugagugagcaagaaccccgaauccaaacgugggcagcagaccucucucuggcugcuccuuugcugaucagggcccagguaaaacuuuuuuuuuguauacuuucuauaacuuaguagguuucuuaggagaauaauagaugcaugggaauaauaacauuuacauuuuaaguucccuuaucuguuaggccaugauugugccaaaaugauuaaggugaguugagauugagaguacaacugaaucuguaugucucucuugguuugugauuaaucugggugauacuugauugcugaauauuucuguagagauuuagaguaucuuauacaugccuggcauaaauacagauuggaggcaggauguuuuuaguugguuucucuaauuuuauuaccugccuaaacauuuuaagaaauauauucuuuugcuucuaucccuuuacccccaaaugauucagguguaggagcugcacgaucugggaaccucacguuuauggugggaggaguugaagaugaauuugcugcugcccaagaguugcuggggugcaugggcuccaacgugguguacuguggagcuguugggacugggcagguaagauuuuuacauuaaugaccuugacuugaugauguaaaauugacuaauguuccuuucucuuuccugaccauauuuuuauucuucuuucuucaaccuauggauucuuugcucagauuuuaaaacauuuauuuggaauaaauuaguuuugcaucauuccuggugggcuuaagcagacaucagccaauuuacuuauuuaaaaaacuuccauuauuggccagacgugauggcucaugccuguaaucccaacacuuugggaggcugagacaggaggaucacucaagcccaggaguuugacaccagccagggcaacauaguaagaccccaucucuacaaagaacaaaaaaauuagucgaguguggugacacacacuuauagucacagcuacuuaggaggcugagguggggggaucaccugagcccaggggugggggauugaggcugcagugagccaugauagagccacugcagucagccugggugauagagcaagaaccuaucucaaaaaaaaaaaaaaaaaaaaaaaaaacgggaaaaaaaauucauuauuaggaucuugacaugucugucaucccagcaacuagugaaaucauccuuaaaacugcucuuauucgaagugcuuguuucugaguugcuauuuuccuccaucuaauuuuguaauuacaguugacccuugaacaacacagauuugaacuccaugggcccacuuauacaucuauuuuuuuuccauagauauauugaaaauuuuuuugaagauuugugacaguuugaaaaaacagaugaaccacauggccuagaaauaucaaaaacauuaagaaaaaguuagauaugucgugaacgcauaaaauauauguagauagauacuaguuuauaaauaugcacaaaucuguuauaaagaguuaaaauuuaucaaaguuuacaaauauuuauagaccauacauggcaccauuuacaguugagagaaauguaaagaaauguaaagaugcauuaaaucauaauggcauaaaauuaacucuaguaauacuguacuacuguaauaauuuuguggccaccuguugcuauugcagugaacucaaguguuacaaguauugagcauaaaaugucaugugacacuaaucaucuuugugugagugguucaucucuuuaguaaauuguguaucauaguaaaaauugaucucuuggaauucucuuguauuuuuuuaucauguuuagugcaauaccauaaaccuugaaugacaccaugggacccauacaaagugccacuagugaugcuggaagugcuccuaagaagcugagaaaagucaugacauuacaagaaaaaguugaauugccugauacauaccauggauugaggucugcggcugcguuugcccuccauuucaagauaaacaaauccaauguaaggaccauuguaaacaaagaaaagaauagucaugaacccaucacugcagcuacuccagcaggcuugcacuuuuugcagaacaucuuuuuaucucacauugaaaaugcagcuuuuauguagaugcaggauugcuguagaaaggcauacuuacaucuaauaugauucaagaaaaauaugacaacuuaaagcaaaaagaaagugaaggaucuaaagcuggagaauuuaaugccagcaaaggaugguuugauaauuuuaggaagagguuugcuuaaaaaaugucaagaaauaggcgaaguagcuucugccaaccaagagacagcagacaguucccaggcgccauuaagaaaaaaucauugaagagaaaguauaucugccugaaugaguuuuuaaugcagacagaagugcccuauuacggagaaaaaaaaaaaaaaaaggaugcucgaaggacauuuauuaggaagagaagcaagcagcaccaggauuuaaggcaggaaaggauaggcuaacucuacuguuuuguacaaaugcaguuggguugaaaaucaggacugcccuuaucuauaaaguugcuaacuucugaggcuuuaagugaaaagauaaauaccagcugccugucuuuugguuguacagcaagaaggccuggacgaugagaacccuguuucuggauuguuuccaucaauggcuuugucucuggagucaggcaauaucuugccaguaagggacugacuuuuaaaguuauuuugauauuggacaguaccccuggccacccagaauaacaugaguucaacacugaagguguccaaggggccaacuugccccuaaacauaacgccccuaauucagccucuagaguaggggaucauaaggaccuuuaaggcucauuacacaugguacucuaugggaaggauugucacuguggaagaaaacccugauagaacaugaaaaucuggaaagauuacaccauugaagaugccauuguuauuguggaaaacgccuugaaggccaucaagccccuaacaguaaauuccugcuggaaaaaacuguccagauguugugcaagacuucacaggauuuauggcagggccaaucaaggaaaucacuaaagagauugugcauauggcaaaaaagguggggaguguaugaaggcuuucaagauauggaucuuggauuaauucaagagcuaauagacaccacagcagaguaauuaacagaagaggcuugauggagaugagugcuucugaacaguaccagaugaugaggaagaagauguaccaaaagcagugccaggaaacaaauugacauuagacaguauggcagaacgguucugauuauucaagacuccuuucaacuucuuuuacaacauggacccuucucugauacagacacugaaaauaaagcaaacaguggaagacggauugguaccauacaaaaacguuuuuagagaaaugaaagagcaaaaacaucagauagaaauuacaauuuccauaaaguuauccggagugugccugccccuucugccuccccuucuaccaccuccaccucuucugccucugucaccccgagacagcgaagagcaaccccuccucuuccuccucagccuacucauuauuaagaugaugggauugaagaccuuuaugaugauccacuuccacuuaaugaauaauaaauauauuuuaucuuccuuaaugauucccuuaguaacauuuuuuucucuagcuugcuuuaccauaagaauacaauauauaauacauauacaaaauauguguuaaucaacuguuuauguuauugacgaggcuuccagucaacagugggcuauuaguaguuaaguuuuuggagagucaaaaguuauacauggguuuuugacugcacuggggguuggcaccccuaacccccucaucauucaagggucaacuguacuugccauaguccucucuauuuguaguacaaucacgcagcaauaacccauggacuucaaauuuuucuugaaaagcaaguaacuuucauuuagaaguaugaggugacugacagagaugauuaaacaauacugaacacugaaauuguuaguugucucccucccccucccaauacacacacacacucucucuccuccucuuaaugcuuuuauccuggucacuaggacucucuuuaucucacucuagacuugguauuaucuuagauauauuuauugucuccauacucuuguccagucagucuccaagcucuauuacuucaaguuacucucauuguugaccuucauuuccauucaacacaggaccugguccaagccuuucuuucagugucucacaccuaguuuacuggucagggggccuaauagucucugaaugucaaauuuaccacucuguccaacaucauaacccagaccaacuccaucaagaugcuuguaucaucauagugcuuccccauucugaaacuuugaauagaucccuauuuccuaccgugucaaauuuuaacucuccacccuagcuuucauagcugacauguccuugccccagucuuaacgaucaaauuucucaccauuccuuaaaacacaggcauauuaaacaauuuucuuacugaucuccagcaacaucccauguucuuaaauauuuaauccuucuuauauauuuacccuucgccccggaucuccuucuuucucuuucuugucuguuuaaauccugccuuggccuccuaaaggaugauuucagguuccacuuccucucuguuccugccuucaguggucuuguugcucugaacuccuaucucuuauagccucuaccuuacaauucaccacuuguuuuuguugccuuuucauacagcauauuacucccauuuccaauuagauuguaaguuccaucccuuaaagagcaguugugcccuauagugcugagcccguaguagcuauguggaaaauaaauuuucacauaggcaaauuuauuaccuaguggaggagacccgcaagucugcucugggauagcaugugagguucagagggagccaugcugcaucagguucucuuccgcacucgagaaaaucaacaguugaauguuauuucuuuuagaaagcagccccuggaauugggcaaggaaaaacguccugugaguuuuaccuugaaaauacagauauuuaauauguacucaauuuauuuucaggcggcaaagaucugcaacaacaugcuguuagcuauuaguaugauuggaacugcugaagcuaugaaucuuggaaucagguuuguugaauaguacguuuuuauacuaacauuuuuauaggcuuuccuauuugauuuucugauguuaaaaaaaugauauucaugagagauaaaugaguugauccaagaacauuuugaaaguacuucauuauugaacuuuaauagacuuugcuuauuggacaagcaauaggacccaggagagcaugaauacucuuugccauagccauaaaauguauugccugugcauuugaaguugugcauuugaagcuauauuauccuuuuuaugugggacccccauuucuucuauuauguugaaauacaagaaacacuuuucuguaaaauuuaaacauacuuuggcaauguugggacaaauuuguauaagacaugguuuuaguguguagugaauucaagugguaugcuaccaugugacuaguuuauguaccuuuuaaaaauauagucccccaaaucugcacuaaaaguguucuuggugguucauucucaggcuaaaaacuggauagcauucauaaagaugcaauucauaugcauaacucuuucauuuuauuuugccugugguuuaguuacuuugcauucguauguaucuuucuauuaaaguggcauacuuugcuuaaagugauucaggaauucuguuuuuccuauggaugaucaucuuuuaaaugcuuaagguuaaugucuuaauuuuagccuuuaaucuuuuggguuaguaaugcuacauaugauuaaucaccuaauuaauuuuugaauguuuuauauuucaugaaaauaauaaauauacauuucuuacuuuagaaaaugcuuaaugagcaggaugcuuuacucaguugcuuucaucacauuccccaaaacugcuuaccaaauauaucacaaaacagaauaguguuucauaccauagcuuuugauaaaaguaauaaaaagagccaacauacuugagauauuuuugaaaacacaguaauggauucacauuuccucuuaauuaccauaucaagaugcuguuguuuuauugaauugcccuugucucagauguuuaacuaucuugaccuauuaaguugucauguuguaauugagauaaaagaggaauuugcuuugcgucagcacuaauugguuuaucaauaucauguaccauuuacauuuuaaaauugaauguccauaagaugguaaagcaugucuguacagagccuuaauaaaagugguaguauauagggaccuuuucaguguuauguuuguauuguggccaguuuuaggauaugggucacuuaucauaauugaaaaacugguuacuaguaacuuguuuucauguucauucucuagacuaauuucauggaagaggaaaauguacauuucuggaacauaaauggcauacacaauuaauugguguugacaccaggauugguaugcauauguauguuuagaauuuuauuuuuauuuuucuggauauaaaugauuauauaaaguaaaaggcuggaugaaccuagguuauacuguacuacagcuuucccucuuugcccauugacucugugcuucucaccuugagcaucacuggaccaggauguuccuuagucauagugaugcauccucuggcauuucuugaauaauuuuccugucagaacucuuacuauaagaugaucauuugaccuucuaaaaugaaguuuuguauaggcuaagugcuuguggaaguucuacugcaaacaccagcuacaacuguaggcaauacaaucgaauacgagguguacaaugaaguaaaaaccauuggcuacuuguaguggguuuguuuucaaggagaaaaugaaaagugauaaaaaauagagauguaagagagcagaagcaauuaauagaguuucccuuauuuuuggcucugaucaacuaugacaaaauuguuauuuagaaauaugaaacuuuuaaaucuuucauuuuucuaaaacucuacauauauacugauauauauaacauaaaauauauucuaaaagucugaacacaaggcagaaacucacuaguuauacuuaacuguuaaaaauaauuuauaaguuucuaguguuucagauuauaccaaugaauugcuuauuuucauaacaugaggauuuuaucacuuuaucuuacgaagauucucagugguuuaaagacccuaaaaaugaaugcuucugcuauugucuuuucuucacgguuuacagacaugguuuaaagugacaggauuguucucuaauagaguauagagaacggccacgauuuauugagcuuugcaaggugaaagagaaaauuggcaucagcaagcauaaauucccaaguaguaaauucccgcaaaguaguauagcaucaaaaugguguagccacauuuauauucugcccacucugaagugaaauuuuuucagaguauuaaugucaacauuuacaaauugagucacccauuccugugaagugaucauuucugauuaauuuuauucuaagucagugguuuuucuggaacacuguuccccuuuuuuaaaaaaauugaagaauaaaaucuuacaguuuaaaauucuuauugacccuaugcucuuuuacagugagucuuuauggauguuagcaaaauuuuuaaauguuguuaaaaaaaaaaaguaaagaguaaaaaauaugguauacaauauauuuugagauuccuuuuuuauuagaccuuucugcuuucuaauuggauuccuacauaggcauuagaagcauaguuuuaugguccugaaaguacccuacuuguauuagagagguuuuguuccuguguaucacauagaaauaacauugaugauguuuuguuguuuuaaauuaccagcuccacuggaaauugauuuuaaaaaaaaauuuuuggugguauaacaaguuacuugcauugccaaccaggcccaggcuccuccagcaaccacuguauugucuuccgccaaaagaagcuugaagcagcugaacuucuggaaagcuguucaagaugagaacuuucccuccaauguaguuuuauuaauaguuucuugcauacugcccuuagaagauguugcuuuugcauuuaugugaugacuggagccuuaguuguuuacccuaauaaauauaacagauggcaaagguuuguaauuuguaaauggccaaaaagcuuguucuuuguauguaucuauacugucugguuuuacauaagaacaaaacaaauuaugucacuaaacugggauguuugugucacaggaacagaucuggaaaugaaacaucuaagaccaugucaauccaaaucauucacuuauccaucauacaaauuucuuaauaaacucauaaaaugccaucguacuggcuaguuguugacuauuaaguuuaccaccuacuuaauagucaacuacuagccaguacgauggcauuugggcauacauguaggucugcauucaagcugucccacagacuuaagcuuuucucauuuauaaaaugacaaaagugauuacaucuauccacuggguuguugugaagauuaagugaguuaauccauauaaaacuuauuaaauaguuucuggcacauaguaggugucgauaugugguaaugauauuugugguuguggugaggugguuauuguuugaaauuaaauuguacuuuaaucuuuuucuuccuaacaugucucacuagcuggcauuacauauuuauuugucuguuuauuaccugucuucccaucuagaagcuccaugaugggaaaugguuuguuuacucauugccauaucuuaagaauauaccuggcagguauuaggcacccagugaagauuugucagauaaauaaggagaggagggaggagguaggggagugagugagugaggggauaagauauggcacuucucuugccaaagguaaaaguuauccaggugggucuuaacucagcccuccuggcagacaggcacagccuccucuuagcuuccuucuuacugucuccuucgcugcacguguagcacuuggauauagcagaucugaguaaacauugauggauaagugauugauuaauuaaaacugacauggucuuagauguuucauuuccagaucuguuccugugauacaaacaucccaguuuagugacauaauuuauuucguucuuacgugaaaccagacaguauagauuacucacagauaauauaaacaaacauuuuuggcccuuaaagucuugguuacagugaaggcaaauguuuaauuuuuuaaauuuuuuugcaguuuaugcauuauuuuuacuucuuccaaaccucauuuaaaauucuuguuuuagaggugaguagauuugacacagugacguuuauuugagacgcauuauauaugcagucagagcgaugaauucauucuguuuauaucagagaacauuccagcaauuguaaagccacaugcaugcacgcaugcacucucgaaccacauccaguggcaaguuauuauggggacugacagacugucauucuuuugauggcuugagcuguauaucuucugaacagcaauggggcucuuaugcagaaaguaucauauguucccagccaauuuacagggaaacagcaauaacauuuuaucaugguugagagcccaguagcugcuuccuauuaaacuugcccuuucagauaccugucuuggauuaauuuguugauuucgaauggaaacucagucuucuccagugaagcaugacguucuaggauagacucugaaugacaauuacuguguauucuagcugguuucagaccauuacaagccuugggcacaguggaaaacagaggacuucaguaacugauuuuaauaucaugucuaauuuuaacugucaguuauguaugugccagagaacgaauccucagaaagaugaaaugcaaaacacuucuaacuugcucuuuuuaaugauacacuuugcugcgggugggggcagggggagggaaguggagagggaauaacuaucuccugaagggaaucagcacgguggggaagcaucagauuugaaaagugagaaugaaacaacugccaccugauuuuuugugugugccccucaggaugcuucuaaauaguaauguguucaccagaaaggguuuccaucaaucaauaccaguacuuuuccuugaacauucaagaaaaauguaggguuuuacaaaguuaggauaauuagcuuugcucaccauuuuguugaauauuauagaaaagagugaauuuccuuagcuguaaaagcucuugugagcuacuacugaguguaaccugguagauuagaaagaaggaaggaauucugcugcuuuaaauaugaugaaccaucuuaaaagaucuaaguuaggaagcccugaaauuauauuucaaauggagagagaaagugacguuuuggagucuuuaaaaguauuuucuccuuauggagcauauuagauguaugcauucuugaacauuugguacuuugcaguuauagcaaauuaacuaauuguuaauugugauuuuacuuuucacaauuauucccuaagcacacuggcuuuaucuuuuccuaagugauauacuacaguagcauacugauagccuaaucuuauuuaaaaggagaaagcaagcaucaguagcauacuaugcaugcagugaacuuggaucuuuauaaaagaaugaaugaaacuguuggguuucucucugggaaucuacaguugaacagaaugaaugauagccaauuuagacugaauuucuguaucuguuacaauccuuaguaaaauccaucacuauaacaugggccaccauaugaauucagauacaugauaugccacauagcagucugggaaccacagcuaccccuugaaagccugauuacauaacaguuguauuaugugguaauuccauacauauuuuuggcuguuagccucagcccccugcucuagcaucugaaaaaauguuuuauuggccaugauauucagauuuugaaauaaacaggcauguguuuuagacacacagaguaaacaaucugagcgugccaagaugcacaguuuguuuaacauuuacauaagugucucuuuucaguguuuuuuuuauuuucuggaagagguugguuuuaagaaaaaguggaaagcuuuuaugacaauuguuucauaauggcucuguguaugaaagaaaccaaauaaauugcuaggaauaaaguuuuauuugaaacuugauucagugauaccuagcaaaauugugcuucccaaacugcauuauaucuuuagaauccaaguaauggagcauuuugauucuauuauuuuuucuaggguccacauugaacagccguuuaugccaucagcccagugauagaacaaaugauguuucugcuugggcaagcuuuguuuuaucaggaucaguaaccuuaucagcaguugacccagaacuauaaugcaugucucugaauagauagcauaugucacaacucugugcagacuugcuucauaagcaagauugucuaauaaagauuuaauaaauaaggaaaaguuugcagcaaaaagucuucuuuuauaauaacuuuucuuaagcucguuuacagcuccuggcucaucucuugcauuuauucucauaaaaacuaaaggaauaaacauacauauaaaugcauucacacagacucccaugaugcaucguuuaucugucaguauuucuuucugaaauauaucauuuguggguaaagaauguagaauuuaaauuaucauauuguuuuaagguucuuaugugacauauaaauguaguaauguccaaagacuagaaaacccaugagugugauaaaccaacaauauuuuuaugcaauuguauauuauuuuuucuuaauaauaggauaacauagaagguuuucuccaaaugcaaaaugguccuggcucaaaaauauucuuauuuaaccaguaguguuuaguacucuauaauucaaaauuggauucuucacucucguaucaaccugcuuagauuuuagaagacauauaauaaauggagagagaagauggagcauccccauacauaaauaagucacgcacgacguguacauuuugacacuuaacacuucuuuucuuugaccuuugacagguuagggcuugacccaaaacuacuggcuaaaauccuaaauaugagcucaggacgguguuggucaagugacacuuauaauccuguaccuggagugauggauggcguucccucggcuaauaacuaucaggguggauuuggaacaacacucauggcuaagguaugguaaauguagacacccaagagagaaggaaaaacguuucacgguccaauaacaccuuccuucucuuucucuuaauaaagcauaugucucagguaagaggcaaaauuacuagaauauucacucucacugaaaaugaguaaaaaccuaacuuagaugaaaauccuuaucuuguucauuuuuauuccuggccuuuugguugagaagaaugggccagaccauguguguguguguaugugugugcgugugugugugugugcgcacuuggguuuauuuauaugagccgguaaaauuucguucaccauuaauuuauguuaauuuaccaacuucuuaaaugagaacagugagaauuuucucauuguuaauaauacacuggcagugcauauaugcaucacgaagagaggauuuucccauugauaauagauuuccaaauacaucuuccugcuuuaagauuuuaauauauggauuuauauauaaaaacuaguuaagucauuggaaaagcaaacugucauccuucucuuauuugagaucucaacuuuagaaagucuauguucucaacuacagaaaauaauuuuuagaccagcuaacuuucagauuucugcagugcuuauuuucucccaguugaggguugguuuuuguuuguuuguuuguuuguuuguuuuuccugauuaaaaaguaagaauacggccaggcgcgauagcucaugccuuuaaucccagcauuuugggaggccgaggagggcagaucaccugaggucaggaguucgagaccagccuggcuaacauggugaaacccaguuucuacuaaaaauaaaaaaaauuagucgggcgugguggugcgugucuguaagcccagcuacucaggaggcugaggcaggagaaucgcuugaacccgggagguggagauggcagucagcugagauagcaccauugcacuccagccugggcaacagagugagacuucgucucaaauagaaaaaaaaaaagaaaaagaauacauauaccuagauaccacacaagcauaccuuggagauauuguggguucaguuccagacaaccacaacaagucacacaaauuuuuugguuucccaguacauauaaaaauuacguuuauacuaugccauagucuauuaagugugcauuagcauuaugucuaaacaauauacguaucuuaauuuuaaaaugcucuauugcuaaaaaagcuaacaauuaucugagccuucagugagucauauaguccuuuuuugcugguggaaggucuugccuugagguugaugaauggugauugaccaggguggcgguugcugaagguuggguggcuaugacaauuucuuaaaauaggacaguaaugaaguuuaaguuuacugcauugauuuacucauccuuucacagaagauuuaugugcuacuguuugauagcauuuuacccacaguagaacuucuuucaaaaacggaggcaauccucucaaacccugaugcuacuuuaucaacuaaguuuguguaauauucuaaauccuuucugucauuucaccaggaguagauccaucucaagaaaccacuuucuuugcucauccauaagaagcaacuccucaucccuucaaguuuagcacaagauuguaguaauucagucacaucugcaggcuccacuucuaauucuaguucuccuauuuccaccacgucugcagugacuuucuccauugaagucuuaaaggccucaaaguuauccaugagcauuggaaucagcuucuuucaaacuccuguuaauguugauauuuugaccuccucccaugaaucacaaauauucuuaauggcaucuagaauggugaauuauuuucauaagguuucaguuuacucugcccagagcugucagaggaaucacuauauaugguagcuauugccuuaugaaauacuucucacauaagaguugaaaaaugacucuuugauccaugggcuacagaauggauguuguguucauagacaugaaaacaacauuaaucucccuguacaucuccaucagcacucuugggugaccacguguacugucagugagcagucguauuuugaaaggaaucuuuucuucugaccaguaggucucaacagugggcuuaaaauaaauauucaguaaaccaucccauaaacagaugugcuuucuucuagacuuugcuguuccauuuggagagcacaggcagaguagauucagcauaauucuuaagggcccuaggauuuuuggaaugguaaaugagcauuggcuucaacuucaaguccccagcugcacuggcccuuaacaagaggguuagccuguccuuugaugcuuuggaaacagacauugacuucucuuuagcugcgaaaguccuagaugauaucuuccaacagcaggcuguuucaucuacacugaaaaucuguuguuuaguguggcuacccucaucagugauagcuggaucuucuggauaacuaacuuccugcaguuucuccaucagcaguugcugcuucaccuuccacuuuuauguuauggagauggcuucuuugcuuaaaccucaugaacuaaucacuacuagcuucacacgucuucugcagcuuccucaccucucucagccuucacagaauugaagaaaguuagggccuuguucuggguuaagcuuugguuuaagggaauguuuuggcugguuugaucuauccagaccacucaaacuuacucccuaucagcaguaaggccguuucacuuaucauucauguguucacuggaauagcauuuguaauuuucuucaagaauuuuuucuuugcauucuacuguuuguuuuaaugggccugccuuucagccugucuugauuuucuacaugccuuccucacuaagcuuaaucauuucuagcuuuugauuuaaagugugagacagcugacuccucuuuucauuugaacacuuaagaggccauuguaggguuauuaauuggccuaauuucaauauuuugugucucagggaauagggaggccugagggguaagagagagagagcugccauucaguggcugggcagucagaacacauguguaccacauuuaucgauuauguuugccaucuuaugugcgcuuucugacaccccaaaacaguuucaauaguaacaucaaagaucacugaucggcugggcacaguggcucaugccuguaaucccagcacuuugggaggccgaggcagguguaucaccugaaguuaggaguuugaaaccagccuggccaacauggugaaacccugucucuacuaaaaaaaaaaaaaaaaaaaaaaaacgcuggguguggugguggcaaaugccuguaaucccagcugcucaggaggcugcgggaggagaaucacuugaacccaggaggcagagguugcugugagccaagauugcgccacuacacuccagccugggcaacaagagagaaacuccgucucaaaaaaaaaaaaguuacugauugauugcagaucaccguaacagaaauaauaguaaugaaaaaguuugaaauauugugagaauuaccaaaaugugacagcugcaugaacugggcacaugcuguuggaaaaacagugcugauagacuugcucaaugcaggauugccacaaaccuucaauuauuaaaauacaaaaacaaacaugcauuaucugugaagcaugauaaagugaagcacacuaagacaagaugugcccauacuuggcuuacucucccucauuccccaugacguuuguucauucugcuucuugaauaugccuugaauucauccagcucccuccuccccagcuagcuguaccuuggcugagccucguuuguguuguaccacaaauacaucuuaacugaucuugucuuucagccugaucuucuccaguuuauuuuccauaucaaagcaagagugagcuuucuaaaauguaaaauccugauugugucacuucuccuuugaagcuuuuguaguuucaguuacuuggagauuaaaguccaucccugcaacuugucugacaagcccccagaugccuuggcuuuugcuugccucaaccagacugauuuucuuucccaucccccucuccuugcuuucaucgugcugaacucacuucucccucuuguucugucucuuggaaaccuucacauuugcuucacauuugcugucacauugucugccaggauggaucauucuuccuugcccaccaccucccugccacccccauguuuucaccuggcuccaggucugugcuucacugucuucuuuuucuucaccuuucccagcaccccagacccugcuuccuuggaucccaugauaguacuccuccuauccaauuauaccaugcuuauuuaauugucuuucuccuuaacacaaugugaguuugggugggcuguggcuguuuugcucaucauuuuaucccagcuucuggcacauugucagcacacuucaaauauuuauuggaugaaguaauauuugcaacuguauuuccuguuuugcaguuuuauuucuccuuguuuucauuuaagaauuuuuuaaaaaaaauuuaugucuuaaagauuuccacagauaagauuacacagggaaauuuuuuuucuucaaaucuguggaacaaaacaaacagguauuguggaagguggaaaaaucgaagagacacucagaaaucaagguuucugucuggagcaauuuugcaguuauaugaaagcgcuuauuuaaaaauguuaacuuaccauaguauuuauaaguaucuuauuuuuucagauuacauuuuuccuucuuucaaaccaaaacauaaggaaccacaguuccaaagagccuuuaccaccagucucagcguguucucuccuccuguuugauuuaggaucugggauuggcacaagacucugcuaccagcacaaagagcccaauccuucuuggcagucuggcccaucagaucuacaggaugaugugugcaaagggcuacucaaagaaagacuucucauccguguuccaguuccuacgagaggaggagaccuucugagugugcccuuuggccacggacacuguugggaaccaaacucugucuuggagccuccuuuuagcucacuccacaaguaaauggauuuaaucaaaggucaccuaucugcuuuugauugucuaggucacaguaaucccuaggauuuuucaccgcuuauucuuuuugucuuuuuaacaaacauauuauccgaauuuuuuuucugcaagccacugauagucucugcuaacuagcuuaauugaccuuuuuacaaaguuugauccccaagcauccucaacuaaaucauugaauacuucaaucaggauauuaucugcuuuacuuuacaaauaaaaccaaaucuuuugucaacaggaugaaacccaucuuaaaggaaagaaaaggaauuggugugaagagagaaguuagagaagggaaaugcagugaauuacuaucuguguccaucaggaaguuuguccuguuaaccaaaugguuacugcacuaccaggguuacugguuuauuuuccagggagcugauaaagcaggagaacuguugcugcauguuuucuauuuggacuccgucacaauaugguaggauaucccucaccaacucccgacacucagcagacuuguuuuuauauuuuuuucuuucuuguucauucuuacuacguauuuuuugacuuaagaaugacaucuuuagaugcauuucagagccaaugaugauauuugcuuuagauaauuauuauauuauuauaaauauagccauauuauuuugaauucaaauaaauuucuauacugguaauacuuu

SEQ ID NO: 14650 - RNA, 1284 nt, Homo sapiens
uuguggaacaccauuuuuauuucaaagaauaacaagacaucuuauagaaagaaaaaagugagucuuacuucaaggaaagcaacugaggguauuuguaaccaaugauaaaacuggaucuuucaaguaaaaauuagaauuuuggaaaacuuguaucugaccauaugaacuuaacaacuuucuaauccuuaaagacuuuugugaaaagauuguuggugcaguuaaagaaugugaguuucuguuacuguauacugggaauuuagaauaucugcauaacuaacugaacgaguauuuuccaauugaccguuguaugauguuaccaaauuaugccuagauaaaagaugcaaaguacaaaauagagggauagauuuuaauguaacauaguauaaaaaguucuuuccacauugcaacaagccuuuaagaaaccaccauuugucagguuuggguuuaauauaaaagaaggauauccacaauuaucugaaaaaguuauuaaaauucucucuuacuuuuuuaaacugcauuaucuauaugaggucagcuuuucuuaauuucaaccaaaacaacauauaucugcuucugcauuuaaucuacuaugaaaauccagcugucuucuauuaagccagaacuaaagagauuugaaaaauugucaagcagugcuacucuucucacuaaauuuuguugcuuguuauuuuucccaaaauauguuaauauguauuagguuuaugauugauguuuuuaagucaauugagaaauguuuuuaaaauuuguuuugauuucuaauacaguaaauaccaauagauauaauccacauaaacaaaagcuuuuguguccucaaaaauauuuaaagaguauaaagaaauccuaagaccaaaaaguuuaagaaccacugguuuaaaaugaugaggccuuggaaauaacccaaauguccaauaagggagaauugauuaaauuacauauuaugaaucagugauguagauaaauaucugacaugaaaauauuuuacaguguuguguuaguaguaaaagcagguuuugaaacaauacaugaauuaaugucacaaaaaguuauuaauauauaauaugcuuaauauuguauucuauaauaccuagguauuagguagcuuuuucuugaaaaggaagguagaaaaaguuuuuuugaaguugucauaacaguauuagacugcaucaugagauacuguuuccuucuggcuuuuggugaagguauuugcuuuuuacuaguuuuguaacauuggccaagucugaauuuuguucuccuuacuuuaaaaau

SEQ ID NO: 14651 - RNA, 1591 nt, Homo sapiens
ccaggugaagcaggccaucagccagaaccgccaacuccgcccgcggcccucaaaaguaggcggcgcagggagucuccgcccccuucgccaccggcgacucaaaccaaaacagcuggguuucucuccgcaaaggcaaaccccagcguccuucucggacgcgaccuacguguuuucucagcuuacugcgccgguaaaacccacacugcccucaaaacagucaccccagaguuuagccuuggacaccagaagcuuuuccuucgggggucgccagcgucacucguccccagccaaagggcccccgucccacacgccucccccaaaucgcgaaggccugucccacgggccucccaccgcguggggcggccacccguugccauuccaaaacuccacagcugauccgagucgcccacacccccgucacaaucgcagucuggaaaggaagguuugucuucgggaaggaaagccucgucaccacagagaccucucccgagaccggccaggccccuacaguacaggggcugaaggguguagcacgagcccuaaaagagaugcagcuggaggccgccccgcacaaggcgcugggguggaccggggaggcgccuuacccaguggaaagacucccggaucaagggagaaaguuacgcaggcuuccgauccugauccgccaucagccgccgaaccucuuccgccacuaccgccuacccccaaagaccggcuacaccuccccucccagccgacaguaggccuugcgucacuuccgcccacggggcggucucuuccgccuccugccugguucgccgcuccccuccgcgacgacacgcccccagcccacuccgccgcgggacgccucaucccgcggguaggcuggcucucuccuuacuucguccuugcuauuuucguucaacuuaaucgcagcaaaacaaugcgucuggauuuacauucugauuuuauguuauuauuuugacauacgaaagggggaaacacacaggagguuuaaguaacucaccagcgauguggaaagggcagcucagagguccauggacaguaccguaucccugucugcgucucagucggccuaaacuagcccacucauuuuauagauaaggaaauagccagagaagcaagggagugaccacacggcuagggcugcaaaccccugagcaccaagacugucucugaacuccuggcccagucgugugcuuuuuuggcuaugaaguuuuguucacugaaagcuccuaggagcuuuucaguucuaaugcccucugauucuauuugcucucgcuccagcagaggccucuuuucuagccgcauuucugugaguuaccugcuuuuguuauccguaucauuuuccgugugugaauuuucucccgcguucuguuauuucuaaaaucacuuuugcuuguuguauauguugccuuccuauauuggacauucaguuugaaucguaacuccacagaagcaaaugugucccauucgaauucaucauagucuucuguugccguaaaacccugacaaaccuugcaauagcaccagaaaggauauguaaauuagaucgcauuaaauguugaagcacauucuaaauacagaacau

SEQ ID NO: 14652 - RNA, 1397 nt, Homo sapiens
uaccugugucccccaucuagaauguaggcuccaugagggcaagggcuuugcuuguggcugcacccccagcacuuacagaagggccuggcacacgguaggcgaggcuuguuuugugaagggaggcuguugggugagauguccucaaagguuccuucugcugcaaacucuaagauucucagaugcccucgcagcauugucagccacaaaacaucguuuuaguuccaucccaggaggccauuccuugcauaccaaaaccaucucaucagaagguggccccacuuaugaucuccaccagcuguguuuuaggaaggucacgauauauuuaucgaaacagcuccauagucagaaacuucagcaugacaguaccucaugcugcaucaggugaucaugaaaagauuacaggcuuucuaaaauuaucagcaagauauggaccuuuauggcuugcauucagcuucuaauugucaagaaggagguaguaaaucauuuggaaguuuguuuuugguuugguuggagagaaaaguucuugagcuauuagguauagaaccacagcauuuuuugaccugaaagaaaccucagaaaucauccauuccugcauuagaauguagcuguggaucucaacgucuaagucugaacucugguuauguucuaguaagugacaaugaacagauuauuuaagcacucuguagcucagcuuccucguuuguaaauugggaauaauaauagaugcaccccauagaugaauuaauucauguaaggcugucgaaacaauaauaauauguagcacaauucaggcauucaacaaauauuagccauuaucauuauaaccagccuuuugguuuuuacuuuuuuuaacuugaaaaauccuuuaaucuaaaaaaaaaaaaaaaaaaaaaaaagucuacucaaaagcccuguagguagaggaugaaaacuacuaggaaguccuacagaaacccuagagccccaagaacacuccuagaaaaccagugauuaagcccaaagcacacauuuuauuccccaagaaauggaggcuacagguugaagugacuagucaaggucacagagaacuccaguuucaacuacuggcccucuugcacucuacguuaccaggugccuccuuguuauuaaggaaguacagaacaugugcuaaugggggcuuugcugcugucacaggaaugagugucaggagugacuuucagaaacugcaugugaucuucacagagaaucauggagguccccauggcaaagugaaaagcaauaagucccucuggggcuucccugccagaugguuauacagccucugcuugaauauuuccaaugaacccacugcuuucccugacagccuuugcugcuaacuagcuauaaaaaccagacuuagaagcaguauaugauuaucc

SEQ ID NO: 14653 - RNA, 1397 nt, Homo sapiens
ggauaaucauauacugcuucuaagucugguuuuuauagcuaguuagcagcaaaggcugucagggaaagcaguggguucauuggaaauauucaagcagaggcuguauaaccaucuggcagggaagccccagagggacuuauugcuuuucacuuugccauggggaccuccaugauucucugugaagaucacaugcaguuucugaaagucacuccugacacucauuccugugacagcagcaaagcccccauuagcacauguucuguacuuccuuaauaacaaggaggcaccugguaacguagagugcaagagggccaguaguugaaacuggaguucucugugaccuugacuagucacuucaaccuguagccuccauuucuuggggaauaaaaugugugcuuugggcuuaaucacugguuuucuaggaguguucuuggggcucuaggguuucuguaggacuuccuaguaguuuucauccucuaccuacagggcuuuugaguagacuuuuuuuuuuuuuuuuuuuuuuuuagauuaaaggauuuuucaaguuaaaaaaaguaaaaaccaaaaggcugguuauaaugauaauggcuaauauuuguugaaugccugaauugugcuacauauuauuauuguuucgacagccuuacaugaauuaauucaucuauggggugcaucuauuauuauucccaauuuacaaacgaggaagcugagcuacagagugcuuaaauaaucuguucauugucacuuacuagaacauaaccagaguucagacuuagacguugagauccacagcuacauucuaaugcaggaauggaugauuucugagguuucuuucaggucaaaaaaugcugugguucuauaccuaauagcucaagaacuuuucucuccaaccaaaccaaaaacaaacuuccaaaugauuuacuaccuccuucuugacaauuagaagcugaaugcaagccauaaagguccauaucuugcugauaauuuuagaaagccuguaaucuuuucaugaucaccugaugcagcaugagguacugucaugcugaaguuucugacuauggagcuguuucgauaaauauaucgugaccuuccuaaaacacagcugguggagaucauaaguggggccaccuucugaugagaugguuuugguaugcaaggaauggccuccugggauggaacuaaaacgauguuuuguggcugacaaugcugcgagggcaucugagaaucuuagaguuugcagcagaaggaaccuuugaggacaucucacccaacagccucccuucacaaaacaagccucgccuaccgugugccaggcccuucuguaagugcugggggugcagccacaagcaaagcccuugcccucauggagccuacauucuagaugggggacacaggua

SEQ ID NO: 14654 - RNA, 5356 nt, Homo sapiens
ucauuuccauaaaugggaacugcauugugucauuaugaaaguguauaaaauauuuggaaacuccaacaaauuaucucuauuaguggguuuauugacauaacuggacauaacaauguauaacauuuauucaucucccacugaaagacuucccagugaaacuaaaguagaacacagauccaggcauuaggcauuuucagugauguucuauggcugaaaagguggguggugaggagaaccagaggccuuguccauacuugcaaugggacucaauauuacccugcugggcaaaagaaauagcuaggagaugcaauagugcuaugauugaaaaaagccaggagcacaaaaggugccagauagcucccugguugaaaauaagagcaaacaacacuacugcucucauguaccaguaugcucucaaucuaaaauaagcccuggcagcaaacuaagaaugacagucuauuuccugugguuuauuaaguuuuggccccgcagacgagacugccagaaaagcagcuguaguuuuaaguggucuggacauuuacucauuugaacauaaacaacgaucagcucauucagauggcugguucccuacucagcuguugagaagagggcaggcaugggucaaucuaggccaaacauaaaaggagugaacuggggugaaagacccggggcugugauggauucccugagucaccaggacccucaggggcuuaaggcccuaaacagaagauuccacugucagccuuagcaccauugcagugaccuccaugguacuccacugccaauaaauccauaaccacugugaccauaaccacaguguacauucucuuagugacugcauuuuuagaccacacauaaaauuauuaauguaaaccaaaccacuacacuuagugauaaacauguacuucauaaauagcagggaaugaaaguaucccaaauaguuggaaacaacugaacaaauaaaggauccuaccccuaaguuuaaaacaaaaacauuuaaaagaaauacugcaacuauuaacuaaaagauaagauuuaauaacacaguaagacacucaguuggggagggauuaauugcaaaauauaucauuauuucacagugagguuuaaguacucauaacaaucuucugguuuuaguagaacagauacccacugguguauuuuuuucacauuuguuuucuauaauuucuuccccucuacuauuucauauaaagacacuaauguggucaaacauuaaacuaucaauugacaaucaccuuuugcuucccuauuaggaaauaaccuucauugcuuaacugcaacucaagagaauuagggcacagucaaccaugucacugauaaaaacauaagaaguaaugcaucacauuuauuccaaucuaaacacacugucacagaugugguaagugaacuggaacacugguguuccccagugggucaucagcuacauauacaucacauucuuuuaucaaaucuggcauugaaauuuccuuuuccauauauagguuuaaaaaaauaaaauuaaaaaagccacaggagcaacccugacagagaagucuugcaugcagccuucuccugagaaaguauguaaucuuaguuauccucgaagucagcaagcgcucuuguacuguuaauauuaaaaggaacauaauaaaauggcccaguccaacuaaaacaguccuugagucuauuggucaguucguuaaaugucagagcuuuucacauuuuugaaaaaaaaaaaugcgucucuuauuaaacuuuaagguauccugaaugcucuaucagccaacauaaacgaguuccuuggcggguauguuaaacuuuaccaccuguuuacaucccccuucuuggcagagaucaccaaaccaguggagucccuggccaagccuccuuuguaaugguaauaaguuccuuccuuaaauagaaacaaaacuucucuguuugacacugagcaaacaaaaagcaugcacccaaauauuucuggccauguugggggcacaagcacccccuuucuacccccaaagccuggcuucugcauugcagugcuacaaaagccauucgcauagcugugucaaagccuccaagcgaagccuccgaccucagcaucccaccauccauuuguccccuacucuggcucugaccaccaaguaccauccauuuacuucucgaguauugggaauugggggauggugcccgaauuggcccucuguccccaccggccucucuggcaagugcacaaaacggcacuuccccugaggugggcuggugggccucacggagaggcggcuccuuagggccaaugagauggucucuauaugcccuggaccuagucggcaaaucgcugcaggagacgguccucccgucucaggcugccgcccgcgccgccgcccgcacuguccaugaagcggucgcaggggaauucgaugagguccgccucacugagcgcgcacacgguggugcguggccggugcgacuggaaucccgagaagucggcggacacgccggugcccauggagcgcaggggccgucggguggaguacaugugccgaacguggaccggggccccgcccuuccgccuagcccgcaguuuccuacgcagccagcgagacgcccaggccgccaaggccaggagcaccagcagcgcguugaccgucagcagggccaaggucagcagcugguagucgacgccgccccggcucccggccuccgguagggugaccagccccgcgcaguggucccggggagccacagggcagacacggcccccaagcacgcccuccacgcacaccagguaggggguguccccgcgcagcucgcgcagcguggccgagucgcugcucucaggcagguagacgaagcgguggaacuugggcugcuggccaaagcggucaaagagcaggcggaagcgcgcgccgcccagcggccggggacugcggugcucgcgcacggcccagcgcaccgaggcgcugucugcgcccaccgccuccaccgucagguugcacagaaugaacuuguugaagucgcaugggucggacaccagcggcggcagcccggccccaccgucggacugggcggcacgcuccuggugcuccgugcccagacgaugcuucgucgcgcgcugccaggggucgccggcgggcgauggcgcagagccaggagaggccguuggggugggcuccgcgagggcgggaucugcccgagucggacggccccgcuggggcuucuugugcaggucuagggacuguggagccgggcccgcggcggcagcgacggaggggcugggcugcuggaggcccgggccccgccgacucagccuuagggcgcugcgguugccuaccagcucccuggcggccccaucccaggccaccccagcuagaaaucgccccugcugcuggagcugcggcugcggcggcagcuccuccgcgagaccugcagguggcgucaucuccuccccugcggccguggguaggggcugccgccugcggucagcggucagggaagcugagggcgagggauccgcgcaggauccauuuugcagcugcuggucauccagguaauccagguauuugccucgcagggccgggggguggcgacacugcacgaagacagugaggagccggcccugcgagugccagucgcccauccagcgcuucaggccucgcagccggcagucgcagguccagccguugccgucuagauccagccgauaaagggcugggcuggcggcgaagauguccccggauagggcgcugagcgcguuguugcgcaggcugagcucgcgcagccggcccagguggccgaagguggccgggugcagggcggacagcucauugccgcucagguccagcgccuccaggcugugcagaggcuccagcagcgcaguuggcagcuggcucagccgauuacccuccaggcgcagcucgcgcagggccuccaagccccaaaaggccucaggcgcgaggugcgugagcugguugccccugagcgagagcaggccgagacguggcaggugcuggaagaugcgcggcccgaggugcugcagguuguuggccgagaggaugagggaggagagggagcgcagcggugcgaagguggccgcguggcgcagggagggcuguagcucguuggcagagagguugaggaagcgcagcuugccuagcugggcgaaggcguucuugcccagaaagcggauccgguuggacuccagauguagguagagcagguugcccaagggagcgaagaccgcguccggcagcgcccccagggcguucccguccagccgcagcuugacuagacucuccaggcccucgaaggagccgcggcuuaggcggcugaucucguucccguuggcguagaggaugcgcagcuugcgcagcggggccagcgugcccggggcgagcgccugcaagagguuguuccccagguacagcucuuccagccgcgagagcuucucgaaggucuuggggugcagagagcggaucugguuguacugcagguccagccgucugagcugccccagacgguggaagucgaaggccgugauguugguuaugaaguugccgccgaggcuguaggugagcacgucgugggggcucggccagcgagcuggucuugggcacuacgcggagcccccuguuggugcacaggagaugcuggggaugcuggcagucgcagcgcuccgggcacacgggcucggcagcggcgggagcgcgaggcagccgcacaccacgagcaggaggcgcaaggcgcgggcagccuccaucgccucccgcccugcgugcagcggccggaucguccucuuggcccgccggcucugugucuccucugcauuccccuuagccuggccagagucgcuaaauggccucuuucggacuucgcagcgccguccagccccuccuccguccuuuguccggaggccggcccgggucucugcaggcgggcuucgcccggccaagucaggcggcgcggggcgcucugcagaccccggguacuacuuguugcauuucuguauaaaacuguuucuccgggugcgcgucggcgggcgggaggagggagcaagacccggcgcuuuuuguuugcagcugaguccggagagcuggauucccuggcgcggauucucccagccgaguggauuccccagcugcaggcgggagccguuccaagagcuucgcggggcgcggcuuggcagcagagccccggcugcucggcccccgcagacggcaccuucucgcucgcggucccggacggggagggcggcuccagugcaauagcucggggagcacgcgggcugcguccggaagggacccaagucugcgagcggagagcaaacggggcggaaauucguucuucccacacucug

SEQ ID NO: 14655 - RNA, 5356 nt, Homo sapiens
cagagugugggaagaacgaauuuccgccccguuugcucuccgcucgcagacuugggucccuuccggacgcagcccgcgugcuccccgagcuauugcacuggagccgcccuccccguccgggaccgcgagcgagaaggugccgucugcgggggccgagcagccggggcucugcugccaagccgcgccccgcgaagcucuuggaacggcucccgccugcagcuggggaauccacucggcugggagaauccgcgccagggaauccagcucuccggacucagcugcaaacaaaaagcgccgggucuugcucccuccucccgcccgccgacgcgcacccggagaaacaguuuuauacagaaaugcaacaaguaguacccggggucugcagagcgccccgcgccgccugacuuggccgggcgaagcccgccugcagagacccgggccggccuccggacaaaggacggaggaggggcuggacggcgcugcgaaguccgaaagaggccauuuagcgacucuggccaggcuaaggggaaugcagaggagacacagagccggcgggccaagaggacgauccggccgcugcacgcagggcgggaggcgauggaggcugcccgcgccuugcgccuccugcucguggugugcggcugccucgcgcucccgccgcugccgagcccgugugcccggagcgcugcgacugccagcauccccagcaucuccugugcaccaacagggggcuccgcguagugcccaagaccagcucgcuggccgagcccccacgacgugcucaccuacagccucggcggcaacuucauaaccaacaucacggccuucgacuuccaccgucuggggcagcucagacggcuggaccugcaguacaaccagauccgcucucugcaccccaagaccuucgagaagcucucgcggcuggaagagcuguaccuggggaacaaccucuugcaggcgcucgccccgggcacgcuggccccgcugcgcaagcugcgcauccucuacgccaacgggaacgagaucagccgccuaagccgcggcuccuucgagggccuggagagucuagucaagcugcggcuggacgggaacgcccugggggcgcugccggacgcggucuucgcucccuugggcaaccugcucuaccuacaucuggaguccaaccggauccgcuuucugggcaagaacgccuucgcccagcuaggcaagcugcgcuuccucaaccucucugccaacgagcuacagcccucccugcgccacgcggccaccuucgcaccgcugcgcucccucuccucccucauccucucggccaacaaccugcagcaccucgggccgcgcaucuuccagcaccugccacgucucggccugcucucgcucaggggcaaccagcucacgcaccucgcgccugaggccuuuuggggcuuggaggcccugcgcgagcugcgccuggaggguaaucggcugagccagcugccaacugcgcugcuggagccucugcacagccuggaggcgcuggaccugagcggcaaugagcuguccgcccugcacccggccaccuucggccaccugggccggcugcgcgagcucagccugcgcaacaacgcgcucagcgcccuauccggggacaucuucgccgccagcccagcccuuuaucggcuggaucuagacggcaacggcuggaccugcgacugccggcugcgaggccugaagcgcuggaugggcgacuggcacucgcagggccggcuccucacugucuucgugcagugucgccaccccccggcccugcgaggcaaauaccuggauuaccuggaugaccagcagcugcaaaauggauccugcgcggaucccucgcccucagcuucccugaccgcugaccgcaggcggcagccccuacccacggccgcaggggaggagaugacgccaccugcaggucucgcggaggagcugccgccgcagccgcagcuccagcagcaggggcgauuucuagcugggguggccugggauggggccgccagggagcugguaggcaaccgcagcgcccuaaggcugagucggcggggcccgggccuccagcagcccagccccuccgucgcugccgccgcgggcccggcuccacagucccuagaccugcacaagaagccccagcggggccguccgacucgggcagaucccgcccucgcggagcccaccccaacggccucuccuggcucugcgccaucgcccgccggcgaccccuggcagcgcgcgacgaagcaucgucugggcacggagcaccaggagcgugccgcccaguccgacgguggggccgggcugccgccgcugguguccgacccaugcgacuucaacaaguucauucugugcaaccugacgguggaggcggugggcgcagacagcgccucggugcgcugggccgugcgcgagcaccgcaguccccggccgcugggcggcgcgcgcuuccgccugcucuuugaccgcuuuggccagcagcccaaguuccaccgcuucgucuaccugccugagagcagcgacucggccacgcugcgcgagcugcgcggggacacccccuaccuggugugcguggagggcgugcuugggggccgugucugcccuguggcuccccgggaccacugcgcggggcuggucacccuaccggaggccgggagccggggcggcgucgacuaccagcugcugaccuuggcccugcugacggucaacgcgcugcuggugcuccuggccuuggcggccugggcgucucgcuggcugcguaggaaacugcgggcuaggcggaagggcggggccccgguccacguucggcacauguacuccacccgacggccccugcgcuccaugggcaccggcguguccgccgacuucucgggauuccagucgcaccggccacgcaccaccgugugcgcgcucagugaggcggaccucaucgaauuccccugcgaccgcuucauggacagugcgggcggcggcgcgggcggcagccugagacgggaggaccgucuccugcagcgauuugccgacuagguccagggcauauagagaccaucucauuggcccuaaggagccgccucuccgugaggcccaccagcccaccucaggggaagugccguuuugugcacuugccagagaggccgguggggacagagggccaauucgggcaccaucccccaauucccaauacucgagaaguaaauggaugguacuugguggucagagccagaguaggggacaaauggauggugggaugcugaggucggaggcuucgcuuggaggcuuugacacagcuaugcgaauggcuuuuguagcacugcaaugcagaagccaggcuuuggggguagaaagggggugcuugugcccccaacauggccagaaauauuugggugcaugcuuuuuguuugcucagugucaaacagagaaguuuuguuucuauuuaaggaaggaacuuauuaccauuacaaaggaggcuuggccagggacuccacugguuuggugaucucugccaagaagggggauguaaacaggugguaaaguuuaacauacccgccaaggaacucguuuauguuggcugauagagcauucaggauaccuuaaaguuuaauaagagacgcauuuuuuuuuuucaaaaaugugaaaagcucugacauuuaacgaacugaccaauagacucaaggacuguuuuaguuggacugggccauuuuauuauguuccuuuuaauauuaacaguacaagagcgcuugcugacuucgaggauaacuaagauuacauacuuucucaggagaaggcugcaugcaagacuucucugucaggguugcuccuguggcuuuuuuaauuuuauuuuuuuaaaccuauauauggaaaaggaaauuucaaugccagauuugauaaaagaaugugauguauauguagcugaugacccacuggggaacaccaguguuccaguucacuuaccacaucugugacaguguguuuagauuggaauaaaugugaugcauuacuucuuauguuuuuaucagugacaugguugacugugcccuaauucucuugaguugcaguuaagcaaugaagguuauuuccuaauagggaagcaaaaggugauugucaauugauaguuuaauguuugaccacauuagugucuuuauaugaaauaguagaggggaagaaauuauagaaaacaaaugugaaaaaaauacaccaguggguaucuguucuacuaaaaccagaagauuguuaugaguacuuaaaccucacugugaaauaaugauauauuuugcaauuaaucccuccccaacugagugucuuacuguguuauuaaaucuuaucuuuuaguuaauaguugcaguauuucuuuuaaauguuuuuguuuuaaacuuagggguaggauccuuuauuuguucaguuguuuccaacuauuugggauacuuucauucccugcuauuuaugaaguacauguuuaucacuaaguguagugguuugguuuacauuaauaauuuuauguguggucuaaaaaugcagucacuaagagaauguacacugugguuauggucacagugguuauggauuuauuggcaguggaguaccauggaggucacugcaauggugcuaaggcugacaguggaaucuucuguuuagggccuuaagccccugaggguccuggugacucagggaauccaucacagccccgggucuuucaccccaguucacuccuuuuauguuuggccuagauugacccaugccugcccucuucucaacagcugaguagggaaccagccaucugaaugagcugaucguuguuuauguucaaaugaguaaauguccagaccacuuaaaacuacagcugcuuuucuggcagucucgucugcggggccaaaacuuaauaaaccacaggaaauagacugucauucuuaguuugcugccagggcuuauuuuagauugagagcauacugguacaugagagcaguaguguuguuugcucuuauuuucaaccagggagcuaucuggcaccuuuugugcuccuggcuuuuuucaaucauagcacuauugcaucuccuagcuauuucuuuugcccagcaggguaauauugagucccauugcaaguauggacaaggccucugguucuccucaccacccaccuuuucagccauagaacaucacugaaaaugccuaaugccuggaucuguguucuacuuuaguuucacugggaagucuuucagugggagaugaauaaauguuauacauuguuauguccaguuaugucaauaaacccacuaauagagauaauuuguuggaguuuccaaauauuuuauacacuuucauaaugacacaaugcaguucccauuuauggaaauga

SEQ ID NO: 14656 - RNA, 19333 nt, Homo sapiens
agaaaaagaaaaaguaacuugucacuaacacaacaugcucacuuccgaagaacaaguagaaaaguggaggguggaggaaacaagaaugcaugugauccuccuaggcuauuaccacuucuuucccaaguaaauuuaucuccuaaaaggagagaauaugccgaaccaucauucuauguauaucuggaaaauacccaguggugugaugggcuucuaugaacaguaugccuacaaggacggggcacgugggcuaagggaacaagcagcaucacguagagacagcugucucuggcaauggcuccagugcccucuucuucaggguuuccacccuagcaccacucacagcauuaacuucucuuacuuugggaagaaaaaaguagacucuuuuccaacagaacagauaggaaucaaauaacaaagauuccaaaagauccuucuagagaguucugcuuuauugaaggauacacaaggacagucagcaacaacaacagcaaaagcauuucacuaccaggaaauaguuacuguaucaagagacuaaacuuucuauauagaaaggagaaggaaaagagggggaaaaaaccccacaaaacaacaaaaaaaguuggggauggggaagaaugggaaaaaaagaagaauguugaagaugaaugaaaaaaaguguguguaauggaaaggagugaaggaucaggaacuaaauuuuacucaaguauaugcaucugagagcuuagagagaccucagaaggaaaacugccaggucgagccuccuccccuuagguuagcaguguugaucagccucugucauccaccaaaccaaagccuagcuuugaguuauucucaucuaaucuaauugcagacaucacugaagguccuugacgcaaacaagaaaaaccucuucucauuuagucucuauuaaugauuacagaaaaaaaauaaacaggugaacucacugcuaauuacacuaagcaaagggaagagauucuggguacgcccaauaggggcaccuuuggcugugcugugugaccuccucgaaguuacuauguaugccaacugauccucccacacacacccauucuuaaaacacccggcgcauuaccauacuacaaccuuuuaaaaacuaucccacaaaagaaagaaaacgucucucacccacucuaagggauacugggaacauuucugcuuucaaacacacugccuuuaaaauuuuaaagaccuaauucauuuucugugauaaaaaguuuacuuccaaaaaaguggcuagcacaguuuccagcauauaguaggcuuguauuaaauacuaguugcacacaugacaaaaaugaucguucugaauaauuuucacagcuguagaacaguuacaaccuucucaagauaugaagcuuuuaccuccacaaacuagaaaaaaagggcggggacuauuuuaaagccaaucuguaaggcacggcaagaaaguugcaaauauuugcauucauuuaacgguaauuucugagucuguaaaacaaaaggaaaugcucaacgagaaaauaaaaaaccuugugcagagcuuugaaacuguggaguugggacucuugacacccuggugugcacgcagaugacucugaaggugacaaagggaaaguguuugcacugaggacuuugauaaaggaucuuuccgcuguggaauuccagguuacugcuggcauucuuuugaaaccuuccaaccuagcugcgagccaagggaguacgguuccuucgccaaaauucaagagauucccagagaaccccacggcggggcgucugcgccuuccucccgcugacaucaagagcaccgugccuuucaagucacccaaaaucucagucuuuguagccuuccuugaagcgaaagggcagccacagcucuuaaccaaccccaagagagggccgugucguccugcacggcgacacggucccgugagagaacugcuuugggaaauacucccgcuccgcgcuggccucaggaaagggccgugacccccucccuaagacggguccagacaccgcccuccagccgcgcagacaaaggaccggcccccggcgcgcccccggcccggcacggccacucaccgcucagauaguugguccacuuguacagcacccccuccauggcgcccgcggccacucggcccacgcccgccggcccccucacugccccaggccccaagaggcgaggagcaccagcagcagggccaucgccuggcgcugcccagacgcccacucccggcgcccgggcccgguguggggacgcccggcccgccucacauccucggcccgggggcggggucacugcggcggccucggcgcuugaagcccagccagccggugaacccguggggcgaagccggcacgcuguucacaaggaggcccggguccgggcccuacgugggucggaggggcagccgaagccuccaaagugcggcgaacgagcugccggucgcaggcggcgccacggcgcaccaccugaacccucgacucgccgggcccgggacgcgcucgcgcaugcccagggcgccgcucgcgcgccccuucccaaaauccacuccgggauuucgcggcagcggcggcggggcggaguuugcgggaacggcccgcagggaaauugagucccgagacgcggacugcggacuaggcgacgggaggagggaggccccugagacaaguguggagcgcaguucugacuguaaauggugcccgccguuugagggucuacgugaccucucacgauaccuccugaguucuagucccuauucuuguuccaaagcugccuaauugaucucacacacuugagguaaccaauaacagggcguaaagagauuauuggaauuucaggguagaauacuaugaggccaguguaaacagauguuguccagacucuaaggucucacuauggaaguguugaucuacugacccggagcacugacaucaccuaagagcuuguuagaaaugcagaaucuugcacccaccccagaccuccagaucaaaaucugcauuuuaaacaagaucuucagggggauuccuaugcacauagagugcggauaugcacuguguuaagguuauuagaccagaaaaaauguuaacuacagauuaaguggaaagaggaggugagaaaagacuacaauacgauuuaaaucgcuuuaaguauaugucacagaagcaugcaccaaaauauuaagaggauuguuugcggcugguggugguaucggcgagcuuucuuuuucuuuaaaguugccugauuuaguaaauaaaaaugcaaaaccauuauucguuauguaucugaaauuccaacuugauucgacuccccaauauuaucuggaaaucuuacuuuagugcuuuccaauuucuuccaaaaugacuucaaugaacaugcauuacuuuugaacuuaggcaaaaaauguaaaacuagaaaauguaaacuacgaugaggcuguguaauucguaaccaugauuaccauuucuucuuuaaagcggaagucugcaagucgaaacucauuauuuacccuguaagguaacuuaagggauaaauuauuagcagccauaacaugacguggugcuguggaaugaaucagaccugguuugaaggcagagcucauuugcuucggggccaaacaaccuuaagcaggacaguuaauaucuccugguguaaauuuacuucucuuuuaaaugggaaaaaagaaccugccuuacuggguguagugagguucaugcaacgggaacgcgcuuugugaacccucaagcaguaugucagucuuuacaguuuauaagcaauagcaaaauccuaggauuguggcaucuuggggggccgcucuccaacggcgagaguaaacgagucuuuccuggaaccccgaagauuucauagggccccgggacucuuccuacgucucucagcaggguucuucacagagauaaaucagccggaggaguuuccgguuggcucugcgccccgccccucucccaaaauccacgcugguugaaugcugaaauccaccgggcucuaggaccacaagggaugauccgccgcuuggcagcugcccggcucuaccgggcuguaaauuccaucguugcagcgucauuggcuugagagcugccugaaggacagcaccaauagccaaugggaggcugcuauucccaggcggccgcguuauaagagccagucaggccggcauuugggcuuaacucuuuaaagguagguucgugacccuugagaaaagaguuggugguaaaugugccacgucuucuaagaagggggaguccugaacuugucugaagcccuuguccguaagccuugaacuacguucuuaaaucuaugaagucgagggaccuuucgcugcuuuuguagggacuucuuuccuugcuucagcaacaugaggcuuuucuuguggaacgcggucuugacucuguucgucacuucuuugauuggggcuuugaucccugaaccagaagugaaaauugaaguucuccagaagccauucaucugccaucgcaagaccaaaggaggggauuugauguugguccacuaugaaggcuacuuagaaaaggacggcuccuuauuucacuccacguaaguaauuaugccccgcagguaaaauaguaauuaagaauccacucacuuaugccagcucuccagcaggaaagguggccuguaccugguuuugccucuuuuacaaaaccgaaauaucuuauuuccuucuuugggaaaggaaauuguuuaaagccaguuuuauauagcgagcgaggccuuugaaggucuuguuggaaacauguggucuggaaaaggcuguuaauuuuuuuuauuauacaaauuagaacuagaaucuuugaaauauugcagaaauauaucuggguguauaauuggccaauaaguagaaaaagcccaaaagaauucucauaucucaaacuccauuucuuaaagaaaaugacuugauuccauuuuuaaugugguguaggugauguucaccuaaaacuuuucacagcgacuucaaaagcaaacuacacuaucacuuauuugccuguugaaggauauacuaaugccguuucacugaccuacuucuuuuguucugacgaaugguauuuuggucaaggcacaggaccaugauuucagucauuugcuucuuucuagagagucagacuucauugaugaggugggugugguuuuggaagucuaggugaaggauuuucaggugguuacacuaucauuucuguucuauaaacgaagaaauuggaacauggaaaugguuuacagccuaaugauuuucaauuaggcaucgguuccauucauuccauuaugacaguauuuagugagcauuuccuugauguuaagccauguucugggugcuaggaagauucagaaauuuuggcuucuaaucaucuucaucuauucauuagucuguccaucuaucaaacucuuauugaauggucacaagucagguccuggagacgcaaagauggcuagaagcagguucuuguccucuaacaguauacaccaucuacaggugggagaaagacaaguaaauaaugcaaugauauaggguacagaauauucaaagugcuagcaaagcguaacugggccugaaguaguuaggcuccaugggguggggaaagggaaagacuucccagagaccauaauugaaaugaaccuuggaagauggguggagguuuccagggggaaaguagggaaggauguuguagguagagggaauaacaugaauuaaaacaguaaaucuucauagcccauccuccaccugauuuucuaauaaacugccuuuacugggcauucagaccuggucugucuugaggguuggggaaaugaauggggcucuucucuaaacuguuagcccugggaaaaaguuccagaaaaauggcuugccuuagaauucucaacagcccuuucuucuugucaacuaggugagugccacgguggauauuaaaugaugugauuugcauuuugaaaauucaguuauauuguuauuuuuagucugaucucuuuuagacucagccugacuucuuucagauuucugaaccaaaaaccugugcugacuuuggugguagccauggaauauuauuuagcaguuugcuacuaaguucuaauaccugaugaggggacuguuaucaugcagccuccauguaaauggucagaagcugcuaacuguaaacuucaugaagaaauaccaucaaauuggcugggcgugguggcucacgccuguaaucccagcacuuugggaggccgaggcaggcagaucgcgaggucaggaguuugagaccauccuggccaacauggugaaaccccgucucuacuaaaaauacaaaaguuaucugggcguggugggcaccuguaaucccagcuacucaggaggcugaggcaggagaaucgcuugaacccaggaggcggaggcugcagugagccaagauugcgccgcugcacuccagccugggcaacagagcgagacuccgcucugaagaaaaagaaauaccaucaaaugaucaguuuguaagcacguuugccaucucuagaaccauagccuaugggauaaauugcuuagcccuaagaagaacugugcuaaaauuguagucagugaugaguaguagaauguuuccugcuucuuuuuucauuucuagccuucccaaauuuucuacaguuggcauuuuguuacuuugaucauugggcaaaauuacaggaaaaaauggcauuacccagauuuaguaaccaugguacucaugaagcguaguacagugacuucuuuuucucaccuacaagauauccuugaauagaauauuuuccuuauugcacugaaagggagcuagguagggaucaggcauuacucagcccuuaagccucccuguauguaguucggcagguugguuuuccuaggcuagacucucuucaacucaugagccaggacauucuauuucccucguccccaguugauaggguuccgcuauggccccacccaauucucaucuuaaauuguagcuaccauaauccccacauguuguggaagggaccuggugggagguaaucgaaucaugagggcagguuuuucccaugcuguucuccuugugauaguaaauaagucucacgagaucugaugguuuuauaaaaggcagcuccucugcacacucauucuugccugcuaccauguaagacgugccuuugcuccuccuuugccuuccgccaugauugugagaccuccccagccauguggaaccgcgaguccauuaaaccuccuuuucuuuauaaguuacccagucuugaauauuucuucauagcaguaugaaaauggacuaacacaccaguccuugaggggcuacucuuccagacuuuccuauauagccccacuguagaccccugaggaggaaacugggcuagggucugaguggggauuuagggaugaaaagcagccuuuucuacccgucagagccaucagcaggccauagcuaaggcaaguuuguaggcaggauauaagacacugugcuucucacucuucauaucugugugcauauggacccacauauguuggcaguaaauucuccuuagccuuucaaucuccuucccaaacucagccauuuuuccauuauuuucuccuuguucugcaaccuaguggccuuccugggacaacauaacuuugugauuaagaccuugaacuuuggaguuagguuuaaagacuggaacuuaaccuguguuuccucaucugugcaaugggguaguaaugguacuuauauuauagacuuauuguaaggguuaagaggcaaaaaauaaaauaaaauuuagaauaauuccugguauacaacaaauguucaaaugguuguuguuuuuauuauuuccucugucuuucuuaagcccagucaaguaugugaaauuugcaucaagaaagaugggcagugaauugaauuccuauaaacuugacuuggagguguguguguaugugugcaaauacagaauugcuguauuuauaaauuuuuaaacuaauaaacuuaaccacuuacuggugggaaaaugcacuaaagaaaauuuuuuagaguuaauaaggaguucuaauguguuuuauuucuaucauagucacaaacauaacaauggucagcccauuugguuuacccugggcauccuggaggcucucaaagguugggaccagggcuugaaaggaauguguguaggagagaagagaaagcucaucauuccuccugcucugggcuauggaaaagaaggaaaagguaauaguauuucuguauuuuucuuacuauagcacuagaguuguucucuggauuaggagacagaaguuagagucacuauaacuuuuuuuuuuccccuggaaguuaauaggggguauguauuccuuuagcaacuguauuaugucuugaguaucaauugaaauggccaguuuaaggccguaaugucuaaaugggcaacuaugcuaacaauaaaaaaagaacauugaggucuauuaauacuguucacaaauaugguggguuguuuuaauugugauaaaauauacauaaaauuuuucauuugaaccauuuuuaaguacacaguucaguggcauuaaauacauucauguuauuguggaaccaucaccacuauccaucuucagaauguucucaucuucccaaacugaaacucaccaauuuacuuuaacaaugcagagagaaagauccauuaacguaaguguuuggaugaguugaacaugugaaauauagauuauuaaaguauugaaugcauuuuagauguggguuauauauggguuguacuucaugaauauuaagucucccacagcaaacugggaguucuuuucauucccguuuuuaaauuuauuuauaaaguuuuuaacaauguauuuaaaaaaaaucauagagugacaugaaaugaauuuaauucucccugugucacaaagcagaagcaagcuggcuagcugguccggacagcuuuuguacuaguuuuucagggcagacacauauccugcuguucaagugagaaccccugcaacuuuccaaagagcugcuuugugauauauaucaagaggucugggccaggcaugguggcucacaccuguaaucccagcacuuugggaggccaaggaggguggaucacuugaggucaggaguuugagaccgacguggccaacauggugaaacccugucucuacuaaaaauacaaaauuagcugaacguaguggagugcaccuauaaucccaguuacuuaggaggcugaggcaggagaauugcuugaacaugugaggcagagguugcaaugagccaagaacgugccacuauacuccagccugggggacagagccaaacuccaucucaaaaaaaaaaaaagaggucugaagaugucuauaugcauuuauucuauaauuccuucaaaccuaagggaauaauuagauaucaggaaaaaaauuugugaacagggauguccauaauugcauuguuucuaagcaaaaaauuggaacugucguaagugguauacugguaagaauuuagcuaaauaaaauauggcccaguuauuuaaaauggcauuuccaaagaguuuaaaaauuauaucugaaaugcaugagauacaguauuauauauaaaaguagaaaauaaaccuauaguauauaugauaguaaauauaggaaaagguacauauacauagaaaguuaaucauaaggaaauaaauaagaauguuaaaaauggacugugauacugggaaucauauuuauuucugguuuuaucauccaaguaugugcucuacaaugagcauguauuacuuacauaaugaagaaaaaaaaguuuaaguagucaucagaaccagacagacaacuacucugauauaguauaaauauagacuucauagcauccugaagucuaagguuaaccacugacaaaagugaggagucaggauucacagcccauuuccugagaaggaaaauagaugccauauggcaagcauuauauauuccaaaauauacaaaucuauacaaaucuuguucauaggauaagauuaacuaaccaaauucaauucuucuuuuagucauaauccucuuuagagaagaaaaccaaguaucuagaaaauuuuuucugaugcugagaauguuuucauuuuaucuuuauugucucaccuuuaauauuuacauacaguaguuccccuuuaccugugguuucacuuucuaccguuuuaguuaccuguggucaacugcagucugaaaauauuaagguauuuugagaaugagagacagauugcauucauauaacuuuuauuaugauauguuguuguaauuguucuauuuuauuauuuuuaaucuguuacuaugacuauuuuauaaauuaaacuuuaucacagauaugcauguauaggaaaaagcauuguauguaugggguuugguacuauccaugguuucaggcaucuaaugggauucuugggacauaucccaguggggacuacuguacguuguauuaguccauuacucuuucucauacuauauuuaacucaaguuuacuucacaauaaguagagaucuaaauuugagucauuuccuucaaacugaaugccaugaaacuaauuuuucuaaucuguauuuaacacuaauuuuguagucuuuuaguacaugcuugcaugccucuuuuggaaagauaccaguuuuaucaacaaccuagcgcaugucacaucucugucuagaucugaaaugguaagcuucagcacacuuuauaagucuucucuuuggaauuuaugaauguucuuucauggaaauaugugggauggggggaggaugacuaagaaauauuuaacauguuuacacagaccuguauguuaaauauaguuauaaggaaacaaguuugagaaaaacaauuguccauacuccacagauggguguguuuguuuguuuguuuguuuguuucagguuccugggauuuuaacaaagcucuuuucacuuuuaaagauuuuuaauuucccuucucagaaauucauuuuaauuucuccccucccaugaaaugucuucaacauauauauaauguucuauaucagagguaguguuuccuaacuuucugaaauuguuaaaccuuccugcauuauuuuuaaagccugugagaaaauuauaccucaauaacauguauugagaguuuacuauuugucaaguuuaaugcuaaguauuuugcauggauuuuucucccuuuauccucccaacagacuccugaggaggaaauuuauuaucugcauuuuauagaugaggaaauugaggcuuagagaugggcaaauguaaacuucagccucagacagugugacaccagagcuuacucaauuauauggguagaaaugccuucuagugguagaaauggcaauacuguauguauuucuaggucaggacuuucugaccaaaaaguuaguuuauuacuuuuaauauacuuaacuccgaauuaucuaaaacccuucaaguccuucuugacauauaauauguaauauauuaauuauauuagaaauguaauaccuaagccauuagguacaucucuauguauguauaugcauuguguguauguguauuuacauuuuaauugcuaagccaaagauagaaugcuuuugcucugcuaguguauauuauuucuucuuuuacucuauucuauucgaguaaaauauaauauacauaauuuucaucauauaugacaaucuuaggaaggcucuuuaauucaguuaaaaaaaauacuuuguccauuaccauaaauuuucuauuauuaaaacuuuuggcucuuuuaaaacuuucugccuucuuuccucacgucagguaaaauucccccagaaaguacacugauauuuaauauugaucuccuggagauucgaaauggaccaagaucccaugaaucauuccaagaaauggaucuuaaugaugacuggaaacucucuaaagaugaggugaccuuuccuucuuccuacuccucuuucuacuuuucuuugguuguuugggguuuuguuuuguuuuguuuuuguaacucacuuuuuaaaugaauauguguauauuucaaaucuacuuuuauuuagguaacauuuauuuauaaguuuucuuaaaauacugaugcuuugaaaguggacuuuuucauagugaaucacuguuuuggagagaaauauauuaagacuuaaaaagcaccauucaaucuuuugcuuuuuucuucccaaugcuuaggguucacuguaucuuaugcuuacccuugggucuuugaaagaacaauuuugccaagacaguuuccaucuggaguuacuguauaagaagcuagcuguccugagaaauaucucauguggacaguuucuguuaaaacuguagacuggcuguuaaauacaucuuguaguguuuuccuggcaauuaacagcaagcaacuuacaugcucuguuuuguucagguugccccagagaaaagagaccccagccuggguuuuacacagcagggcuccagccccaucaaaaucugagccuuuggguaaagagaaaggaagaagaggcuucuccuuauaauucggccauugcuacacauaccugucuuagucuggcugcugcggggaaagaaguggagggagauauuuauuccuguuuuuuaucuacucacacuccauucuguccugacuggucagauaucaagucccuuucuaugcuuugaucaaauucauucuaauggccaggaaaugauuaagucuugaauaagccaaauuguuacgaaccagggguucaugauccacagccacuaaauuuauaacaccucauaguauuaccagucacaugccuuuuucuuccauccaagauaaauuuuaauucccuuucauuaaauaauuuugaauauauaacacagucacaugguucaaaacaaaaaucuauuuauuuauuuauuuauuuauuuauuuauuuauuuauuuauuuauuuccugagagggagucuugcucuguugcccagccuggagugcaguggcaaaaucucggcucacugcaaccucugccuccuggguucaagcaauucugccucagccucccaaguagcugcaccaucaugccuggcugauuuuuguauuuuuaguagagaugggguuucaccauauuggccaggcuggucucaaacuccugaccucgugaucugcccaccucggccuuccaaagugcugggauuacagacgugaaccacugugcccagcagaaagauauuuauuuaaaagucuuagcugggugagguggcucacacuuguaauccuaccacuuuggaaggcugaggcaggaagauugcuugaggcugagacuucaagaccaaccuggccaacauaggaagacuuuaucucuauuauuuacuguuuuuuuuuuuuuuagacggaaucucacucuguugccaggcuggauugcaguggugcgaucucagcucacugcagccucugugucccggguucaagcgauucuccugccucggccugccagguagcugggacuacaggugcacgccaccauacccagcuaauugucguauuuuuaauagagacaggguuucaccauguuggccaggaugguuucaagcuccugacuuugugauccgccugccuuggccucccaaagugcugggauuacaggugugagcuaccgcauccggccuauuauuuacauauuuuuaaaagucuuucuccuaccuacauccucuucuauucuauuauccccacauccaguuuuauuaauuacuuuuuucuuucuuucuguuuuuuuuuuuguagagaugaggucucgcuauguacaagcaugcaccauugcacccggcuuaguuuuauuaguuucuaauauauccuuucaguguuucuuucugcaaauccaaauacauagucuuauuucccccuuucuuacacaaaaagaagcaaacuauacaugcuguuuugucguuuugcuuuauucacacaauauauccuagaaauacauucuacauuaauccauagaguuuaauggauuaauggaucucucccccaccccuuuuuuuaacaacugcauuaaaucacuuuaacuuaaaaauaaauauauacuauauguguacuucuugaaagcugggggagagaggauuugaaauugcuggucuaaacagaaggaagagaggugauauaauuaaaacugaaaauauaggcugauuuucauuguggugaaucuugugggaaauugaaaacaauauuuauauuuuuaaauaucugaaugaaaugaaaauggaguccgggcaugguggcucacaccuguaaucccagcacuuugggaggccaaggcaggcaaaucuucugaggucaggaguucgaggccagccuggccaacuuggugaaacccugucucuacuaaaaauacaaaaauuagccaggcaugguggcaggugccuguaaucccagcuacuagggagucugaggcaggugaaucgcuugaaccugggaguuggaaguuguagugggccgagaucgugccacuauacuccagccugcgugacagagcaagacucuauuucaaaaaaaaaagaaaaacaaaaaaacaaaugaaaauggaaaauuguagucuaggcacuuaucagaccugacuuucugagauugaaagguugugauuagacucaaucuaaucacaugaucauaaccaaaacccaaaagacccacuacuugcagacauuuauucaagucaaagaugccacuauuuaaucuaguuuuaagagaaguguccauggggugcaguggcucaugcuucuaaucccagcacuuugggaggcugagggguuuagauugcuugagcccaggaguucaagaccagccugggcaacauggugaaaccccaucucuacaaaaaauauaaaagccagaugugguagcacaugccuguaagucccagguacgugugaggcugagguaggaggauugcuugagccugggaggcagagguugcagugagcugagauggugccacugcacuccagccugggugacagagcaagauucugucuaaaaggccgggcgcgguggcucacgccuguaaucccagcacuuugggaggccgaggcgggcagaucacgaggucaggagaucgagaccauccuggcuaacacggugaaacgccgucucuacuaaaaauacaaaaaauuagcugggcgugguggcgggcgccuguagucccagcuacucgggaggcugaggcaggagaauggcgugaacccgggaggcggagcuugcagugagccgagauugcgccacugcacuccagccugggcaacagagugagacuccgucucaaaaaaaaaaaaaaaaagauucugucuaaaaaaagaaaagaaaugccuaguauuuagauucagauuaagaacaaguaguaugcucucauuggguauucuccaauaauauaagcccuauaugaggauuguauacaugacauaagcuuuaucucugccuuugagcaauauauauauagagagagcuauauauauauauauauuuuuaauuuuuuaauuuuuuauuuuuuugacagagucucacucuguugcccaggcuggagggcagcagcgcaaucucgauucacugcaaccucugccuuccagguucaagcgauucaacugccucagccuccugaauagcugggauuacagacgcaugccaucaugccuggcuaacuuuuuuuuguauuuuuaguggagaugggcuuucauuaugucggccaggcugaucuccaacuccugaccucaagcaaucuucccacuugggccucccaaagugcugggauaacaggcaugagccaccacaccuggcccugccuuugagcaauauuuugugucuccacuuuagcaguuuagcaacaguuuuuuuaagggaaaaaguuucuauuauuuuuuaauuaucauuaaaacuaugucauaaaauggcuguuuagaagguauuauauuuaguuaaugaacuaaauauaauaacaguccaugucugugauauugauuggcucaauguggguaucuuaugaauccaaguuauuaaugggaucuguuauuuuguagguuaaagcauauuuaaagaaggaguuugaaaaacauggugcgguggugaaugaaagucaucaugaugcuuugguggaggauauuuuugauaaagaagaugaagacaaagauggguuuauaucugccagagaauuuacauauaaacacgaugaguuauagagauacaucuacccuuuuaauauagcacucaucuuucaagagagggcagucaucuuuaaagaacauuuuauuuuuauacaauguucuuucuugcuuuguuuuuuauuuuuauauauuuuuucugacuccuauuuaaagaaccccuuagguuucuaaguacccauuucuuucugauaaguuauugggaagaaaaagcuaauuggucuuugaauagaagacuucuggacaauuuuucacuuucacagauaugaagcuuuguuuuacuuucucacuuauaaauuuaaaauguugcaacugggaauauaccacgacaugagaccagguuauagcacaaauuagcacccuauauuucugcuucccucuauuuucuccaaguuagaggucaacauuugaaaagccuuuugcaauagcccaaggcuugcuauuuucauguuauaaugaaauaguuuauguguaacuggcucugagucucugcuugaggaccagaggaaaaugguuguuggaccugacuuguuaauggcuacugcuuuacuaaggagaugugcaaugcugaaguuagaaacaagguuaauagccaggcaugguggcucaugccuguaaucccagcacuuugggaggcugaggcgggcggaucaccugagguugggaguucgagaccagccugaccaacacggagaaacccuaucucuacuaaaaauacaaaaguagccgggcguggugaugcgugccuguaaucccagcuacccaggaaggcugaggcggcagaaucacuugaacccggaggcggagguugcgguaagccgagaucaccuccagccuggacacucugucucgaaaaaaagaaaagaaacacgguuaauaacauauaaauauguaugcauugagacaugcuaccuaggacuuaagcugaugaagcuuggcuccuagugauugguggccuauuaugauaaauaggacaaaucauuuaugugugaguuucuuuguaauaaaauguaucaauauguuauagaugagguagaaaguuauauuuauauucaauauuuacuucuuaaggcuagcggaauauccuuccugguucuuuaauggguagucuauaguauauuauacuacaauaacauuguaucauaagauaaaguaguaaaccagucuacauuuucccauuucugucucaucaaaaacugaaguuagcugggugugguggcucaugccuguaaucccagcacuuugggggccaaggaggguggaucacuugagaucaggaguucaagaccagccuggccaacauggugaaaccuugucucuacuaaaaauacaaaaauuagccaggcgugguggugcacaccuguagucccagcuacucgggaggcugagacaggagauuugcuugaacccgggaggcggagguugcagugagccaagauugugccacugcacuccagccugggugacagagcaagacuccaucucaaaaaaaaaaaaagaagcagaccuacagcagcuacuauugaauaaauaccuauccuggauuuuaaaaaagaaaaaaauauauauaauuuuauuuuaaauuggcuuuuaucuuuaauucuuuuuuuuaaaguuaucaaaucuucauuuucuaagaguagcccuuuauaguguacaaaaugauauuaagugcauuauuaucuucgcuuuucauggcucugagucauaaaacaagcugguggaucucacuguaccuaauuuauagacgaggaaauugucauucaaaaagauugacuguuaugcccagggucagcacuaaccugcagaaccaguauucaguccccaaguucagugucuucuacugcccucuacuaaugaaaagugaaaauuucccuggggucuaauucucucuucaguuugcugugccguuguuuaucuuugagucuucauucucugaagauggcuuucugccuguuucugguacauuagaauucucacuaugauauagaaauggcuucaguuucauagcauaaucuugcaguuagcucugaauugccucaaaaacccugaacaacgcgagguuccagauguguuuuacuucuuucauucauauuuacccccauuuguuguuuaaaaagaauuaugaacaauuauuacaucauauguagaccacuuucacugauuauauguugacauuuuccucaguaaaacauaaaguucuuaacaagacuauacuguaacaccuuucuccaacaaaaucagcuguauguugaaaacuauuaagucauugcuaauguuuuaagccauaauacagacagccuuauacucuaugaugggagaagggaaaguaguuuguccgauggugcuacucuguauaaacauuacugaugcuaucuauaguagggcaagaaaaguaaaaagaguuuugauuauucaggcagcauuuuuaaaaaccugugaauuuguaucaguucucaucuaaacauuuggacacaaguauaaaaugaaaacauaugcacaaguuaugguuuuuaaguuaucugcucuuuuuuuugguuucacuguaccuuuguacucuucuauuagugggaauaaucagacaugaacugugacuucacauguacagucauaccucacuuaaugauggagaugcacucugagaaaugucuaauuagguuauuucaucguugugggaacaucauagaguguacuuacacaaaccuagauaguguagccugcuacacauguaggacauguauauagccuauugcuccuaggcuacagcauguugcuguucugaaucauguaggcaauuguaacacaauggcaagugucuguuuauucaaacaucuaaacacagaaaagauacuacaacaauaacaauaugguauaaaagauuuuguaaaaaaucuggucaggugcagugguucacgccuguaauccuagcacuuugggaggcugccucagcagguggauugcuugagcccagaagcucaagaccagccugggcaacauggcgaaaccccgucucugcuaaaaguacaaaagcugagguuggaggaucaccugagccuggcaaggucaaggcugcagugagccaugaucauaccacugcacuccagccugggugacagagugacuccccaucuaaaaaaaaaaauauauauauauauauauacuauauauauauauauaccauauauaugguauauauauauauaguau

SEQ ID NO: 14657 - RNA, 1211 nt, Homo sapiens
cagccguuguccggacacagcacauagaaggagacgccggggucggcguagaaauccauccugcguucggucuccucgguggcgaugagcucgaagggcguguuggagcaccauuucuccgcaacgucggccagcugcuggaaauccaucgcggccccgcgcccgccucccgccgccgcccgcccucccgcuccuaggcgcccuccucccgggcgggcagcgcggcgcucggcucggccugcgcgggcuccuccggggccgggcugggccggcugggacuguuuacaugcggugcggaguggggcgggcggcggccggggacagcgcggcgccgcgcccgcggcuccuccuccgccccgccuccccccgcccccuugcgggccgccguggggguuggcgcggccgggccgggacgcggggcggcgggaggagcggccggcacccccgcgggcgcccggauuuuccugggcgcucccgcccccccuuuauuuuuaaacaaacccggagcaucccggggcccuggccaucgcggugccgccccgggccgugacgucaugggccccagccaaucaccggagccugagaccgcgccgcggcuugcgagcccggugacgucacagcgcgagccuggaauccgcagcuccgcggguuaccuggaagcggugcgagcgcccaauaccugguuagcguuucuguggaguuagaaagcccaggaagcguuugcccaaaugcgauuuaaaugcaagggaggccauagaacugcagauaacuuggaccuugucuggggcuagcaguggaggagcugagaaaaucuaaggaaaagggagcuuuucuuuuugcagaaaccaaaguucuguucuccgauugauuuaagggaaugugucuucuuaaugcauuuaucagacacuaauaugaauguucacuugcaaagggcgugugugauuuuuuauuugcguuacguaaagcugaauauuucuuagaaaugagccucauaagacuggcuucaguauuauucagcuugaauucacauugcauaaccuaaaaaggucaagaggauaaagcacauuuuaaaacaagaguguguggcccaacgauugcaccuguugagugcucacuggcugccauauacuggacaggcauuacuggauugcagaaaaugcacuaggguccucgcccucaggacuugaacacuacaaacacagacacguuau

SEQ ID NO: 14658 - RNA, 28028 nt, Homo sapiens
cggggcggcaccgcgauggccagggccccgggaugcuccggguuuguuuaaaaauaaagggggggcgggagcgcccaggaaaauccgggcgcccgcgggggugccggccgcuccucccgccgccccgcgucccggcccggccgcgccaacccccacggcggcccgcaagggggcggggggaggcggggcggaggaggagccgcgggcgcggcgccgcgcuguccccggccgccgcccgccccacuccgcaccgcauguaaacagucccagccggcccagcccggccccggaggagcccgcgcaggccgagccgagcgccgcgcugcccgcccgggaggagggcgccuaggagcgggagggcgggcggcggcgggaggcgggcgcggggccgcgauggauuuccagcagcuggccgacguugcggagaaauggugcuccaacacgcccuucgagcucaucgccaccgaggagaccgaacgcaggauggauuucuacgccgaccccggcgucuccuucuaugugcuguguccggacaacggcugcggcgacaauuuugugagugccuggaggagggaccgccggagccggcgggaguguggacgcggcggugcgucccugcgcccgagcucccgcgcggugggcggcggugggcgcagaguggggggccguaacccgcgccccgcgccccgcgugcuccgccggggaagccccgggccgggcggugcgggcuccgcugcccggguggggcccggugggcggcgggcaaggcgcccggaggauccggggagccgggucggggcgggagguguggcgucccccuaaaggccacuccucuccccgcugcugcgggcgccguuucgggaacccgaccucgcggcccgugcgcggugccuggcauggagcaucccuggggugugggugucacccgcgucggaccagccgggucuggggcgcacggacccuccggcaggagcccagguccggagcuucccacauccaggcgucccguccgggauaggaaucccgcuccccuccggugcccagccucggcuccucgcauugccccucccgggagaaccccacuccccgcccucgcggguuaguccuugcacugccuguuuggacacaaagcucuguccauacuagcgaugcccgaucuccuggaccuucuuugcggaauuacaccccggaucuuaauacgcacgcgcgccugcgcauacaccccaacacacacacacacaugcucacacccucacccucacacgcgcacacucacgcgcacacgcggcacgccucucccccugcccccgcgcugcccucgcugccucucugagcugcccgagagguguguguggcccgggcggguucucuccagccgaggcggugcccuggcccugcugaagcccguuggcuuuuccagaugacggggaauccccucagccccggcucagagggaccgggaacugggacugcgguguccaaaccuuccacuuugaauccugcacccaccugggaucccgacucuggcaguugaggaaggggaugcggagggcaggggagucggggugggagggguggaguagggcgagcacggugcucaugaaguguuuccaaggucggggaauaaauaaugauccccaaauguaagauggaggcggccgugggcgcgggugaccguguggucgcgggccuugugggcggaggugggguggugcggggcgcggccuggugcacgcuccucaggugggggagacaaagcugggccgugguccugccgccgagcgcccugaccaccuacgggaaguucgcgaaggaguuagggagacugcaagaccgccuuucuugguccuggagaggugaaggcuuauguaugccuggccgauaaagcauucccuccgcccacacgcacccccugaggagggcagggauccaccugggcauuccacaaguggcacuccagaagagggauggccuugugugacagccagauuugaguucuggcucugugacugugcucaaauacccacccugagcucaguuuccacauccaaaaaaauagguauaauaaugccagcacccaggcguucauauagguaacgcaccgaauagucccuaacacacagcaagagccccacaaauuugggguuagagaccugggguuucccagaauuuagagcuugucucauuuuuuaaagagccuugguuuucccaccuguaaaauggggcuaaucagaauaccuccagaagagccaacugaacaauaauauuaaugccuguaagcccaucuuaacuguagguaaaguaaguaaauaaguguucuuuuuggaaggagugggagaucauuaaaaagggauucacuccauugcaaaagugugagaaagcccccaggauacaguggaaagggcaccagaauccagcugacuguaaaauguuaggguuuggcuagggucccuuccagcucugggcuuccuucaucugccagcgcccuuucucccuccugaccgugugaaacagggcaagaauggcucaugguucuggauuucacuggggagaagcccacacagccuuccugcugggaccgcccaggccauacccaaagaaaugacuccaaagacaguaagugggccaggaagacaaaaggcuguucucuugccaugaauauguguauccaaccaucguucagaaguaagaaguauuauauuauuuguaucaggccuuucucuugaggccacccagauuuuaaauauuuucccaucugcaugagaaaaaugcuugaaagugucauguaaacugacaauuuaaauagaauagauagaaagauagaggaugggggugggcagaugauuccuuggguagaauggaacuuucuccaaguucuggaggcucuaauggacaagaugccaaccucgggaguuuuccuagccggaccucuugaaucugucccaggccagguuugucaagcuacuguuugccucuaauaaguguccugccuuaguucuuuucuuuuucccuggaaaauguauuaagcauuagacaaaagugugagaucaauggaauuucuauuaguugaaggacuuagcaauaagaaugucuacaugagcauuucucaauuuacaaaaguauuuccacaucauucauucauucauucaacaaacauuuauugaggguuuacuuugugccaggccagugcuaucuagaauacaaauagggucucugccuucauguuccuggggcaauuuuuacuugucuaggaagcagugugguguggugguuaagcacacaggcuguagaucagacuacuuggguuugcaccucagcuccccguauuugugugccuugggaaaguuauuuaaccccucuaugccauacuuuuuuuuucuuuuucuuuuuuugagacagucuugcucugucgcccaggcuggaguguaguggcguaaucuuggcucacugcacccucugccucccggguucaagugauucuugugcgucagccucuccaguagcugggauuaaaggcgugcaccccacgcccagcuaauuuuucuauuuuucguagagacaggguuuuguuacguuacuuaggcuggucucgaacuccugggcucaagugauccucccaccuuggccucccaaagugcugggaugauaggcgugagccacugcaccuggccucuaugccauaguuucuacaucuguaaaaucgggaugauaauauuaguaccuccugagcagaguuguuugagaaagguaucuaaaguaggggcagcuuagauagucuaagccacugucauuuuucaucgugucuccuaauuugucuccuugcuuauaaccuccaccucacucuuacuguaguacugaaguggagguacuaaauagauccaaaaugacugcuuggggagacugacucuaagccacugucuacccagcagucauuuuggaucuauuuaaaauauaagccagaucaugucaccacuaucccccaccucagcugaauugacuucccaucuuuuauaauaaaaccuaagcccuuacccuggccccaagcccccacaugaucuaccuuccugccacacagacccugcugguccucagaugugccaagcgcauuccugccucaaggccuuggcacuugcguucugucugccuagaacccucuugccccagaucuuuccacggcuggcuccucgaugcuccugaggcccaagagaagccuuccugaccacauguucuuagaucucacccucuuuuauucuucccauagcacucguuagacuuggcauucucuuuuugguuuucugccacugccacuagacucuaagcuucaugagagcagaggccuugucuguguuaucacuguguucuggcauuuggagcagcauccauacaugaugggugcucaguacauaucuauaaggaugaauaaauuauagucuaguguaaaagacaugucaaaugucaagaauucaguuucaaagaauaauaauaauagccaucacuuauguucaguuuacuauguagcagacgcugcucucggcacuuuacauaugccaacucauuuaacuuuaguacucucacauaauuauauaaucucuauaauuaucucuguuuuacagaggaagaaacugaggcauggcaaacuuuacuaacuuuuccacaguuaauaagugguagagcaacuucaacuauagcccuguauuuaaugcauggcaucacaggagugacaacaugggacccaaucuagacuggguucagggagugcuucuuauugggccucacagaaauucauugagguagauauuauuauucccacuuuauaggcaaagaaacugaggcucagggaguuuaagagauucauccaggacuguaccacuaagaagugacagagcaaggacuugagaccagaggccuguccucuccaccaugcagaacagcccacagguggggucaggccaguaguuccaggggcccauguuuaguaaacaggacgccuguuuauuuuuccuccauuuugggucccuugcacacucuuucucuaucucgcuccacaggccaucccauccaugccgacccuuuccaaacugucccucuaccugggaccccucucugugggccccaugaucagggccuggggugaaacaaagcugcuagugcccuguguguggaggaaauucaagggcauggccacccugccuggcucuacagguuugauaagggagggcuccuggcccuggucagagggguccaaggaguccuuucugccaacuuggaagguccuucggggcuugguaggcuuggaauggggugucagcagccacuuggaugccagauaaacagaggggcacuccuaggcauggagcaccagcugcguuccuuccuugucuuaggccacgagaaaugaggucucugaacaaagagcacugcccagcccaucugggggccuggauccugaugauugugggagagagggagggauucauuucccagauugcccagccuuuccugucagcccaaagacacguuggacucuaaaauuuuguauaguuuaaucccuccucagcacaaaaacaaagguaguaaucaugauauuauuaaagaaaaaggcuuuauuuauggcaggacugugauuuaauuuuacauguguuuguagagggguguguguguguguguguguguauccccauuuguggucugaacacaucuuuauuauuaacuaugugaucaaauaacagccuucuuauuuggauaaagaaaauagaacuuauuuaaaugagauugagucccgcuuaugugcugguauaguggagagaaaguacuuucuuguugauuuaaacucuacccuguuuccuccucugucagauagggacagucaugccuguauuacaugauuaguguggggaugaaaugaagagcugugcaugugaugugcucaguagacauaaggccauuccacauuggcugugccuguucauauagagagguuauuucugggaaaaugagagguccuuuguauauucuuugagugguagucaugaggagaguaguuacgucaauacaagcucaaguggaugggcauaaucgcuuauugggccccugcuaaaugagagucagucuacagguuguccccugaaaucuuuagauucccccuguaaauauaauuauuuucugugacuuacaaaugaauacacgaggcuccgguuaaacauugcgcacagaguguaguugaaagggugcacacuccuccguugacauucuggcucugcccuuguucccugugugaccacaggcaaguuacuuaaccucccugagccucaauuuccucacugguaaaaugggucaguggcugacacacagaucgggcuaguccuagguauggccagcugugcucuucccaccaugugcaguggcucacaccuguaaucccagcacuuugggaggccgaggcgggcggaucaccugaggucaggaguucgacaccagccuggccagccuggugaaaccccgucucuacuaaaaccacaaaaauuagcugggcgugguggugggcgccuguaaucccagcuacuugggaggcuaagucaggagaaucaauugaucccgggaggcagagguugcagcgagccaagaucgcaccacugcauuccagccugggcgacagagcaagacuccgucucaaaaaaaaaaaaaaaaaaagagaaaaaaagaaauauguugggaggcgugugguggacuguggcuuuuaucuuuuucugccaucuguuuccaggacaagaaucaggguuuuguuuugguauuuuauuuuggaaacagggucucacucuugcucacgcuggaguacaauggugugaucagagcucaccguaaccucaaauuccugggcugaagcagccugcugcuucauccuggcaaguagccaggacuacaggugcgcaccaccacacccagcuauuuuucuuauuuuuuguggagacuggagucuugcucuguugaccagguggucuugaacuccuggucucaagcagcucuuccgccuuggccucccacaauguuggaauuacaggugugagccaccaggccuggccagggauccauuuuggauuaagacacaccaauucaaaauggacucccucgguaccgaguggcagaaaacccccacuucaguacuccaguaagagugagucccagagcaagggccccagagggaggagacacaggaguguguucuuaccuccccugccacccccacccugcuuaagcaccaggaaguccagcugcauacccaccaggauuuagaauaguaggggugcacacauugugcucccccaaaaaugucuguaggguuggacuacuuuaaugacuggagaccacuuuuugauaaacuggauauuccgaucuacauuguacaaaacaggaaggugcucauuuuccuauuugcaggugacauaguuauauucucuuaagcugggcaagcuuuuaugauaaacucuggccugacuucacaggaagaagggucgcagauggccuauacucaaaucaaagugcuuaucggauuuucuguaggaaagaguagaccacucaggccagguucgaugacagccacuucacugcagcucaggccaaccugagauuuggagcuggcuauagucaguaauggcaauugcuguaguucucccggaaagauauuuaaaugucacaccacccacaacccccuucaaauauguaguuagccaaaguucugcugugcccaugguucucaaaguguggucccagaaccagccacaugagcgucagcugggaauuuguuggaaauacauauucucagcucacugaauaguucauuagcuaaauaaacugauuaccaagcagagguggauacauugcaauucugucauuguguuugagugauacacuuuucucaguuaacuuugcaauuuaaacucugcccccccagcacgcaacucugauccacacugaagcuugagaaccgcuucccucuacucccugaagccuuuccaggcauuucuccuuuaguccaagggaguccugcaggcuguugacgcucugacuaccgccuuauuagagagucaguacuuuccguacccagauucauguuugccagggcguugcauuguucagcgcuagagguucucugauuccugcuguaguuuuuuuccuggucaaaaugaguauuugguuacacaugcuuaaaauauuuuccaaguugaaguuacuguggccacgcccaguggcacaggacuccgggccuucaguugugcauuugucuuuguacaggacuaaauccuguucucaggagcaccagcccugcccauagauggucucuccacuccgcuugguuuuggaaugggccccuguaucuuccuaagagaauaaccgcucugcccccaacccccugccuguuaauuuuccugaagagcacgucuguuuuaucuguggacacuaccucgugagauugauagugccucuuucuuugcaugggcuacuuagaaagcuuugcuggcaaaucugugucccgucuguaguaaguagccaggcccucauaccuugcucuguuuguccuggucucacucuuggaucuuauuucccucccuuuguccuuuuuuuuuuuuuuucccaaugacagacuuaauuuuuaguucauuuugucuuguaucucgugauaccuugccggcugccuugauucauuuugaaaggaaggaauuuaaauggaacaccuccuuguuaugagauacaauggauaugagacaacuagcauuuaguaaaugaugucuuuuaagugaccguguacacccgaaucugaguccaaaccccaugccacucuaucauguggacaaggauucaguuacaacauuuuuuaaaccccaaaaccuaacagaacugguaauagguggagauagccaaaugaaggaaguucagacagaaggcccuuucguggguauuaagucuuccuucaacauauaguccuaaauugcucuaaaaggagaguaauggaaauuguggugugaacaaucucuucaugagguuagaaaugccuuagaaacacuuagcuaaauauacugucugauuaccaagcagugguggcuacacugcaguuuaugauucuguuauuguuugagugauauacuuuucuaaguuuacuuuguaauuuaaagcccagauguacuuacuuuuuaacaaaguagguuuacaagcuuuucauaggugcaccugcuucugaauuaaccgcaaccugaguugccucaggcagugcucucagugagucacauugggugucugauuuacucauugugugaccauagccuuguggcagaugguaagcccaccccuuccccucugucucccccauccuccugcagaugcaaagggggaaagaagguacuuaaguccaccauuuacugaauauucacugcaugucagcuaggcacugugccagguacuuacucagcuuuuaacucugucaucuucacaagucuacagaggacaggcuucaaguuuuugaaauguggugguagauguuaauccccucuuuaacuuggauaauaauuugaaauaagcuggaacuuuuacacauuugaguaugaaaauggaugcugagcagaacuuacuaaguagaacuuuuguuguucuuccagaaucuccacugauuaagaaucaacuggcauaauggauauacaaguacuuuguaccauuacacuuuuguacaauggaagagacuauuacauaaaugacauuguggugguuugacagcuuuaagggucucuaauuaguagggaagagcauuugagcuguucgcuaaagcuagagagcccagacguugucuuuauuggguuggggaagccucuagagaagucugcuggcaugagagcaacgugugucgaaaauggaccuuugcaacuaugaaacacagauaauugggguauaaagaugguacauuggcaccuaguuauucucauuuggaucugagcaguauuuuaagucuguaggucuaguucucagaaacccugcaaugagaagaaaggagaggaaauguguuuauugagugauagggauauggggccagugugugcuuggcauggaccaugucuccacauaagucuucuauccugcuaucuggccgcugcaucuuguucuuaucugccagaugucuuucuuucucccagaccucaauacuuuuuuuuuuuuuuuuuuuuuuuugccaguguuuagccauccuggauccguccccacuaaagagugauucuugguaccugacagauacucugauguuacccuggaagccccgugucccugacuugcuuagauaugcagggcaggguauucugcauuaagaaugcucaaaccuauuucuuggccuuguuccaggucuuugaacauuuaugagagaggcuugccuagucuuaaagaugugcuaaaauggauauccucacauggaaaaaagccuuacccagucuucagaaaaaauaaaaccuagacugggcaugguggcucacgccuguagucccagcaauuugggaggcugaggcagguggaucgagaccagccugggcaacauggcgaaacccugucucuaccaaaaauacaaagaauuagucaggugugguggugcgcaccuguaguuccaccuacuuggguggccaagaugggagggucacuugaaucuggcaggaagagguugcagugaguuaagaucaugccacugcacuccagccugggcaacagagcaaaacccugucugaaaaagaaaaagaaaaagaaacaaaaaaucuaaaaccgaucuccucuuaguauguguuagauugugaaaugaugcuucgguaugauguccuuuuaaagcauuuuagggaagggaaguuuucagaaagccuuuguuuuccagugacauaguggugacuugguggguucucuuaaguuauuugcauuuggaaguaaauuuaccaccacgccuacucacaggccgaucuggguaaagaaugucuuguuccaaguuaaugcuuacaaacuaugcuuaauuaaucuuucagccguagcugaaagcaaaguuaaggauuuugaaggcaaaggcucugguuucuccuuccccaugucugaaaaccgcccuuagccugcacaaggugaacaguggaaaucauuggugaggaauggccacccacugcccucuuuacuguguaggagcagaucugaugaugaacagagcaggugagguauggaccaaaagcucgggggcuucuauagauuagacauuuuuucuucccuuucaacgcaaacaaaucaagaacgcauguaugaauuuuacuguagaauggaggccuucuucaaauugauguuauuaagaaaaucugcuuggcuuuucugaacuucacacugaguguagugacugugugucuuuguuuucuccuuccgucgcccgugggcacgcagcacguguggagugagagcgaggacugccugccuuucuugcagcuagcacaggauuacaucuccuccugcggcaagaagacgcuccacgaaguccuggaaaaagucuucaagucuuucagaccuguaggugccugcuuggcuucucaccacagcuuguuuucuauggugauuguguuuagaauaacaggggcgguggggaaggugggcaaaaccugggaugacuaauuguuuuucucuugucuguccuguggcuuagagauagcagccaguauagggaggccgagggcgggaggagggggacgggaugugacacagcuguuugcugcagggaugaugguuauuucuagcaucacuugaguugagaaucccugauggggggggaagcaaacagauccuuuaugagacaacugaguguuccuguucuccucuaggagacuuggaaccauggcacuugcaagcccaauggagguucuuuuauaauaguggggcguauauuuggggauugcugggaagcuguauacagguuauauuaauaccuccacguuuguggguauggaaaaggaugaaacuggauacuggcucuauucuuuucuauuuuuaaaaagucucuguuaugagcuacuguugcuuuguuuuccccuuuugggauuuaggaauguguauuucuguggcuagcugacagucuguuuucauucuagcugauaaaccuuuaaaaugaaugcucacuucuauuuugaagauuaccuacuucccuuuaucuucauuggaagauaaagucccaucaccagugucucaguguuuccccuaaguucgauucccugcccacuguaaauacugcacauguucagugguauuugcuagaauuucuauuuauuuuucaaaucuguucuaaugcugucuccuucucugcugcguuuuucaagcuugucuucuguuucuuugaacauaguaagcuugguugcauaguagacuaugucugaugauauuucauuuuguaagucuguuuggucuucuuuuguuucugcuaguucucaaaccugguaucuuguuucucugugugugggauuaucuuugugugcuaguuauuguauuugaaaguuuacauguaggaauaaagugaggccugagaugacaguaccuuacuccagagaggauuucuguuugcuuccgucaggacuugggggccuauuagucugagacaccuuagcacaguuuaagucuugugguucucugauggcucccgggggugagaaggcaggaugcgggucuggccuccugugccuccuccucguucugagggugugggccucugggggcccagcuucaaguggggaugguguauagucugcuccuuuggaaaacuguuagaguagccugagaaagcagugaaguuucuagcugcugcuuccaggucagcaaaugcccccaggauaaaagcagcuuuuuauguuuggcuuacccucuccugguuaauauuuuauauuuaagaagguauuuuucauauuuaauucagcuuuuuuuagucauucucaaugaaagaguuggacccagucacuuugugcaccauuguaagaaaugagauuucaguggcuuuugucacucugauuugcuuaagcaaaugacagaaaucaaauagagugacaaaaaccacugaaaucccuuuuuuguuuguuaauuuucuaagccaguuuggcacauucaaaauagauacuugacuuaaaaguaccagucugucccacauucauucauucaauaaauauguuuuggguacccacuggguacauggcacuguguacugcauuguuccuggcacuggaacuaaagcaugagaagcuuagaucucacagagccugugcuccaguggggggagacaggauagacaaggacacacguaaugucgugaaaugaugcuaguaauuaagugccaaagagaaaggaaagaaaucagggaaugggguaaaaagugucagggguccuggaauuuuugaguagggaaccagggaaggcuuugcugagaagguaacauuugaggaaaaacuuagacuacagagugggccaugagaaaaucuaggggaauagcauuuucaguagagagagcagcagguaugaaggccucgggguuggacaacaccuguguccagggagcaggagcggccaguguggcugaaggaauuagagagaggugagcuggaggaauuccaggagucacagaaggacaugggcucuuacucuggagugauggggagccccccaagggguuaggcagaagagggaugucaccugacuucacaucuugaaagccucccucugaugacuguguugagaacaggcuguguuaggggagggacagagaggccauugaggccauugcugucauccaggugagagauagugguggccuggacugggacggucacggcagaggcggggugagggguuggauucuggagauaccuugagaguagacccagcuggacuugcugguggaucagaagugggaugugggaaaaagggagagaaggcugacccugaguuucuugcccaagcagugaagggaauggccuagucauuuacugagauggggaaggcugcgggggcgggugguggggaguuugggguugguaaugucagagcucaguuuuggacaugucaguguuuuaaaugccuguuagacaucgaagaagggagaucacauuaggcaaaauuaaaaagaaauggauuccuguaaauuuuaaccagaagaauacccguuagcaacugagguucgcuuugcagcagguuuccucacaggggcucacucauugaccugccgccagcuggucucugugggugucgucugugguggcaggcagccuccccucccugcagaacuggcucaccugggaaggggagcuccagccgggagucacugugcuguuuuuccuuaccgaggcucugguuguauuuuggcaaccaggcuagccacguuaaaugaggaaacaaaugcgguccaaaagaaauccggaugugcagcugaaagcaguuggauugguugaggaaguucuuucagguggcgcugagaugugucacgugggcccacagcuuuggugugcuguugcugggcuuccagguuuccuuucugaaguggaacuuuaccuugugggcagggauguggcuccccaggugaggaggccuugacguggcacagcaugcccuuuggugaggagguuugugggcugggccgcccucuggcagggccgguuuaccccugagggcaaggcuggugggaggcaccuucccggacugguaaagaugaagugcugaaggccucaaguuucucccagucaggaugcgccccagacugaaugagagggagcgucacaaacccgaauaaaggaccacagagaucccuggagaaacuuugacacucuccaccuccaccaaauagagcacugcuucccaauggcaccauuuaucuguuuguuuuacguaagggagguuuguuacagauaagacauagguagggguuuuguugcugucaucacaguugaacguauuuguugaaacgcuuacccaaaugcuacagguuaucaaguggguaaaaccagcacaucauuucccugaaaauacaugggaaucugaucaauccaugcagcugcuuuuuuguuuaucgugggccagccccaggaggaguguuuuuaccuucaucuuagagcaguccccugcucugccuacugcacucuacugguucuugggagagcuauuucugugagcauguucugcaggggguugcuugucaucucuuaacccaauuaugagggaacagguacuacagucaugaagaacccaaggucuguugucaggcuacccggauuuaagucucaguucuaccacuugcuggcugugugaccuuagacaaguuacuuaaccucucuguuucucaguucauuuguaaaauuagaaaauuaaugaugauaguucccuuaggguugcagugaagauuaauggaguuuuuguuggguacucagugcagugcguuauccacgguaggcacuaagucaauguuaguaugauguggauaggaugaggauacuagacaaaauacuguggagaagugagcagguuaccguuggggggaaccuuagauuauugguggagagagaaaacaauuugcuaagugauuucaacaugaaaaggcauuagaaggguaagucaaaaguuuaucaacauugguuuugguaaaauuacaagcauucacugaguaccugauccacacgacucacugugcuagaggcuaggacuccauagaggaccaguggaugcaccuguccucccagaggggcacguggccaaagcgcucaggguuauggaugauuuuuuauuuucuucuuuuccacauuuucuaaguuuucuaugaucacauuaucagaaaauauauuuuuuaaugaaacuguggcuuccagcguauucgaagggcuaggaguaucagugugagcaggcucauugaggaacaaagccaggcaguggcuucaugaggaggugggacugaagaauagccggaccuagacgugcucagagcaggggcagggcuggcccaggaggaaguccaggaagcguccaucuuggcugccucagcuccguuuccuuagaaauggcuccaugugguggaagguagaucggcucugcccuguuuugcucccaugcuguguggccucuaacagguacacuuggccucaguguccccagcuuuaaaaugggggcaauacugauuuagcugucuuguggauucauggggaacuuugaagucagacugagaacccaaaggauugucaaaacccagacacucugcuaaauuuagucucaguuucuggcuccuaacagguauuaggaaauguuuauuggauggguaaaugacuguggaugcagccggccaccuucccucgagugacccacauucuacuccacuccagugaccuccuacuugcuaauguugauugcucagagagguaugauuuuuaccuauuuuuucuugcuacuggcaugucguauccaaauggcacauguaugcacaugacaaugccaggcaggcuguuguuggcauccacgagcagguacugcuacuuguagugguuucagaaacccccaucaaucacuuugguaagugugaguuggauaaucgucagaaccuugcauuuuucuuaagugacccuccauugacaguugcuggucauacacgauugagcuggagaaugaaacaaugguuacggaccuaaauaauggugaucaugccguucaguuuuccccaccaucuuuucauguuuuauauuuagugucaacugacagacuuacugcuggguagaaaacaguuuacaagagaagaaauagccuacuauuuccaauuuagcagugaaacuagacuuuaucuuugcccuuucgaauucucucaaaguguuaugggcuuaacaaggaacuauugcuuccucgaguguguucuucuccuuaccaacgcuguggacauuaggguccugaguccccuauugcucuugcaguuuuuugugcuguuugguuguuguugcuuccauggcccggccuggaguuggguccugugguccuuguagauucucacucaguuggcccaaguccucuccugggcuugcugugugacucugcguuucuucucucaagaaagagacauuucugccagaaaaaucccccuaauucugguucacuggcauaagcaagauugauauuuucaguuugccacaaguggcuggagagcugcggcuuaaaucccacaggaaaauccugugucccagaaaaaguccaauucuugccucuacucauggagucuggucaagagccuggaaaagagaaagaauccaccugucagaagcugccuggguggaucagggaaagucugaugagaaaagauuaugcacacauguggguuucauaauaaacauggaauauugacaguuuaucuuuuuuuucuuuuuuccuuuuuuuuuuucucauucauguuaugaacauucaaaccauucucuuuuuuagagaguaugauggccucaaaagguaagagagugccuccuccugcccauugugcugcauccaucuugccacccuuuuuuccuuagggucaagaagacugacugacagaccaggaccccaccagggguuuccccauaccgccagcaucauaaucaugaagauauauggugccacauuucccaaaugcuuuagaguccuaccaccccuggcucuuggacuaacaguauucccaucaccugggaguguguuagagaugcagaauugggucccacuugagaccuguugaaucaucaucugcguuugagguagauugcugagcacauuauccacaccuacacauagugaaggagaagagagacugccuaaggggagucccuggaagguacauacaaggaucucugaagccacagggcacuugcucgaugcacaaaagccaugguugauuggccgugcucuccaggguacagacaccaccuccccuuccuuuaugaagaccuucuagcccacugugcugagugcccccuccagagacaguagcugcuaaaugccaccucaauauggccucacauaguuuacacuauuauccaaaagaccuguagucggcccuacagauaacagauacucucuugggucugaggaacugaauucuccagaguuggcagcucugccuuucuggugcaaccuguuuggauagaugggccccagcagugcuuaugugaucaccgauagcucacaggaagcuuuguggacagugagacacuggaaaugcuaacucucuuguccagagugagcauaaacuauuuucccagucagcugaaaaaaaauucacugaaauaggaauaaaugauuauaacugucaggaauaauuuaaauauaccagucacuuucguuuuuuggcccaccuuuuugguaugagaaugugugguugcaguaaaagccagggcuccagaauucuucccagucuguguguacgccugucucuucuugacuguugaaaauugggauccagaaguuaaauuuagacuugcccaccauaggugggauuaagcauagaggugaggaugcuagauuacuacauaucuguaagauaugucccuuagaauuccaggcagucuauuucuggugcuuucuauccaugcuuccaaauugucccuccucacaaauuuagacauuagcauuucauauugcauuuuuaaaaaagauuuauuccccagcggaaaacauugaaaccuccagcuaauaggaacagcauuaacagcugaaugggagucuccuggguggccugguggguaggggugugaagucugcugucagaucacccagguuugaauugaauccuggcucugccacuuacugggugacucuaggcaaguuacucaaccucuucaggucuuaucuguaaaagggggacaauaaaaguguccaacacaaggucauuaugaggagcaaaggaguuaauguguguaauucugcuuaagacagugcauuugcugugccaaacccccuuuuuauuuuauuuuauuuuauuuuuuuagacggagucuugcugugucacccaggcuggagugcaauggcacgaucuuggcucacugcaaccucugucuuccugguucaagcgauucucucaccucugccucccaaguagcugggacuauaggcacacgccaccaugcccagcuaauuuucauauuuuuaguagagaugguguuucaccauguuggcuaggcuggucucaaacuccuguccucaagugauccgccugccucggccucccaaagugcugggauuacagaugugagccaccgugccuggccuaaacccccuuuaaccucaguagggaaggcaccagguucaagaggccaaagaagagacccagagccagcaaacgagacacgggguuuuaccguacugacauacaggggagagaguccagcagcaggggcugggcaggagaaucgccuuacaugcaguccaguggcggcaggcuggacagaagaaccacguggucccgugguggugggcugggcaggaaaaccaaccuccugcaaucagugugcaguguauauaggauuuucacucaacacccucccgcuaaugaccuccaccuggcaacauucauuuaacccagaacucagggccgauuuuaauccccuauaacgacccauguucccugggauaggccauaggcucacguguuucuuauagauaaggagugacucucuuggccacucccaguuucccuaguuccuuagagauaauauagcuagauuacaucacaucacaucacguguaguuacauaaggcuccauaguuugcagaucauggcugccuucaaucucucaugucaucuccauaguuacucugugagauagagcagguaucauggcgcuuuacagagaaggacauugagggucagcaagguggugacuuggcagaggucuccagcuaacuagagcucuggccucuggacucuagugccagugucuuuuuccacacacccucucaauaaaucuguagacccuacacuaaggugccuccaaauuccagaaggccacagagaacugccucuccucuccccuuuccagaagggcagugagugagcagcucuugaaagagcagucagaaaacuuccagccuggggaccugucaguagaugugcugguuucaucugagguaagguagggagcuggaaaaaggaacugcagaagagagguggucauggcuaugugcuugguuuccugggucuuuuucaauaagguacccuaagcugaagagagggaggguguugagugcuaccuaugguuugggucaguaugaaucaccuagggguguuauggaacagaaucgcccaugguacaucucuuuuggauaaagauggcaaauaugcagaugcacaccucagcugcgcccuuuucaugcaggacagccauugcuaguugaccacaguguuuuccacggggccucagaauccugaaacuccaggcagccacucccugucaggucuguuaagugagagggaaccaacuggucauuucucuuuagugacaucccuucaauacaaugaacaauuauauauauuguuuagguaauuuuggaguuccuggugguggcgauaguauuuauauuuuaccagcuauuuaaauguuaccacuuauuugacacuuuuaccuugcuaugucaucgagcagcucuccaaauaaaaaauugaccaccaaguguagucaucgacgugccuuacgacuagucaucuuuucucucuuuagaggcaaacuugguuuuuuauuccauuuacuaaaaucugcaagggagacaggagccggaaaaagagacuuucuucucccaagcacacucaagauuggagcacccucuccggggagcugagagcgcucuuccugcccuuccccucuacauccgcagagucucugaggcagcuguggcaugcucagcucuaaggggcgagcgugugucugcaguugacuguguacgccuuggcaagccacaggcagagugugaccaacaaugccuagcagaugauuuuguccugaauguguucauagggugcugggagaccugggagagcugcagcuggagaacuucagagugaaggcauuauuuucaucaggacucugcuuucucuuuccccauuucagccguggagggagugagagaggaaggggguggcaggacaccagggaggcaaugcaauugaacagaauggucagucuucuuuuuacugucuugaugcaguuaguguuuagaucauuagggccacucagugaaggugcuugaaauugauggcccuggacaccccuauguaagaaguccuugggccacaaacagacuguagaucucaugaaggcaccaggagacagaagccugguuaucacaggcagguccgacagcuaggguuguggcuucuugccugcaccaggaggugguguucauacugaucaggccuagcaaauggcacuugguuucuaaccaaagaccagccagugcuuuaaaaaacgauguuuauuuugaacgucccacauaauuauacagcaauuggaaaauacaaaaagauaaaaaggaaaaaauuacccauaaucucacaaucuuaaaaaaaaccuuaaaauugggguguauuuuacugaagucuuuuuucuaugcauauguguauaaauuuuaagaacuccgggucaggugugguggcucaugcuuguaaucccagcacuuugggaggccgaggcaggaggauugcuugaguccagguguuggagaccagcuugggcaacauacugagacccugucucuauuaaaaauauauauauacauacacacauauauaaagaaacucugggucaggcaugguggcucacgccuguaaucccagcacuuugggaagcugaggcaggcagaucacaaggucagaagaucgagaccacccaggccaacauggugaaacccugucucuccuaaaacuacaaaaauuagcugggcaugguggugugcgucuguagucccagcuacucaggagguugaggcaggagaauugcuugaacccgggaauuagagguugcaguuagccgagauugcgccacugcacuccaaccuggcaacagagcgagacucccucucaaaaaaaaaaaacucugucauaauaaaagugcaauuuugucaugcuuuuuuuacacuuaugugcaucuuuuuaaugucaucaagucauucaaaaaugccauuuugaguggauauauaagauuccauuucaauaacaccauaaccauuuugcuguugaacauuuuaguugucucuagauuuuuagaaauguguuauaaauaauagcaccaauaaauaauagcaccguguguuuuuaggacagaaaauacagaaucaguuuuugacaucuuggugggacagugagcacaguucauuucauacgacugcugacaucccagaugugugugugggcacauagcuagcucucugugcauauguggugccacauuuugauacuuaaaaauagagacucuccaggcuccccaguaaaaccuagcccuuugggcacuaauccauugaaagauugacauuuccgucuaacaaguuuaugaaaaucauuguaggggugguugacggggaagucugcagcugcuggguuaaguacucuuuaauguggauccgaugccuuugguugucuuccugccugugggccauuuggcgcucacagcugcuuuucucuuguucucucccuguaguuacuggggcuuccggaugcagaugacgaugcguuugaagaguacagugcugacguggaagaagaggagccagaggcggaccacccccagaugggggucagccagcaguaaaucugggggcuccccugagaaggagagugagccccacaguaaccuagguggggucacugccccuccuggguuagcauuuugcauuagcacuucgaaauaggacaucuggcucccagcauccaaauuaaaaugaaauaccuuuuuaacgaccacaaaauaucugugaugagcuuugcucagaagugaccugaauuucacucccgcuucagugggguuucuauggaguugucuugguagccuuugccauuuugaauuuagaguccauuuuguggcugacuauucucuuaaguuuauguuggagaauuaacauucgcugacucgaauguagagaacucugaauguauuaaggauagguuuugaguccucacaggugaccuuacugagggaaagcauggcagagaagaaaugcagucugcacuuuuuauguacuuuuuaaguguccguaagugaaagguuuugcuuauaaagcaugaauuuuaauaucuagucauuaaacugcacaagugcaaauacaagggcaggaaaggauaaucacuuagcuuuggacuaagaggguaagagaggcccagaagccuuuaaguguuuugccauuacugaguuaccuggguauguagcgacugguucgugguuagguguaaauguuacuugcuuguucgacuguuucaaaacaugcuaauuccaaagccacuuuugaagucuauaguggaaaauauagauggggugaaagauauaauguauugauuuuuaaagcuguuuauaagccgucccacguauaaaaugaaacauuuuaccuucucucuuucuaaugagauggccgcuuguuaaaucaugaaaacauccagaauucaagugccgcuuaaacuuugaagccauagauaaauuuguuagaaaaguaaaccaggauuaaaaguuuuuaaaaauaugguagaauccuucuuuacuuuuuaagucuuuuauuuaaaaaaaaaaagucaaaaaaaggauuccauuguguaauuuauuuaaaaauuuaaucacauguuucgagggacuuaauugugguguauuuguaaagggacacgaagguaggaaucuuuuaaucguggguuagcuugguuaacagggaacguuuuaauaaucaagauacucagacaacucacagaaacaacuucuguaauaacuggaaauacugcuguuaucguuuagccaacaauuacuuacuggggacauccuuuguaaugcuaacauggaauuauuccuggacccuucugcaucccugguuuuaguuaaccuaggaugcggaaugccuccuuuacaacacuagauuaaaccuagcaucugggguggguacguuuaaacagucacacaugugccuguuagguugugaaaguuuugaauuaaaaacaagcaguagcagcagaggccacagaacuuaugggagucuuguauaucuuccaggcaugucgguguaaaccugauugucucgacauuuucuguuuaauugauuggugcugugaggaguucggcugcucgugguaaaacagcguacuccaguuuuaagucaucggguaaaauaauaggacagugauuuccaucugugcuucaguacccacuuuguguucuuuucuugaaaagucauacuaaagguuaauuucaaguaaaaugaauuuccuuccaaguagccuauuaguaaaacacaacuuaguguuucauccauuggggugagcauauacugcccuuugcagcccugccuguguucugauuggcuccauucaugagcaaaggugauugugagcuguauauuacacaggugucgcccagguuucguaaccuccacuuuaaugcaguaagccgcaagaaugacuucugcaagugaaaugaggaagcuucacuagcuugcuccauuggaagguaaacugaaauuuuauacguugaagcuuaaaaucuaaauuuauguauguuuggaaauggaauggacauuaacauaaaauguauuuuaucaaaaaaguguuuagacuuugaccaaauacauguugguauuaucauguuaauguucucuguuuauaaaaauugaguggagauagauagacucggccauucugugggcugaugagaauucugggcuuuguuuugcaccagggguaggaaacagagaacaugucuguauguuacuuaaucuccauagcaaaaucccaaacagcauuagcagaucgaauuguuucuucuaagacuuccuuuuucugaaugugugcacaucccuucucgugcucacacacuugcccacacacucacuucuuccugcgcuguggcugcucuaagcagggcugugcauggugcaaagcugcagucagugagccuggcagccugugguuucuguuauggaaaugguuccauggugaaacacaucccugacccuucacagacuuacacauuuacucaccaggagguggcagcggugugggaggaggaguguugaccuuggacgcaggagagacaccuggguucuaguucaagucggccaaggacugugugaccuugacaagucuaacuggucugugaacaaggggcauuugcccuuccagcuguaaacacugcccuucugugccugccuuaugugugugugugaguaaggagcaacagucaaggaaacuuuuagggauucgagaagaaaauacaugugggaucuugccaaggugcugccuuuaggaugcugaccccugcacuaccuuagaacauguugaucugugagugcccaagccccugagggcucgaucucauggggcagaugaaauucucuuccuuagaggaaagggaaaggugaggccccagaggacuuaucucagcuguacaugcucugccuguggagacauggcuuuucuuugugcuguggcagacuggggcuuuggaagugguguauguuuaacuuaccugagagugagagauguguaggaagaauagcuggaagaaagugaaagaugagugccaguacuuuuggccuguuauccaguagagagaaagugacagugaaaguaacgugagagagaaagaguguguguguauaugugagagagagaaagaaagagaaaggaaugcuugauugcuuguuguucacugggccagcucugaaauccaaaaucaugccuugauaacauuacaaaaccgugauccuggguuugagugaauccuagagacauuguucuuauggccgccugguuuccgcagccugaucaccauaucgagcagacgucaaggaaucagagugaaguacggagccagggagggaggugaggccccguguagugccugucaccacuguggauucaccugcacucagguguccacuccugucucccaggcccaaagcagcacauggugcaauggaaaagucucuuauguagggauccuccuuguguccuggugccagaauuagauuuccaguguacuucaacgaaaaccucucuccuuuauaguugcugucaucuuucauguauaaacagaaaccgucucuagcacaauauauuucugaauauuguuucuguuucauaagagcacaauguacauggaccuaggggagcuguggucccaagugucauuggaauuuauauuuuaggaauaggcuuugcauguuaaaauucacaaguugggaaacugguaugaacagaucugauuucuuacagagaggcaugaaggaauaggcaggacuuaacuuggggugggaggagaugaauaagggagaaugggagaguuggggucugacaguuaccaccugagccccaggaaaacuguuuucauuuucacggcugucucacugggggccugcuuuccucaaaggaacugacuguauguugagaggcaaugccuuguguuggcauggcuuugccacuuuaaaagugccccccagccaaggagaccaacaggaacccugcucaucugguagggcucuuuccuucaguaaaaccagcugccagccugagaagccugucuuucccaaaugcaggcagaucugagaggggcuccaggcacccggcagguaaaucacaaagcaaacuuggguguccuuggcagcggggaggaagcaggagugcccccucaggccagagggcagggccaaccuccucacugugcuucaagguuguagaaagagcacaauuaaugcuuaagcgaucacagaccccucuccccugcaguggguguuagcuccaaagagaugccauugcugaucacccagucuucggagaagccuaaaauuucuuugaauuaaaaacugauccuuuuucauaaagacccagucacuucucccaguuuagugauaacagguaugacacaagaagcugaagucuuuuagauuuuauagagaguaauucugaaaccugccagaaugcugguagccugugguguccauggcaauggguguccaugguaaaauaucuauagcuucugcucacugggcaaauauaaaagacaacauauuauuuaacauaauauguugucuuuuauauuuuuauuuaaaucuggauuacgaaaauauaguacccaugagcauuucauguuagaaaccccauuuaaagcacuauaaggcugaauaggcacaagcgauuaaaaguagaugccaggccacauaaaaauaaauguuuuaauuuacuuagagcuguauucaaguuguuugauaccagacagaaagcugacagucuguucuuuguaaacugccuuucccuguuuuucuguuuuguuuuguuucucaaguuucauuuuuuacuaagccccuucugacaccuaggcagauaaagauaagaguagugcgcaguacaaaugucagcucugaagaggaggaaguaaaucuucaaugcuagggcagaucuucacuauccgugauccagucuuaauuugagcaugagagcaaaauuuagucaucuacacaagaagcaaaagcaaggaauaguuguuggguuuuuguuuuuugguuguuguuuuuuuuuuuuuuuaggcaagaaguguugccgguaggguaugugugcuuucuuugccuuccuauuuccuuucaaagaaaucucuuguaaauuacaaaacugugaauuggguugccaaaaacuguugcccuucguuagaugcuucaaacaguguaaauccuauacugcacccuguccaccucugcucccuccucccuccccugagagugaggaccucauccgaccauguaauuaccauucgcuugcuauuaaagagccuuucaaacucugguggugu

SEQ ID NO: 14659 - RNA, 1136 nt, Homo sapiens
aauuuugucaugcuuuuuuuacacuuaugugcaucuuuuuaaugucaucaagucauucaaaaaugccauuuugaguggauauauaagauuccauuucaauaacaccauaaccauuuugcuguugaacauuuuaguugucucuagauuuuuagaaauguguuauaaauaauagcaccaauaaauaauagcaccguguguuuuuaggacagaaaauacagaaucaguuuuugacaucuuggugggacagugagcacaguucauuucauacgacugcugacaucccagaugugugugugggcacauagcuagcucucugugcauauguggugccacauuuugauacuuaaaaauagagacucuccaggcuccccaguaaaaccuagcccuuugggcacuaauccauugaaagauugacauuuccgucuaacaaguuuaugaaaaucauuguaggggugguugacggggaagucugcagcugcuggguuaaguacucuuuaauguggauccgaugccuuugguugucuuccugccugugggccauuuggcgcucacagcugcuuuucucuuguucucucccuguaguuacuggggcuuccggaugcagaugacgaugcguuugaagaguacagugcugacguggaagaagaggagccagaggcggaccacccccagaugggggucagccagcaguaaaucugggggcuccccugagaaggagagugagccccacaguaaccuagguggggucacugccccuccuggguuagcauuuugcauuagcacuucgaaauaggacaucuggcucccagcauccaaauuaaaaugaaauaccuuuuuaacgaccacaaaauaucugugaugagcuuugcucagaagugaccugaauuucacucccgcuucagugggguuucuauggaguugucuugguagccuuugccauuuugaauuuagaguccauuuuguggcugacuauucucuuaaguuuauguuggagaauuaacauucgcugacucgaauguagagaacucugaauguauuaaggauagguuuugaguccucacaggugaccuuacugagggaaagcauggcagagaagaaaugcagucugcacuuuuuauguacuuuuuaaguguccg

SEQ ID NO: 14660 - RNA, 2693 nt, Homo sapiens
uaauuucaaauauaguaaauagcauagacacacccacauaaacaaaagcucuuugcacuccacaauaauuuuaagaguauaaagagagccugaggcuaaaagucuaagaaccacugauguggucuaaacugucacccaggcagggcuccuuccacaguguccccagcagauggguuaccuaacuucccuuuuacauaacuagccgagucccuuccaaaacaaccuuuuccacugcugagguggcucugacuaauggaaggcucccauaccaaccuccauccacuggugccagcugugcugucuggagcuacuaggcaaggcuacaccacucaacccaauaauggugccagcaagcacacaugaugcacuacacagaaacacaacaguguccugcucucaggaggcuuacagacuaagcucaagauugcaaauagaguuuaucucacauggagaugggcuauuccaaccuccauauucgaagaaaucucuuacauucugccaaccucccacaagauuaaacaucuccaaaucuuuuaauuuccuccaaacuguucaccauucuagccccuuuccccuggacaggguucaguuuaugaauguccuucuccaacaagaaggccuagaaugggguaugacaucaagauguggccugaacuacacaguggcgggaaggcucuuccuugaucuggaccccaagacugcaugaucuugacagcacugaaaucccagagcccuaaggggccuuagacagcuggucuaauagaagagacugcagccaagagaaauaaaaaccuugaccaaagaccccauaagauagagccaggggcagggagaggacucacuucuuuccauccuaauuccaaaugaauugggagaacagugccagcaccugcacccacaccuaaacauacagcagguaagugagagcgcagguggacacagacacccuguuuuugauuggcucaggcucccugauuugacugauacggcacuuugaguuugguguuugcuuuuguuuugcuuuucugauuguuguuuuacaaacuucuuuuacauuugucucucauuuuguuuugucucucugccuaauggaauucuaccauggucacccuguaagagagacuauaaaacaauaaugugaaauuuuuauaaucuuucuuugaaagagaaaaaaauaaaagcagaauaaaugaaacuauaaggcuugggggguuuagccccuuuugacuauuguguuuuagauuuauuuuaaaagaugcuguuuuuuccuuuuuuuuuuuuuuuuucuuuuugagacagggucucagucuugcccaggccagaguacagucacaugaucacagcucacuguagccucaaccucccagguucaagcaauccuccccacucagccuccugaguagcuaggacuacagaugcacaucaccccaccugccuaacuuuuugauuuuuuguagagauggggcggugggacaagugucuccuuauguugcccaggcuggucucaaauuccuaggcucaagcaauucuuccaccuuggccucccaaagcauugggauuacagguguaagccaccacacucagccuaaagaugcucucugaaccuggauagguucuccacuccugaacugcaaagacaaagcugaguagguauucuuacccagcagaggaacagaaaaccauggcauccaccucacaaacaaaauggguaagcuaagggcaggaaaggaggccugcucaaggccccacgugucauugacaguagagccagggagaaaacagaggcacuguucuucccaccccacacacagacccucuucucggacugcccugugggguaccccaaauaaacccaggcgugccuuaagcccagcccaguucucagccuccagucccauaacaacagaaagagcaacagccccaccuguggggagcuggcgaugggcccagacaucaugccucgcacaaucagaccagacuuuggccuggaauucucucccauccucuucacauccaaggaaggcuccgagugaagcuugucuaucuucucccaugcagaagucaacacaggaguuucacccgggaccgucugcaugggcuuacuuuugugcgggggccuuuuagaugauacaaaauuaccaaguacaucuccaucaagauugucaugucugugaaaaaggaauauuuccauuaaaacagacuccccaaaaggaaucaguaacaaagauagcaaauuccacauucaaugugcauucaaagcaagcccauuaauaaaucuaugaugacuucuaaccagccagugcguuaucaugaaagacaaggaacagaaaauacucugguaucaaggcaagucugcccuauaaaauaagaccaguaaacaagcaaacaaauucagagaugaugauccauaacaggaccccucaaguccuuaagacuaaagagcauccuuagucuuccagaccugaaugauuaaggaaaacuauaaccuuucaguacagucaugcgguaugcgaagcccagccuugccgcacaccacugagaggcguggagaagacccauagcaaacuuggcauuccccacuguucagcuaaagcugaagucaggugugccaaugggugugugugugugugugugugugugugugugucagagagagagagaggaaguaagagagcaagaaagaacaaaagaag

SEQ ID NO: 14661 - RNA, 15901 nt, Homo sapiens
ugaggcauaugaccaacagcauuuauguaaauuaaaguacagacacacaaaacaccacguauuuugcaagacacacagaaacacaaguauucacauuaagcaugcucucuuugccugugagaggaggcgaaugggaguggugaaggcaaaagagaguacauuuuaagaauaaauaaaacaagaggccccuugcacagauaaauaaucauaauguagcaugaacugaggaaugaugaacgcaacucagcaccagacgucuaaauaaagaacgcaggugcgcuccccuuuaaaggcccauuuacucacucaaacaugcgucuauucauuuacagguuuauuggcuccucugagccuugggcuagagccccaggccccaguaagaggaauggaugagagcagacacagagggaccacagaagucagagguagacauacagggaccucaaaagagagucagaugcagagacagggaggaagggcugcaccugccccgggcuggguaacagcugggguggggauguggcccccuugcuccuccagagcauggcagacccgugguagcugcccaaauucaaguguggacuccaguggcgugaugaggcagccuagcacauagaugucagcaccuuugccgccgagcgggaaggcgugguccacuuagcacggguccuccaggcuggcagaagcucagggucauggccaugccacuuccgugagaucucaguccucaccuccagggacaaggaagaggacguuaggaaggucccccuguggcuuugcuacucaaccccaaugagacuaaggugcagggagaggccguguaagagaaacagagacauggggcaggaaaagucaugcuuggcaacagguacugcuaaguacuaccucuggaggauacuacuuuuuccuuccugugaguauuucucaccauucuuuuagcuccuuucucugccuuuuagcccugccuuugucugagcccaguuaaagacauuuauaggugcuuucuugaguuccuggccaaauaaccacccuguucucucuuaaucacuuagaccacuccuugcucugggauucaauuuugugagcucaacucuggccacuggaaaucuguccagaggacaugaccugaagggagagaggauucagaacucugucugagggguugcaguugaggaaacugaaaguaaguaaaagaaaaguagccuggggcaagauggaacggugggauuggggggugggggugcugucuguaucuucacaucuccaaggggcuuucaggggcauagggugcugagagaaugugccucaugcaguagagccgaacugggguuguggugaaagauaaaaggaaucagauaucuguucaacauaaagaugaucuuuccacagcugccugacaacagaaagagcuauugggauguaguaagcucacugucaccagagguauguaaccaccuggucuccggcacugcuucccaagacagcucccuucacaccucucuguggaaacacuuuuuccacaccccaccagccucagccugggaugcuucuugccccucccaggacccccagggcccauggucugcuacagccagacaccagauaaggcugcaugggacuuagagaggucaggugaggaauaaagagagggagaguggaaggagcaguaagggacagagguggcagaugagaugggagcaaaacuccacagcgaaggggacagggcaucugcagccaacucucacagaaugcagagcccauggcaaauccauggccagcagagggagcgcauggcccugcaggugcacaaagguggaacuugggaguccggggcauugagaucaauucucccccgccucucuccccagagcaggacuguccuaagggggaaauucagugucuccuggguggaauucacuuugcgucagucucugucguguccccacguuuccacaugugcagcagcaccaucuguucugucuuuucaugucuaucuccccuucuguccacucucuuugugugucuguuuucuuuaggugcucucucuguuucuugggcuccagaucuuccucuuugucucugcaucugauuauuuuccuaguucccuguauguuuaccucugacuuucuuggcuccucuaucuguucucucugauugucucucccucagcuggcguacccccuccccaacucuccuuuuuguucaauuuuaggaacacagaauugggggauuccuucugacucccuacccuaaucccccuccuuaucccugaaaggccuccuccaccuccugaagaguagcuaguagaacuuggcccagcucagaggaaggauggauaagagauguuuacaggaaacauuccgguucagcuugauccagaagcucaggacagacuaccacaaaagcucacaagagugaagguguggccugagcugggguuuacagggccugagugggagagaggaggaggggccuuaggucuggugggagggggacuccaugagggauagccucaaaaaucacacaccucuugguugaggaagcaguagaggauggcaacaaugaagcccuguggguccaaagaagaaagaccccaucagaacccuuuggccuggccugaagguguccaccgucuuucugcuaccuuuucccuacucauccccaggcuauggcuugggccagguuugauugaaaggggaauuuaaaugcauucauuacuuacuaugugccaggcauauugucauagaauugucauagcaagccugccagggcuguacuguuggccccauuucucugacuuuauuucugcaucccuugugaaugagcacaacacuuggcacauaauaggggaucaguaagaguugaauagauuggauggauggguggauggauggauagauggauggauagaugaguggguggguggauggauguauagauggguggguggguggaugaauggguggguggauggguggguggguaggugguuaggugaguggauggauggauggauggauggguugguggguggguagauggauguauggauggauggauggaugcacggauggauggauggaugcauggauggauggauggauggaagaaugcauggguaguugaauacguagauggguggcuggaagauggacagacagacagauauuugaauagauggaugaaaaacauagcccucacccugucaugaacucagccaaggcccgugggcaacagcaccucccuccagcacccucaauggaaagaaagagugccugugggggcccucaccuggaaggaacccagucccagcuccagggggaggcggaugcccaggccagcauugucuggcaggaaguugaagaugauguagugaauuccaaagagugggaucaggaaaagugucgacuuggagagacgccugcaggaaagacaaauccuaggcucccaagacugggauuagaaacugucgugugcacuucaucuccucucacuuccuaccaccucccuauauccacucuguggaacagccaccuugggaaacgccaccuccccacaaucacucugggcuuuuuuauuucugggcgcuggauccugcugauuccccuaccaacuguuauugccccaguuuaucccaaagucuaugcaucuuucaaaguguggaucaaaaccacuuccuccaggaagucuuccuugaccacaccacccuucaacuagaaaggaucccucuccccaggcucccauagaaauugaucccagcacucaucguucuauuuggcaugggagcuggcuguuuggaguccucauccuuccaauauugugauccccuagaaggaaggggccaggucuauucugucucugggaacauagggaagaaagaguauggggcugaggucaugagugcuuauuggaugagacagacacauugaaucccccuccaguuacccuuucccaguauccccagacacaaacacacaguaccaauacugagacuggguauggaggcugcccugagcuggcuccaguuuccucaccaggaugcggauaauauugagaaaaagcccaaaguucaccuggaaauagaggcauaggaagguggaagacaagggucaggggguagccuuggguggcuggggugagccccagcccauuuggggacuagaaaauuuaaauccuugagacgugagaaugugcaggugaaugaaugcacagaucauugcuccagaacugguagccuggagaugggggggcgggggucccacauuugagcauuggacagagaaggaccaaguccugggaucaaggggggcgaucaggccuugccaccugccuccagccaccucccaggcucuucucuagcacaaagcagaugucccucacuuugcacaguugcuaaguugcaaaacauuuguacauuuaccaaagccaugcaaagcagucuucacugccucuguguugugugugagagcagagggaggagagggguuuagcugcagacuccauuuacugcccccacccggcaccccuagucucucacuguggugguaaaugaucugcaaccagcacauuaggcucaucaaaauugagcuggaacagccugcaugcugauggagaccaccaccccucuaguuuuaccaaugggauacugaggcccagagagggccucacagagaaucaguggcagagcaaggcuggagcccaguuuucaagacacccagccuggaguugcauuuccugcugugcacagcccgucaguaguuccagggaaguugacugaauaaagcaaagggcacuggcccagggacugaccccgaccgagaggacaaugggcccuuugaugauccaccaguagggggaggugucguccaggucccagcaccuggggagagaggaaagaaggccguuguuggaaaguccccuucacuguggugacgcaggcaccucccucucaggcauucaugccuucuggucucacccaccuccccuccagccuuuucuccugucucagccaguuaaggucucacccaaaggggcaccccaauccaggcugggcucacccuuucuauccaccuagauggacaaacguuucugaacucuguucaaugccuccuugcuggcccccuggcagcucccucaccccaccuucccccagccccacagcccugggaaucugagcuccacucuccugccuggcucaugccccuucugugcuacucacagacuguucucccaccccccauccuagccgggcagucccuucuccuccucuucccagccuggagaacagcccauggccugacuguccacuccacaccccauguaggaccagcggguaugacaagguggccgcuccgacucacgcgauguccucgaaggccaguuugcagcucacccacgugccagugaagagcacgggcagcccuacaggaguacagggaagacacaagcgagggagucugcauccuugacucugagaucuggcgccaccucccaccaccaccaucagccacguagggcacugcaaaggcagggccaggcaggaccccagagccagggcccuggucccacccuccaacacuugcugccggacuguggccugucccucuccuucucugggccucagagugagguggaggggccuuuauguaaacucccugggccuuuccagcccuuuaccuccccauggugcccaacccgcccucagugcucaccccagccagcgagaaccagccaccagaaggcucuccuugagcugggggagguggaggccaggaggcaguucagguagacggcuucugccaacagccagcugaaguuggucaugguggcgaaaugggaggcggccacagagaccuugcauagaaccugggggccaggaccugggugcuucagagcugggacacccacuggagccccaucccagucuccucuacccuacucagauacagaaccuccaggccccuccauguuaggcugggaccugcagcuccuugggccacccaagaggggauguggugauauacagugaggguuaagagcacagauuugguaucuagacagccuggcuucuaauuuacuaucuauuuccugugcaaaucuccucacaccuuagcuuuucaucuguaaaaggaaaaaccuccaauaccuagaucaaguccucaucauaaggauuaaauggaaacugccuaagacuugcuucuauuuucacuuacccccauccuuccugagcugaagucaaucccuagagcugugacuuauucagccacagcucugucuugcaaaaaacacacacaggcacccgugcauucacucacucacugcaugacuugaucaccugccggcaggggagcaggaccaccucugaguucaguuggcccagguuugaucccagccccacccgugugccacugggugaccuugccaacugucucuccucuacaaaaugggauuaaagugaugcuuucuucuucaagcuguuuuaaaaauucaagagauaaugccagcugacucuugaacaacaaaggugugaacugcugaaguccauuuacacauagauuuucuuccaucucugucaccccuaagacagcaagaucaacuucucuuccuccucccccucaggcuacucaacauaaagacgaugaggaugaagaccuucaugaugauccacuuccauuuaaaaacagccaauuuuuauuuucucuaugauuuucuuaaaauuuuuucucuagcuuacuuuauuguaagaauacaguauauaacacguguaacagacaaauauguguuaaucggucauuuauguuauugguaaggcuucaggucaacaguaggcaaucaauaguuaaguuugggggacacaaaaguuauacuugaauucucagcugaaaggggggucaacaccacuaaacccacauuguucaagggacaacuacauauguaaagcacuuagugcaaugccuggcacaaaauaagugcucaguaugaaguaugauuaauucuuucaucaguuaauugaggucauguguuaguuugcucccugauuucgcuguucauuuccagcacacuugcagaggaucuagcaggugcugggucuccacauucugcccaacuucccuuuaauuucaauugccucuuauugucuccaccccaucucucccauggugccuucccaguuucuuggacauggcccagguccuccugucuuugagaguuuguucacccuggucucuccucuugaaauguucuccuuccccaucucccuauuguugcugccaauacagcuccaggguccucuccucccugaagcccccucucguucucuccuagcucucagcuuccuccacuugggaguccccuaaucugugugcauucugucccaugggcucuuccugaaggagggacccagcuccucccagccccuugcguacacacccccagcacagaccuaugagugcucagggaggggugaaaggaaaggaaaaggcugugcauagugaaacguggucuagguuggacuacagaacgcggaguagagcaugcaauaugggaaaugacauggaucgacaccacaguccaggaaaggcgugaggacuuagggggugacaugggaaaggagcauuuuccuguucuguaauuggccaugcgggagccccagggucagcccacagggcagggaagccugacgcaggcacaucugggucuguaauccuaccuccucucucccccaccugcccagccccuucacccauggccauuacaguggagaagcugcaguggucagugucgucgcuguggaaaagggcagcauccuucaggaacacagcucccgccuugaggauaaaaguggugaacagcuggguguggacguaguuccgggggcaguggagccuccuggggguaaugggagaaaugaggaacaagaagcaagcagggagaggggauucuggugugcugcaacugggcugaacagggcaggaggugaaucgaaucaaacuggaugcaaucaaacugaauugaauugagcugaacuugaggcuucaguuuaacccuugcaggacagcugagcaaccauuccugugcucaggguaaguguggaaagagaggaauaucuggucccugccucgagggugcucacagucucagggaacagaggcagaaacggcagguacugcccaugggagcccccuggaugaucagagacacucauccccaugagaccaagaacagcacaggccagaugcagugcucagacuucgaaggcuggaggaggggguggggucuuaaaggggacaguggucagagaguuauaacagucaagaggggcucugggcaggaggcagaggacugucagaugcagauaggagcugggcuuucucaguuauaaauacacugagaacaaugaggaauuccaagcaaauagaaugagcaccacgugagcaaaggggcagagguaggaaugaguucugguguuugaagagaugggucuacaugguggggaaaagggaagggaaaguuagacauggguauggcgccuagaucugggaaguucauggcuauguaggcaaggaagcagacuugacccucugggaaauaaggagccaaggaagguucuugagcuggugaugaggaugacaaaccugagagcaaccaggauggugauggccacgaagagggcuacaauagagaugcuauggcccacgguguagauaaucuucacuguggagaaguaagauuccugggaagggcagagacagaagaaagucucagcuucugggccuuuggaggaaagagaggcuugacaaucaagcaggugaagccuuugccauuccaccccaacacuccccaucuggaggcagagguguccgcgaguaccauggaaagcucccccugugcacuggagcuuuaguuuacagccugccuuccaccugaccugcgggugagggagggguaguggcgaggaguggagaugcuuaacauucaugaugcucugagggugaggagaggcagccgcagaaacuacaugucccuggggaaugacaaaagcccaagaggaaaucagcuuguuuauugacauccagcuugcucaccagcuugggaacacaauguauccaaauaaaggagauagccagggacaccuggggacagccacaggcaggcaggcaaaagguuuccguggccaaguguuuggaucagucagaguccagccuggcccugaagauagagggugcaggcaagggaagggagcaggggccugggcacuggccccaaucccagcucuccugugggguccaggcaaucacuuccugucccugacucagucuuuccaucugaaaaaugguuacagucaugcuuuaccucucagagaucaaggggacagagaaaugggaugauggguuugggagugccuggcaaaggcccugcuggauacacaagugugcggugugcuggcugguguuaggagcucucugcaaucacccugggcuugaguuucccucacuugcccacaucgcaaccaugcacacugcuccacagacugagggccagagaaggaaaggagcuucccagggcugcuaggagccuuguuuccucuggaaccacuuuaagcucccugcccuggaggccuggacacagaaccaagacagcagccggcagaucucccaccugcccucugccccgcuucucccuccaaguaacuuggcccgugggucacccuucaguaacuuagcaaaagaccccaucuccuccagacacuucacugcucucugcuggaaaacugcuguaaguaguauuccaaucugcaggcuagagaauggcggccccuacaguugugcacccacccauacaaauguccauggcaguccuuccuccaagaugccagaagacucuuaccuccucagccagcagcuccagaggcacagggcaggccacaggguaagguggaaagggcucagaccagccagugauaguacaaucccguuucacagccccugggaggcaagcaagacucucuagccacaacuccuucccucuccccaggagggggcugggggugccagggaccaucaagugacccuggcaggguuugcauggacagcuccucugagcaacagagaggguggcuccagaggccuggggcccaggucuagccugcccagggacacacuauggggccuuccuucucuggcuucaaaggugccaucucuucacaaagaggauuauuccccugaggggugaggaguggugagcugggcugccagcauccuaagggcaguagggagaaaagaggcccucacugucccagcaccuaggccagggaagugaagcagagcagcagagugccccacccucuccauccugggcaguugguggugucuuggcagucaggcaggccugcccuccuccacccuugcagccaggcuucugcuaacaccuggagggcauccagguccagcacuuacagguucugcacucuaauacuuuccugcacaguuaaugcucuuguucuccccaguucacagcucaggaagcagagaucaggauagacugacuggcccgaggucaccccagaagaggggaaguugguauacaaacccagguuagccugcccccaaauccagugaugauucugccacuuccagaugaaagcaccucccuuucccaccgccacacccagcaccccucaccugacucugagcugaagugagagaagaaauccgggcaggggagggugacccacucgccagagccugccguuggccagcacagcagcccaucccaggucgcagggcagccuggauagagagccaggagcagcagagacucagcccaggugcagggcugucccaauaauccgaggggugaggcuggaggauauaaaggaaucagagaagccaccaccugccuccuaggccccauacccagggugguguugggcaucuccucugcugcuuguagacaggcacucucauccucucucagcugggugaugaagucacauucugggugcauguggcccaauaccugcuggaaacagugaacaggaugagccaagccauuugggugucuuucugggcucugugguccacaugaccugagaacagggacaaggccugauucauaucugugcccuaauccuaggcaaagaccugcucacaguaguuucagguguguuugguagauguucagauggaaggaaggaaggaaggaaggaagggagggagggagggagggagggagggagggagggagagagggaggaacagaaggucuaauccucucuugugcaguuaaugcucuuguucuuuccauuucacagcucaggaagcagagguuaggguugaccgacuugcccaaagucaccccggaaaagaggaaguugguauacaaaccuaggucugccuagguuuggauggauguuucuccauucugucucauguaaguaaguucugagacacauuagacaauaugcuucugaagaucucacagggauggccaacuccauucucaucagggccuuuccuccuucccugugucauucuccuugcucuccacuccugcucccuggaagcaguucugcauaauaaugguagacagaauaauggcccccaaagauguccacauccuaaucuguggaaccugugaauauguuaccuuaaacggcaaaaggacuuugcagaugugauugaguucaggaucuugagaugcaaagcucauccuugauuaucugaguaggccugauguaaucgcaaggcuccuuauaggaugggcaguaggcaagagagucagaaucagaggaggugacaugaggaugugugccgugggaacugagauuuaaagaugccacacugcuggucugaagauggagaaagggcaugaacccaaggaaaaggcaaggaaauggauuauucucuacagucuccaggaggaaugcagcucugccaauacuuuggauuuaccccacuggaaaccauuuuaaauuucugaccuuugucucagucucugcuuuuaggggugcacacaggcaggaacacaugagcaaauggguagcuuaguaagugagagagaagauggaugaaugaaugagcacauggaugagugagcacaugaaugaggugaaggcugcauaaaaaaaggaaggagggaaggaaggcaggaaggcaggaaggcagaaaagaaggaaggaaggcuaguggaauggaugaguauacagacagacagacaaauauauggcuggggagguggauggauggauagacagaugacuggcugcauggaugggugcaugguggaugagugagagagcuguguaaggauggauguguggcuucauggauguguagaugaaaggaucauaaccuugauggcugagcaaccuugaaagauuauaguuuuaggagccucccagaucuugugcuacacaguggccaugagaaaugaucucuggaagcuggaaacaaguugggguuuuuuugggaaucuucuagcaguacuucugaaagugugccucaagaaccagcuagagauccauugggauggaagcaggaauauguagagaucuaggguggauccagcacuuuguauuuuaacaaguucuccaggaaacuggaagugaacagcaggaauuucuagcacuucucccucccaccgccccaaaccgaaggaaaaccaaaacugaucgcccagcaggccagagcccaaacagauacauacaagggaagccaaguuuacaaaacauacuuucugcacugugaacuggguauacagcauacacauuuuuguauaaaacacacauccaagucaaccaguguagaugucuguucccccaggcuuucacaggagaggaggggcuggggaagggagaagggcuggauccuaauagacccugcgcaaacugugaucagaagcaggacaggggccgggcgcaguggcucaugccuguaaucccagcacuuugggaggccaagguaggcggaucaccugacgucaggaguuaaacaccagccugaccaauguggcaaaacacuaucucuacaaaaauacaaaaauuagcugggugugaugacacgcuccuguaaucccagcuacucaggaggcugaggcaggagaaucacuugaacccaggaggcggagguuacagugagcugagauugugccacuguacuccagccugggcgauaaagugagacuccaucucagaaaaacaaaaaaaaaacaaaaagaagcaagacagguaccaugggagggaaugucccucucacagggauuggggagguggcauuugagcuggaccuggggacaagggagcauuuuuuagagccagacacacacaguggggagaagagcaucuggaacagaaagcacagcaugugcaaggacaagggaagugggaaaagguguauuugggaaguaucagcucaggacuaauguuucucuccccauggcccccacccccaccccacacacacacacccucaaugucuagcaggauccaugucagcaaauguuuaauuaacagcuaguguucuuugggagaaaugcaggcacagcaaauaguguagcagauguaagaccagggcuggggucagagaguagagacuuugaccaccagaguggggacaauagauggugggugaccacguggagagacccgagagcucugccgcagauuugugggauaggagaaaaucuggagagccagcccaguaaggagggucacccccaccagugcuacccuggcaggagaagucacuccugucccgcccugcugaccccauggguccauggcuuggacgcagcucugccaucuccugccuggcccugcaaggccccagggugcagaugucacccacuacccaggcuccaggucuuauuuuggugggugccccggacucagcucuuggcuuccucccgaggacucaguaaccucagguccaucucagggcagagccccguugcgucuccccuacaucucccaacagacugagcgcacaaagcggggaaggaagagcaggagggcagaugggccuguaugggacuuucucacaccaucagccugauauugacccugggcuguuggaagagcuguggucucugccuauccuucugccuacugcacagucuggcaagccccaacccugccugggaaacuuuucagggccaauuuggggaagcaacugagggcaaaggaugccaggagagcagccucaugccaaaaggaugaacagacagugcccacaccucuaagagaaggagggaaauucagagaagccccacuaaugacucaggaugugugggcauagggccagauguaaggagagauucuagggagggaaguggugggaguggaaggauagaucguucuaagauuuauccaaaugcuccugcugaauuaggacuggcgaaacacauccuggggcucccagucacccccccacacacaucguggaccccacccaccccugaggggaggcuccaucgcccuggacccccaggccuugcaucuaugccugcugcucuuccugguaucugcaggggaugaugcccacacuggcaaacagugauugaguucuagcuuugguacuagcaccaucugcugaauggccaccaccagaucuuggguaccccugcuaaaaauaaagcuuuugcuguagagugcacacagauggcagacaggggggcagucgaaguuuccuguguugcaccccuaugcccagcccuugacaaaucagauuccacucaaugcacagugacccgggccagcggauauuuucucuuuuaacaaaagagauaaaagcaagacucaggaaggcugaggaacuugcaguucacacggcuaguuucaugcguccaggauucaagcucaaagccugugcacucaggagcaggugcagcaaggugcucgggaggggcagcacccuccaauaaggcagcggaggaagaaugcuucaggcccucaccaucccagaaccuugugacucccagccuggucccugcugucacuugcaguaaccuccuggaaaguuacugggaaacugcagcccauucaggaagggcccucucuccugaugccccgugcuccagcgcucuagcccauggaguacaauuugguugccaaaagccucuccagcccucagcaucgugagaagaugauggauccccuaagugcuggagcagaagcagcuggucuccaccaacuccuuagguuccauuccuucccuggccacacccucuucaaaggaaaccaccaaacuggagaguggcucagggagucauagggcuaaggaaggguccagaaagcuuaccacaggagcguguggaagcaucacaggugcacagcugagagaaagagcaaacugcagggacuaagaggggagccugacuuugccucaccaauucugaggcacugucuuguggcagacagagucucuguggcccccagaggcacagccaggcccugggggaagcaacaagaaggugagcucagcucagccccuggaaggacauguuaauagcacuacccagagucacuacagauugcugggcagagggagaugagggagggagccccagugucaggggcucuccaagccacagccugccaccugcucguagggagggacucuagagcaggagaagggcaguagggucuccgccaggcuccaguuggcccuguggcucccaaaucuggagcccaguggcagaggccagagggucucagcuggcuacucacggucgguaacgggcucaacacgcagaagacgugggccccccacauccggcgguccauggugagcccagcaguggcucccuccaccagccucaguaagccuuggcuaucuuccuuccccugcuguccccugacacagccguuuccaccgcacccucugcuuccccuucucagguggcu

SEQ ID NO: 14662 - RNA, 3391 nt, Homo sapiens
caaaaugacaguuaaccaaaaacaccuuuauuuucaucugcaaagaagaagcucuuuucuucuuuuuccaggauaaucaugauuaacuuacaaaaauggguacacaucuucaaagcacuucccuuuaacgggaaacuuagcuuuaugggauuuaaacauuagaaagugggaaaaaaaauuccauuuucuugucauuauaagccaaaacaaaaucuaguguaagucaaggaaacucauucacacuucagguccuucuccuccaggaaccagcugcauaaagaggaaaaagaguuuauuaauaacacuaccaccaugucaucuaaaaaccccuugcucuucauuaagccaccuuugccuguccccugcacuccacguucccauuuucuccagauugucaguaucuauuuacaauucccaacgucaucaauuaauacuuacuaucucaacagcgauuaaaaguuccaagcaaacuaaccuuuagacccaaugccucuucaauagcugagcuuuaggacccugaccacagagaaccccuuucccaucuuaugcaccacugggccaugaucauuuagucaagcaagcaacauuaagguuaguucuguaaucacugcuccccaaaaaugggcucccaucaaaauaaaacaguuucaaugugucuuaccauuguuauauuauuuccauuuagcaaaaucugaucuaauuuaguaauccuucuuccuucuggugugauuucacuaaaugaauagauaaaauacagucaggacaaacagugaaaaucaaagccaacauuuuggaaauacuuacccucccuaaaaagguuauccuuguauacaaauuacacugagguugagcaauuauauccacaauuuucagauacaaagguuauccacuagguaauguaaccuucauuaaaagcagcagaaugaacucacugacacuaagacccacgucuaucagacagagcuucauaaaaagaagugaaagcuugcccaggaaaucaaauaugaaaugaaauguuuuuuggguuuuuuuuuuuuuaagagacagggucuugcucuguugcccaggcugaguacagugguacaaucauaguucacugcagccuagaacuccugggcucaagggauccucacccuccagagcagcuaggacuacagcugcccccuacuauaaccagcuaauuuuuaaauuuuuuauagagacaggggucucccuuuguugcccaggcuggucucaaacucccaggcuuaauccuccuccuuuggccuuccaaagugcuaggauuacaggaaugagccaccauguccagccuaaaugcucuuacuaucaguuccuuuauuugaccugaacccuaaaauuccuggcucuuuuuguuaucuucuaccuuaaaacugugucuccacuaauauucuaggcguuuacuaauaauuacauuaagguaauaacacucugauccaauuuuacaagcaaacagauaaaacgucuaucuuuaacguuauuccaccaagagguaauguuuucucauaaauaauuuuacucaaaaguaguaaaacugucuuuaauuaagaagagauuccccccaauucuuuaacacuacucacaacucagugacaucuuccaguaccauaucugaaauuugguguuaagaaaauaaauacagaauuuacucuagcuucugccuuuguucagcuuuuguuuuuuguuuuuguuuuuguuuugagacaaagucucgcucugucauccaggcuuaagugcagugguacaaucacaccucacugcagccuccaccuuuuaggcuuaaaggauccuccugccuuagccccggagauuagcuggacccacagguguacaucaccaugcccagcuaauuuuuguaauuuuuguggagacaggguuucaucaucuugcccaggcuggucucaaacuccugggcucaagcgauccacccaccucgcccucccaaagcgcugggauuauaggcgugagccacugggcucgccuguucaguuuuaauuacaauguuuaauacaauggcucaaauucaaaaugcuuguuguugauaggaacuuuaccgucuuucaauacauaccucuuaaaacauuaucauaaguucccugagaaugaacugauuuuuauuauaauaaucacaaauauacugauugucuauaguucuuauguuauuacuuaagaaaaaccuauaccaccaccaccuuuuaaaaggauacugacaaagucaucaaauccuagaagaguaccaacaauuuccuuaucacucuucaucacgaugugaauucuugauccuauacauuuguccacaagcucugaggagggaaaaaauauuauuuuaccauucauuauuucaacaaauauuugagugccuacuggcacucuuacuugcauauagugaaagaaaaaccaggaaaaacauucauucaauaacuuuaggucuuauaauacaaaucucaguucaagcacagcaucuggcacauaaugagccuuccaaaagagucuguggcaugaaggaaugaaaacuuuucaaucacggccacgaccacuaguucaaucacucuucaccaacuacaaaaauauaagaggagauagguauaauuauauucaccggaaacucuccggucacugcuucccuuucccaacucugucuauccucugugcucugacgguagcuugaacaucucuuuagcuagccuagcauuauguggcaugaugucuacuuguccaguguucucuccuccacuggcuugugugcuauuugaaggcaauggcuaugguuuaucauugaaaaaugcccaggcacgguaucuaguguauagauacucaguuacuacuuauugaaugaauaaauaacaaacagagcugguuuccagauuccucauuuaaggcucauuccggaccaggguguuagugucacuaaccaaccacauacauaacauggucuaucuaaucuggggaucguaaacgccaggcugagaaguaggccuacuaccuauaacacugcagaggcgggcucacaacaaaguaggccgacgacgcguucacuaaauguggaccuuuuccagugaaggucugguuugagaagucaaaguccuugccuggaggagcccgaccacguuaaagagcaggugcggccugcugucgcgaagacuuggagcucagagucgaaccgcauuuggucuuauacauuuccccacacucggccagggccugccucggaacagccccucggcccccaauccugaaugucagcucccuguuccugcuccccaaaggacggcgauuaccuaagggcagcagcugcgacggguugguaguagcguuagccgccauggcuacgccggaaguggccugccuucauugauggugggacgacuuugaa

SEQ ID NO: 14663 - RNA, 3391 nt, Homo sapiens
uucaaagucgucccaccaucaaugaaggcaggccacuuccggcguagccauggcggcuaacgcuacuaccaacccgucgcagcugcugcccuuagguaaucgccguccuuuggggagcaggaacagggagcugacauucaggauugggggccgaggggcuguuccgaggcaggcccuggccgaguguggggaaauguauaagaccaaaugcgguucgacucugagcuccaagucuucgcgacagcaggccgcaccugcucuuuaacguggucgggcuccuccaggcaaggacuuugacuucucaaaccagaccuucacuggaaaagguccacauuuagugaacgcgucgucggccuacuuuguugugagcccgccucugcaguguuauagguaguaggccuacuucucagccuggcguuuacgauccccagauuagauagaccauguuauguaugugguugguuagugacacuaacacccugguccggaaugagccuuaaaugaggaaucuggaaaccagcucuguuuguuauuuauucauucaauaaguaguaacugaguaucuauacacuagauaccgugccugggcauuuuucaaugauaaaccauagccauugccuucaaauagcacacaagccaguggaggagagaacacuggacaaguagacaucaugccacauaaugcuaggcuagcuaaagagauguucaagcuaccgucagagcacagaggauagacagaguugggaaagggaagcagugaccggagaguuuccggugaauauaauuauaccuaucuccucuuauauuuuuguaguuggugaagagugauugaacuaguggucguggccgugauugaaaaguuuucauuccuucaugccacagacucuuuuggaaggcucauuaugugccagaugcugugcuugaacugagauuuguauuauaagaccuaaaguuauugaaugaauguuuuuccugguuuuucuuucacuauaugcaaguaagagugccaguaggcacucaaauauuuguugaaauaaugaaugguaaaauaauauuuuuucccuccucagagcuuguggacaaauguauaggaucaagaauucacaucgugaugaagagugauaaggaaauuguugguacucuucuaggauuugaugacuuugucaguauccuuuuaaaaggugguggugguauagguuuuucuuaaguaauaacauaagaacuauagacaaucaguauauuugugauuauuauaauaaaaaucaguucauucucagggaacuuaugauaauguuuuaagagguauguauugaaagacgguaaaguuccuaucaacaacaagcauuuugaauuugagccauuguauuaaacauuguaauuaaaacugaacaggcgagcccaguggcucacgccuauaaucccagcgcuuugggagggcgagguggguggaucgcuugagcccaggaguuugagaccagccugggcaagaugaugaaacccugucuccacaaaaauuacaaaaauuagcugggcauggugauguacaccuguggguccagcuaaucuccggggcuaaggcaggaggauccuuuaagccuaaaagguggaggcugcagugaggugugauuguaccacugcacuuaagccuggaugacagagcgagacuuugucucaaaacaaaaacaaaaacaaaaaacaaaagcugaacaaaggcagaagcuagaguaaauucuguauuuauuuucuuaacaccaaauuucagauaugguacuggaagaugucacugaguugugaguaguguuaaagaauuggggggaaucucuucuuaauuaaagacaguuuuacuacuuuugaguaaaauuauuuaugagaaaacauuaccucuugguggaauaacguuaaagauagacguuuuaucuguuugcuuguaaaauuggaucagaguguuauuaccuuaauguaauuauuaguaaacgccuagaauauuaguggagacacaguuuuaagguagaagauaacaaaaagagccaggaauuuuaggguucaggucaaauaaaggaacugauaguaagagcauuuaggcuggacaugguggcucauuccuguaauccuagcacuuuggaaggccaaaggaggaggauuaagccugggaguuugagaccagccugggcaacaaagggagaccccugucucuauaaaaaauuuaaaaauuagcugguuauaguagggggcagcuguaguccuagcugcucuggagggugaggaucccuugagcccaggaguucuaggcugcagugaacuaugauuguaccacuguacucagccugggcaacagagcaagacccugucucuuaaaaaaaaaaaaacccaaaaaacauuucauuucauauuugauuuccugggcaagcuuucacuucuuuuuaugaagcucugucugauagacgugggucuuagugucagugaguucauucugcugcuuuuaaugaagguuacauuaccuaguggauaaccuuuguaucugaaaauuguggauauaauugcucaaccucaguguaauuuguauacaaggauaaccuuuuuagggaggguaaguauuuccaaaauguuggcuuugauuuucacuguuuguccugacuguauuuuaucuauucauuuagugaaaucacaccagaaggaagaaggauuacuaaauuagaucagauuuugcuaaauggaaauaauauaacaaugguaagacacauugaaacuguuuuauuuugaugggagcccauuuuuggggagcagugauuacagaacuaaccuuaauguugcuugcuugacuaaaugaucauggcccaguggugcauaagaugggaaagggguucucuguggucaggguccuaaagcucagcuauugaagaggcauugggucuaaagguuaguuugcuuggaacuuuuaaucgcuguugagauaguaaguauuaauugaugacguugggaauuguaaauagauacugacaaucuggagaaaaugggaacguggagugcaggggacaggcaaagguggcuuaaugaagagcaagggguuuuuagaugacauggugguaguguuauuaauaaacucuuuuuccucuuuaugcagcugguuccuggaggagaaggaccugaagugugaaugaguuuccuugacuuacacuagauuuuguuuuggcuuauaaugacaagaaaauggaauuuuuuuucccacuuucuaauguuuaaaucccauaaagcuaaguuucccguuaaagggaagugcuuugaagauguguacccauuuuuguaaguuaaucaugauuauccuggaaaaagaagaaaagagcuucuucuuugcagaugaaaauaaagguguuuuugguuaacugucauuuug

SEQ ID NO: 14664 - RNA, 1430 nt, Homo sapiens
gagggaagugggaaaacuuugaggaaaaagagaaggcaaaagagaaggaagugcuuugagauugaauccagggaggaaaaagcaggugugccacgccgcaccuccaggucccgcggacaccacaggcucugcaagcccagccgcccgggucacguaagccccaccccgccgcuccucgucaagucccacccggacccgcccuccccccgcuccuccccccgcuccuccccgccccacagagucgaucucuccucuccuagacccaccccgcucccccaggcuccaccucggccucucagaccccgccccgucagggcccucccggccuugcccagcccugccucgccggcggcggccgccgugucaggugacagcccggaagcugcggaagcggaugagggaagggcggccguggcccugggggcggcgggagcugcuuugccuccaccgaucucccugugcggcccucaugugcugugcucgcugacacccgaaguccgcggcuuuccgcacacgguggggucgucagacccgcugcccuuggcggucgaagucgucgugcgggcccgcggcggccgcccauggagaaggccaggagaggcggggauggcgucccccgggggcccguacugcacaucgugguggucggauuucaccacaagaagggcugccaggugaggaaagggcccgcccccgcccccagccguucgggcguucgccccuuccggggccccccugcccugcuucugugugcucagcucgcgucgugcaguccuccccacagcgccugcgacccuucgccucucaaccugacuccuuuugcagcuccucccacccgccccacaugaagcccagcccccacaaccucuuccuucugccccugaaaaaugguugagcagcggaggagcugguugauacguguagguuguagguuuuuaacuucugcuuugguggagugggaggaaagcaucgaagaccggccccacucucuuccccguccaucauugucuccacuggcuuucuggguguccaccuauaaugggagucuagaaaaauucagugcuuggacucugcuuucaagguaauaggcucagugggcuugcauacuaaugcuucagguagcuugcagcacaugcagccuccguagaaaaaucagcuuccuuuguuuaucugauggaagccuuggaaucucuccuguuagguacgguugucgauugacuuugccucccccuucccauugguccuuaguuuugcuauuucaucuucuccagauuuugccuuuuggugagagauuaaucucuccauaucaaccgcaauaagagaaaguguauuaccaaaccguucaaauauaaaggcguuuuucagcagccucacugaaucauuaaugcagcaucugaaauggaauauuugcaaucuauguauugaaggca

SEQ ID NO: 14665 - RNA, 1074 nt, Homo sapiens
uagucaucuauauucucuagauugggcuugugccaagacuguaaguuaggaagguagguggagucugugugggcauuucugacaauuuuuugauccacgaauagcuccuagcaaauuuacagccugccugccagcaagcugugccaaguuaacuaaaacaguacgggccacagccauuagcugcugcuacaaacgcuucgcuuugcgaagcaacgcugaaggcgcucuuuuggaacucgggggguugggggcgugcagccgccgcauugcagcacacaacggaaggcuucagacgcuggagcugccguccgcacccagaugucucucucucccuuuuccccuaaccucccccaacugcgggcccuuuugggugcugcucugacuucuuccuuggccuugggaaaagccgaagcggcucuggagagaggagggcaugguuuggagaagaggugcugcggcaacaaagcgacccgcccaacgccuccucaacuuucuccugcccccggucugguauuguuuaguccuacucauucccacuuuccgagccagccugcaaaaaucuguauuucaggggaaauuccaagggauaaaacaccuccuucagcauaacaauugguguuuugcucucuagauuuccuagcaaugaacuugucgggccucuccauccgcccgucuaggcccaaggccucggccgccgcggcuacucggagugccccucugccgcgcacgcgccccucaagggcucucccaugaccuuucccgggaacccccuucaauuacgcuucccgucaccucgcgccgcccccgcccuuccugcucuuuccguuuccucuuucgcgccugcgcggccccaauuguuuuggcuuuccgguggcauccggcagaggaaaagggcgggggcagcuagaguaagggaggggcgggggacggucgcgaggacccgggaaacugcaaaacugccgcuggugccgacaggcgcgcgcgcgcgcgaggcgggagggcggcguggcgagggcgggcgcggcaggcuggccagcgguccauugcgcgcgcguucccgggccgcgggcgggg

SEQ ID NO: 14666 - RNA, 1223 nt, Homo sapiens
gauggcacuuccauugaaacuuuugcagaauauugaugauucuuuuaucagaucugauuagcaccagaggacugacaguggcauaggcauugaccacaaacuuguggacaccauaggugacagggccaauuacccauaacagcauuguggaugaugagaggaugaaguccacugaguacaucagcacaaaggaauucaccagcaucaggauggucuugguggccauuuucacuagagaaguccuuaauauaaggcugcugcugugaaagugcugggagugccucugaugccuggacaaaagaaugaccauguauacacuugagagcagcgugauuccuaugaagaaggcaucucuggauaaugacagcauaagaaauagcguccugaugaggacauucauugggaaaaaugugcaauauuugcugauauucaaaauuaucugggucauuggaauaaccuacaguguagauuaucaugucacuacugaaagacaaauugcuaaaccaaaaaacgaauaagcccaggauaucguauuuuguaaauuuauguuuaaaucuaaccaaccaggaggugcugaggcugaugguaauggccuggagcaugcucaggaggcagguggugcagauggagaggccccucaucaccuugugcaaauagaagaaagcuuuaggccgggcgcgguggcucacgccuguaaucccagcacuuugggaggccgagguggguggaucacgaggucaggagaucgagaccauccuggcuaacacggugaaaccccgucucuacuaaaaaauacaaaaaaaauuagccgggcgugguggcaggcgccuguagucccagccacuugggaggcugaggcaggagaauggcguggggcgugaacccgggagguggagcuugcagugagcugagaucgcgccacugcacuccagccugggcaacagagagagacucugucuccaaaaaaaaaaaaaaaaagaaagaaagcuuuacaucuaaaguuauucugaaaauucagugacucaaacaugucuggagacaaaaacuccauugcagugaagagcauuacuagguggacaaaggccaaaugacaggugaccaggucaugggucuuaggccugugauccugaaagaauguaaaaauguggaagagaagauggaagauguuggcugagauucuaaugcuagcuugacaauuaaagguauuuuuaaaagauaacaua

SEQ ID NO: 14667 - RNA, 715 nt, Homo sapiens
uucuuuuuuaaccaugcaacaaaaccuuuauuagcauuuugaacagguucagcuauuacugaaacuuguaauuucuaaacuuaaguuggggcaaauggcuauacggcagaguaaugccaucacugggcacugcgaaugcaagacuggagaauuaacagccaccccucaggugcaggaccaggugcaggguugacucuuucuggauguuguagucagaaagagugcggccaucuuccagcugcuugccugcaaagaugagccucugcuggucggggcugggggugggggggugccuucuuuauccuggaucuuggccuucacauuuuccauggugucacugggcuccacuuccagggugauggucuugccagucagggucuucacgaagaucugcauaccaccucucagacacaggaccaggugcagggucuacucuuucuggauguuauagucagaaugagugcagucaucuuccaccugcuugacugcaaagaugagccucugcugguccgggguaaugccuuccuuauccuggaucuuggccuucacauuuucgauggugucccugggcuccacuucaagggcaauggucuugcugguaagggucuucacgaagaucugcauuuugaccuguuagcggauaugacgaggcuccgaaacaccagucauguccagccacagggacaccaccacauacucacccaacaaagccagu

SEQ ID NO: 14668 - RNA, 715 nt, Homo sapiens
acuggcuuuguugggugaguaugugguggugucccuguggcuggacaugacugguguuucggagccucgucauauccgcuaacaggucaaaaugcagaucuucgugaagacccuuaccagcaagaccauugcccuugaaguggagcccagggacaccaucgaaaaugugaaggccaagauccaggauaaggaaggcauuaccccggaccagcagaggcucaucuuugcagucaagcagguggaagaugacugcacucauucugacuauaacauccagaaagaguagacccugcaccugguccugugucugagaggugguaugcagaucuucgugaagacccugacuggcaagaccaucacccuggaaguggagcccagugacaccauggaaaaugugaaggccaagauccaggauaaagaaggcacccccccacccccagccccgaccagcagaggcucaucuuugcaggcaagcagcuggaagauggccgcacucuuucugacuacaacauccagaaagagucaacccugcaccugguccugcaccugagggguggcuguuaauucuccagucuugcauucgcagugcccagugauggcauuacucugccguauagccauuugccccaacuuaaguuuagaaauuacaaguuucaguaauagcugaaccuguucaaaaugcuaauaaagguuuuguugcaugguuaaaaaagaa

SEQ ID NO: 14669 - RNA, 733 nt, Homo sapiens
ggcggcggcgggcgcgcgaggcuguugugcucccggcucuccuguuuccccuccugagcggguggaggaggcccaagcgaugcugggcgcgcucccccuuccuuucccuccggcguccucucccggcccucucgcgcugcacugucucuccgacgcaagauucuccuggcccggauauggcucguggacagcagaaaauucagucucagcagaauaaugccaaaaagcaagcuggacaaaagaagaaacaaggacaugaccaaaaggcugcugccaaagcugccuuaauauauaccugcacugucuguaggacacgaaugccagacccuaagaccuucaagcagcacuuugagagcaagcauccuaagacuucacuuccuccagaauuagcugauguucaggcauaagguuguuuacaggugaauucacgacaccuuugacucuucuacugucucagaccuuagguaacauaccugcagcugcuuuucuaacaaacuguugaucagcaaaaauaaaggggcuacagaaacacucauuuuuuaugcuguucccuuuugggcuucaugcaaagacaauucuguguaaauguacaguugacucugauuuggaaauaugaaaaucaguccauccuuguuauaaaaaaauuuuuuacaauuguaauuauauugauguucauauuguguaaaauaacucauuuaauaaaauaguacuuugauuuacgaaaaaaaaaaaa

SEQ ID NO: 14670 - RNA, 2160 nt, Homo sapiens
ugcuaaaaaacaaaagcauuaaauaaagguuuauuaacaucauauuaaagacacauuaugccauauguaagcauuacaucaaacucuauauaauaagacacaaacaaauaccaaacaaaguuuuuaugguaguaugagucaccauuaaaaugggaaaguucuacacaauaagagcaacuuagcaauacuuugucaauuauucgucuucugucccuaaugcuugauauuuaucuaugucagagaaaacuuguuuauaaauaugcaggccaagcuuuaauauacuuugacuuucuccaguuuuaguaagggacuugucauguauucuauucuggugagauucacuaaguagcacuagaacucacaagcauacagguggauguggaaaaacgcauucauuugguaccagauguaucuguguuuaaauuccagcuccaucuuguauuaacuuugugaccuugagcacauuauauaauuucuuuguucuuuggguuccuccucugcuuaaugagaauacaauaaugucuccaucucaggguuguuacaaggauuaaauaacgguauuucaaaugcuuggcacucaguaugugcuuaaagguuguuaguuucccugcuucuccaaaaaggaaucuaggagaucaucacccuucucauuuuacaaaugagaaagcucaagcccacagaaguuuaagaaaaugcccaaagucccacuucugcacucuuuccucugcuguccucuuauuagcuugcuuaacuucaauagagaagagaaaacucagcagaaucaaaaagaauucuuuuccucuuuuuaauauagguaagccaccaagagacuuuuaaaguaggagugaguuuuaugaaagguaauaaguagucuaagaacuguuuuaaauccucagagauauuaaaaacagaaguucuguucuuccaguauuuccauagcagaacauaaguauuuuguaugcuuuggcaccaaaaaacuccagaacugaguauuuaucugcacauuuuaacucaagccuccuggaaugcuugcccauggaauuggcaaaggaacuggcauucaguauuuagagcagccaaguuugcucagaccacagcuguauuugaagcacagcucucugccauuagucaauggaacuugcacaaaauucaauuuagauguaaauguugugauucuuacccagcuuucauaucucuuuuaucuuuuuccauaccugaugaucaccccaggacaacccaacagaaccugggauccugugcauaauagaaggcaaaauuccgcaagcuguaauuuacagcuugaccucuuuauuugaagaagaaugacaagcuuuauucagcaggaaggagauauucaauauuacucuuuuaaaauagucaaccaagaaucugcuauuucuuuaaaaauguuuuuaaaguuauauuuuaccauaauaaaacugguugaauuuuauuugguuauuuaaaacauguaaguaugcuuguuugucccucucacuuaaaguucuuaccacauccagaagagcuggaaacaucaaauguugcugaagcuacuguagcuacugugauacacggaaacucaaccauuggaaaugggccauauuugugacuagaucaguugcuguuaccaaacugcucauguagcaaucuaugucuauuguuauaacugugacauuaguugagccacaaucuuguuacuucagccauauggacccacagagcgcaaaccaggucagacaaauucagaugccugugagacauuuaccagugguucuugaggguggcaugcuucuuccaaaaacuguuuguuggucuggcaauguggaaauuaucaggccugcauggugaaaggaacuaauauauuaauccuauuuaaauaggucugaguucauuuuauaggaaaagaugagaaugaacagucagucagacuucuaugccuaugauguauucauacacuugguucuguuuauuauaaacaauuuuucucagaaacacacuacugucagaguuauaauuaaauaugggcauuuuggguuuuucagucuaucuuaaaacaacuauugguguuauucuguuauauccuauuuacacaaguugaaaggauuacaccaaaagguaauuauagauaagaaaugaauauuuguuuauuuccaagucaug

SEQ ID NO: 14671 - RNA, 228775 nt, Homo sapiens
cgaggaggggcugagccgcgggggauccuggaaucggcagggagguggggauucugggaggaaaacuccauuuccuccuucccugccgguuucuccccucuacccuggcaccccaaauuucgaugugccgccugccgggcgcuaagcgccgguguugagagaggcggcggccgccgcgcccgggaaaaugcugggcauguacgugccggacagguucucccugaaguccucccggguucaggacggcauggggcucuacacggcccgcagagugcgaaaggugggugacccggcggcggccugcgcgccccugcaccucgcgcgcccugugccucccggagucgcccugccgcagggcccggggcgcggcgggcuucaccccggucgccccucgcccgggccgggccaggcguccgugggaaggccggggaccgcggggcacggcggggguggccuuuacucgcugcgccacccgagcaggcagcgccacguagguggcggcggggugcgcuccgcugccggccgguccaggggcggaacugccaccggccucccugccgcaagaugucuuuccucucucccgcaggaagugagcgcggcgggagccucccucuuccucgguuacgggugugagcugcgucuuugcguuggcgaaggcacgcgugggcggguguuuucccccgcgcgcacgcugcuccgcugucgccucuuuuccuuuaggaugaauuaauguggcuagaaacgccuaacuuuccaugcggggaugggaggagcagcccagagcgccgcuccacgcaggccguagaaucucauucauacgcccaggauuuccuucccuccuucuggaauguauuauaugugccuucagggaggugccaaccagaugaucuuugagugucuauaccuuuuuucuccgcucuuuuuuuuuuuaauuugucuccaacaucgguucgaucucuccagccagaaaguuacaggcaugugaugagaggaagcacauugcucaguucguacaggaagggccugaaaguguuggauguugaaagcaaaggccuaggaagagaggccacaggaaaaguccagcucuuuggauuugaucuuauaauauuauaacuuguuagagucguccuagccguccucgcccccuuuucuuaguagauauuuuguaagauggagguuugggcaagaacaggcuuguucagguaagguauguuaacaagagguucagaggaugcaguagagacacuagggugccuuucaucugcauauaacccucuccccuuugccucugaccuaaagagcuggugaagaguaguagaaagugcuaguaauccccaaaaagggcuccacugacaacaugaucuccagucauccuucagggcaaaauuggagaaaauaaaccacuuauuuauuuuuucaagugggaguuggcgagaauguucaaauguuaaaaacaggaauaaauaauuuaucugaauuagagguguauugaauaguugccaaauggccaaauguuaaaaucaacauuuuuugaaggccaaauacaaccaucaccaaaugacgucuguacagaguugaaauucuccuuuuaauucauucuuaaaagaugugaaaaauucucaaacagaccuuccuuaaagguuucuggcuuaaauuuaauuacuuuaaaaauuaaacacagaucuuaaaaaucauuuuauuuaauguuaugaagaguacuguaaacaacucugcaaagauuagaauuauuauauaauccuuguuguuuccuuauauuaccauauagauuuuuagaaacagcuggccaaccuacuuucuuuugagauuuuuauuaauuucaguuuauuuuuuucauguguuugauucuuuguaaguauuuuauuuuugggcaugcaaugaaaugaacagcuuccaaaaucaucauauauuauugcaucacuuuacuauugcaaugauaaaugcuuaucuuuuccuggccaguuuaacuuuaauaaauaaaacacauacagauuuucauccagaucauauuuagaaugcuucgcuguauuucaaagugaaugugcagauguuugcuaugaauccaaacuauuaucgauguuuaguuaugaucccaaaauauucagucacaaggucauggacagguuuguugaucucagaaaugaccuuaaagcaagcuucaguuccuuuuccuuccaaaaucugaggacgaagacaaagcuaaagccaaacagcagacuuuagcugaauugugaggcugcagcugaguaucaaggcaucccuuaccugcuuauggaaggcaaacagucccucaauucuuagguauuuuccaaguaaccuuguacuaggccuaauucuggacauaaaucaagggaucugagaagagagauuuaucagcagcuacauuaagaaccuuacuuaaaaguuuuuaugcucucuauucuaaacaaauuuuggaagauaccacuuuuaauacauguguuggaaauuacagauguuuugccacacuuuuauaacacauaugcuuguauaacacuccuguuuuaaaaagugcuugcaauucaagccaucuguugauuucaaauucagagaaucuaauccagacugagguuggggaaucuugcuagaaaccccacccucauuacauucaccagguugagaugggauuuucuugcuggugguaccucuuaauccucuaguccuaccccuuuucgugcagugcuuccuagagugguggugucuuugcagcagaaucaccuaauucccuggcuuuaccuuaguccuacuagauuuuuccuuggcaauuauccuuuuuugcuggucuguugccucugauuuuuuuuccaguauaaaaaucuguauagugacaacucaagaaaacgaaaagagucaguuagaaagcuuuugagaagaaaaaggagaccugaguucauucauacuuuuacacauugugauuugcuaauaaucagaauaaggaaaaauaaugaaauugacacuuuuugcaugcugugugccagacccugucuaaugcuugcuguguuuucucgggagcacaguugaaugcuucagugaaaauguggcauuuuagguugcaaaguauuaugcagauuaaaauuaauauuaguuacucaaaacucauaaauuaaguauacauccaauaaaaauuuaaaguuaagcagacaccuuacuacauuacauuuuuuguuucaugaccauuuuuuuccuagcuugcuuauaugauuaaccaccagugggugguguuuuuugauauuguaccugaaacugcaaaguggaaagguuauuucaagcucucagauuaugugauuuuaagggaaagauuaagguggaaauacacugcucucagcuuucuuucccuuuggauauuuuaggcuguagguuuuucuucucugacuuucagucauuuaaucauucauauguggcagguacuguacuaggcccugggaauacacaggugagcaagacagacaaggucuuuuucugcaaggagcuugcuuucuuauguggggagauaggcagcaaacaaguauaaaauggaagauuaccaaaaugauugaggcaaguguuaaauuaauugcaggaaauaaacaggaugaggcauuaaagaguaaaugaggggugggucuacuuuaggagggucagcagggaagacuuuucagaggaaaugacuucugagcagagagcugaagucgcugagccagccaggagauucucuaggaagagaagugcagagagccagccuguucaguauaaaguucuuccucuuucaaagugccugucucugggcuuuggccagaggcaugcuucccagccugugggcuggccacuuggcaggcugcaaccauuuaggagaaauaaaguccugucuccgccucuccuuuucuaaaauuauaucuuguaauuuuuugcugaguuaacagacaucaucuaauuggcacauccucauuuuacaggugagaacacugaagcccagagaguugcagggagucuugcagcucacaguugccucucagauuccuaugccuuccacagugucaacucccuccuuuccaaaccaaggcacacaccuugauucucacugagggauuuguacuaaggucauuuggugagguaaaauccuaaguaaaaaaaaaaaaaaaaaaaaauaccugacguaaaggcuuaaaggugaguuuguaaaaauacaguaagauuuuaaaacaaaagucaaauuuuacaaaguuaaaaaaaaucaaagaaagaaaaaagcugaaacagauaaguaaauaaaagccuguagaggaaaaaucaccaugcauaaauguuaauacaggaagagcagacuuugugggauaagguguuguguugaucaguguagaaggugacuugucugaagaaacauggauuuguauccuagggcuaaaaaucugccagccaauguuugcuuacauuuccugguggccgaugauaacuaaucuggaaacauaaucagaggaaaaguaaucaugaagccugccguauaugcuaucucuucccuguguucacacauucacacuucuccauagugacucaaggcagcuuuguauuuccugguguuauuaaacauuuuuuaaacuauguaacuacucuaacauuuucuccaaacuauauuuuuugugauaauggcagcuacaauuaauucaauaaguauuuauugaacuauggcaguuuuuaggcacuguuuuaguuacuaguggcagaaaagcgagugacagagacaacagucacuagaugcuuuacacaguuuuuagugaaguccugcaauaaaccugcaagggggcuguuaguaucccuguuuuauagaugagagaggugauguugaggaagguuacaucagucauaaguggauuaaugaaaauuugaacucaggucauuccauauacacuuuuccuuaaaaauguuuuuucucuauucugauaaaaugcuauauccacaaauauacaaacacaugcacacuuuuaaaaaaaacauaaguuuacaaaaauaagaaaagaguaaacucacuucaucaucucacacuucuuucgacgguaucuuguggaaauuccuguaucuaccuuggcucuguuuuuuuuuuuuuuuuaaugucugacuauagucuaugcuguggaugugccauaauuuuuauuuauucaggucuuguuuuacacauucauuuaacaaucuuuaucacucuauaugccaagaccuguacuauucacuuugggguacaauaguuaagaaaauagguauucuggcucuuggggagcuugcaguccagugagggaagacacaagauaacagaccuauaagauaaauuuuauacuauguuaaauauuauaagaauuauagaaaaaagaaaaagagcuagguaugguugacuuggcagaaaaggugugugggugugugugugggaugcuauacauguuagaugggucaguuaauccucacuaaacaggagagauuugggcaauuauuugaagggugguaggaaauuagccaaacauauaucuacgggaagagcauucuaagugcagaagaggcagcuacaguaaaggaccuaagacgggaguuugccuguugugguccaagcacaaggaggucaguguggcuggaaugcaaugagcaagcaguugaggaggaggucagagggcuaaugaagggaugaguguuaggggaagauccacugcuuagagcccuuuaggccacugcaaagccuuugacuuuuacuuugcgugaaaugagagggcacugcagaguuuugaacaaaggagugacauaaguuuaucaagcaugacucuggcuguucuguugagaaaaguuugccacagggcaaguguguaaacugggagaguuaggauucuacugcaguaauccaugugagaggugauagcaguuuagaccaagauaguggcuacuuugguagugugggguaacagaacaugcugauaggauuggaugugaagugugaaagaaugggaaggauucaggaugauuccacggauuuuagccugaggaauuggaaggauuggauugucagccaacaacugagauggggaagguuguggguggaggagguuugaagagggcagaucacggguucaguuuaaggcauguuguuuuugagaugucuguuagacagcaaggggauaugucaaagugucagugagauacaauuguauaaugcaguuccuccuucccauucuuuaaaaugucacacauuuuauguuuuauguuauaaaucuuacaguacguuuuuacucuuguuucuuuagaucaucagugaucuuuuagagcaauuaaaaugaagacaaauugucuuuguuauguaccucuacuuuuuaccauuacauuuagcuauuuauuuauuuauuuauuuauuuauuuauuuauuuaugagauacagucuugcucugucguccaggcuaaagugcagaggugcgaucucagcucacugcaaccuuugccucccagguuccagcuauucuccugccucagccuccugaguagcugugauuauaggugcccaccaccacaccuggcuaauuuuuguauuuuuaauagacaggguuuuaccauguuggugaggcugaucucgaacuccugaccucaagugauuugcccaccucggccucccaaagugcugggauuacaggcaugaaccaccgugccuggcccauuuauuuauuuugaacuaaguuucugucugguaucauauucugaaugcugaagaacuucauuuaacauuucuuauaacacuugucuucuggcaaugaauuuucucagccuuuaucugcccuucugcccugcucuuguucuucuccccacaguggacuucgcuguguuauuuuuuggugcugggugggcugauggugagggguaugggagaaggaucucuguugucuuguuccauucgcccucuuauguaggguuucucugccugggcacugggaguugggcuuucucaauaugccugcuccucuucccuaggagagcuaaucuuuuaacuugugucagugguuggucuuuugugggugaacauuucuugucccuuccccagugguaggaguccuuugaugguuguggucuaagugcuugagccuguacuguuucuuucccuucuccccgcagugguggaucuuuacuggggucauccuggggaugacauaguuuauugcuuuucuucaguagcuaaaggcuuucuucugauaugagaaaaaggucaggacaggagguguacacugucaugccauucuugcagcagcugcuguuccgcucuugcaugacagcaucacugaggaagucucuuuguucucccaucuguucccaaaccucucucacauggggagguccuuggaaaauaaugugaacaugccugugagcaucucuugggucuggggcuugcuguaguucuauaccuucauucugucucacauuccuccuuuagcaaguuguuaaaauguuaguugauuuuuuacuuguuuggaugguggauggaguagggcacuggccacagguaagcuagugcucuccuuaagaaaaguuaugauuuugcaguuuaucauucucauuguuaggauaguagugauacucuuacuaaccuucuugguggaaacugaacuuuuauauauuuuuuauuucaauagcuuuagggguacaagugguuuuugguuacauggaugaauuguauaguggugaaguuugagauuuugguguaccacucacugaguaauguauauuaaauccaauauggaguuuggauaacccuccuagccugucucuuccgaguguccaguguucauuauaccacucuguaugccuuuguguacccacagcuuagcucccauuuguaagugagaaugugugguauuugguuuuucauuccugaguuacuucacuuagaauaauggccuccagcuagauccaagccgcugccagagacauuauuuuguuauuuuuuauggcugaauaguauuacauuguguauauauacauuuucuuuuauccacucauaggcugaugggcacuuagguugauuccaucucuuuaugauugugaauugggcugugauaaacauacaugugcaggugucuuuuugauacaaugcaguugauacaaagcauuuccucugcuugcacucacuccauccugcagcccuuggaagaaggugcgugcuucucuuuugccuuccaccaugauucuguuuccugaggccucccuagcaauguggaacugugagccaauuaaaccucuuuccuuuauaaauuacccagacuuagggaaguucuuuauagcagugugagaauagauuaauacacuucucaucccuuuaaaaaaauacucuggaguuaugguuuuauaugugagguuuccuggaucuguucucuaaauaucauauuuuuaucuggucaugguuuucacuugagauuuuguuuuugaauuugauucuaaauaucauauuuuuaucuguucguaguuuucacuugagauuuuuuuuugaauuugauucuuaucucuuucuuucaauucauucuguaaagauauuuaauugggaaguuaaugguuuuuaacucuuaaaaguuuuuuuuuuuuugagugcuguauuugaaucuccuuaaauuuucuuagauaauucagguauucccuuuaguugagguauucugucugcugcagaacacagagcgugggucuaauucuucugccuuaucuuccuuuuucuagcagcucugcuccuuuguaugggcuguaucccuugguugacucauuggagcucaagacuguuauugaauaguccucuguggcgucaguccugcaggugguagaaggcaaaugggucucucuucagugggccugcacuggcagauaggcugucaguucccugucagucagcuuucuggucuccuuguacuuuugugggcaucaagagcaggaaagauugugggcugugacccccuccaucucugacuuucaaauucuuuuugggauucccugguuuucaguccuugucccugguuacucugcuguccucuacuuuauuacuaagucuacuggagagaacaccucacaccagauuucugccagaaccuaaggcuucacuugcauccauuugcccacagaugcuaguaguaguuguuuugcucaagagaggaaaguaacagguuugagggugaaggggaaagguguugcauucaggucaccauauacccacaauucuuuuugucgcaucucuucugcauuuccguuuuguauuauuucauaagugaugcauuucauaaagaauaauuccauuuuauuauaggcaccacuacauuucuuuccccugaccucugcuauaucaacuggaguaagagagacaacugcaguaauuaaacuugaaguuuuuguucucccucuaacaggaagcuggcagauggaacaagauguuuguggccauuaguucaguggcucaaaaugucagggcagaagucuuugcaauucucuuggacucaagguggcugcuucagccccagcuaucaugcucauauuccagguagggagaaacaggauuagguauacuuucuaguugacucagcuucauuuaagaacuugugugauaguuccauacaaugauuucuacucacagguuguuugcucccuucucuucgagauaaauauaguauuuuaccuggauacauuaguacccuuaacacgaucaguguucuaguacuaaugggaauggauauagggaggcaacuagucugccucagacuuccuacaguggggaaggaagauugguuauuuuucacauugaacuuuuaagaaacacauuuaauacacuauugaaggucuaauuauauugcaaaggcacauccaugcacaguaguuuaacauugaaacauaauuauguucuaaguggggacucuagucuccuucugugaaaaacaucauuauuucaaauauaaaugacucaacugcagauugauucacuuuaauguauuuauuucaucuauauguauauuuuuuauuucugaacuauuucaaaguaaauuacagauguugugacaauucaccccucaauacuuuagcauaaggacauucuccuaaauagccaugaugcuguuuuagcaaauccaacaaaaauaacaguaauuuccuaaugucuucuaaugcuaguccauauuuaaauuacuccaauugccuaaaaauguuuuuauagcuauuuauuuuugaaccaggaucuuaucaaagacuacauauuacauuuaguuaugucuauuaaauaucucuuuaaucccucccucccccuuuuuaauaacagugacucucugaagagaucaugucaguuguagaauaucucacaucuggauuuaccugauuacauucccagggcuuuauuuaacuuguuucucuaucuucuauaauuccugcagucuggaaguuagauauaaauauuucuggcaaaaauacauuauggagugaugcugguuuauuugugcugcauaacaguagggggcauauaauguaucuggcuucccacuguuacugaugccaacauuggguuaagguaauuuuucuguuguaaauguccuguuuccccuuuguucuuagcaaguaaucugugagcugauacugcuaaauggauauauauuuuuucaccaucaaccuuuugccuaaugguuuuaguauccauggagaauucuugccaaaucaguaauauuauuagggauuucaaaauggugauucgcuaacucaaauauucccccuuuauuuauaaguuagcauucuccuguaaagaggagcuuuucaucaucaauuucugcugucugguuagccugaacuaugguuaguauugaaaaggcaggauaaaaugcuuaauuccuuuucuuuacuaauuuuaauaauaacuuauuauccucuaaugauagcaaaugagauuuuaaaaacauuuucucucacugacaguaugggcuuacaaauuuguuaauguguuucaaucaguuauccucuuguccuguuugagucucagauuguucuaaauuuggucuguggaagcucuuucuauuggaauuuaaaagcuggaagaaaucuuagaaucaacuaaucuaaaucccuaaguuuuguagauaaggagacugaggcuuagaagauagugcuuuuccccacaauucugagagagauaucugcagugaaucuuguuuuuaacuucucacuaauaacauucagcaaaaugagagaaaauggcccacauuuuugcaaucauacaguuuuuguuuauuaaaaguuacugucuaguccagugaauagaagauugaauggauuaauuaucugcuuuauucagaaacaguuugaauaaaaacaaagaugcuccauuaugggcuggacauuggaucagucugagaagugaguuugacucagacaguuugguguguacaggcugaauuuaucuugaagucacauuuuauuugaccugcacaaaguguugaguucuuggaauucauugacaguguaaaaaaucagugauuucacacacaaauuugaguuauuagcuucucuaaaaaucauguauauaucuggcaacauuggguccacauggugauacagcaacauucaguuggaguggaaaaguuuuuagguggcaugcucuuuccaccuuaccuccuggcuacucucuaaaauaucauuuacauguuuaugguuggguaucugguguuguguugcccuacugccuaacuuguaaguguuugagguggugacucuugagauagaagugaagaagucuaggaaaguucuugcaaagaaaucacaagucaaagguaauaccaauaaugcaggcacaaauggacagcaagaaaauggaagagcggacaguuuuccuaucugcuagugugaaaucuucagcagguuuauuacaaaaaguaaaaccaaugauaucaggaagucagccagaaauuuuugaaguuuucaagaagaguguuugaaauacagguuuccuuccugucauuaauuuugaaccuccuccuagguguuuaauuuacuaaggcacauguauauacuucauuuaugaugaaucauaugaaaaacuuucauuuuguaggucaaaaauggucaaauauuggcaauuucauauaauuccacuaaaagaaaaagaauuauauauguaugggguaugugccccaaacuucccuuucauagaugugcugcccaagcagaucugaaguccacugagguagaagaggcuuauacugaaguuagaaucucuguaggaaaugugguuagugaauaaaaauaaaauuguaauuacaguuuuaagaaacuacuguuuguaugauagagacaacagugaacaaagagagagagaaggauuggguagcuggugcuggaaucccuaggggaaggcuuccuaagagugggucuacucaguauaaaaucuucaucuaaagccaaauauaaauuagguuuucaauaucugcauuguuucucaccacaguaguauggauaauugagaguuggcuauuuacauuuuuauaaucuugcagccaugaaaauucaaguuuauuugaugaacucuuuguaacagacccgguaagguacuuugaagaaaugucaucaaagauagaaagcuaauuuaccuccccuaucaguguuuuuaaugucaguguuuuucaagcugugaaucgcagcccaucaaugaguucuguaauuaauuuagugggucaaaacucuuuuuuuuuuuuaaagcauaugaaauaacacagaguagaaaauaugaagaaauuuauacaguaucacaggguuuuuuuugucuuuucuuugaaggauauuccugaaauauuaaguaucucaguuuuauagguguguguuucuguguaugugugaaugugcuaaguugagauacaaaauacauuucuuaaagcuaaaaaccacuauuuauuauaauuuggugguuugaguuuaugauagagagugauuguucucuauuaauggugaagcuuuaaaaucagcauucugcuuaaucugaauuuucagagcuuuaagucuuuuaauaaucuuacuaggccugcauccaagcaggcuucccccgcaccccccaccccccgaucccauugcauuuauuugaguuucuauucuuuccucuuuaguccucugaacacugcugaauugauagauucacuuuuuuuuuuccccuccaaauuuguacugcaaagaggaacugauugguuuggauagaucaguuacuuuggaaaguguguacuuagauuauuauuacuuucuguaauaguugauaaaggcuaaauacaugacagaguggaccgaaaauggaaccacauucauucauauuuaacccucacauuuauuacagaaaacacaccuuauuuuuuggucuguuuucuagauuggcuuuaacauaagcucacaguuucuucaauucaguagucaauguauugaguguguacauugggcaauugcacggcccaggucauugcuaaauuguagucaauggaaagcugaggagguggcaucagguggccucagcaguggaccaugcagcugucugucaggguuuugaguguuggcuuggugaaguggauguugccugagcacuccacucagaauaaaccacugguuccugauacuaugucuaaucaucgccaccugauugaccuuaaucaagcaagcuauuuaaauuccgaggcucaauuuucuuaguuguuaaauggggaaacucccacauaggauuauuuggaaugcagcacaugguaguucaguaaguguuaacucuucuccccuguucuuguggagcuuuuccuaccugccaucaaauccugguuaggucccaucuggaggagagaagugauuacuuuguaaagaaagccucuuuggggcuguuguguuuaagugugauguugaaugcccauuuuagcaugaggggacuagugaggcaugagaggauugugaagcagaguaggcuucuagcuucucugaaauuggcugucuaaacuuuguauuaauauuucuaauguuaugaauagugagcaaucucccuguuucuuugcuaugccuguguuuaaauuacuuacaauuauagucuugauuugaggaaucucuggguauuuucugccccuaaguuaacauuaaagaaauggucuuccuggcucugccaguauuuauggcuucuccggaccucuuuucuucaucuguaaaaugagggggcuggguuaacuauuaauauuuguaauucuuuaagcuuuaaaauuuuacuguucucaggaguuggguguucuguuguucauuaaguaauuuauauccuugaaauauugccuuagugguuaucuuuucuccuuacaauguucaucaaaagagauuuuguugguuuuuuucuugcaucaccuccaugugaagggaaggauucugcugaaaaauagucauaggcagguuuagaagcaugaguggcucugugucuccucugcacacauuucaacaaaaugucugguuggacaaauucaacucauucccacugucucugcagucccugcuuuggucacuuuagagagaaaagaguguuacuugcccauugaacauguccuuaaaagucccgucaggguagauugaaggacagcccauuuccagauucugauuuuaacaaagaccagaauucuguaucucaaacuaguaacacggguguuucucaugcaugugggcuucaaagcacacacuucaagaaagcaugguuuaaagugugcccauuugccuguuugaaagauuggcaggcaaauuuaaaguuuauuuaugaacacucuuccucugagaaugccaagcccacguccuucuuguccagaauauggaugaauuuaugauuuuuauggaaaccaggugauuuucugccuggugggcuugucucucaagucagacaaaacucagugcuuuuuucaacaucgcuugccagaggcuaugaagaggauugaaacauaugaaauacaauguccagugccuugucagaauuugaaaguaaaugauuuaacccuuuuauguugcuccuauguuguggauuuagcguuuuaggcuaaaaacagauuaaguuggauuguaaauaaacauuuuguguuggguaaauuaguuaauauuucaaaagcaucucuucuuugggcaugaagauuugcagaaaaacauuccagaagaaaaaagucguuuauuuuaguauguugauuuauuguacuaauccuuguucaauauaaucauugcuacucagggugaaaaguucggacccuuugcuggagagaagagaaugccugaagacuuggaugaaaauauggauuacagguugaugugggaggugaggauaugacuuauuuuaauguuaaaaauauauuuguauuguaccauuuaaugcauuuuuaaggcuacauuaauugauauugauuccaguuaaguauuuaaguauugaaauguuuuagguuuuuuuuuuuuuuuuugagauggagauuugcucuuguugcccaggcuggagugcaauggugcgaucuuggcucacugcaacguccgccccccagguucaagcgauucuccugccuuagucucccgaguagcugggauuacaggcgcaugccaacauguccagcuaauuuuguauuuuuaguugagacgggguuuugccacauuggccaggcuggucuugaacuucugaccucaggugaucuacccgucucggccucccagagugcuaugauuacaggcaugagccacugugcccagccaaaauguuuuagguuuuaaaaaaaguucagcuuuuuuuuuuuuuuuuuuagagaaaguggacuguugagauaucuuacuagacaguucuuuuagagaucugaaguucuucguugaaaaauaaguuuuucagguauagugauguuugacuuucaaaauaagcaugcccugaauuuagaacuugacuucuguaaauaaaauuauacuuaauuuuuuuuauuuacuaguugaaguucuaauuguauagaaacaaaucucaguuucauguuguaacaaaaaucccgccuuaaaauguacuuuaccuuuaaaaacacauaguuaaggaguuguaacacuagagacagucuuuugcagucuaaaguuucacuuaagcagagaucuguauaugccaguauaugucugcacguuaugagaauuuucauccuaguuuaugccaauuauauucguugcuguucuuuucuaggcauuagaaaaaggaccuaagguaucaaaauaggaaagcagugguguagacuguugaaacaaaaauuuggaaaaugcaguccuaggaauuauauaugcauguguuacuuaaugacagggauucauucuaagaaaugcgucaucaagugaacaucauagagcauauuuguacaagccuagaugguauagccuacuguacuccuaagcuauaggguauagccuauugcuccuggacgguaaaccuguacagcauguuacuguacugaguaauggaggcaauuggaagacaguggcaagcauuuguggauccaauguaucuauacaagccaggcacaguggcuugugccuaauuccagguacucaggaggcuaaggcaggaggauugcuugaggccaggaguuggagcccagccagagcgacauagcaacccaaugucuuaaaaaaauauaaaaaauuaucugggccuugugguacgugccuguagucccagcuacucaggagguugaggugggaggauugccugagccuaggaguucaaggcugcagugaacuaugaucuugccacugcacuccagccuaggcaacagaaggagaccccuucucuagcaaaugaaauugaaaaagaucuaaauacagaaaaaguacaauaaaaauauaguauuauaaucauaggagaccaccauuguauguauagucacuguugacugaaacauugcauugugacccaagacuauuugauaguuucuaugagaaggguaagagcugagauacauguaggagguagagauuaugcaaucagaaaagguuggaaaacuggaguuuuccacacauagagagucucucuugcauguaucaguaagggucuucagagaaauagaaccaaggagauaguauauauauuuguuuauuuuaagguauuauguuauuguggugguagcaagucugaaauuuauagggcagguccucaggcuggaaccucaggcagaaaggugaugcuguggucuugaggcagaauagcuucuccaggauaccuuaguuuuugcucuuaagggcugugacuaaauggaugagggccacacauguuauggagggugaucuccuuuacuuacaguaaacugauuguagauguuaaccgcaucuacaaaauaccuuuacuccuauaucaguauuugauuguuagauguuaaccgcaucuacaaaauaccuuuacugcuauaucagcguuugauuaaauaauuggguacuauagccuauccauaguauacauaaaacuaucaguguauuaccuguaagcaaaaugcauuuuuaagcaucacccguauuguugaaacugcugggggugaggaguggaggugacugagaaaggauucugaaagguuucuucagugcaagugauaaaaaauggaaauucauaauauaguccucacuauaauuuaagugggaaauguuauugauauugucugaauuuagccugcuguuuuguuuacuuuuauguacuuaaacauuuuaauggcuuucacuauguuucuacaaggucuuaauuuccucagcaguuaauucuuuuacuaugaagguuuuucagaaaccauacauuuaugugaaccaaaaaaaccugauaacuuaguaagucauaaaaugauaaaaaugcuacauuuuuaacagguuuuuucuuuuuuaaaaauguuauuuguauaaauuuaagggguacaaauucaauuuuuaacauguuauuaauaguuuauguuacuuguuuuguuaucugaaaauuuuagugugaugaucauauuaauguuuuguguagcuauaagguaguguuaaacagauaauaauuuuuauuuuaaaaggaagacuugcauauaggaaacaaagucauuuuuguacuauuauauaguugacaguuccacaguacaucaucuaguuuugcauuaucuauuccuguaguucuuuaaugucuuugcauuauuauuuuguuuucacacuaguugucuccagcucucucacucugcuacccaaggagcuauugauuuuauacauuuuuaugcucagguaaugguacacucacacgauugccauucucuguuucauuuuacuucacccuuuaugucuguguuuugaacaaguaauauuuuuacuuguuacacaauucagaagguacaaaagggaauugaugaaaagucucuguucccuuccagccuguuuuuuucaccugagaccuuuugauacauuuaaccccuuaguucauauaccuucccccuccccuucugguucuuuuuccucuuggucucgucuucauuucggauugucagccauuguauuagucuguugucaugcugcuaauaaagacauaccugagacugaguaauuuauaaaggaaggagguuuuuuuguuuuuuuuuuuuuuuugagaaggagucucccucugucacccaggcuggagugcaguggcacgaucucagcucacugcaaccuccaucuccuggguucaagagguucuccugccucagccucccaaguagcugggauuacaggugcaugccaccacaccuggcuaauuuuuguauuuuuaguagagacgggguucuaccauguuggccaggcuggucuugaauuccugaccugaagugaucugcuggccucggccucccaaaguucuaggauuacagaugugagucaccaugcccagccaggaaggaaguuuaauggucucacaguuccauauggcuggggcagccucacaaucaugguggaaggcaaaggagaagcagaggcauguuuuacaugguggcaggcaagagagcuugugcaagagaacucccguuuauaaaaccaucagaccuuguaaaacuuauucacuaccacgagaacaguauuggguaaacugccccaaugauuuaauuaucuccagcuggcccugccauuuacacauggggauuauugcaguucauggugagguuuggguggggacacagaggcaaaccauaucagccauucccugcucugcccaguugugcagcuggacaggggaagggacagauucugugguaggucuucuagagggaacauuucaagaacaacacuuuuagaauugcagaguuauugcuugcuaucuuuaaucuugucccuuauuauguugagugagcaagcugcuuccaaacccugaguuauaccauugaaaguccuuuauuuuuuuauuauuuuagcuuuggaggugcuaggauucagaaagagcacagauacaggagaauaacugguccuguuacugguccugcuucugccccuuguggaacuguuugagucuuuccaaagggagauaaugagccuucccuccucugguggguaaauuuagauugguuaugggagucauuucugcuaugccccauaucuauggugcuaaccacaaugaagcucucaaaugaguaguccuucucaaaaaaauaguuacauauguugugguuauggaacaugaaccagaaccuggugguagugucuggaaaaugaugucaugugagagagcauguggcauaacuccuucucaguuuauaccuguauucugcuuaugaugccagugguugugguggacaaggccaagagccccuggggagccauuucauaccaaagaacuuggaguuaccagucaggauugagccuccugguaggugugagccuuugugagcuugggacaggguaugaagggaucuuagggucauggggagcacuaauaauaucuacugccaccucucucucuuuguccaaaggugcagcuuagaacuuacugaugcccacugcuucagagugcucacuaguaccucaguuacuuucuguauuggccaucagguuuugagcuuggucucugaauagacugaguguugugggucuuuaauccuucuugaucaccucagauuuuuacuuuucuuuuaaaauuaagugcuuaagcagaagaacucuggauuucuugggccucaggcauauuacaaagcuugagguuaggaaccaguguuugacuguaaaugcuucccuuggacaauuugguggaauauacccaguuuucugcauuguauuccauucuucucuuaauuagaagucuuucugucuacuuuuugccaggugguuuggagcuugagauacauuuccuucaauucucuacuaauucagacucauucuaugaccuaugaccuauguucuauuugcuaaacucucaauaauucuuuguuuuuacgucuccaagacauccucuuucuauaauauuuucuuagauauuucaaaccacaauucaaguacguuuucuccaggcacuggcucugugcuuccagcauauaacuuuacauuuuggcaccuguggaaugcagcacaguuugugcauuuccuugcuaccuguucugaccaugauuuaguuguucuaaaguggcuacuggugaauccaguagcagcuggaauccuccaaacagcucuuuucuauuggcucugggccuuucuuuccauuucaaaagugauucucugggaugcuugcaacagguuuuguguagaaacugcccugauaaguucucagaaacuugguguuguccuauauuuccaguggagucauucauucuugaacuuuacaacugcuccaagaucacaaggucucugccucacucuccucuuuuucucucacucaugcugagucugcauuugccucuuagucuuugaacguuucuguggaugcaguggguguucaguggugugaucugaugcaaguggagucauaugcuaugccacaguucaguacacuggguggucccucuggaaagacagcuuuuacugugugcagaauccuaaagaaccagauacaaacuaaaauuucaaguaaaauaucuuaauucuggguggcauuuucauaggaaaaauuuaagccucuuuuacuuaaauacauuauaucauccauaacuuaugcuaaaaagguauuuaucucaacacaaggaacauuaggacaaaaccaaaacaaauagagguugaacuuugcuuuuuuaaaaagucuguggccucguaaggguuccagauguaacacaaugugggauacccagagcacugugagagccgugugcgucaccugcagcagccugacuuaauggcauuuaaaaaguuuuacaugcauuuauuuuccuacgucugucuccuggaucauucaugagaaaacucuauguuuuacaucugagguuaguguauuaccaggguaauuagucauuacaaccuacuagaaaauugcauauuacaaaauccagaggaucaaauuaucaugauuuuauuuauuuuugugggcaguuucugauuuuguggacuggauaaauaacauguuuucaaaauauagccaucauggugggaacagggugagggauaaaagacuguauauuggguacagucuauacuucuugguugacagguacacuaacaucucagaagucaccacuguagaauucauccauguaaccaaaaaccacuuguacccccaaagcuacugaaauaaaaacaaaaaauuuaaaaauuuaaaaaaggauggaagcuuguacauaaucuaucacucguuuauuuaaauacaugaggacauauauaaaagugcuuaauguaccuaaaauagaagugaauggguaacaauagcugucucuaaggaaaaggaaugggugacaagaaauagaggagagagggagacuuuuuuauuacuauauaaucuuuuuaccuuuaaauuuuuauuguguaugggcauuaccuguugugugaaacaaacuuuuuuuuaagcaauaaauaccccccaaaacuccacaaaauauagcaauuaaaagacaucauuauaagauuugcagcuguuuuuguaugauugugaaucucuuacaguuauagcaaauuauuauuucaaaauaaguguacauagcagaugaguuggggcuccuucuguuauugaugggguuuaagacauccauuuaucaguuaaaauauauauggauuguuuuuggaaacuucuuuuccaacccuugacuccccucuucacuuacacacuggugaugguucuuaguuaauaaccucuguuuguccuugguuauuaauuugaaccaaugaagaacagauaggaaccagaugaagauaaaauaucuacuuuauuaaugagcauguaugauauuaugaaaucuauauuugguccucaucuacuuccuugacauuuaacuccuaaaauccuuggaaucccuagaguauaagaguguuuuuuguuugcuaaugagaugacuggaggcuggaguccccuagauagccuccaggaugggacuguuugccaggggaagcaaccacguggugauuagaggguuggaacuuucagcccccugugucccccucaccucuagggagaggaggguggcugaagguuagguugauauacuagugacuaauaucagucaugccuaguaaugaagcuuccauaaaaacccaaaagaacuguguucugaggguuuccagauaacugaacacauggagauuucuggaggguggugcacccggagagggcauggaagcuuugcgucccuucuuuuauagcuauuuaucucuucuauaccuaugccuuuuucuguaucuaugcaucucucccaucuggcuguucaccuguauucuuuggaauaucccuuauuaauauaccuguaaacauaagugaaguguucuccugaauacuuuuagccucucuagcaaauuaauugaaccuggggagugugucaugggaacuccagucuauagcaaguugguuaaaaguuucagaggccuggacuugccacugccuggugcaggacagucuuaugagacugagccuucaaccugugggaugugacguuaucuccagauagauaauauaaggauugaauuaaauuagaggacacccagcuggugugguacugaauaaucugaauaauccaccagagaguugcuugcuuggugugugaugggggaaacccuaccacaugugguaguagaaguguucugaguugacuguguugugagaauaaaguaggagauucugaguuuguuguuuuccuaucccuacagcaugcaauaauuuucuaaguaccuagcuccagaaaagcuggauuggugacuaggagcccaggccuucaugccuggcuucugaaaucuugaaguguguaccaccuguggcaggaauugagucaggaaaguagauucaaaaucuauugccaaucagcugugugacgaauuauggccuaauucagacucacuucacagcauaauuggaguggaggauaacagagagcacuggagagagacaggucuccagccuguguagaaggcacauccugagucagcugguaugucugcuuacuauacagcauggggaugggcacaggaaauucuggccccugcuuuuuuucugagguaugguaaccaaaguaaguaucagacccaaugacuaucagggucucaguaaucagcugaagagagggaaccaugaaggaaagaaacccaaaguauauuuauuccaaucuauuucucucauggaggaggaaguaaggaaauaugaaaaaggagaauaaggauucuuuaugagaacauacagaauuauguucuucucguuucucauacagaaaaaaaugaugugcucguuuggaauucuucacaaaacaaaaauaggcauggugagugaagcgggauggaaagaggagcgcuaucagacagucagacagucuucagucugauugcugccccuaggaugcaguagagccuuuauucuucugggaccuauguuuuaguagcaaagauagaauuaaaacaucuguaauaaauaauauagugaaagguagugauauaugguauaaagaaaguaaaauagggcaagaaagcuucugucugauacgaacuugaacacaucaauauuacugcugauaacaacuccaaaagacagguuaaauauaaaaauaauuuguuuaacagcuucaagggguguuaaagcaaggaguccuagagugacuaaagcuccagagaggugauaauuuuggagagaugaacugauaaucugcaguugcuuuucucuuggggaaguggucagacugcugauucuguguauaggcaagaggcuaaaaaucugagcucagccugucuagaggguuacucuuugaggacacagaaauagguagagcuuuuggaaaucuugucgugugaagcaacaauauuggagacccaaaaggacuaaaaaauauugcugucuccuucucaagacauuugcagaauuaugaagcugcguggcagauuauuauaaaguuaagccacaugccuuugaaaagcaagguguucuguggucucaucuugcugaggagaggcuuucagugcaugccauacuuugaauuggaagcaccauagggcuguggguaggaauauaguacacugaaacagacugagccuugccacaacugaagcccagcugugaaucaccucacucccugaugcguuuaaggugaacaguuucugcucugccugauagaaaacaggguaaaucuacuccagagaaauauaauaccuggauccucuaaacuuuucaauauaaaauauccagcauuuuauaaaaaaugacuagacaugaagagauaggaccauaucacuaaaaaugauaaaagcuggacaauagaaacugacuuaaggauauuucaaauguugauuggaguuggcagauguggacuuuauaauaaccaugacuguuauacucuagcacauggaagaaaagaugagacaaaaagaggaagagauggagaauuuuacuaacaaauugaaauguauaaauggcaaauuuauacauuuagagcaaauuuauauuuuagagcagagaacucagugugcaaauuacauaguagguaugacaaagcaaaagacagaaugaaugaaaaggaaaagaagucaguagaaaauauugaaaaugaauuacagagauuaaacugauaugugagacagugaaaauaucuaauacaucuguaauguuaggaccuuuuagcuuagcaggagaggauguagaaaaugggacagaagcaguuuugaugagguaauggcuaagaauuuuccaggacuuuuuaaaaacauuaucugaugaauugaggaagcuguaugagccugaaacagugucaguagaaagacgguuacaccuacagauaucuuaguaaaacuacuuaaaccaagacaauccuaaaagcagcuagaaaaaaaaggagacauuaaaaaagaaacaguaagagugagaguugauuuuuaacagaaaaauuaagauaguagacaacugaauaauauuuuuaagaugcaaaaagaaaauagcugccaaucuagaaugcuuuauccaguaaaaauaucauuaauaaaaugaccuaguucuucccaucucuuccaaaugugaccugauucuuugagucacuucuaugugacugguucuuuggauuugucaaagaauuagcuuuaguuuaaggcuaaggcuaacagcauuguucacaucauucauucuucaaaugaggguacuaagaccaccuccagaucuuacccagaggaaaacuuugcuacuuuggauuuacugaaaggaggaaaaaaaaaaaaaaaacuauaggaaggcugcgcaugguggcucgcgccuguaaucccagaacuuugggaggcugaggcaggcagaucaugaggucaggagauugagaccauccuagcgaacacgaugaaaccccgucucuacuaaaaauacaaaaaauuagccgggcgugguggcgggugccuguagucccagcuacucgggaggcugaggcaggagaauggcgugaaccugggagguggaggcugcagugagccaagauugugccacugcacuccagccugggugaaagagcgagauuccaucuaaaaaaaaaauuaugugugugugugugugugugugugugugugugaaauauuuaagcacagggauguugcacaaauugaaauagacagacuuuacaaacaagccagugaggaaauuuccaaaguagaacaaaaauguaacaaacuucaaacuauuuaaaagagguuguaauugaucuccugaauuucaaauuuagagguacuguuaaucaacuaugugcaagugacuucccugcuugaaaugcgaaugaagagaugcugugcuaucucuuuagaaugaaagugacagaauuuaaagauauuaaaugauauuauagaauagauuuuuauuuugcugaaaaaccuuauuuuaaaauaaaguuccucgcaacaaauuucaucucaaguagagugguggcccaucuucaguguugacuaaaguuaaaugggaaucugagaaggacuugauuaaaugaucaugucagaaguaaaauaaagcugucuagaagaggaagcaugaaaaaucucaggccuucuucacuugauucaccaaugauucugaugcaggugcaggugaauuaagagagcucaucaaaguugcucuuugggacugggcaugguggcuuaugcaaauaauugcagcaguuugaaaggcugaggugggaggauagcuugaagccauaauuuguuuuuuguagagacagugucuugccacaaagcaagauuuuuauuuugcugaaaaaccuuauuuuaaaauaaaauucucaccaacagauuucaucucagauagagugguggcccauuuuuaguguugacugaaguuaaaugggacucagggaagagauugcaacaaagcaagacccugucucuacaaaaaauaaauuagccaggcauggugguacaugccuguuguccuagcuacucaugagguugacgugagaggauuguuugagucaaggagguugaggugucagugagcuaugauggugccagccugggcuauagaacaagacccugucucaaaaugaaacaaaacaaaaaccugcuauuaaagcgcagauuggcuucuuauaugauagauaaagaaguggaaggagaagaagcugauguucauaaugaugaugaagaagacuugaaacauauuuugaugaagaagaugagggcagaggggaagaagaugaagaugguguugauguggaagagggaggaagguugaagaggaagaugacuaguggaauacuaauagauucugacccucuuuuuacuuuuagaaauuuugcauucuuugggagccaguugccaucuccuauuuuuuccccuuuuguacucaguugccuuguucuaauaaggucucuuucucucucucucccugaucugguucuucacuuacuuugugggagacucuugagcaaaauacaguggaaaaaacaucucuacccauuucuguuccaaguuucuugccuuaaaaaaaugugaauguagugauguggaacuaacacaucaaccugcacugugggaaagaagaaauuuucucccuuugcuuugcuggaagcuggagggugcuuaucccccuugcauuagugcacaaaauucuugauuuuacuuucucuaaaggauucagagauuacacuuugucucuuugugauuauggacauuuaacauuaucauguacaugcacuuucucuuguuaaauaaaaaagaaaaaucuuacaaaauggaauuaagucaggaaaggauggauuuccgauguuuugguguuuaguguuacaaggagaggagagaaagaauggagcggaagcagaaaugauaauggcuuuaaguggguauuuuggugacauggcuucuucuugugcauggguaauugaaguugaacuuauauuuuuaaaacagaauucucuucuagugaugacuugagcucuacuaauugcaaaaucauccaaaauauauaagauccuugaaauugacauucucuguuuuaauuuugucccuuuucauuuguaaauucuacuuuucuuuuaugggaaaggaaagaagauucucaguuuuaaacccugaaaauacauauauguuucuuuuguuuuuacaauaaaguuaaauguauacacaaaagauuugauacuguuuuccucagaacagauaaacuugagaucuuccaaauuucauuuauaaguaguguugucaaacuuuaaaggcaaauaaagauguuuucaaacaagcaaaaacugagacuuuaucacuagcugacuugcgccagaagaaauauuaaaguaaagggagcucuucauggagaaggaaaaggaauccugauggaaacauggaaaugcagaaaggagugaagagcagugaaggguaaccauauuggugaauaacauauuguugguguuggacaauaauaauguugguuuaaaaauauaugcaauuuauauaauaagaacaauuugaauggcuggagggaaguaacuguaauuaaagcauugcggguuucuaguaaguaaauuuauuaaguaaauuuaacuagauuaucuaacuaaaaugauacuaaaauaugguuuuaacuaaaaaguuaauacaagggaaaaauaggaugauaaaaucauuuuauuaauccaaaaagaaggcaaggaaugaggagaaagacaacugugucauauagaaaauaguaacaugguaaguauaaacccaauuagaucaaucauugugcuaaauuuaaauggacuaaguauuucaauuuaaagacuuauacuauuaaugaauuggaccaaagaacaaagcaaagcugaugccucuuuagagacaauuuuaaaacuuaaagacucagaaagccugaaaauaaaagaaugaaacaaauauauuaugcaaagacaaaugaaauuagguuuaaccuuauuaauauuugauaaaaugcacuuuaaggaagaaacauuacuagaaauaaagagggucaauacauucgaaaauagauauguuccgaaugugaaugcgaaaacuaaaauaauuagcaguagaaauaggcgaaugaauaauccuaaugguagacuuaagcacaacuuucucaauugcugauagaauaaacaggaacaaauaaccuggaaaggacauauagauaauucaaucaauacaauuaauacaaaagaccuaauugacagauacagaauacuguguccagugacaguuggucaaguaacgcacauggaacacuuaccaaauuaacuauaugcugagucauagagugcaagucaacugcaucaaaagaugcagucuugggggaugggccaaaaugguggacuagagacagcucaugugcaccauugacagaaaggaaacaaaagggcuggugaauacugacccugcuggccagccaucugagaagccauguggggauccaucaaggcagcagggagacacagagaguagagaggaauaaagcuggacaccagucugucuagguucagugcaggagaaccucucggacauggaaaagggugagugaaugagagcccccugaggaauucacacuuuccauagggaccucugcaagacuggaaacgggagaaucccccuggacucccagcagccugccaucuuccuucuggacugaggcagagagccgucaggauguuuuucaugggcaacucuuuugaguccaaggggacuuuaauaaaccucggguccuggagcagaccaccacuggcacuguagccucaauagaggcuucagucauggggccugggagcaguaagauugcucuacucccccuucacuggauggggcuuagugccaacuucuggcccagugguccugcuucugccugaacuuggugcagcugcaaccuucugcuguccucggaaguacccagaugguagggugggagcccccacccaccacugccacuaguagccagucaggcaauacgugauagagcugccagcuagucaguggucccacuucugucugaacuuagcuggcaggcacaaccuucuguuuuccugagaaacaaugagacagcaggcagggcaggugacuucacccuccuccaccucucauagccagaugagccacacccauuagaacuuccggcccagugguccugcuucugccuaaauucuaugggcaggugcgccccugugaagcacucagacagcagaguagggcugaccuggcaaggauauggccugucugccaacugugguuccuaccugagagagcccuguggaccagaacacucaacaccaggaacauccagauucauaaaaugaguucuuauagaucuacaaagagacuuagauaaccacacaauaauacugggagacuucaacgccccacuugacaguauuagaucauugagacaaaacuaucagugacguucgggaccugaacucaacacuugaucagauagggccaacagacaucuauggaacucuccacccagaaauaacagaauauacauuuuucucgucugcaggugguacauacucuaaaauugaccacauaggcauaaaacaauccucagcaaauuaaaaaagaaaaaaaaacccuaaaaucauagcaaacacacuuucagaccacagugcgaugcaaguagaaauuaauacaaacaaaaucacucaaagccacacaacuauauggaaauuaaacaacuugcuccugaaugacuuuuguauaaacaaugaaauuaaggccaaaaucaagaaauucuuugaaacuaaugugaacgaagauacaacauaccagaaucuuggcgauacagcuaaagcaguguuaagagugaacuuuauggugcuaaacauucaaauaaaaaaguuagaaaguggcucaugccuguaaucccaguacuuugggagaccgaggcagguggaucgcuugaggucaggaguucgagaacagccuggccaacauaacgaaacccugugucuacuaaaaauacaaaaauuagcugggcaugguggugggugccuguaaucccagguauuugggaggcugaagcaggagaauuacuugaacccagaaggcggagguugcggcgagcugagaacgugucacucugggugacacagugagacucugucucaaaaaaaaaguuagaaagcucccaaaugaacaaccuaacaucacaucuagaaaaacuagagaaacaaaagcaaaccaaccccaaagcuagcagaauacaagaaauaaccaaaaaucagauuugaaugguaggaaacagaugugaaaaaccauacagaagaucaaagggucuagaagcugguucucugaaagcauaaaugaggucaauggaccacuaguuagacuaauaaggaaaaaaggagaagauuuaaauuagcacaaucagaaaugacaaaggagacauuaccaccaaccccacagaaacacaaaaaacccucagagacaauuaugaaaaccucuaugcacacaaauuagaaagccuagaagaaauggauaaauugcuggagacauauaaucuuccaagauugaaccaggaagaaauggaaucuuugaacagauucaauaaugaguuuagaaacugaaucaguaauaaaaagccuaaaaaccagaaaaagcccgagaccagauggauucacaaucaaauucugccagauguauacagaagagcuggugccauuccuacugaaacuauuacaaaaaauuuuaggaaauuucauucuggacauaggcccugucaaagacuuuaugaugaagaugugauaaccaauugcaucaaaaacaaaaauugacaaauggggccuagugaaacuaaagagcuucugcaccauaaaagaaacuaugaacaguguaaacagacagccugcagaaggggagaaaauauuuacuaacuacacaucugacaaaauucuaauauccagaauguauaagguacuuaaacaaauuaacaagcaaaaaccaaacaaccccauuuaaagguggacaaaugauaugaacagauacuuuucaaaagaggacauacacauagccaacuagcauaugaaaaaaugcucaacaucacuaaucauuagagauaugcaaaucaaaaccacaaugagauaccaucccacaccagucagaauggcuauuacuaaaaaguaaacaaaaacaaaaacaugcuggugagguugugggaaaaagggaauucuuauacacugcugguggaaauguaaauaaguucagccauuguggaaaccaguguggugauuucucaaugaacuaaaaacagauguaucauuugacucagcauucccauuauuggguguauacccaaagaaauugauaugguuuagauauacguuccuacccaaaucaugucaauuugugauuucccaauuggagauagggccuagugggaggugauuggaucauggggugaguuucucaugaaugguuuagcaccauccccuuaguacuguucuuaugauagugaguucuccugagaucuguucauuuaaaaguguguaacaauucccccuacucucucuugcuccugcuguggccaugugaggugccugcuccuuuuucaccuucagccaugauuguacauuuccugaggccuccccagaagcuaagcagaugccagcaccaugcuuucuguacagccuguggaaccaugagccaauuaaaucucuuuucuuuauaaauuacccaggcucagauauuucuguauugcagugugagaauggacuaauacaggaauauaaaucauuauaccuuaaagaugcaugcacacguauguucaucacagcacuauucacaguagcaaaguaauggaaucagccugcaugcccaucaaugguagacuagauaaagaaaauguacacuauggaauacuaugcagccauaaaaaagaacuagaucaugccuuuguagcaacauggguggagcuggugaacuaaugcaggaacagaaaaucaaauaccacaugugucacuucuaagugagauaaacacugaguagacaugaguagacauggagaaaaagaagggaacaacagacaucagggccuacuugaggagggagaggauugaaaaacuauuguauacuaugcuuauuucccaagccacaaaauaaucuguauaccaaaccguguaacacacaguuuaucuauauaagaaacuugugugugcauaugucccugaaccuaaaauaaaacuuaaaaaaagaugcaaucuccauaaaaauccuggaaaguuuauuuuuauuaauuuuuuuugcaaggagggugaugguauggaaauugauuuuauaauuuauguaaaaagcuaaggugccaucaaggcagcuuugaaguaaaaaaacaaaacuggaggacuuauacaaccagauuuauaaagggacuuuggaauugucaugagaauagacaaauagaaacuguugucgacaaaaauaacauuaaugauauagugggaaaaguaugucauuuucaaggauuauauuagaucaaaauuauauccucauggaaaaauaguauuuugaccccuaauucacaucauauaugaaaaaucaacuuaauauuauuguaaauguaaacauaucagaugaaagcaauaaaccuuucaaagaaauuuucuaagagaauacuuuuaugaacguaaagacagguuucuuaaauaagcacaauaaacacuaaccuuaaguggaaaaaugauaaauuggugaacacuaaaauuaagaacucuuuaucagaagauacuacaaagagaaugaaagagcaagucacagaggaugauaagauauuuguaauacauuucugaaaaaaggauuuguauccagaauauaguaagaacuauaaaaaucaauuuaaaaaaaagaaaaaugggcaaaauacuugaacaaggaugucauacaagaagauguccagauggccaaugaacaugaaaagauauuuaacuuuauuaguuaucugggaaaugcgaaucaaaagcgcaagaugccaccauauguucaccaaaaugacuaaaauuaaaaagacaaugucaaauguuugcaaacaucaucugaaacucucauauacugcuucuggguuuuuuaauuggucacaucacuuuggaaaucuaucuagugguaucuacuagagcugaauauaugcauaugauaugauucagcaguuccacuagacagauauuaacuagaacacguuacuaaaagauuuguacaagaaccuacauagcagcaguaucaggaguugucucaagcuagaaguaacacaaauguccguauacuaguaaauggacaaauacauucugguuuaucauaaaauggaauauuauaaagauuuuaugauaauauuucuauuaugcuuagcaacaugggugaaucucaguaacaaagccuugagugaaauaagcuagagaaaauggaauacaucuguuugauucccuuuagcuaaaguuugaaagcaggugaagcuaaucuauaaaauuauaaaucaggauugugguuaccucacugugaggguagugauuagaaguagauaucuggggagacuguuucuugaucugugugauagcuauauggcuguguuuacuuugugagaauucauugagauguaugcaccaaguuucugcgccuuucaguaauugugugacacuucaauaaaaaguuuaguuaaaauaauaagacagaacaacaauaggauaaaaugucggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagauugcgccacugcacuccagccugggcgacagagcgagacuccgucucaaaaaaaaaaaaaaaaaaaaaaaaggauaaaaugucuaggcuguggguuucugcuuuagcugggcugucaaguugugguaggaccuaaauaauaaguguagcggccaucugaagaagaacuaggugaagaaaccagauuguagcagagaugacaaugaagucagauuguucaaaggacagaaacaaagcagcuaggcuaaugguuaguggaugagagaccaguagugguguguaggauuagagaggcaauucuagauuagauaaugagguuuauucuggugguagaaggaagucauuuaagggauuugagcaggagacugaugagauuugauuuaugucuugagaaggucuuugugucugccucguggagaacagguagagaggcaagaguggagcagggagaccaccuagaugucuguugcuguagucaaggagugauuugaugguggcuuggaguugggcccuaacaguagauuuggugagaagugguuggcuuccaguuguguguugaagguaacuaacacugauggggcuugcugauggauuguguauugaaagagaagagucagccaggcgcaguggcucacgccuguaaucccagcacuuugagaggccaaggcggguggaucacgaguucaggaauucaagaccagccuggcaaacauagugaaaccccgucuccacuaaaaauacaaaaauuagccaggcgugguggcgggcgccuguagucccagcuacuugggaggcugaggcaggaaaaucgcuugaacccaggaaguggagguugcagugagccgagaucaggccacugcacuccagcuuggucaacaaagugagacuucaucucauaaaaaaaaaaaaaagaaagagaagagucaagaaugacuuuuaaguauuuggcuuaagcuauaugaguggaaggugaugacaugucugagauagggcaguuauauaagacugagacugagagggaugacaaggugggguagacuauguuguagacuuuugaaggaagggcauugucuuuuuauuaccuuauuauuaucuuuacuccccaggucuuugcagaguaucuagaacauaaauauaauugaauaaaaguucauuucauauucauuauucaacaaaucauucauauugaauaaauacauugcauaaauguauagcuauuuuuaccauuggcguucuuaaaaaauaaguuacuuaaagguuaaaaaaaggaaacaacugauuaacuuccuuaguauuuuaauucucugagccuugccuacuuuauagagauuuuucuuuucuuuuucaugaugauguugauuugacugaaauauagucuuuaaaggagcagauugguuggauauuaaacuggacauuuuguuuacauguuuuucucauucuuugcaguuauuaugugauuacagcuguccugcuguugggaacuugguucaguaccagguuuccaauguguuuuaguuuugggaaaaaauguuuucaauuguuuaaaaucuuuuguuuucuuuauuguuuauggaaguccuuuuagguguuuggaacaaauaauucuuuuuaccaaauguuuuucuuuugcagaugauaacauuuuguuaugggguccaaauggaaccacuuaguguagaccuugguggaaaaauaccaccuaugaagccuuauagaaugcuggaacuccuaaaacaaaugucauagugcauucuuccugacauuaguccucuaguuagggaaaaugcaaagcaaucgaauguuucaugucuucuggaaguucuguguuuugugguuguccuuuaucugccauucauaagauggguccuaccuaaauaugccagccaauuucuggucauucagcaaaaccugaggugugauuaaagaaugcuuggaauuagaagccaaauuguuugacuaaaagaaaaaaaaacacauaacuuuuguguuauuggaguacuuccauucccuuugugguucugaucacaacuuauagaacuggaggaauuuuuuuuuuuuuucuuucggugauagggucuugcucugucucccgacuggagugcaguggugugaucucagcucacugcagccucugccuccuggauucaagcaauucuccugccucagccucgugaguagcugggaucacaggcaugugccaccaugccuggcuaaguuuuguauuuuuaguagagaugggguuucaccauguuggacagacuggucuugaacuccuggccucaaaugaucugcccaccucggccucucaaaaugcuggcauuacaggcaugaaccaccaugccuggcuggguagaacuagaggaauuuuaucagauagauguaguugauugcaacuccaacuccaacuuguuaaauaaugaggaaggacauuaugucaaauaagaggaaguucaguagucaagcaggcuucagggcugguggauuaauaacuuaauguuacccaaguuuuuuccaccucuucaccuuucuaccuugguggaggcuuaauccucaagcuaguggcagguaucagguagguugcagacaagauagugucuguaaggaauagggguaccuuuugaagaaucuucuucuccuaguagaucuccucuaauaugccagagguggguaaugugucguaugucuuuucuuuucuuuuuuacuuuuuuuuuuuuuuuuuuuuuugauacggagucuugcucugucgcccaggcuggaguacaguggcgcgaucucggcucacugcaagcucgcccucccggguucaggccauucuccugccucagccucucgaguagcccaccaucgugccuggguaauuuuuuguauuuuuaguagagaggggguuucaccauguuagccaggauggucucgaucuccugaccucgugauccacccgacucgcugggauuacaggcaugagccaccgcgcccggccaguguuucuuuuuuugaacugggaaagggaaagagaugaaagagauugcuuuuauuccagucaggcauaaccuagagcugggaaaggucagcuuuuuaucagacuucauaggaaagaguagguauaugaauaaauuuaauguucuuugaaggaggaggauggucaggguguacacucagaaguagugucccccaugaaaaugaacacauuuguuauuuuucauucaacaaauaugucuucgauguuuacucuuucuuagauauuuuguacugggugcuggauuuacuuagaaagauaaaaaguaucgggcagagaagguaaagcuuaaagccugguaagcaguccaauauuuguaucuuucauuauuucuauguuauacaaauguuuugauuggggagcauagaaagcauacuuaaugaaaguguuuuuaguuguaggaacuauaaaagaacauuucuuuuaugcauuuuuagggguuaaagcaaguguuucaaguagagagaaaguguaaaugaagguaggaaaaguguaaauuaagggagauacaaauaucaaccagguuauguuuucaaaaaugcuuauuuuucauuacauaucaucacacaugauguaaaaaauuauagcaauacauacgacauuaaugucccacauuauuuuuuuuguguauucacucuugcugauauuuuugugugcauuucuauguauauaugagaccaaugggaucccuauauaaaucuuuuaaaguaacucuuauuucaauauaugcaguaguaauauugcuucucugauauguggucaugaagagauuuguuuuuucacuaauagauugggcauaaaugcagggggcauuugugaauuuuucauagcaguuuuauuaagauuuauacaccacaaaauuuacccuuuuaaauguguaauucauuaguuuucaguauauuuauagagugugcaguuacccucacugucuaauuuuagaauauuuucaucacuccaaaaagaagcccuguacccuuuagcaauuauuuuugaauauuuuauauauuucauuaauaucuugugcaaaguuucauuugaagagcuaugauucucuaaguaaucuucuaaacacauuaaguccuuauauuaaaauuucaguuaacuucuuuuuuuuauuauacuuuaaguucuaggguacaugugcacaaugugcagacuuauuacacauguauacacgugccaucuuggugugcugcacccaucaacucauuauuuacauuagguauaucuccuaaugcuaucccuccccccuccccccaccccacaacaggcaccggugugugauguugcccuuccuguguccuuguuaacuucuuagaaccaguuucagauaaguauuuuggauucuuagaaggaucuccaagagaugaauguguguacuuuuagaaguaaaaccauuagcagugcagaaaauuuuuguguggauugauaucaguuuuuaguauuuauugcauaaauaaaaauaagaguugcauuaaacuagugguagucagguuuccuauguuuuuagauuucuaauuguauacuagaaaaagaaaacauuuagcaaaauaaacgaaaaucaacuuuaagaaagugcaauguggagaugauuaauugaucuuuauuguaccuucuaacacuauaauacuuaauaauucuguuugcuuuacauugagagaaaaaaaugaaggcagaaggggaaaauguaaguaaugugcuugcauuuaaacuuuucauguuuccuacaauaacacuuuaaaagaaacuaauuuaaccuuaagcauacaaauggccacuguccacuaugguagcaacugguuacauauggcuauugagcacuugagauccagcgaguacuacaggggacugaauuuuuaacuuuauuuuagcuuuauuuaauuuuaaaaacugaggcaauguaaaauauguuuuuaccaaacagcuuuauucuuugguaggacuacauuuuaguuuacuguugcauugugugagauauaacuguauuguaggguguguaugaggcacguacguuguuuugaaaauuauaucuaucacugauuuaauugucaauggaauaauucaaaugauuuuuugaaaauaaauuuuuucuacacacgaauguaacuuuguaauguguucauuugaauauuucauacagacaacaugauuuccaauaauaccuuuguagauuguagauuaguaauaauauagagauuuguuauacaugcauuauauacaugguauuuauguauuauaaaaugguuauuucaauuacuguauugcguagcuuucuaauauaaaaaugcaaauguggcaaaaauuuauauaaagaaaauauacuacugaugcagaauuaaguggagauacagaagcuaguaccagaacaauaaaggacaaaaugaagauggaagaagguggccaggugcggugguucacgucuguaaucccagcacuuugggaggccgaggcaugugcaucaccugaggucaggaguucgaaaccagccuggccaacauggugaaaccccgucucuacugaaaauacaaaaauuagcugggugugguggcaggugccuguaaucccaucuacucgggaagcugagacaggagaaucgcuugaacccgggaggcggagguugcaaugaagccauaugcuuccuucauugguucaagucucaguggcuugcuggacacacucuccuggcaccauugcugugcuuuucugcagugcaacuuuauuagcagcuugucacagggccuggcuugcuuaggaccccgcugagcgagggagagaaggaaggaggcaaggaaucugggagaaugcccucuggggcugugcaugugguccaagaggcccacaauaaauauuuuucauaugauuucaacaggaucuguagauuuggucagcuugguuccugccucaagaaagagccauuuuuggucagagggauuguaaaagaaauuauuucaguuaucaaaauuuuguugcagaaguaugaggaaaagccuaaaagugaacauuagacaauagaauacauggccuuuccaacaauaaggaagaucaauugagucaaaguuugaaaaauugcaaguagguuuuuuauuuuuuggcuuuaggugagucauauuacaugagacaccacccaguuaauacuuuccauacaguuauuuucaaagguuuucaagauguacaaagaaaugucaauucauggccuaaauaaaugaacuugugguguagaguuuuaaaaaauucuuuauaugguuaguuuucucauagagaauggugcucuggcuaugguaagucaaaaaauccagacacaaaauuuuuaaagugugagacuaauguuucccauacugguuaauucuacuucaugacacauaaugaaaauauuugcauuuaguuuuuugaaguagacucugugaaaaaugucauggauuuaauuguuaaauucauucguuuauuugccagcgauuuuacuuauugccaauuuguggaacuauuaaaaggaauagaagacaaggaauuuaauggauuugugccguuugccaauacucuaugauugaguugcagaagaguuuuacaaggauuuaucauacugcugacucugaagauuuucuugagaaauaaauacuugacaaauaaucaaagacaaaaaaaucuuugugugauuuguguuuucucaccaauaucacauugcacauaaaugagcuaaauugaagcuccagggaagggaaaaacauuuuauaaccuagcugguuguugaaacuuucaauacaaaucaauaauuauguuuuuacacauaaaaaaaauucaguugauuuuaauuauaguacaguguuauguaaacuugaugugaaaaaccaggagaacaauuugaugaaugcuauguugauaaugguaagcuuaguguuguuuuucaauuuauacaauauuucguugaacuuaauuucauuaauacuucauugacacccagaguugauaaauuuacuuaucuuggauugaugcaauuuugaaauugaugagcguuuucaucaaagucaaaucaauucuaaaaaaagacgaaccagcuuugucaauguagauguaaauguauuaaaggacaaugauuuuuugguacucuauuuacauauuggaauauuuuaaguaucuuuggaacaacuugcuuuugugaaucuauuuuuuuaauuaugaauuuuauaaaaccuaaacugagauuaaauauuaaugacgaaaauguaguauaugaguugacaugugcuguagguauaaaauacaaccagauuucaaagauuuugaagaagguaaaaugucucauuaauaauuuuuguauugguuacaugguugaauugauaauauugugaauauauugguuuaaauauagguauuaagauuaauuuuguauauuucccuuugcucuguuuaauguuacuacuauuaaaauuacauaugugguuuacauuauaugucuguuggacagugcuggcauagagagugucaagaguacccugagcuccuucucgggaauuagcucauggcaaauuuagagagaaguauaggucauauuuauggagaaagugaacuuuaauauuuuaguuuauauauucuuuacuuguauugugacauuuagcaguugauuuuagcuucaguuuaauuauuugugugugaguuuuaauuaauagacuuuguuuuuugaaguauauuaacagaaaaauuaaguauaaauuacagaagaguucccaugucuacccucguguuacccccauuuuccccuauuauuaacaucuuacauuagugcaguacacuuguuacauuugaugaaccaauauugauacauuauuauugagaucuauaguuuacauuagaauucacucuuugcguuguucauucuauggguucugacagaugcauaaugacauauguccacugcuacagugucauauagaauaguuucacugcccccaaauuuccuguacucuauucgucccucccuccuucaccccagugcccagcagucauugauuuuuuuuuuaacuaucuccauaguuuugccuuuuccagaaucucauaaucaauugauccuugaacaacacaggggaggggcacugaacccugugcuguugaaaauugauguauaacuuuugacuccccaaaaacuuaacuacuaauagccuacuguugaccagaagcuuaauguaaauacuugauuaaugcauauuuuguauguuauguguauuauguacaguauucuuacaauaaaguaagauagacaaaaugaaauuucacuaagaaaaucuuaagaaagagaaaauauauuuuguaucuaauacgugcaaguggaucaucauuaaaggucuucauccuugucaccucacauuuaguagacugaggaggaagaguaagaggagugguuggucuuguuaacucagggauuuuagagguggaggagguggaaugggaggcaggcauauuugauguagcuuugaaaaaauccaccuauaaguggaccugcacaguucaaaaucuguguuauucaagggucaaucauaguugcagucauauaguauguagcccuuucagauugucuucaauuagaaauaugcauuaaauuuuccccuguaugucuuuuugaggcuugauagcucacuuauuuuuauuauugaauaauauuccauuguauggauguaccacaguuccuuuauccauucacuuauugagggacauuuugauugcuucuaaaguuuaguaauuauuaacaaaacugcuauaauuauuugugggcaguuuuugugugguguggacauaaauuuucaacucacuuggguaaaugccaaauugcgugauugcuggaucacaugguaagaguauguuuaguuuuguuagaaacugucaaagugucuuccaaagaggcuguaccauuuugcauuccacucagcagugaaugagaguuccuguugccccauguccuugucagcauuugguguugucaguguuuuagauuuuggccauucuaauggauguguagugguauuucuuuguuguuuuaauuugcaauucccuaaugacauaugauauucaacauguuuuuccuauacuuauuugucauuuguucaucuuuuggccaaggguuuguuuagauuuuuuuugcucauuuaaaaaauugaguuguuuuccuauuuuaagaguucuuuguaucuuuuguauaccagcaaagauuuuuguaucacuguguggcucaucuuuuugugcacuuuacagugucuuucacagagcacaaauuuuuaauuuuaauaaagucaaacuuaccaauauuucuuucaugggucugugcuuuugguguuguaucuaaaaagucaucaccaaacacaagcuuaccuagauauuuuccuaugucauuuuccaggaauuuuuuaguuuuagaaaauuuuacauuuagaucugugauucauuuugaaaaguuaauuuuuguggaaaauauaaagucugugucuacauauguauuuugugugugaacauucaguaguuccaacaccauuuguugaaaagacuauccuuuucccauugaauugcuuuuccuucuuuguuaaucagcuuauuuauuuauuuauuuugaugaauauuucuacagaguacuuuuuaaucaggagguaaguucaacaaguuuguuucuuagggagaaaggucauagguguaagaauacagaaaugaaagucuacagaaauuagaucuucuguaguccuucuguagacuccuauagcaguuaguuucugcucaaaaauuguauuauucucucugaauguuuaguuaccauauggacguauaauaucuguuugagauuuuggauauaucugagugauuucacugacuuccaaucugaaaacaaggugguuaguuuuuuguuaauaauccaaaacuaguuguuuauuauuuuauucuucuuuuaucuuuguuguguggccaguaaaaagagauucuuacaugccacauuuuaugaguuccugggcaguaaacacgaaguuggcugaaagauaaguuuguuuguuuguuuauuuauuuauuuuugagacggagucuugcuuugucacccaggcuggaaugcaguggcacaaucuuggcucacugcaaccacugccuccuagguucaagcaauacugcugccucagccucccaagaagcugggaucaaaugacugugccaccaugcccagcuaauuuuuguauuguuaguagagacgagguuucaccaucuuggccaggguggucuugaacuccuggccucagaugauccacccgccucagccucccaaagugcugggauuacaggcgugagccaccgcacccggccccguuuauuuuaauauaaauuauucuucuagcagccuggaguuaaaaauugaguccaggaauggaaaagcaacugaauuguuaaauugcacaguuaucccaggaacaugaugugguuaucacagcagcuggccaaauaaauaacugcuaggcuaaauaaguguuacuuugauuauucaguuaaaauuucaaccuaagugaugugguacauggaaauagccauggucagaaauacggguuuuugaggaggaaacuauuugcuacucuaaaggucacuuguguuucagaaacaaagucuucguuuauucaaggccguaaaaauauagcugaacuuaccucaugcucucuuccuuguuaaguuuaugauucugaacucuggcugauugacccuaccuugucucagaguuggcacuggaguuauuuuucagcaaguuagucuuuauccuucucaugagaaaaaguuauuuuuuauuuguaauaaaaaauauaauaugugcuguuucucagauaagauuuuucuggauagguuuugauaagacaccuauuuagaguuuuacaagagaauguccuauaagaguuuguuuuguuuuuaaggauuccucuggauuugacugcucucccauggcccacauuguaaauuuuugucaguauuuuacucaaguuauauaaaacauaguacauccuaguuccuauagcaauagagaauaaaggugguuuuuauuuuucuaaaauuuugcaugcauuccuucauguccugggaauuccugagauuugugguaaauagaauccuuauauuuuuucaucaaauguaucucugguaaauaaagcuuauaaaauuuuaauuucacccuggaauauaucugaugugggauucauuucacagucugaagugcuuucaacuuuuuuacuuuguaaggucuuuauguuuuuagaccuuguuucucuuuaguuguuugguuauacagucaguucuguuauaaugcaauauauguuccuaaaagucacuguacuaugccaaaucaaacaauaaaaaucacaagucuuaugggaaaaaugggguuagggacacaauacacaaaaucuuuguaauugacacacaaaauaaaagauaggcaucuaauaaaaaugauagcacaauuuuacauauguuaaaugauuaagaaugaugaauaguacaauaaauauuucaguuuacuuuaaaaaagaccuaaaguuuucuuggggaagucuccagcaagaagagcugcagguugugauucuuuugcagugguggaaggaggguaaucugaaaacagauggaaggucauaacuccugauguggaugugcgugucucacaauacauguggugaaccaaggaaggugguagauauuugaggugugaguguuuugugcauuucucuguggcucauuuguauuucucuguagcucagcuagaugcaguuuucuucauucaccuaguguuucugggagacgaaauugugcaugaucaaaaucagaaauuuuauugugcucagauuguucccuaauauaucaauagcauuggagccaguugucauuuuacaaacaagcauucuagcagaacaaacucuauacacuuuugaaauaaugaugauuuuauagcuuuauaaaauacuguuuagaagcaacguggcuugaauuacuuacccacuccaacauggcaucuauccuguaagcagcuuuuuucugugaaaaagaauuuuuuggaagcaauuucuuauuuaaggaauagcuaccaaaaugccuagucauuuguauuuugcccccugucuacuacucuacuacuuuuuuugugaaaucugucacuaacuacacugcuuucuuucacaucauacucuccccaugcccuuggguuaaucauauucucauaguuuccucagaaaucuagcuuuggcuuguuuuuucucuauggccaguuuucuuguggaaacuuggcugauucccauucugacuugaccugguccucagagaccagagucagcuuuccuaacagcucugcuuccagggcauaaaugaacugaugguuucaggguugccccugugagguauuucaagugccaugaccaucugacacuggauugaagauaaacuccccuccuguacacuaauucaacagcuagugcagacagaggcugcuggcuccuuggcagucucagagucauccucagcacagugcuccaggcaaacuccacugaucaauuggaauuggcacucaaguugaaauuguuuuccugucuuuguuuuaaucuguauuuguguggucuaggcccuggcuucuaggguggccugagucagggcccuggguuggcuaacaaauagauggaaaagauuggccgcaugcuuuaggucaccaaauuuggccaggaaacucucuuuaaauauccuagccaguucaucagggagggccaggccaggccuucuugacaucaccacagguggggaacacucuccguccaccgcccaucagaaaagugagcuuguucucagcucaguguugugaucugcugcugagagccaggccaggugauuaugcagcuggcacgcagaccacacuuagaacaggagccucccaccaccucuucccuacaaggugcuacaauugcuuccugagcaguggcuguagucccaggccauaggacacacauauacuuccugucagagccagaagcucagaugcuucagagacauagacaaaaucugcaaucugggaccaguuuccucaguauacccacaguaucaguauugggcaagaaaaagaaacucaauuucuucuucccccucuuuggcuagauuuuuuucacaauaguguuaaauaauaaagcuaauaguaaucaaucuuguccuaaucuugauuucaaugucauguuuauguguuuuaccacuaagcauacuggcuuugauuuaaauuggcuguuauuugcauuuuaaaaugauuuuuuuuucuuagugaacuaagaguuuuuuucaggaaucuugugaaaauugaaaccaaucacaugcaguuaagcugaauguuucauuugcuuuaaucuucucuugugauucugaagcagaaauccauuuuaaauuccacauauuugacuuaaaucucuauuuuaucuauuaaauaaagacagaaaacauuucaccuccacugcuuucuacucccacuuugcaugcucuguuaaugugugauuaaagucauuauuauuaacuuuacauauucaucuucuacuucaauaauagaagcugcuggacuuuggaguuccugauuuugauuacuuggacaauugacugugaaauuuucauuaaugauaggaagaauaaguuuuaguguucuguagcacuauagagggacuauaauaaacaacaguauauuguauacuuucaaauagcuagaagggcgcauuuugaauauucuaaacacaaauaucagauaaauguuugaggugauguauauguuaauuacccugauuuaaucauuacacauuaauauauguguaugaaaauagcacaccauaccccauaaauauguacaauuauuaugugucaauuaaauaaaaaaacuggauaaacauuuaauaaaguguacauaauagcccaaaaugcaugaggagcuaauaaaaaaacagcuauuuaauaguuucuaucuacuaucccagaaaaauuauauacaugggugcugaaaaaauaaguaccuuuucuugcagaaacuuucuauuauuuuuugagaaaucauggcaaauaaaggcaaaugaagccccuaguggggaaaaaguagauuuuggaaauuaugaaguucuucaguuacaaaauuuuggaaugaaauaaccgacauauuguuggagaguauucagaacacugguaaacaugagaaaucuguaggauguuuuuaauggucauguaaacccaggagaguccaauagauauaaugacuuuugauuugagugaaauguuugacaaugacuauuguaaauuuuugugggaggugaagaaauguggauugugugauaguaaacuuugaaguacugauggauaguuggccacuuauagccggaguguugaauuuuaauugaaaagcaggcucugucuuggcucuuccuguucaauuauuucuaucaaagacucaugaaaauugagcacauaucuugagcccacugucuguacaacuagagugaagggaggggauagauacuguuuuuuucucuucuuaaaaauuguggucagggcgugguggcucacgccuguaaugcuagcacuuugggaggccgagauggguagaucacuucagguuaggaguucgagaccagccuggccaacauggugaaauccugccucuaccaaaaaaauacaaaaauuagccagauauggugucacaugucuguagucccagcuacuugggaggcuaagucaugagaauugcuugaacccaugaugcagagguugcagugagcagagauugaaccacuguacuccaguuugggugauggaguaagacucugucucaaaaaaauaaaauaaaaaauaugguaaaaacacauaacauaaaauuuaccaucuuaacuguccacuuaccacuuuaaguguagaguucaguaguguuaaguauauuuacauuguuaucaagcagaucuccagaacuuuucuaucuugcagaucggaaacucuauauccuuuaaacaucucaccuccccacuacccccugccccugguaaucaccaugcuacuuucaaauucuaggaauuugacuacuuuaguuauuuauuuuuuuagagacagggucucacugugucacccaggcuuuaguacaguggugcgaucauaguucacugcagccuuaaauuccugugcucaagccauccucccagcucagucucccaaguagcuaggacuacaagugugcaccaccaccacuggcuaauuuuuuaucuuuuauuuuuguuguagagauuaggguauguugcccagacuggucucaauuucuuggccucaagucauccuccugccucggccucuaaggauuuggcuacuuuagaugccucauauaaguauaaucauacagcauuuguccuuuuucaugacugauuuauuccauuuggcauaauguuuuuaagauucuucugugcuguagugugcaauaggauuuccuuccuuuuuaaggcugaauaguaaucccucguguguauauaccacauguuguuuauccauucauuccucaguggaaauuugaguugcuucucccucuugguuauugugaauaugggucugcaaauaucucugugagaucccacuuugaauuauuuuggauuuacacccagaaguggaauugcuggaucauaccucuguacagguuuuuuuuuuuuuuuuuuuuuuuugagauggagucuugcucugucgcccaggcuggaaugcaguggcgugaucucagcucacugcaaccuccgccucccggguucaagcaauucucuuuucucagccuccugaguaggugggauuacaggcgugugccaccacgccuggcuaauuuuugaauuuuuaguagagaugggguuucaccaugucggucaggcuggucucgaacuccugaccucaugaucugcccaccucggccucccaaaguguugggauaacaggcgugagccacgcaccuggcucuguacuguuucaauagcaguugcacuauuuuacaauccuaucaacauggcacagaaguuccaauuccucuauauucucaccaauucuuucuuuuuuuuuuuuuugaaacaguagccacccuaauguauuugaaggaucgauaauauuuuaagauacuuagcauucaaaaagcuuuuaguaacuagagugauggauuaaaugcauauaugaugaaauucagaguaauuuuuuaaguuuacgauggaggauacuagacuuaauauugaccuauaugcaaauaucuuacuugauuuuauacggacauuuugguuagcaauauuauuugguggcaauaacaaaaacucagaaugcaauaaaagaaguagaguggucagauuacagggagagaauagugcuuugguacuguguacuggucagaccauaucaggagggucgugucaacaucugccuguuagacacagaccuggaaguugauaaacaucugacgugccacagggagccauacccagaaagggucuggaagcugugaccugucagucagugagggaacuagggcucaaccugaggaagaacagaagcagauaguugucuucauaugauuuaaaguggugucauguggaagacggugaaggcuuagcuuuccuguucgaugacagaacaacaacaacaacaacaaaacauuauguggaacuagagagaaguguguuucuaaucaaccugaggaaaaacuuucuggcaggcagaaggguacaacugugaaaccugcugauucacagccuagagaguucccucuucccauguggagagggagguguucaaggauaggcuggaugauggcgggagcauggcuguaaaguauagucuucuacuggaggggaaaucuggcaagaugaaucuauauucugugcacaagagaguaggagaagguagacaaaacauaguuccagaggcaaaaccucuaacauauaguagguggucauucuugccugcccaggcucaacccuaccuagacucugaauaaaucuccuucuuaggaggaaucugaaacucuguccugacugcugagaauccacucaggggugaugcugagcuaccguccgcuccacacugccaccaaaugucacacggagcccaaggucugacccacugcaaaccucucugaaccuuguucuucagaguuuccugccucacacuugacucuuuacagcuucacguuuaauucacacucacacaugugccuuuccucuugcuggucccuuuacuuggacugucagcucuuuucucauccguacucacucauuauuuuuccugggcuggcuuaggggccucucccugcuauucucugaauacccaaggcaggucaggcaggugagguuuuucccccaccccccacuagguggcuguucccccaccucccacuagacugugagcucuuuccaagcagguccuagauguugaucuuuauuagugcaaacaauguuuaucgaaugaaauaaaauggggcagagucuuuuguuuguguguccuagugccuaguguagugcuuaacauguaguugcuuaaugauuuuuggaguaauagaagacuuaaauauuuguauuucuuucacucgaggucauaaaaucaucauauggcucucagaaaccuuaaugugguugggaugugccuggugaaucagaguuugagaccagcaggccuccacuuuccuccucuuuccugccucucccucccuuccucugucuccuccgucuucccuuccuuccucguccuuuaucucgcuguuucuccccuucuccuccgaguccuucucucugcuucuuccuccuauguccuccucuccuauucuuccuccuuccucucuccucuacuuccuccucuuuuuuuuucuuuguucuuuuuugaacugugcagucuccuuacacagugcucucauguagacuuuggcagacuuuaaaaauucuguaguucaugcauggguuaauugaggcugaguauuucacaagaucucagaugcaugagugcuaacagagauuccagaccucuguguguugacaugagguuuuuuuucaacauggcaaaggaggaucaaagacaccuuguucaauuucuacacauuugccuuuuuauuuacuugucuuucuaguuuuucuguaucugugccagucuccugaugccaaccaucuguugauucuuuaauauuauagcaacacaggcucuguuuguauucaugguaguuuacaguuuuauguuugccaagaccuuuuguuguuuuuauguacuaaauuaaaugugaggacaacaggcaggcuaugagugucuuuaugagcagcuugauuuauuuguaucagauuauauaagcugucaggagguuaccuuuuggucuguuuagcaaccaauuguaggucuaauuuauguuuaauguaaaaaagugaauucaaugaacuuuuuaaaaguuagguauuguauuuucuacaagugaaaaccacuugcaugaauguaacuacauugcacaauggaggcucugcaaacacugcugaaaaaguaugcauaauauucuaccugagaaguuuuguuuucuuuuuauauaaagaagauuaauguucauggacuugaauaaauuccauuuaaugauuuggucuauaauuuccuugcccuaugauaaaugacuacucagaaguacuuugaagaauuuuuagugcagcuuagauaauuaauguuuugauguguauauuuguuacauuuuaacuuuugauuuaacaaucauguuuuuuaaaaaaaaucugucaggccauagagaucgauggaaacauauauauguauauucuuuugucugcauuuaagguaguaguuuuauauuuuauaaaucucagacauuucaaaucccaaaggagggcuauguugauauauugcccaggacuugcaaguuguuuccaauuugcauauuaaugaguagauuguaggugacauggaaaagaauauaauauucauaaguauggaagagacuguaaaugccuuauuuuuaucuauaggcuucauuuuuaggucaaagagaguguagaauuaguucuccauaaacaaaaucuguuuucuuaggaguuguccugaacaguagugucaggacauuuaaucaucuaauacuccuuuguguuaccuacuauccaugccaccuuuuacagacagaacacauuaagaagcuuuggucccaaauaaauuaacagguuuuucuuuaauucuguggcauugcacuuuuccuuguuaccauugcaagaggaccugucaucauucuacuaaguuuguaucaucucucuggaggaaaaggacuuuaauggauuaucuaaucacucauucuaaccucuagguucauaggcccuuaaucuagaaaucugaaauccaagaggcucugaaaaccacauuuagaaaaaaauaacucauuuagaagcaaauccugacuuguacuuauguaaaguuguuuguagcuuuuuguuuuuauccuaccuagcuagcauuacuauuuauacauuuaguugcagaaaugugaaugugcuugauuauggaauggugucccaaacccugcagaaaauguuauauaaacacaguauauaugccauauuuucuuuuccaauaaguuuuuuuaaaaucagcuaugcaaaaccucugauuaaggaauuuugauacuauauaggaacauuuccacuucuuguuuagguaaaaaagcccaagaacuauagauauuuccauaggagagacccauuaaaggaaaguauaauaggguuacaauaugugaauaaagcaguagauguuagagucaguaagaaacuguuaaugaaaguaaaauauuaugcauauucaugauacagaacagcauaauacccauauuuaaaaucugucuugaaggaguucauuggcagcgcccaauguuguucccauuucacucagugaacacauuuggaaggugaaguuggguccaguuugcuugucauuagaguuuaauauuaggguuuuuguaugugcucaggccaaguuuuucucacuuuugugcuaacagcugccaaugaagugagauaucucuggacaaagaagguguuuuugucacuuuguaauuuuagaugacuuauuuuaaaggguaguuuguugcaaaauuaaaaacacucccuuggggaaagccccagauuuguaagcauacuuuaaaaaacucaaacuaaaguuacauaauaccuuuugagcaucaguuuucccaacugcuucccuuuauuguguucuacaucuguauuuuuaaugguuuauuaugucuuuaugaggugaaaagagcaauagaaaaaauauuuauggucaauaguuuccuuauguguuaaauucuugauacaaguuugaugucucuauauacacuggugaaaguguacucagaccauucaguaauaaaugaaaaaaauauauaauuuaagccuuaagauuuggagaaaacugaugaaaugggaaauguagaaacauauguuuugguuuuuuaaaauuuuauuuuauaagaggaacugauuuucucuauuuguaauaugaguuaguauuaaaauuuaugaagaucauuuaauauucccuauacaacauuuuuuuuucuuaucucacaguugugugggugagaaguccagguagguuuucugcuuaagggucuuaaaaggccagaucaagguaguggcagggcuggguucuuauuaggaggcuuugaggaucaauuugcuuccaagcucauucagguugcuggcugaauuugguuccuugagauuguaggacuuagguccuuauuuuauugcuggcuuuuggcuagagacuguuuucagucccuaggucugcgaauggccccucucaggccacccugugagccccucaaucucagcaauaugucaaauccuuuacacauuuuaauaucuuuaacuucuauacuuaccagccagagaaaauucucugcuuuuaaauagcucaugugauuagguuaggcuccccaaagauuaucccuauauaacaugaucauaggagugauaucauauucacagguuucuuucauacucaaaugggaaggcauuauacaaaggugugaguuaugggaagucagucuuagaauucugcuuaccaguuggcaaacuagugaccaagguagugaguguauuaagguaguauaacauggugggcucuggaaucacaucaucuugguucaaucccuagcuccaguaacagcugugaaaccuuuggaaaguuauucauuucuguuucugcuucaguucgcucaucuguuaaacgugcuuaauauguagcacuuaccucauagaguuguuuugaggaguaaauuauauaauauauauaaagguguuuaacaaagugccuggcacauaauaaacacucaauaacuauuagcaguuauacuguuaguauuuguuuuuuaaagcagauuucuuuucuuucauguuucacuuuucauagaauaaaugaguauaaaaugcaaagcacauguuuguaaaaguaacaugauguugacccaaauaggaaucuuucauccuuauggaaucugacucaugugagaaucucucagaugaaagugugaagcacuguuccccugcuccaggcaguggaugugcauucuuagauggcuagggccaggugugugugcaaugaagugugcagugaagugggaggagguacagugaucugagcugagacagacaagucagcaugugaagggccucuuuugucaugcaaaggaguuuggaauucuggcaaacagcauugguaugaggagguggaagaauugcaaagaguacucuggcaauagugugaaagaugaauucgaagauagauuuugaguugauauagaaaaagagucaauuacaaaaaugcuauuguuauucaaaugguggaucauugauugucauaacaugccccaaaucuaagaguuuuucuugacaucuuaacaagaaaaguugaggaagcucugaugggggugggggcugggucaggcuggagaaguccugguggauacucuuggucaggaagaggcagagaauuagaagcaagaccagguuugagugagauucaauuucuagaguagaugagaaccccggagaucaguguaugaggacaguguaagugaugcccaggaacuauaauucaccauucagguuacccaucucagaggaguggaacuguggacauguugaggaccagggagugccaguuggcagagaucugggcuagcagucaucugaccucgagcaaauccaaccaugcaucgcuauaacccugucaccaaaaugucgggauugaagaaagaguuugaugaguagagugacuccgugggguguagagcagcuggugguaacccagucacuuaaaggcuugguugggaaggagauaucagauuauccuacaggagaacaaaucacaaauggaguuuuaagauuuugugguacuagaguuggagcaggauugauaucaaggcugacucagcaauggcaaggacugaauaaucucagugucugucccuacucuucuuaaacaggccauauguuuuucucagagugaggagauuugagagugauuauuaaauguccugagugguagaguccuugaacccagacagaccauuaagccccauaucucuggaaaagacaacauuccugaagaauuucuccccacuuggagugucccaaauuccuuucuugaaagguucccgugcagccucauuuucaguuccuuugguucaggcacuugaugguguaagaaaaucacaucaagggaagaagcccugguuuucuuuguagaaaaugucuucugcugcaauauuuguguucuagguuuggauggcauuucuugccagauuuuuuguugccagagcaguuauugaugcgagacacagcugugucuguagcagggagauauuccuaugccagugauccuaccuccuggcagcaugagccuuuuggcagaauucuagaaaaugaccuauaguaagagagaaguguguacaacauggauguacgggcucuucugaguuggugcuucuguucccauuuaauuguuaggacauaagagcuuuagucagauucugagugaggaaacaaaaucuuuuaggaacaaguacagaucaauuucuuauuuuuaugaauaaaauguuuacuuuuagagaauaauuuuucugaacacuccuuaacuuaaaggauauucuguaaaucacccuuucugauacugaucaaugacacucagagauaucaauaucuuuccacucuaugaugacacugcuaggagauguagaguugggaauccucagccaaccuaucugauggcuggaugugugggaagaggauuuagaaaggauuugcuguguuccucuuugguugcauguaacaucaauauuucuuaauuuuguguuuuuauuguuuucuuguuuacauuaaguuugccuguccugauuucaccugccuuggauuaaaaacaucuagaauauuggucugucugauuuuuaaucuuugauacugugcuuuuuagauaucagauaucaacuuuauguucaaggccuguagaucguacuucccauccuuaugcuuuucuccuuagcuccuaagauguagauuaauaaauuaauacaauuauugucauaguauauuuaguccuuucaccuuucacagaauuuucccuccauacacaauucaucaugcacaguaggguuguuggucacccaucaucuauuccccuucaucuuucgcaguugaaucgagauuuggcagaguuuccacccuuccuccaugcagcaguguauuauuacugagaagcuaacgccuuacagggguggccccugauuagucuuagccauugaaauuucuguuaguuggaggauagaauauccuaauucauacagucaccauuuauuuccuguuauugcuuugauuuugcugcuccagccacaaaauuugaguccuauuguccuugacuaacugcaucuucccaaccagauuuacuucugucguucauuaugucuccuccacacaaaaugacuaaguuacuuuaccauucuuucauuguuauaauuuucucuacaguggauucaccucuuugcaaaacuuacguucugaagccaauuuauaaggcaauaauuucuuauaauuacuccugaauauucuuccuuauuugaucgcuagauggaguugguuuguuuuuuggccacaaaagggaauggucuuuauuauuucaauuuauuuucuuucuuugauuuuucucauuuuuuuaaaugcuuugguugaauugguaugguuuaauuucuguaaguuaaguauuuguaugauaaaacuuuguuaaucuugaaaugacccucugccucuccuauuugcaaauuuguaucccauuuucagcacauggaacuaaguucaccuuguguguuggagguucccaacacugccccaacacuugauuuuuuagaagaacucgcaggacucagcccauuguuguacucauggcuaagguuuauuacaguacguaguagguguguacagcccuaucauaagggaaaaggcauaggcagagucuggaggaaccugugugcagucuuccuuaugcugucucccucccgugaaggaucacacagagcaaauauauauauacauauauauguguguguguguguguguguguguguguguguguauauauauauauauauuuuuuuuuuuuuuuuuuuuagacagagucuugcucugucacccaggcuggaguguaauagcccaaucuuggcucacugcagccugcaacuccuggguugcagcaauucucaugccucagccucccaaguagccaguuuauaggcaugugcuaccaugcccagcuaauuuuuguauuuuuaguagagacaggguuuugccauguuguacaggcuggucucgaacuccugggcucaagcgagucacccuccuuggccucucaaagugcggagauuacaggcgugagcuacugcacuuggccagagcauacucuuugcccgcaaauaaaaaugcagccauacaugugugacguuucuguacaaggaagcccauuaaacauucaaugcccaagauuuuuauuagaaacucauagaugccuucucccuaggauauaccaaaauuccagacuucuggaaggaagacagguguucaacauaacccauauuguuuacacaaguagucuaggcacaguaaaacaccuugauauguuaacuauugacagggaacacucugagagccaaguucucccaugcccaccaaaggccaaacuuacaggcaggacuuuuuggcagucucaggccugcuagguuuauucuagagacguaccucucuacuggaagcuuuucauaaugcacucuucucugcucucuuacuuuucaucuugguccauccucaggacuuggcauuguauguuacuuuacacccuucuguaccaauucauuuuggaaaugaaugcaguucauuuguauguccuuuauagugaucaguacauugcuuugugagcuuuuuaaacauuguguuuucugcuuccucauacugaagguauaaauugaguaaaggaacuguguucaaaaauuucaucuguggcuuuucauagcacauuugaaaauaaccaauaaagaaauguauaguaaauguuguucaguaaauguuuacugacaaaggauguuacuuuuuagaauuuuucagcacagaacuaugauugcuggaugauuaugagaauuaccuuaguaacugggaaguauuugguugccuuaggugcauuuuuaugcuaagaucauuaauugguuucucugucaaguuauguacauuuugaggagaauacuguuagauuuaaauggguuggguggauucaauuuuaauagcuuuagaaaacuaugcaguuaggagaggaauuuggauuaggagaucaagaucaaaggaaaaguagauuaaaaaaauuuuuuucucccuguggauuacaugauguucuuuuguuauuuaguguuucuauaaccuuugcacagaaguuuucagauacaaagcaucuucuccuuuuuuuuuguuuuuucuuuuuuuuuuugagacggagucuugcucuucaccuaggcuggagugcaguggcacgaucuuggcucgcugcagcuuucaccucccugguucaagugauucuccugccucagccuccugaguagcugggacuacaggcgugcuccaccaagccuggccaauuuuuguauuuuuaguagagacaggguuucaccauguuggccaggcuggucucaaauuccugaccucaagugauaugcccgccucggccucccaaagugcugagauuacaggugugagccaccacacccagcccaaagcaucuuuuucuaaaaacaccaucaagacugugaucucuggaucugggauauugccauugcuuuauguaugaccaccaacucuuuaaaauaauuucauguuuuaugauuagaauuuugcuaccaaaaauugcuuauuaauauuuaauaccuuuuguaaacucuuuuaauaugcuguagggaaaauucuccaaaagcugacuacaggcuggucaugauagcucaugccuauaaucccagcacuuuggaaggcugaggccggcaaaucacuugaggucaggaguuugagaccauucugggcaaaauggcaaaaccccaucuuuaccaaaaacauaaaaauuagccaugugaagugguacacaucuguaaucccagcuacucgggaggcugaggcuggagaauugcuugaauccaggagacacagguugcacugagccaagauugcaccucugcacuccagccugggccacagagcgagauuccauguuaacaacaacaacaaagagauaacugaugacuauaaggcuagaagucuuugcaggucugaaaucuauauuaaaaauugggcaacgcuaaggcuucauaaaacuuuaacaggauuuaaagucuuaugaaucguugcugagggaucugguggaugcugccaaacugucagaagacaugcuggccuuauuauuaugguuuucuaauacuuuggugaaauaacacuuuuugcuuauggaagucacuugcuuaacaauauugacaaaauaaaaaguaaacaaauaagccacuaaguagcuaagagaaaugcuguaacauucgugcauaaaaaccagcauguuuuacagaaaaccccuaaaacaauggguacaauaagcuaaugucaguuaaacucaacuuuauucuuuuuuuuuuuuccaagaagggagaaaguggucacuguuguauucuucaugugauaaaaaagccuaucuguccagaaaugccauugaaaucugaguagcugaacagguucguaaaacuauagaaaaggacaguuucugugcuguuuaggcgcuuucauaaauuugcuguggaaaagaugaugugguuuucacuauguguuucauuuuuugucagguauuuauuuuuuuaaaaaaaauuagcccaauuuaaaaaguacuuugaaaggcaaagacauggagugcuuuaaaauauuuuacauuaagugucuuauaaaauauuuuugaacauuuaaaggaaauaaaggcaaugagaguuaaagaaaagacacacuauaugagcuuuuaguuaauaaaauauuuauugagacuguaucaaauaacaggcuuccuucucugaguggucaguuguccagguauaggauuugcuuagcuacagaaaccugaccaaguucuucaguuauacuugucuuugugucuuugacaguaucaugagaccuuucuuaauauggauuguuuauaaagguaaucucagcuaaaugucagguguggcaaccaaaaauugcuuuugugauuuuuaagcugcuucaauagaaagagugccuaggucagaggucauaaucguccuuuccaggcuggauucugucccauguuaggaggguuuugacaaguuugugugcacccaugaggauaacccggacaguaauggaacugaaaaucauguccaaaaaggaaggaguuauuuguuuuguggaagagaaacguagagagggagggauucuugccuucagaaauuugaagggcuauagaugguagagaaauuaaaacucuuugagagggcagagcuucaguuacuggcagugggucacagagcaagguguuucaguuuggcauaagaaagugugucaauacagcuaaaaugacaucuggguuugcuacuaccuuauaauauucaguuagaggcuauuugaauauguauuuggauuugaauaauaguguuaagauauccuuaacacuaucuuuguuccuugaaaguacuauguuuguuccuugaaaaagcugacauggcugggugugaacacucaugccuguaaucccagcacuuugggaggucaaggcaggaggauuguuugagcccaagaauucgagaccagccugggcaauauagggaaacccugucuuuauaaaaaauaaaauaaaauuauuagccgggcaaggugacaugcaccuguagucccagucccagcuaucugggaggcuaacaugggagaaucauuuuuugagcccaggaaguugaggcugcagugagccaugauggugcugugccacugcccucuagccugggcaacagagaugcuguuucuaaaaaaaaaaaaaaaaaguugacaugguauguauguucccagcugugccauugaaagcagaauguuuauauuuaaggugccuguagccguugugggcccaguuuccucauuuuacuaauaccuuaugauugcaaaauacccacugguauaaagaacugucaugcauuuuauuucauuugaugcucucacagguucugugaauuugcagggcagaaacuguuguccccauuuuagaggucaagugaucacggcuuaguucagugagaggaaacgacucacccaaagugauguagucagagccuuggaugacaucuagguuuuugauuccuaguuuagcaucuuuaccacuccagaaugauuuucuuccacuugaaauuuaaauauuugucacaaaaagugacuuuauuuuucucaucaguacuuuuauauuaacuuuguauguauuauaugauggauguuauuuaguaaagaaacaguuaucuguaaaugccuguauuuccucuccaucugcuuucccagggcagaggaauccauggguuaggauuaccagauagcaauuagcaggugggaggcagagggacggaagguagaagggaguuauaaguagauaagcuacaauggugugugugugugugcgugcgugcgcgcgcacgcacgcguucauaagcacacacaagcaaauaguaauuuuagagagaauccuuugaacaaucagugggggaauaaaacccaugcccuuuucuuggaaacuauaaaucacuacaguuuccuagcuaugaucauugcugauuucugaaagugugucucccuuugguuuaaaucugacaaacaaugugccgucagaauugacuacuugagcacacuugcuuuuuugugcuccuaaagauauccugaagucuggauaauuaaacacugaaggcaaggcauauggccuuacuuuaguuaaaaacaauugcagaaagaaugccuguaauuuaaauacaaaaacaugguggcauuuuauacucuaaagacauccauacucuaaauuuuagugcuuaaaacugcuuucuuugaagagccuuguugaaagacaaaaagggaaauauguuuuauuuaauaaauaauacuguaacauaacguauuguaauuuuucauuaaggauauuauugcugucuuuuuuggaacugacuguauuugcugccauuacauuuuaccauacauuaaaucaaauuuuaucuaucaguuacauuuugccacuucuggggggcaaaucuggcugacuggcuuugcucuuggagccuugauggaauguauauaguuagugaaaaauuccuuaggcauuugaaaugauugaaggaaaauaauagaguaagcaacauuguagacucgucuuugaaaauuaaccauccaaauaauaauugagcuucucugucuauaguugacccaauuuaacaaauaaaauauuuaaguuuagggaaagaagauuuguaucucucuccccugcucccuauuuccacuuucuucuuucauuuacacguuaggguuuucuguaauugagcugagauuuuuugugguuuccucugucuuuuucuggguggaaacacaaaaucaacuaugacauauucaauguugugaacuuuuaggcugaaaaaagguacagauacaugguagcaaugaccagcacauuauuucucucagauacuugaaaagugacgucaguagcauucaacagaggcuagacccugccaaguucccauaagggaauaauuucauuaaaugugaagcagcaaagucauacagacaugaacaauuauauugaagcauaaaaguuuucauuuucacaagaagguaucuuucccuuuccuacuuuauuuuauuuuacuuugagagauagagucuugcucuguuucccaggcuggagugcaguggcgugaucucgguucacagcaacuucugccucccggguucaagugauucuccugccucagcuucccaaauagcugggacuauaggcaugugccaccacaccagcuaauuuucguauuuuuuaauagagaugggguuuuacuauauauuggccaggcuggucucaaacuccuacccucaggugaucugcccaccuuguccuccugaagugcugggauuacaggugugagccaccuuccuggcauguuuccuacuuuagcuaaccuuuuuguguaacuacuguaggaagccugugcaaaucaaacagguuuucgaacugaggugguuuuuacuacacgaugagacuguugacuucaucauuggccccagguaugcagaagaugauccuaagucagauaguaaccaaauacacuucauuuccaagaaaauucaaauaaaagaagaugguauuuggaagacuaagucuugacaguaacauaauacacuuuggcagcaaaaauuagggagaugcugaaacaugguacuaggaggaauuuucagucuuuuuuauuccuuagauuuaaaaaauguucaauuuauuaccucaggguucaguaucaaauuaaaauagauaaauggagacuuuaauaauagccagcugucuggaguuguuuugauuuggugucucugggaagaggaaugauggauuagauuacuuuuggaugucucuuucagaugauaugucagcaaggcgaacucuguguuuaggguagugagauaaaagucgugugcacagguaaucuaccagcuuugguggaguguugaagacuagacuggugcaaugaggaaauggccagccacuugaaagcuggagaaaacaggcaggccccagagagcaaagacucucuaagaacuuaaaaguuguuuggguaagcauauuuggaauaaaaugggcagugauucuguuaaugaacaaagaaaguuauuucaaauaugaauauguagguaauguaguauauugcugguugugauaguguuguucugagaauaaagauaaaucagcacauaaauuuguguguauuaaaagugauacauuucagaauaguuuuaguauaaaaucaaauuauguauuucccuuaagacggaauauugugugagaaagugauagacaggaagugcauaugucuaauggacugaaaaggaaaauaaguugcuaauacugaauaauugaacauaguuggggcuaaagggccugggaaaaagcugaaauacacaaagaacaaacaaugccccugguaaaaacucaaauauucuuacuauaauaagucacagagaaauauuucuucuguuucguaucuuugaagaaagaauuccagauguuaaacacaucugauauauauugugcuuacuacugagugacaaauguaugauuaagaagggccauaaacuaauuucucuaaguagugcuguccucucaaacugagauaugccugggcaaacccauuuguguuucacuacacaaaguuaguuagcuuguguggauuucaguaacaguuauagauuuucaguuucaauucuacugagaaaauuuuucuuucaaguauuagguggcauugccaccugcugugcuuaauuuggcuuuuugucaauauaaacaguuuuggugcuauugcugugaggguaccugaaaggaaggacuuuauauccaaauauuuaaaauuauuuguuuacucugccaaaaaaaugugaacugacaugcccauugaggcagagguguagaguguacauucucuuuaccauaucaguguugcuggacauuuuuggaauuucccagugggcagugaguguucugagucgaaguguaaguagggaggcagaacaauuuucaggcaccucccaaagcagaucuuuucagugagaguuuguuauuuagugagaaguguuacaaauucccauaccuucacauauaagcaucuuaaguauguaaauaugagguauuuauaguccuaaauugcucuuuuagaaauuacaauaugaaaaauuaaauucgugcuucccagugauggucuggcauucauuauugaggauccuugggcacuuaagaaaacaggaauuguuugagaaacauggcaguaugucacauauaaggaacaggcagacuguauucuuuccuggguauuauauaugagaaucuuuaaauaucaguuuuugcagugccuguaacagaugugucuuuaaaauguuuuuuggguaaaaauaacuguaccugcccaaaguaacugucuagauggauuccuggucuguugguccccgcaugaucuggugucugccaaucuguuagaucucaaugcccaccacuuucucgguugcuccuucuguuccagccucauaaccuucuuauuguucuuugaaugcaccuaauucauuuccaaaccgaaggccuuucuccuugccuuucacuugcuguacccucugcuuggaaacagucuuccccuagcucucuacuggccuguucccucccuuuagaacucuuaagguccucucaucaaagggcuuuuccugauggccucauggaauagagcccuucucuuaguacucuauuuucuccugcucuguuuuaguugucaucauaguacucaucuuuacacgaaauuauauucuacauuuguuuacuuuuaaguuccaugugcucuggggcuuugucuuguucacugaaagauucuugaugccuucagccauuaaggacccaauaauuguuuguugaaugaacaaaugauuguucagauguagcaugaaaauacauaccuuauuggacugauugucuuuuauuuuauaaaauaaaauuuuggaaaucuagaauucuuaucaagucugccaaggugaauuuguaaccuguauguucguguuacuugguguuggagauauggagugcuaaucacucacuccuuuccuuuuuuuucuggauucuaauggaauagaaacaugaaaucagaguugaauggugauugguauauaaguuuuauaaacugggcaagucccuagcaacugauaaugcagggguuuuggagaagcuagauuucaaguaacuuggguucaagaauguccaauggguuaccugcuuuuggaguuacuccccuccucucuccaguugaauguagaguaggccugagcaaugagagcguauggucugagacaaaaaucagagagcccaccauccucagcaauccaugagugggccaugaaaggauaaaaugggauuguuucauucauucacaaguaaagagcauaacauuuuguuucauuggaugucagauucccgcuggcuagaugagcagguucuccuuuuauggagaugauucuguaagcagguccagagaggaauugaaaugauugcuccaguucuaccccucucaacugggaaauaagcaguaugacccuucucuuuggagaaaaggggaagguugcaauaaugauuauucucugaacaauugugauugcaauacauauacuggaauauacuuacaaaccgaaauaauuuugaccagaaaacaacuaucaacguaggauguuucugagaguucauugcaauugugagucaucuagacaucugccaaaugaaauaguaggcuguauuucuacauguguuuaagagaagaaugcauguuaguccaacuucuauuuaucacccaucaauaaaaaagguauauacuuaugaaaaaacgucauguccuaaccuugauguguuuaaaggcuaauauucugacuuccauuguaaacucaggagccuuuaauguuucagguucgugggaguaagggagaaguuuuguacauuuuggaugcuaccaacccacggcacuccaacuggcuucgcuucguucaugaggcaccaucucaggagcagaagaacuuggcugccauucaagugagcuuauuugcuucucauuuguacuaugcacugugaggggggaugaauuaauauaugacuguacucccuguuuuaaauuuguuucccaaugaccuccuucaaauaacaguaacucauaaaagcagagaaaucucaucuagucagcauauguaggaaagggcaagccuagcuguaaacuaacaccaggguacuuacuuuaugagaauuccugagggaaugaauuacacagucugauauuguccuuggcagaucucgcuuucagguacuuuuauuucauucagugaauauucauugauauuuuaauuuguuugauaguuuauuuuguucauaguacuauacccucuguuaguguuugggaaaggcuuuauggagaagguuuacuuggggauauucccugugaccaggcuuugagcuugucggaggugguguguuagucaggguuucccagagaaacaggugcaguggcucacgucugugaucucaguauuuugagaggcuaaggugguaggaucacuugagcccgagaggucaaggcugcagugagccaugaagaugcuguuccacuucaaccugggcaacagagcaagacuauggcuccaaaaaaaaaaaaagaaaggauauauccuuauauauccuuuuuuuaauauaaaaaauauauaaaaauauauauaugguuguguguauauauguauuuguauauguguguauauauguguguauacauguauauguuuauguauguguguauauauacguauauauaaaauaggggauuaccucacaaugauuauaggagcugguaaguuuaaaaucuacauugcugauguaccaguuuaagucuaauggccagaagcugcuauagaaccaggaagagcugauaucccacuuggaaacccaucaggcaagaagagcuagcguuccagguugcaggcuguuaggagaauucucucuuacucugggguaggucagccuuuuguuugauucaggacucagcaugauuggaugaggcccacccacauuauggagggcaauauacuuuauucaagucuccugauuuaaauguuaaucuuuuccaaaaacacccuuacagaaacacccagaauaauguuugaccaacuaucugggacccuguagccuagucaaguuaacauguaaaguuaaccaucacuggugggaaccguguuuuauugaauuccauuucccuguauccuagcauacugcuggacaaaacauuagguuuugauacaaacuaugaguugaacuuaggugaucccucaguggaaaauaaggcaagaagagaaaacgauauaguuuuuagaggagcccuauaguuagggcuucucuaaaacacauugaucagaugaccaaaagaauaaggaaacauuaaauucuggcagauaauugacugauuacaugugaaagcucaucuuccuggauucuaaacuucagaagaggaaguaaagcuaugguuggcaaaaguaagaggggaagggaaaagaauaagacaugaacaguauuugagaaucuaccauguacacuguucaagaagcuucauauacauguggucauuuauucguagaaauucugauaguuugacaauuuguugacauuacacugauuucauucaauucucaauauaaaaucaacaguagcaagaaggaaaaggcacagaauuaaguuuuaaaguaacuagcaaacagucaucuagacuacuuaauuuccuaaugucaucuaaacaauuuuuuucaguacaaaugaguauuagauaaucaaugugacuacugucccuuuuugcauggauacaugagagaugacucuuacuaaacagcugaggugacauggaaaauaggaucucuggcagccggggauauucaagccacuuuuccaauuauucaugauggccauugauccaaccacaaguuuaaacugauguuuuuuuuuuuuuucuuuuucaacauguagacauuauuuuuuuccaaguguuuauauauuuuuucauggcuuucugaggcaaacucauccaugagaacaucauuuaugucaauauuuuaauuuacggacucaguuuguuucuuuguaaauguuacuauuauuaaaauugccuauagagccaugaauuuaccuuaagccaacccauuguuuugguagguucuccaucauugugauuguggagaauauuauuuaugcuagaugguuuuucuuuucagguguaaauaaugauuuuaagccuucuccaaauuccuucaguuucagaaaugucuuccuauugccuauuauuucuguagaaucaguaggucucuuucuuugccuaaacuuacaaaguguuaugugaguuucaucuuauauuuacuuagguaauacuuguuuaggaguuccccuuaacugaacaucuuacuuguaaugaucccuuuaguuaauggaaaacagugucaauaaguauuuauaccuugaucuuucaccauuuacucugcuacucuacuaugcccuguauguuaucauauuguaggcacuucgcucauuuucaguaaucacauugucuaagacuuacaguuuucauguucauuuaguacauuccacgcaguacuuuucuuccucuauaucaacuguguuuuuuccuugaaagaaaauauaaaucacaaaagaugacagguacuccaagaaauuauuaaugacuuaacaagaggagugaggggggauuagaacaggacuuauguaacuggugggcucucugaaauuucacucuugaauuauaaucuaaguauguucagaagccacucugagaggcuuuuggugcagagcaaugacaguggcuuucauuucuuuuaacacuguuuugcacuuucuuaauagggaugcagugcacugcuaccauauuuuuugucauagauuacaauagggaucuuuguuagcucccuugagguaacaucuuucuuauuuugaacaguagcuggaguagaggauugcugaggguucaaaaucacaucugagcuaaaggcagagagcauaauaguugggucacguggcugaaagagauuucagccuucuaauugguuggaaugaucuccuaaagauugcauuccagaaacauugaguugguaaggucaugauguuuccugcauaacauuaugaaucacuugcauuccaaauugcaucugaaguuugggguauucaggaaauuuuuuauuugagcuguauaucccaggaguggaguaaaugagaaacauuugugacuauguggcuugcucgguggaaaacgucaauacuugguccaacuuuuuuggacaagggauuaugaaguugaggucuguuuuggcagauaauuggaacuccuucuuggagacuugauuauauuucuaguuuugcaauuuauuugauuuugaaaaauuugcuuugcaaaugaugacuuaaguaucugaauuaucaaagacggaucuaguaagcaaacaguucuucccacaugcacacuuuucagaauaaucauuuaacuguauguucagacuucugaaaaguuuccaacuauggcuagaaaauucuaaaugugaaaguuguggcuuaaaaugaacuaaaauauccuuaagcuccauaggaagugggugauucuuauuaaaugcuaauuuuguugcacuaaaggaaaaaaauguauauguagcuuaaaaauauuuuugaccuaguuuguguuuugcaggcucuuaaaaauuucuguucuuuugauagaagaugaauauuuuaugccacuuacaguugaaacuauuaauuauuugaacauuucagagauggagugcuacaucucauauucuuaagcccauauuuucaggcaugucuuuucugugacuaguugccauacuuaucgauuuacauaaaaagguaaaaacauuuggguaaaaacauuuggguccuggugcacuucaugaggggugucaggaugugaggauggucuaaaugaggugagaaggcacuggguauugagccaagauauucucacagcucugccccaauucugcugucaguuuagaaugcucauuaccagcaguuauuuugucacagauuauugaaccuccuuucucugccuugccugaggauggauagucauaaacaauuuauccuggggucuucucuggcgacacgugaaauuuaaauaugacagagcuggaaaaucacauguggaucucuaaagagagaagcaacuuuguuuuccaagcacagauaagacauucuccauugucacuaagcuaccaagauccauaggaguaacaaauaauguugauacagaauucaaauagcagcaguaccaacuaagcaaccaacaaaaauaaauaccaaaaggauuuauuacuuaugugcaaaaugauggcuuuuccaguucucuaucuuuccuauuucuguuuuuucuuaccagauuuauacaaguggcauuuuuagaauuuuuuuaagaaucugucacaaaaugauaaaguacagcugucuagugauuuucuucaauaauaacauaaaaauaacaguuaaauaacuuacagaucuaucuuuuaauagguuaucuuccaguaaggucugcauuuguauuuuauuaggguaacauuuuaaacuaaaguaaaaaugcaauuggucccgugaguuuuuaaauaccugcucuacuuuggucuuauguggggaauuuuauuacuuaucaauauuauuuucauuaauuuuguagcuuauugacagggcaaauuugcauuuauaggaauauucuuaaguuauuuauagugguaaaguugaaaucuguguuaauccuuaaaaugaugaugauggcagcuaacacuuacugaaugcuuacugcaugccaguuagcaguuauucacuuauuaauguauuuauuaacuauuuacugugacuguaugagaaagauauuauuauauaauuuucaucuuccuuugucagauaaggauacugacucucaagagcaucuaaguaacuugcuugagaccacacagcaagugagugacuggguuugauuugaauccagauuauaugucuucauuguccacucuuuuaaccccuguguuguaaugccuuaaaguugagauuacuuuuuaaaaauguaaauucagaucuuaaaaaucuuucauguuucugaacuugguauuagauauuuuugaaacuacugacaauuuucaaagcagguuaauuuuaaaauauauauuuuaaguuauuuauguuauguaucccuugauuuuuuuauguucccaaacuguccuuaauccauuauaaagcauugcaccugcuucuucuucauauacagaucaugccuaggcaacaucuauucuuguuucuuuuuccuuuugucuccucuugccucauuuuagcugcuagcuaaugugcuaaaaaugugauaaagguaacauuuagaucucuugaaauuauuauuauaauacacuguaguaaaauuucagaaucagagccugucagguuggguguagaggaaaguuuuaauuaggugggacuuucugugccucucguccuaggaaccauagaggaaguuaccuuuucuacuucuauugaagaccaauccugcuucccaguauccaugucucacccagcgguaaaacagaaucuuuuauaaccuuaucuuugacuaauaugaagguucugucagucacguuuauuagaguaugacuuuugaguuauuugcagaaugacuuucaucuagccugucuuauugguauguauuuaugauuguaguaguuauccaucguuauguaacaaauuuaccccaaauuuuaacagcuuaaaauaacaaacaugcaguaugauuuuauacaauuuguaagggucaggaauuuaggagcaacuuagcugagugguucugggguucugguucaaggacuuucaugagguugcugucaaguggucagccagggaaaacuugauugaagucugugaagacuugauuaggcuggagauucuguguccaaggucugucacauggcaggaggcuucaguucuucaccacugaacuggggcucucucugggguugcucaggacuugacagccugcuucucccagagagggugaugagaaagagugagagcaaaaaugagugagagagagagagaaagagagaaaaagggggagcugcaaccuuuuauaaccuaaucuuggaaauaacguuccacagcaucacuucuguugaauacuauuagucacacaggccaaccuuggcacaguguaggaagggacuacaugauggucuggauaccagaagucgagacauccuagagguugagacaucugucuucaagcuacagcagugaucaguggggagaauauacuuuauguaaggauggaauaagguuagaguaaauggaaaaggcaaacacuugauacagacucagaaggaaugcagaacccaacccaguuuggauaauauuaagaaaggcaguuucaagcaguagaaagagcaugaacuuuguugucugaaggacuuuaaguagaucccgggcucugacuuuugcuggcugaguaaguuacuuaacucauucauucaacccauagcuauggagcaucugcuacguaccaggcccaaugcugagcacuggagauacuaugacuaaaaagaugaucuagcucuugccuucauagcaguaaaaauaaccuuuaaaacugcucuucuuuaugaguugauuguaauaaugcuuacuuuauuggauuuuugugaggacuaaauuaaaugagauaauauaugcaaaacacuuagccucuacacaccuggggaugcucuggguuucauuccaguccacuccaagaaagugaguaucucaguaaaacaccauaacaucuuugguuucacagugcauguaaacguuauauuuauacuauacuguugucuauuaagugugcaguagcauuaugucuaaaaaauacacauaucuuuaaagaauacuuuauugcuaaaauguguuaaugauuaucugagccuucaaugaguuagaaucuuuuugcuggugaagugucucacccugauguugauggcugcugauugaucaggguggugguugcugaaggcuaggguggcugugguaauuucuuaaauaagacaacaaugaaguuugcugcaucaauugacuuuuccuuucacaaaagguuucuguguagcaugcuuugcuuuuugauagcauuuuauccacaguagaacuuuaaaaauuggagucagucuucucaaacccugcuguugcuuuaucagauaaguuuaugucauauuugaaauucuuugcugucauuucaacaauguucacagcaucuucaccaggaguagauucuaucgaaggaaacuacuuucuuuguucaucuguaaggagcaacuccucaucuauacaaguuuuaucaugagauuacaucaauuuagucacaucuucaggccucacuucacaucuucaggucucacuucuaagucuaguuaguuuucuugguauuuccaucacaucugcaguuacuucuccugaaguuuugaacaccucaaagucauccaugaggguuggaauugacuucuaaacuucuguucauguugauauuuugcucucaucucaugaaucacacauguucuuaauggcauuuagaaugucaauccuuuccagaagguuuucaauuuacuuugcucaggucuaccagaggaaucacugugacagcaauagccuuaugaaguguguuucagaaauaauauuugaaagucgaaauuuauccuugauccaugggcugcagaauggauguugucuuagcaggaauuaaaacauucaucuucuugaacacuccaucagagcucuugggugaccaggugccuugucaauggcaguguuauuuugaaaggaauuucucaaaugagcaguaguuuucagaagugggcuuaaaauauucaguagacuaugcaguaaacagaugacagugccaucauccaggcuugguuauuccaucgauaaaacauaggcagaguagauuuagcacaauuauuaagggcccuaggauuuucugaaugguaaaugagcauuggcuucaauguaaagucaccugcagcauuagacucuaacaagauagucagccuguccuuugaagcuuugaauccaggugucacuucuccucucucgccaugaaaauucuagaugguaucuucuuccaauagaacuauuucuuguacauugaaaaucuguuguuuaguguagccaguuuucuuaauuauuaauaucuuagauagaucuucuggauaacuugcugcagcuucuccaucagcucuugcugcuucaccuuguacuuuuguguuauagagauggcuucuuuccuuagaccucauaauucugcuagcauccagccuuucuucugcagcuuccuugucucucucagccuucacagaauugaauagaauuagggaguugcucugguuugggcuuuggcuuaagagaauguuguggcugguuugaucuucuauccagaccacucaaacuuucuccauaucagcaauaagauuguuucacuuuccuuaucauuuguguguucacuggaguagcacuuuuaauuucuuucaagaacuuuuccucugcauuuauaacuuggcuguuuggcccaaguggccuagcuuucagccugucucagcuuuugacaugccuuccucauaagcuuagucauuucuagcuuuugauuuaaagugagagacgugugacuguuucuuucacuugaauacuuacaggccauuguaggguuauuaauugaccucauuucaguauuguugugucucagggaauagggaggucugaggagagagagagagaugggggaagggcuacugguagagcagucagaacacacuaucaguuaagcuugccacuauauacguaugguuuaugguggcccccuaaacaauuacaauaguaacaccaaagacccuugaucacagguuauccuaacagacacaauaauaauaaaaagguuagaaauauugcaaaaaguagcagaggcaugaaguaagcacaugguguuggagaaauggcucuaagaaacuagcucgauguagaguugccguaguccuucaauuuguaaaauaugcaaugucuaugaagcacaauaaagcaaagugcaaguaaacaaaguacgccuguaagugcugauauaguaagcuuaaauuuucauuaucaccaccccuugccagguuuguaguuuuugucuuuauaauaucgucuguauaugaaacaaaguaaaaucuguuuuauuucuuauaaagcuuucccagaguaucuaguauaauucugugcauguagaagacuucucaguaauuauccacuacucaagagacaaccugcuguguggagugacugaauccuagugagccugccccacaguggccgcagcggccuaugcacccugcuacugagcuccucuguguuuaggugcacgaagcauccucuuaggccacuugaguaguauuuacuguggaugacauugugcuugcugugcucuguggccauucuucucuuuggaaagauaaagacuuuauagacacaagaaaugcccuguggggaagaagucuuacuguacugugugcugagaucuuuauuagauauaguggcuuggugacccuagggauaagauuaaaaucauuaugccuauauguuugugccaaaccacuuuucagcuuuuuuaaagaagaaaguuuugugcaggcugauucuuucuuuauuuucuuuucuucuucuuuuuuuuuuuuuuuuaaggccggaucucauucuguugaccagcgugcaguggccugaucauggcucauugcagccuccaucuccuggguucaagggauccuuccaaguagcugugaccacaggcaugugccagcaugcccaucuacuuuuuuaaauuuauuguagagauggggucuugcauuguugcccaggcuggccuugaacucuuguacuuaagugauccuccugccuuggccucacaaagugcugggauuacaggcauuagccaccaugccuggccuauagagcaccuuuuaugugcucauuuaugguagucuugugcaggacauuggcauuaaauuaaauuaauuaauuaauuaaucuugagacagggucucucucuguugcccaggcuggagugaugcaguggcacaaucucggcucacugcgaccucugccuccuggguucaagcuauucuccugccucagccucccgaguagcugggauuacaggugcacaucaucacgccuggcugauuuuuguauuuuuaguagacaggauuucaccagcuacguuggccaggcuggucucaaacuccugaucucaagugauccaccugccucggcauccuaaagugcugggauuauaggugugagccaccaugcccagcugacugauuguuucuuacagaaauccucugaauuuugccugcucucagauguuuuugcagauuggguaaugcuggauauuagaaaguugugucccuagaaauuauagccuuauggggcucauauauucuuuccauauuuagugaccuaacaaagccuaccucuguaacauuaaccaaaagaaggcuagagggcugaagaauguuuguucccucauugauuuggggcuuuugguuguaauaggauuggugauagugaaagugugaaguagaauugaaaauagaaauucugugaagcugucauggggggaaaguggcaaaucuuacauuucauauuuagauuaaauuauaguguuuaauuuaaaaauuuuaaaauuuaaaacauuuuaaaaauaguuaauuugaaauauucccaagacuccuagaauugaaauccaaaauacuuaauaucaugaugacacuuagauaaacuauuuauuuauguugucaucucuaucacuaggcugaauuucucaagaguggcauuugugucaguuauguuuguuucccaguguucauuucgucuagugggggcucaguaagugcuuguugaacuggccuccuuuggcagcucuucugccucuuuccugaugugguacaccuaguugaauguaccuugucacuugggaaaaggcuuacaucuguuuccuuuaaaauaacagaaagcaaaugcuuccacuugaacucuggccugaaauauaugugcaugcgaguauuuggucuggcaaagugucacauuuuuacucugugagugcugaguauguacuuguauguguguacacauuucagucuacugcuaaguaguuuuaucuuagccagacugccgugcagccaacagcaccucaucguuaaugucaaaagucuuuuuacagauauaaccacagacaagcagaaccuuuaauucagauacucuguugauuaacaaccagagaguucagucuggacucacucagaaaacuaggauauagaauaaugaaauagcuaaggcuacugagaaaagaaguauuuacuaugaagugguagugugcuuucaaaucauacguaacaaauguaguaaugaaagauuaguauuugagaauuaaucaauauugcacuaaauauacuggaacugggcuauaucauuacaagauuuaggagguauguuagaaauuaaaaagaagaaucuuaggaauguuuuagucacuagaaaauauaaugaaacauuuguuauauauggagccaagcaaacaacaugaaagcucacuuaccagaggaggaaauuaaacuaacaaccauguacgugugagugcgugggugugugguguguauuuuugaaguguuaaaacuaaaauuuagacacccagaauaagcacauauacuacuuguugccaggcaagauuuuugguguaugaacauaaagaaggaaaugacuuuguuuuuguguuucaaaauuggaaauauguuuuaugguaaguuuuaaacuauuuuuuaaugguuggcauuaaagaagucaauaaacaaauuacaaagugaaguaaauguaauggauacaacacaaaacaguagaauuagccacauguaggucuuuaucaauggaaguugaguagucuagggaaauuucuauucaaagaagacuguacuacauccagugccugaauagacugucauaaaagguucagccacuguugagcaauacgaaguaaaaugugaaguucugcauucuaucacugaauucacuacucaaaagaagguauaaaaauuaccuuguacuuuauauacuguacucaauguaauuuguauaacaaaguuauacuguauuaagccaaguauauuucacucugauaauuuugagaagucuacuaugucacaaaaucuaggaaaauguuaccuuagacccuaaucuaaucauccuugauugagucuuagucaccguagaaaucucacaugauuuaaaaaacacaaggauagguagagauuuguuaaaggauacaaaauuacagcaagauaggaggaauaaguucuagacuuuuucacugggguccccaaccccugugccguagacccauaccuggcugcacagcuggaggugagccaugggugagcgagaauuacugccugagcucugccuccuguccgagcagcaguggcauuaguuucuuauagugauggcaguggagggcugucucgaguggccgcugccaucaugccagccacugcagggaggguauggggaggaggcagauagcccccugcagccugccgcccuaggggccaccaugauguguccgggcugggucgccugucaggccuaucgugggcagagucgugaccugugauggacagaggggccccauauugcggucccagguugggcagagaggggcccugagaugaagcugggccuggaguggugcugugcuugcccauggggggaaggggcugggccugggucacggagcuggggccacacuuuuggggccugaggugggaauugggagcagugcuugcuuugaggacccggccagccaugcagucacuguacccacccugcugagggugcuggguuccuaugccuugggaggaggcucugcguggggcugcccagggccauguccaugggguccacccugcauuggggugacugccaagccugacauucccaacggcugggccuggggcccgugauccacucccagaggagccccuccccaggcagggcccugagccaaaugacggggagccccaggcugucccugagcacagggccaauggggagagcuugugucaaugucacucuuaccccaaaugcuggccccagcccggcgagaaccuggagcccugccccagggugugaaggggcacagccaggacugcaugcuccauggagccagugggagccaggagcagguagcagccgcacccucccagaugcggcuucagcuacccaaguuggcgcuguggacccaggccucccugugcugcuugcaggcucugaaaugccugcucccgcucccuggcuucucccagcugucagcgccuacucugaucucagagcaauguggggcugagcccgguugcugucacagccuggcugggggugcauacaccuggggcagugcugacacaccagcugccugcugccucagcuccccgcugccucagcucccccgcugcagacuugggcaccaaugaguguggggggguuggaaaccgaugcagagcugagggcagcucaguguggccugcaggugccccuuggcacaagcaccugggcuccauggaggguggcaggaggcagauaggcuccugggcaaaagggggcagguacccggugaggccccaccuucaggcuagggauugccugaaggcugggggccaggcugacaguccggucgaccagaaugggaacuuguggugccuuuucugggccugcccaugacugccugugaaccaaagaaugcacacuuccuccccuccgaggccuguaaaagccucaggcucagccagagcagagcagaugauggaaugaccagcugcagagaggagcuacccucucugcugagaacugaaugcuuauugugaugacuugccuagagagaggaguuaccuucucugcuagcagccugaaugcucauugguauacccugccuguggaaagaaaaccugcagguuuccucugagcuguucuguugcucaaugaaguuccucuucaucuugcuuaccuucuacuuguuuguauaccucauuuuuccuggucacaggacaagaauuugggacccgccgaauggcgaggcuaaaagagcuguaacacagacaagacugagaccugcuccuugcuugccacauugcgagugaagagaaggagagaagagcugcagccuuucagggaucccagaccugggagcuccccaagccagggcugugacuccuucuuuggggugcugcaguuccuggugucuccgagcuucuggaugccacuguguucccuggugucagcuguggaagcuacuugcggugugccugucccagcugcagccuggcagagagcuggcaccugugcuggcaccuggagcugcccacccuucugcagcagccggcauaucugacugugcauuggccagaccccacacucacucucacaccccuugccgcuccaugcagucucccuuggcagguguggaauccaggccauuagugugagcugaacacagccugccaggucgagugagcagaaugagcucagugggcugaagcaaaaauuugggcaaaggcacgacuggccacagagguuuccagccagaaaagcaacaccccaaagaucccauaauaauaggagugcaaaaccuguuguaaacugugcaugccagggaucuagguuguguguuccuuaugagaaucuagcuaaugccuggugaucugagguggaacaguuuuaucccaaaaccauccccagccccaucccuguccauggaaaaacugucuuccacaaaaccuguuccugaugccaaaaagguugggcacugcuauucuauaccgcuguaggaugacuauaguuaacaauaauauauaguuucaaaaagcuagaaggaagacauugaauguucccaacacaaagaaaugauacauguuugagaugauggauaugcugauuaucuugaucugaucacuauacaugauauguauuguaacaucacuagguaccccaugaauauguacaauuaugugucaagauaaauaaguaauaaaauaaaaagcuuuaucuuauuccccaaaaaaagacagcuugaggaaaggaaaaaggaagauuacuagcagaguuguaggcuauugucuaugguacuuuacugcaugaagaagguacagaggcugaauggaagagggguuguaaaacuggaguaugggcuuuccuuucacauggagcuuuguuuaacagaagucuagaaaguagauauaagaaucauuaucaugguuaguuuaugucaaaacuauacauacugucuuauuauacuuaauuaaauggguaaucauuugacuagugugucuaugaguucguaaguugguacuuaaugguuauauuauuuaauucaccucaguggacagagauuaaaacagagucauuuucugguuccuuuuccugugguuaauuaaguccuuugagauauggcuguauacacuuuauggugguuuacacaugucuguuuuauuaguuuugcagacaguagacaggaacaaaaaggggcauagucauucuugcugugaguuaacccuacacuucuccaagcaguagaauguaaacucaacuaggcuuuugagaacuuucccucagugacuuaauuaauuccaugcccauuucuggacuuuggaauauagcaugcaucuauguagcuuguuuuuuacuuuaucaaauuuaaaaugcucauuaucgaacauuuauauuuuuauauuaaacuuuuguaaguauaaccugcuugguuucaaauauuucacaugcaacaugacauugguuggaauaauguuauguuguauguaaaaguguaaguuguauguaaaagauuaauaucacaauccuuugaaauacuuugcaccuugcuauugaauaaaguugaugacuuuuaauucuguugacauaaucuagaacccauagggaaacucuaugauaauguuuuacuucuagaaagucagucaauaaguaaaaacaaaacagaaaaaacauaaaaaacuuuuauuauccaugcuuaugaaaugagauuucaaauggagucacuuugaugcaucauacaaauguaucaaauuauugaaauuuugcaucagcaggcaccucagagauuaaauauauccuucaggaaaucuagccuuauaacaguaucacuagccuuauaauaaucagguaguuguaguauccuguccuuuuagacuuaguauuggacugacagucaggcauggcaauuccugagcauguuggugguagauugguggagauggugcuggaagucaccuccagagcauggugaauuugauaggcagguggguagaauagccucagaacauuugacuuucacucuauauaaaucuuguggcacauagcccuuuauauuggguuuauuaauaauaaugauaaaaauagucauugugacuaauaguaauuggcacuaugcuuaacacuuuagauauauugucuuauuuaauucuaacaacccccccuaaaguaguaguaauauucccauuuugcugaugaaaaaacugaacccaaguauauagagcuugaaagugguggaacaaagagcuuuucacccuagccagucuaacaugcaguuuugguaucuagauucccccaguuagagaugaugagcauaauaaucaauuuuuaucuagaagauucagaugaauacuuguacauuuuacagcaaugauaaauaugugcuuuaaguaccuuuuaaauauaugaguuguggugauguuuacaguugaucuaacaccaaagcuaauaaaguaucuaacuguaagucuuacaggagaaaucauggguuaaaagucauuuggaauugagggcacucucagugcuuaagaggauguuucuauagaagaauacaaguauccuguuuuauacuugaucuuaguaaaaagaccaagaagagauguaauagccuuuguuaauguuuggaaauauauuaaaauuaaaaagauauuauaaaagauauauuuuucuauuuuuuggaauauuaggaaagaugauaauaaacaauacguauauauuccugaacuucugacaucaacauucacacugccuuacaaaugcacacuuucucauucuuuuuuccuaaaauagagaaauauccccuucucuuucuuaagaacaaaucuccuaccuguuucucuuucugaugaacacuuaccuuguagguuaucccuucucuccauuugaucuuuauccucuccuuccuucaauugucuguaugcugugucuucauuuucuuaccuccaacguucucugccacccacacuaaccugguuucugcuucccucuggccuucuguuuguucucucucaggucacuaguucugcccucauuaugaagccacuugaugcuuuucagauuuccuuuuacucucagacuccaaggcaacauuagguguuguggacagcuaccuccaucuuucaacucacccuucuuuggcuuccugaaaccaccuauccucugagucacuuuuuuuuucuuucgccuuuauagcuuauauucuuuuacucagcuauuaaaugugcgaguuccuuuccuuuuguauuagucuguuuuuaugcugcugauaaagauguaccagagacugggaaaaaaaagagguuuaguugacuuacaguuccucauggcuggggaggccucacaaucaugauggaaggcaaggaggagcaagucacguccuacauggaugguggcaggcaaagagagagagguugugcagggaaacccccauuuuucaaaccaucaaaucuuguaagacuuagucacuaucacaggaacagcacagaaaagaccugccccuaugaguuaccucccacaacaugugggaauucaaaaugagauuuggauggggacacaaccaaaccauaucuccuuuauucuaccucuuucaaauauguguguacaugcaugcacacaggcauaggcacacaugugcaugcacacacagacacauuuucucuuuacuagguuucuccuauuugaacucuagacuaggucaguuuucuauuauauacuucaguaguacugugcugcucuuugucgucacauucaucaaguuauuuuuauuucuuuggugguugauuaauggcuauuuccacucuuuaggaauacuguaaacucuuuaggaauagguacuguauuuuauugcauuauguuauacuuaguccuaauugcuucaccuuaugugcucaaguccuaagagcucauaagugcucaacaauuuuuucaaaugauuuaucuuuaucagaacuacuuucagauuacuuaagugaaaacaaucauagaauuaaaaauuguugacauugaaggauuaugugcaggugagucaggaagaagaacugggagagcccacauguaauucuaguucauauuuaaaggcaugagagccaggagaaaugaugguguaguuucaguccaaaggcaggcaggcuugagacacagaaagaccugaauuugagucugagggcaugaaaagccaaauuccuugcuugaugauaguugaaauucucuugcuuggaggagagucagccuuuuuguuuuauugaggccuuccacugauuggaugaggcccaccuacacuuuuuaggguaaucugcuuuacugagucuacucuacugauauaaauguugauuucaucuaaaaacaacuccacagaaacacacagaauaauauuugaccaaauaucuggacacuccacguccuagucaaguugacacauugucuuagucuguucaggcugcuguaacaaaaauagaugaugcuggguagcuuauacccuacagaaauuuauuccucacgguucuggagguugggaaguccaagaucaaggugccugcuguuucaguugucugacgagggccugcuuccuguuucauaggcagcugucuucuugcuguaaccuuauguggggcaagaaaguaagggagcucucuagggcccauuuuauaagggcacuaaucccauugaugagggauccauccucaugaccuaaucaccucccaaagagccucccucuaaaugccauuacauggggaauuagauuucaacauaugaauuuggggggacacaaauauucagcacauauaaaauuaaccaucacauugaucaaaugaacauuucuuauaggcugcuuucaacuaguuuuuucaaaugugcaauccauaggccauguuuaaucuaugccugauuuuucagucccuccacguguugaagcuacuuuuuuagucugaucguuuacaaauuuccuguaauaaccaauguuuuagcuagauuuguugcuuuuuauagcauaaaucuacuuuucuuagugcuuucacuuugcuaauguuguuuucccuacuuuaaugagcccauucccuacuaauauuauuuuguuuaggacuuaucuagcuuucacagauucagagugcguuucaaacaucaucgugaaacuaccuccaaaaauucuguaacuaccauucucuguacaacuaucuugguccuuuuuacacuuuauaguccccucuucggggauauguuccaagaucccccgugaaugccugaaacuggauaguaccaagucugauuauaauuacuggaaacacauuucuguuccugucuucuauccacaaauuuaaugccuuuuccaucuuaacuaagcacuuaucauggaccguggcuauaauuuuugcaguuugaagugcaacaacaagacuagcauagauuccuuccucaaaauguuaugguagaagauucauuuuuagcauagauguuaucaaucucagcauauuaauguuuuuuuuucuuuccuaauuaggucaagaacuuucaccuuuucaauuaaaggaagcauuuuacaacuucuuuugggaauaucugaguuguuagcaccacuacucuggggcuauuacuaaguagaauaaggguuacaugaacacaagcacugugacagguggcaguuggucugauaaccgagaaggcuaccaagugacuaaugaauggguaacaucuacagaauggauacauugcacaaagggaggacuccugucccgggugggaugaagcagggcagcauuagauuucaucacauugcucagaauggcauccaauuuaaaacucauuaaucguuuauuucuggaauuugucauugaauauuuuuggaucaggguugaccaaguguaacugaaacagcagaaagcgaaagugcagauaagaagggggcuacuguacuguuauucagccuguuuuuucuguuuccccugagagcauauaaaguccagggggaaaggaccagccuuauguguguggguauucaauacucugcacauuauauacuguaguaaauguauugaauaaacuuucagcuaucuaauauguuucugguaugucaaauggguguaugcuuggcacaaugcugguucucuuuccagggagcacaguuacuugucuaaucuuuuuuaaagauuugagugaaacccucucacccucucaacuguugaccaacuuuugacuucuuaagaauuuguugagaauaggaaauuuauucuacaaccccauuguagcucauucuacuuucugaaugacauucuugccuuuacugucuuacuaauucaaaaggaaaugacaauuuuuuucucauauuugauucaauucagcagauacuuuguugauagccuucagugagcaaagugucacaucagguacugagguugcacaaaggugaauaugauauagugccugcccucagggggcucacaagcucauggggaagugaggaggccagggaaaagagagguuuguguuuagcuaauucucaugcaauacagcguaaaugaauauuuggggaauaauuuauauguaauuugugauauaguuuggcuguguucccacccaacucucaucuugaauuguaguucccauaauccucaugugcugugggaggaaucagguagagauaauugaaucauggggacaguuuccccuacucuguucucaugacagugauuuaguucucacgugauuugaugguuuuauaaggggcuuccucauuugcugggcacuaguuaucuccccugcccccagaagagaugccuucugccaugauuguaaguuuccugaggccuccccagccaugcagaacugugaguuaauuaaaccucuuuccuuuauaaauauccuagucucagguauuucuucauagcagcgugagaauggacuaauagaauuuggguguaugaucccuuccccauggagcuuccaacccaguuggggauucagcuaaauaaauacagaugaacauggaaaagacucugauaggaccagcacagaugguuaggaaguauguauggggggccuguuccucacacuugcuuauauaauaauuuaguugacacucucuuuuuugaugugauguggaccaauucauguuaaguuaauaaaaguuggccccaguaugggaucauagacuugauacuucaaacauuuuauuuuaccuuaaguuuuauaaaucuauauuuauuuaccaauuuacugaucuaugaccaaagcuuucuugguucuaaguauagguucucucauuagcauuugcugucauauuuuuucauaaccacucaauauccaguuuuacucuuuauaaguaguauaaguagacucuugcaaagcauccuaaguucagaguccuucuagaguugugauuuuccccuuuuauaauuguuuugccucauauaauuuggcuauuucuuuuauagacuuaucguugagacuuuucaaaacauucaauugauuuucuuagaaacaauugaauuuuucuuacucagcugucuuuauuuuauuugaaauguaguucaauuauaugauuaaaguaacuuguccccaguguuuuaaacagguguaggaaugaaugcgugggacugugggaagcaugccugacaguuaggugguaggaacagaaugugugggcaaacaagaagacagcagcuuccuaauugagaagacuucagguggggcaucauucaguagauuuugugguaugcagagugucaguuaaguuuaggaccuaauuaaggggaggucaguuaaaagagcuucugauguaaauaaagcaaauuugcaauaagaacauguccgcccucuaaucacuuguuuauaaaacggcugcccucuccuccacagcacuaucugauucaacacuuucaugguuugucaauauugauaacuuauuuuuaaauaaaaaagugaaguauauauauuuuuuuucaaaagccacugcuucccaagcucacaucacaagaaaaaguagcaacuuuuucuguuuauguucuuuuuuguugauucuuuucuccacaauaucagauuugugucaugagaugguucaaacauuacuagcucugcuugagccccucagagaaagauauguguauacauacacauauauguuaguaauuugugauugauauucuuugcuuauagacuugauuuuuuuguuuaauauaguauucuguuuuuaggaaucauacuaaacuguuuccucccuguauggcugauuauaagcuaugacuagcaaaccagauuuuauuugcaguuguuugaaacuucauuuuucuuauaugaccugauuaaugcacucugaacaugaaucaguguauccugcccuguucuuuguuuugaauacaucugucauuuucugccucacauuauuuuccuugauuucaagucacuugcuucuuauuuucaaauaaaauaauuuuuaagaauauuauucugcuucagucaauuuuugcucagaagaccgcuccaacgaacaacccuaaacucuuagugguuuauagcaacagagguuuauuucuugcugacaaaguauaggcugccagaggcuaugacucuguccacagcuuggcuccacauggcaucugaagauacaacccuuaucagggacauguguuuuccuggcagaggggaaagagagcggcggccaaaaugugaugauuuuuaaagcuuucacuuggacgugguucacuuugcuucuguucacauuucaucgguuagugcaagucacccggccaaacucauaagguauacccacuccccaaagguaacuuucugagucacauagcaaguugggaaaguccucuuacugggaagagagugaauaaacaggaauccugucuauuacaguuaugucuuaaagacuuuugguuuuauuguuggauuauagauacauuuugugaauuuuaauguggaaaugauuuuuuucuugauguuugucagcuuuguauguugagugcuauagacauaucgauacacagguuaagacugauucaggaguuuaguaaagaagcuuuauaugagaggauauuaaauaugaaaucuuuacuguuucauucuguuuucuuuuuugcaccuucaucgcuugucuuuuauuucuauugauuauuggauagcaguccagagacuuuuuuuuuccucuacacugguauaaguuguucauuuauaagcccuugcauuguuuugaagauaauucccuuuuccauggauuacccauuagucauguuagcuggauaguguggauuuucacaauuuacuaccuuuucaauauaaugaauuguaccuuugccaauuucacaaucaugguuuuucuuacaguguccacauguggauagcagccugccaacaaguaaacaaaaacugaguuaagcgacauacagauacagcugaaauaccaaauuacccguggccucuccuggaguuauauuuauuugcacacaguggggacuaguauuuccuugugaaacaagagacuuuuacuguuuugaaauagcagaacugaaccucagaugcaugaguucauuaggauagauuuauccuagugaggcauggcacuugagaagagacaaagagcaaauuaucagagaagguugagguguacacauaaugccggauguggaagggucauagagaauuugaaaauuagauuuauugccuagauaucuaggaguaaauguuucuguguagugauagaagcagaaauaauuagacuggaaggcaucuugaguucauuugguccuaaccauuaccacaguacagaaguagucacauugauaaaaucuuaucaaagcauggcuuauguuacgcuauguaauuuuggagaaugggccucucaaccuuacaagguuguauauuccagcuuuucauaggaauccuaguuaaguauuucucuuaauuccauaccaugcuuugcuuuaguagggugaggucugagagggaaagcaguaaucagaucagccucuauauguacuuuuccuuuuaaauucauuaacuagacuccccuaaagaugaguuuauuucacuugugauugagucuagcucuagaagggaugagauuauaaaguccaacucuaucauuuuacagauaaaauaagaguacugaugauaagaggcuuccccaaggugacagagccucagagcggccaagccaaagccagaagauagucuugauaaaguguucuuccugucauauaccacauauaaggaacuacucuaagaauauauuaauaucagauguagcuagguaauggaauguaagcuucuccugugccugagacugaggccacaaaguuaacuguauguuuugagcccagugcuugaccaaaaaagaauaauuuuguaagucacugaaguaaagagaaagaauaaaaaauuauauggggccaaauucccuucagcccauaaaugcauuggauuauuuuaggcucauuuggaaaauauuuuaucuagugaaguuaaaauuauaguugcauaauuugauaacuaauucuacuucauuccugaccugauuauucuaguucucaugaugcuaguccuagccucagguucuagauuggcucuagaauuuacuauuugugggaucuuuacauuuuauuuuucaucucugagccucaguuuucccauauguaaaaugcagguguguuggaggggcuccuuuggagaaguuccuauuggagacagaccuugaugcuaaucauuuccugucugccagauauacuuuacauauucuauauuauuuaauccucaaaacaauucuuugaaguagauacuauugaacccacuuuauagaugaggaaagcuagacuaagacaaguuaagauaaccuugcuuaagaucuguaacuaauaaguuauauacuaggauacaaauucaagucuaucugacucccaagccaguaucuauccaguguacuggacauuuccauuccuaucuccaaggguuccaugaagguaagaugagacaaaguacaugaaaaacuagaaacugcaaagugcuauauaaaagagggauacuguuauuucuucuaaguguucuuggcuacguaauuagcagaaauuagcaguagaguccaguccaaagcauuaauaagucuaggggcauuguauuuucuauuuuacaaugaggacauugaggcccauagggauaagaaagaugcccacauagccaugaagugacagagcacuuccuaaucggguuccaaagccuaccaucuggcuggcuucuacaguacuuugccucaggccuugauauuagcccuuggcauaggagcugggauucuguuacccacggauugauuuucugugauggaacuucccacccagugugcugagauaccuugggaaucuaagaauuagguuacuagugugaggugagauacugaugauaguaguuuuuucuuauaguguuaagaccauuuacauaaaguuaaccauucaaaauuugugaaaguccaaauguuauuugaauaucacuguauuuauaugacuacucuucuaaacuuucugaauuuagcaaugauuaauuugaugcauaagaaguuuguuggugccccugccucuagagaaugcucuguaauggccacaccacauggcacuaccucugacuuuucugcugaagcaaccuagccagguuauugcuuuuuuucuggauuuguuuaucuuuauuacaaaaguuuuuuugaaaaccaugacaaccaucauauuuggagaagcuuuuguguguguguuugccagcaaaucugaauuccauauuauaugauguuaccaaaaugaccagucugauacaaucuaagccacugcuauuguuuuucagcuuuguucaaagaagcaaaauucuacucucuucuuuucuuaucagaaugcauucguuguccgaaggaagggcuuugcgagucgauuugucaucuaaaauaauuuuuuugguuggggauuaugaaugacucacuuuguagauuuguugacugaauugacuaauauucuacgguaccuuagugaagguccacaugaaauuauauuuauguguacagagaagagauagauuuaaagcaaaaauucacaguuaguguuuuguuucgaaucuguaagaagaaucauuauuaaauacagcagcaucuuugaaugcuucagggaaaacuucauuaccuuggacucauccuugacccuuccucucucacacuccauauacagucugucaggaaauggcaucugcuuucccuucaaagcaugcucagaaugauuacuuuccacugccuccacuacucacugcuacaguccucaucgagucaccacuaucugugaccuggcuuaguuuaauagccucccagcuguaaauaaauaaaggaaaagcugaguaagcuuuuuauuaauauguguuguuuuucuucuggcacaaguauuuuacuaccuauuauuuuaaaaauauugagcaaguauuaugagauuagcuugcacuugauaauucuuuuccacuugagaaaaucaucuuuuggggagguaaaagcaacacauauuagaaauucauugaucacaugaauuaagugacaaaaaccacagaaguaaaugaugugcccaauugaaguuaagacaguugauauagagaacuccuaauuaaaaguuccuacaugaauuuaguagauuagagaaaguuucuugaaggaggaugaaagugagcugcgccucagagcacauggaggaguuauagcaaggggccaaguggcaucuuugcaguuguacuaaggugggaauuagcucuguguuuucugagaaguguacuaguuugauggaagaagaggagcagguacauuugaaggagauuuggggacaagagaaugacaugaaaauucagaugaugggaguucacuugguaagcuguuggagucgucucugggaauaugacugguccuaaauguugagaauccugauguggaccuggagauggugaaggagguagacccagucaauauuguuguuaggaaaucuuaaguggaguuaagaaugugauuuuggagagcaugauggguguaguuagguauccaacuauccuaguuugcccaggacucucucaguuuuagcacugaguaaucccuauccuuggaaaccccucaauugcaggcagacuucaugguuggacaccuuggguaugguucagacaauugauugguaucugagguccaaaccagagcaacacuuuaacauguuaacaguggaagagagcaugacaacaggagauccagggcagagcauuuaagagcucuacuaggcaggcagauuuauuucaaaaguaauaaauaacaauaaguaagaaaaacaacacauauuauuaaaagcuuacucaacuuuuccuguauuuauuuacagcugggaggcuauuaaacuaauccaggucauagauaguggugacucgaugaggacuguagcagugaguaguggaggcagugggaaguaaucauucugagcaugcuuugaagggaaagcagaugccauuuccugauagauuguauauggagugugagagaggaagggucaaggaugaguccaagguaaugagcuggaugucuuauauuuuggcugagagcauuuugaccaaacgaauuguaaucaaagcagcacgguaaaagcaacuuugugugauaguuugguugaaacagacuuuggacacaaaaugaauauguuaaccacuggcauucaaguuuuuauuaaauaguaaugauaguaacuaccacucaugaaugcuuuccacauguagggcaucuggcuagacuuugcaaauauuaccaucuuuaaucuucacagccauccuaugagauaggcacuacuauuuucuccauuuuacagaugaggaaauuggugguuugggagauuaggcuguuugcucagucacauagcuagucaaucuagagugagacuuugaacccugagcaucccaaaguccugcucucuuugguugccauauaguacugcuuccugguaucaaggaacaggguucauuaauuauccauuguuaucuuuuacuacaaaaguaauaaauaaaauaaauuaauuaauucuaggaaaauuauaaaauguagaggagcagaagaugacuauacaaaguacucacgauuuccuccauuagaaacagcccuauuaacaccauuguuuacauauuauuuucuuuuuugggcauauugauuuacauacauuuuuaaaaauuaaaaugauauuugauaaauguuuuaaaaccaauuguuagagauuugacuuuuuuucaacuuauauuguugggccaguaggcuauggugacuuuuugauauuacaaacacugugcaguagaaguaaugagccaaaaaacaacaugcaaauaaaauaaagcaaaaugaaaugagacuaaaaaaagacaaaaaauucaaaacaauaggcaagagaugaauaacaauuguaaaaccauucauucuauaaauauguuguauucaaauuauaaugcuuugaaaacugauggcuggggaauauuugcuuuugagcaggccuugauguugaacaaguuucuaaguguuuuuaauaaaaucaccuggagccagugacuugaaucacaagcaggaucucagcccuuaggcagagucacaggaauguggcucaucuuaaguguauauacaaggcguccaggagggacugugcucaagggaauaaccuaagaccagaaaugauagauauaguaaggagaauuaaucucaguaugagaauauuaaaccagugaucaaaucugaaccacaagguuauugcuaggcuaacaguaacaugacgacaggaagcugauacugagucccagagcauuggggcaacacccuugucuuaguccauuuguguugcuauaaaggaauaccugacacuggguaauguauuaaaaaauguguauuuggcucacaguuuuguaggcuuguacugaaguguggugccagcaucugcuucuggugauggcuucaggcuccuucuacucaugguggaagguaaagugaaacaaacauguguaguggucaaagaggggauaaggagggugccagucucuuucuaauaaucagcucucuggggaaguaauagaggaagaacucauucauuauacugagaacggcacuaagccauguaugagaggucuguccccaugacccaaacacuucccaucaggccccaccucuaacauuggggaucacauuucaacaugagguuugugggcacaaacacccaaacuauagcaacuguaaauccuuccugccaaagggcaugagauuaggccugggaugagccuccagguggacaaaauggcuccagaaauuagggaucuggcaggccuugucaaucugagguuuguagggaggagaacaacaccaugaagaguugcaggauuuguaggaugaucaaaaauuagugcaguguaugcaaggaagugacuuaagaggauacuucuuaauaguauugggguagcaaaugaaaggaaagagacuguuggucugcacagugguuggaauuauauguacagagauauccagacauucccauuaaauaaauagauugaaguaauaccuguaacuauauuccucuuuauaucacauuuuuuggcaaacagagaaaaaccaugcagcugguccuguggagccuggaaugcugccauuacuuucauuaaauuaaaguuuuagcugguauaugaaaauuuucuuuuauuacagagccucuaaacagacaugccauauccugugauuacaguuuaaguuaaugguaucauguuuuaaaauuaaaaauuauuaucuuuccuuggugcuaucaaaaccaucacaaaauuaaucacuaauauacuaggaugacgguucaauuaacuuucauggauauugaucagauaaacacuaauauuuauuauugcauucugaagucuuuauuagguuaguggguuacccaaacaguuaaaaacucaucuaauaaagaccuggaaaaugcugcuuuugaguuaaagagaccucuugcuuagugucuauauauuuuuugcuuguuugcuuuuguugcacuaagaauaccaauaguauauaaguuaauucagugaucuuaauuagaaauaaccuuuuuaauguuuuuggauauauaaaauuuaaaaacuuccaagaguguucaaaauguuauaggaaugucuauacauuaaguguagcacaugauuagauuugcuucagugcuuugaacuuuugaaucaagccuuccuuccauaggauuggaugcauaugaucauaauuucugucucuuccaugaaauuuucuaauauauauuguuuuaaaauuacaaaguagucaugcuuauuauucaaaaaagcccucccaaacuaagacaauguugaauauagccccucucccauccucaaaauaacuguauguacaauuugaugcaugucuuugcaauuuuucaugaagguucuaauuguguuuacauauauacauaaaucuaugcaugcauacacucuccuuccuccccucucuccuauuccuuccccucucacaucuucuccuuugucuuccuccuccugcuuuuaaacauaagugcuaugauauugccaaagaagagaaggcuuuguucugugcucugugcuuuauugaauuucauucauugguggaccuuacuuucuuuguccuuuccugccuuugccacuaugaagguucaauaaauucagucucuguuuugcuuuucuuuauauucagcagccucacuaggaacccucccagaacaaauccuuaacuauguaaaagagagcaauucugggugcuuucuccuggggacagcccgcuuuacagcuucaguucuggcuucccuggugauuggcccaaggcccagcauggcuuuuguaucaguugauuccaagugugaaguuucucugggguuuccuuggaaagaagguucuuuguagcauuccucuucugugucuguuauuggucgagguuuccucugcauuaguuaucuauuauuucgacuaugucugauuucuguuuuccaggacuuucuaaaauaucuugauauguugaugguggaccuuguuuuuuuuuuuuuucuuuuucucgugucugucauuucugugggauuuagagaccaaagaggugagguacacaugauggcuccaucaacaccuugaacuucccagaugucuaguauuuuuucuauuucgggaccagguuucaguaaauucuuucaggggacgaacuuauuugcacuuccucugguuuguguuagaacuugaaaggcuuuuuuuuuuuuuaaguuuuguguuaguguuaauaauaacgaaaucauugauaucucauugcucucugucugcaugugugaaugacacuguugcaugacaacuacauuuauaggccaccacaaaguguugcuugcauaaggccaguuagugaugcaaaauucacuuuaaaaauugaacauaauuucauuugacauguguaaaugucacuuuuugucauauguauuuguauuuuauuugccagguaacugaauauugucaccugccuuuuucagcacccagaucaacuagaaauaaaaaaaaguaauaacuuuucaugcacacauaguacuccauuaauguaucuuaaaauuauuucuuaauuacuaucagaaacaaaugaaugguucagcauuuaaaaaaauuuguuucaggaaggagaaaacauuuucuauuuggcaguugaagauauagaaacagacacggagcuucugauuggcuaccuggauagugacauggaggcugaggaggaagaacagcaaauuaugacagucaucaaagaaggggaaguugaaaauucuagaagacaaucaacagcgggcagaaaagguauugcaucuuuaauuggugaucugggagaagaaaaguuguagaaaaaaguguaguuuaaacugugguugaauuauaguugccuuguaauauggcauucucaaauaaaguuaguuuuugucaaaauuauucucgaggguauccugugguggacucaucuuuguuacagcaggaaaaguauuuugggagugggugauggauguacccuauaggacugccuaggccgcaggcagggcugcauugcuagggcagcucccggcucucacugcucucacuggcgcauugggguaaugaguagugaggauuuuuauagucuugccauagcucugccacuaaucagucuuguaacguugggcaaguugcugacuuucugagacuuuacuuucucaucugcauauaggaaaaggugagaguggaggugagguacacaagagagccugcuggauccgaaggggauugauuccucuuguuugggaucuuuugggaaccugcagcuucuuggcaucucuuucuguucugaucacagaagccuggaggauugcuagguugcccuagugugguuaccaaaaacuuucagugaccguaggucagaccuuccucagucaauacugcagccacuugcuuguuaacugccagggaauaaucaauuauuauuggccuuguuucuauuauguuguguuuuacuccuaagggaaauuuaagggauauaugaaugaugcuauagguauucacauuuuguaauaggccucgucuuuauccuuucaggcuguuauaacaaaauacuuuagacuagauacuugguaagcagcagaaauuuauugcuuacguuucuggagccuaggaagucuaucaaggugccagcagauuuggugucuggugagggcccguuucuaauuagauagcaccuucuagcuguguccucaugugacagaagggacaagcaagcucucuugggcuucuuuuacaagggcauuaagcccauacaugaggacacagugcucauaaccuaaucaucuccuaaagggcccaccucuuaauacaauuccauugcgguuucaguuucaacguaugaauuuuggggauucacgaacauucagaccauagcaggcugauacuuacuauacaguacuuuuccauuuuguguagcaaagccacuucagaagugauacugguuucauuagucaaagugguaguaugcuuuuccuguacuuuuucuguucuaacugcauguuauuggcugagaaagugugaacauucugucaccauugccagcuuaugcuucuguuucuuuauuuuaguugaauuauuuaaggggaagauaaggacaggcuuauaugcauuaugcuauuuggaauaucauauuuugggugaugggaauuauuucuguguuauucuguguuuucuuuguuuuuguauuuuauuuuuucccuguuguccccagggcaaguuauuuuauccauuauuuuaauuuaaaaauaaguaaucuacuuaccuauuacugcccugauuucugcuuuaguuauuaaaauaccaguuuucauuaucuuuguaaaaagaaucaacagaaacuuaaacagaauuuuuuaaacacaugaaccaagcacuugcauuguggcuauuuugguuuuuuuaaaauuuuauuuuauuauuauuauacuuuaaguuuuaggguacaugugcacaaugugcagguuuguuacauauguauacaugugccaugugccaugugccauggcuauuuuuauuuuagaauucuuaguuuuauuuagaaaagcaaagaaacaaaauaaaaacaaacagcaaaagaaacaagccacccaaaugucuaacaaugaagaguuugguuaaauaaauugugguacuuuaaguuuaaaaauaugccaacauuugacuugagaagauguuaaaugggaaaacauauaaaauuguauauaaaguaugaucccaaauuuaccucuucuuagacugcgcauaaaauauguaugcacuaaaggcaagucaggcuugccaguaauauuaugacaguugucucuuccugaugggauuauugguguuuuuuauuuucugcauuuucuaagucuaauuuuauuuuauaaucagaaacaaauguguaauuuaaauagcacgcugagaaauuuggucagaccugcaccagucuauaugggaccguguagcauaauucacucuacuagcuuaaucagcacuguuuuuaugaccuuggucuuuuuucacauguaugugagauucuccuugguaauucaauauaguuugcaucaguuggauuuuucuccuugugaagguaaaaaugagcuaaaaaugaccaauuucaggaauagcuuuuguuuucuaauuuaacauuuugaucugaaaaguuaacauuauaggaugaauuaaauaaggaauuugacuuuguauuaauuuggugaaauacaagugauuuugaaaauaauguauuucucucuaguaacacuugcuauuauuuuuuuguggccaaauacuauuaauauuuauagugauaauaagaauuuauucauaugguaucauuaagcacaauuaauuaauuaauuuaaaaugagagcaaaacugagcauuucuuggcucugaauuuuugucucaugaauauguuuccuugugaaugugcagaucgccuuggcuguaaagaggacuaugcuuguccucaaugugaaucgaguuuuaccagugaggauauucuugcugagcaucuccagacauugcaccagaaacccacagaggagaaagaauuuaagugcaagaacugugggaagaaauucccaguuaagcaggcuuugcaaagacagugcguauauuaaagaaauaucuuuaaaauuauaagcuaacacaguuuauuccauucagcuuaacucauaguuuuuaaccugugugugugugugugcacgcgcgcacgcgcauguuuugugugugaaugagagauuaagcauuuuacauugguauugucauuaacucaucuuuucuuaguauaguauguugauuauuaaaauauucaaauuauggauuuuaacacauaaacacuguuuaugguaauuaguuuuuguccauuuauuaauuugccauuauguaucaagcuuacugguuuaaucugaaauucagauaugccuacuuuaguuacuccuuugagguaacagacuuuuaguugucuacguuuuauauuccuucuggaaucuguuuaaaaaaaaguuuaagaaauggggaguucaaaguauaaagaauuccuggacauuuugggaagcacuguuuauuugagagcaacuuuggaggaauaauuuaaagaugcauaggucccaguuauaacaauaugauuaauuagaugaucccacacauagcucuguacccuuuuuuauuuuaacaauuuauauuaacaacauaaaauuaucuuuauuuaaauauuuuacaggaucagaaauuguuaaaagugagaaaguagguauaugcauuuguaaaguuuuauuuuuuuacucauuaaaguuuguaauuuuaaucagauaauugaauuuaaguaauuuaaaagcauauuuacauauuggaugcaacuguagacucucauuguguugaagccaauuacuuccaauaugaaaguaauguaaauugucccaucucaucaacauaucucuucucuuaugugcucccauccugccauuuacuuucuuucuccaaccuuagcuucucauuuuaacagaauguuaccuuacuuaugagcaagaaaucuuuaacauaggcuuuaauguuacauuuuuacauuuuuguguuucauugaacuaaaauucugaaauaugcuacauuucauacuaagacuguaugaauauuauuauaugcaucaacuuuugcuuauaaaaauugagaugaaaauugugcuuaaaacuuaauaaauguucagaauaucaaaacuuuuauaauagcaggauacuacauauuuagaaauucuauuguacuuccuuaaaaaacaagcaaggacuauaugcuuuuaaauaaauagauguuaaguugcauucugguuagcuuuuauugcauuuaguauuauauauuuauacaaaagacacugcugagcaagagcuuauaguuaagguacugcuaaaaauuuaaaaaggcaaaagacaaugaaaaaagggaucacgaacaugacuuuauucagaguuaguguaguuucauuuuugucuuagaguuccaguuuuuguuuucuuuucuuucucuuuuuccuauuucccuuuaguguucuucagugcacagcgaaaagcagucuaaaggagucuucgcgaaguuuucagugcucuguuugcaauucuuccuucaguucagcaucgagguuuugugucugaguuaugaaauggcuguuauauaauugugggucauuuuuugcaugcauacuuucaugcuucuuaguaauucaguuucacauaccuacagaauuuaaaugcuuuucuucuuaccugcauagguaaugcauggaaugaccccgaaacucuacuagggagcauguauuacaaaaucuugcugauguuugaguuuuguagguaugucuucaccauuucuuccuguuccgcuuugcugguugucuuguaguuuugagcagcaccaggagacuugccggggggaugccagguuugugugcaaggcugacagcuguggaaagaggcugaagagcaaggaugcccugaaaagacaccaggaaaauguccacacuggugaggagucguuggagggucguuuccgaaggggcuuccuuuccccaggcugcagcgaucuguuuuuaauucucgcucuugaggagagagcuggcuuuuccauuguguuucacacagauguggagcgcuggcaguggauuuuuuucuuucacugaacacuauuucuuucucagguugaauuuagcagcauuuguucuuuuucccauuccugaauuaauuauaacuguaagccuuaguuaaagucuaguuauguuuggguggucagaugcauuaagaauuaauauuuuuaaguaacaauuuuaaauguuuuggcaugugacauuucuuuuauaaauuguuaaaauuuaucauuauuaagugauguccuucugccuuauuauuuuuacaguaaaaauccaacuugugaaaauacaguucuccuaaguuagagaaaauugcuaacacauuuugacauuggaauugaauauguauggauuaacaaaacaaauauuauuugaauuccaucugauagcuagcuaaacaauaaaacaaauauaaaauuugacugucuuuuggguuuaucugcuuagcacaugguauacugucaguaaauauauuuuggcuuagggauuaaaucuauugcagugaguugaacagauggcuguauugucucaguuaacuuuuuacuucuugucuuuuuaccuccaaagacuuccuccuuaaaggagguugagauuuaugaaacccuguguguucuucucuucauauucuuuguucauguguuuauuuuugcccuugacuucugggaaauggguggcuaugugucucuggaugugggggaaaguggauuucuuuucucccuucaguuguuuauucuuauauucaggagaagaugauaaucugcacccagcaucuguauccuguauuuguucauuguccaaaaaguauucacuuuaauaauaauacaguuauagaggcuagcgugaacaacugcuagcugcgacuuugcaucauugguuugggcugcauauuaagugcaaccuauggugaaagcucugugugguggaaguagggccuugugaaaugcaccuccagcuuggugcccuucacuaggcuuuuacaguguucugguuucuuucuuuccuuuugaagaauacacagcugacuuagggaagauggauuuuuuucugaauucaguauacuggggucuucccuaugauugcaaaaggcaagcauaacuuuuugauagacuugccuucguaguuuuuugauuuucaaugcuguucuaguuaaaaugcuauucuuaauuuucuucaucuaugucugcaauauauuguaauagaacuuucaugucaguuuuaaagcuuaaguuugcugaacuaaguaaaaaaccagaugcauacgaaacucuggagacuugcauucuuauuacugggcauguugucuucaggcugugcuauaagcacaaugucuuugaggcuucuuguaguuggccuugcauauuguaauauuauuaauucuggaaauuuauggugauuuuguaggaaauaauucauaaaaggaaaucuuguuuuauauauauuuuuuaauuuguggaccauauaaaguguaaaaucuugcuguauuuuagcuaacgguuacuaugccauauguuuugcugggguugguacaugaugucauucucucauucacaguaugucucuugcuucuccccuuuccuccaugggcugcacaggcauuggaggaaagaauauucccuauuggagauagcaagcaaagcagcucucauauacaugguuguagaauccuuuauuauagaaaggcaaaggcacucaaagaaagagaucuuugauggcaaauguuuuuuuguuaaggugauaugaauugaggaugaugauuagagagaagcugaauuuuucaauauggaucacauuuuuccauagcaaccauaacauggguagguagguucucagaccagcuccuagaagcauacuuagcucacagcguguugaaaguugaguacuuaagugauuguguauucaguacaguuguauuaauuuccucacauggccuacugguauaaguaauguguuccuaaauguuuuugaaaguuuaaaucugaaagucaaauaucagauuuaccuaaauaggaaaguuaagacaguauaacaucuaguuauggcuuugcaggugcuguuauccaugagccuaggggagcugguagaguggugaggcuccucacaguuacuuaagagggaacagagugaaggggcuaagcuccuccgucacuucccaucuuucccuuuugcuuagauuccaugguugcugacaaagagacuuugcauuaaugggagauaacauuuaucuacauucucagaugaauagucauacauuuuuccugugugucuucucagaggagcuaggauucuucuagggugaaaaagaggagaagccaugaaaaggagagagaagacugaagauuggggaugaggguuugauguauacccuuugauaccugcaggcagaguuguggcaggagugcagggguaaagugagagugguggguggagaaaucuguuucuuucucuccucucuccuccucggacccauccagugggaaggaguagggccuaguaucaaggaguaguugcuaugagggcuaggacagggcaauaaaggauuauugguggaagauggaccaucccaacuaguaggaccuggaaaagagggaauauucuuucugaauggugccucagguaugauauguuuaggaaauugaugaccaaauauaugcuaucagauauucauuuugccugggagaauuuucuccuuuaguagccauguuacuuuucaaucacugagaagcauuuucuuggcuaucauauuuagccugcuaaaaacagugcauuaaauggaauaggcaucuugaauaauaagacaaaaauucauauuugccauuugaaaguauauuucuuucauaaaugcaguccuauaauaaaacgaaaucauuuuguaauauugauuuuacuuguuuuagauuugcuucaaaauauagagaagugggagaguggaugggauugagguugaggcaggaauggucauggugagucauuguuggggccaggugauggauagauggugauucauuauacuauaugcuuacuuuuuguauauuugaaauaaaccaauuaaaaguugaaaacauauuuuaugguuauucauuguggugcauuugauauuauuauaucacauuuaauaauguuugauugccucuucauuucuauaacaacugugaaauuugaaauaugaaaugagcuacuguaaacauaaucacuacauaagaagacagaaucuggcuuugaguaauaguaugaauugccaauauauuguuuuauuguacuuuauuucuuaauguuaacuugauaagcauauacuuaaagauuuuauaaaacucuagugcuggaaagaauaaucuauaaauucuaucuuaaaaaacccagcugauuaaauaaaauauucuguugaaauguaaaagaauuaacacaaucacuuuaugaauuaauaaauuuaguuuuuucuuuuacaaacacauuugguuaauuuuaauuuugcuuugaauuccuuguggauauaucacuuucucuuuuaauacuauacaguauuaguacauggaaaagugaaaggccuguuuuauauaugagaaaggugguauaugaagcugugaagaugucucaaauuuaaaaagaaagcauuuacacagaaugggagaaaauauuugcaaacuacccaucugacaagugauuaauaaccagaauauauaaagugcucaaacaacucaauaggaaaaaaaucaaauaaucuaaugaaaacaugaagaaaauaucugaauagacauuuuucaaaagaagacaaauggccaacagguauaugaaaaaauguucagcaaaauuaaucaucagaaaaaaaugcaaaucaaaacuacagugagauaucaucucacccuaguuaaaauggcuucuauccaaaagacggaauaacgaaugcuggagaggauguggagaaaggggaaugcuuguacacuguuggugggaaugcaaauuaguacagccucuuuggguaaugguauggugguuacucaaaagacugaagauagagcuagcaauuccacuguagauauauaccccagugaaaggaaaucaguauauugaagagauaucugcacucccauguuuauugcagcacuauucacaauagccaauauuuggaaucaaccuaaguguccaucaaugagagaauggguaaagguaauuuucuuaagugaaguaagccaggcacagcugcacaaauuucacaugugcucacuuauauauggaagcuaaaauuaaaacuauuaaacucaugaagauagagaauagaaugaugguuaccagaggcugggaaggguagcggggagggggugaauaaaaugggauaguuaauagguguaaaaauauaguuauaaugaauacgaucuauuauuugauagcacaacagggugacuauagucaacauaacuuauuguauauuuaaaaauaaaagaauagaauuggaauguuucuaacacaaaugauagaugcuugaggugauagguaccccaauuacccugaugugauuauuacacauugcaugccuauauugaaacaucacauguacccgaaaaauacauaacaccuauuauguacccauaauaauaaaaauuaugaaaagguauauaagcuucugcauucucuugggagcuugggucuuuauucugaaggcuccccuauauacauguuaauuaauuuguaugucuuuucucuaauuaaaaauaauuaaaaagauuuaaaauauaacuuacucuuuaaguuuaaugaauauaucuacaacacugaauuguuuagaauucuaaauuaugaagaugaacuuacauaucaccucgaaacacuauuuguuuuuccucuuaauagucucauuuaaaucaucaugguauuuuauuucuauuuuaggagauccuaagaaaaagcuuauauguucagugugcaauaaaaaguguucuucagcaucaagccuacaggaacauagaaaggucaguaagauaaaaauucaucacaguuuaauaucuaucuuuaauaauuuuaauauguuuuauaguaaguauaaaaguuaccaaguuauuuugaugugaaaagauaaucugaaaaaucaauggcaauuauuaacucuaacaacauuagcaacuauuuaauauaauuuguaauaaaauagaauuaauggaguuuuaauuuuugcucuuguuaugacaagguccaauauauucauacuauauuuuauuauuauaacaaagauguaaaugaucauuguuaauuucacauauuguuucuuuuagcauagcuaugagcaugagauauuuucuuuacaaaagagaaggagaugguauucgugaaaauaaaauuuuacuuuuguuaugguuuguaaaaugaauuuuuguuucuguuuauauauagauguauuacaaaguaauuugacaggacuuaaaauuuauaugauuuuuaauccaguagcuccaaccaugugcuguggguuuaacuuauaacaugugaggcagcuaaauuauuguguugauaugucugagguuauaucuuguauguuuagugauuuugauacuuaaggagaaauaauaggacaagcaccagaccaggaaucaggguaguggguuucuuuuucuaucacuaaccuuccauguaacauuaggccuuucuucucccauuuauaaaaugggacacugaauugaucaguauucucuuguuuguuuguucucuauguaccaugaaacuacuuuuuuuuuuugguuuucaguuuucaaguggcagucuuauuagauuguuuagagauauggaaugcuuuaugaauuuguguguccuccuugugcagaggccaugcuaaucuucuuuguuacauuccaauuucggugcugcuaaaaugagcacugagauuacuuuuaaaggaaaaauuuuaugcagaaugccaauccagaggacccuuuuauaggucuuuuuuccuccuucccccucacccuuauggcuucugaagcagaacccuuauggcugaagcaguucaucuucugcagagacaaaacaauuaagucuacuggaauagaucucuucuaagcauccucuuuuauaauucuaugauuuauuuuucugacccauuuaaaucuuagagguugaaauuuaagcuauuuuaccaaauagagcaaugguucccaaccuucuugguacuagggaccguuuuccuggaagacaaguuuuccaaggaccagggggugggggaggagguuuuaggaugauucaagcacauuacauuuauuguguacuuuauuucuauuauuauuacauuaaaauguauaaugaaauauuuauaaaacucaccauaauauagaaucagugagagcccugagccuguucucuuguagcuagacagucccaucugggggugaugggagacagugacagaucaucaggcaucagacacuccuaugugaugguaauggaauacagaaacuauaacucaugccuccugaguggucuuugcagaauguuaauaaguugcuagcucaaugcagcccuuccuccauuucagccauaguccuucacuauucagccuuuccgaauccauagucaacuuuuauugacuccaauuggaacuuuuccuauaguugagaaugucuaaugucuaauagaguuagguugcaguauuucaccuugccaguagaugaugcuauaugacaaugccaaauuauacuauagucuaguaucuuaaauuacuauuuauuaucuccuauaaugauaagguauauuaugauucuucuugaaaauaauuugggaguucaaauuuuaaaauauuacccuccaaauuaauuugguacacuguaaauuuuauaaaaucucauaaaaauauacuuuauuuagcauuuggcauaauuaaauaguauuacuugucauuuucacuuuaaauaugaucuuuuuauuaagcauuuuuuuguuuuuuuuaaaaguauuuuuuuauuauacuuuaaguucuagggaacaugugcacaacgugcagguuuguuacauagguauacaugggccauguuguugugcugcacccauugacuugucauuuacauuagguauaucuccuaaugcuaucccuccccccuccccucaccccacgacaggcccuggugugugauguuccccacccuguguccaaguguucucauuuuucaguucccaccuaugagugagaacaugcaguguuuggcuuuuuguccuugcgauaaugagaggugacagugugcuggcagcccucgcagccuucgcuccaucuugaugccuccucggcccuuggcgcccgcucuggccaugcuugaggagccuuucagcccacugcugcacugugggagcccccuucugggcuggacaaggccggagccggcucccucagcuugccaggagguguggagggagagggccaggcgggaaccggggcugccugcggcgcuugcgggccagcgugaguuccaggugggcgugggcuaggugggccccucacuugaagcagccggccagcccgcaaacccugggcagugagggacuuagcaccugggccagcagcugcugugcucaauuucucacagggccuuagcuaccucccuguaggggagggcacgggaccugcagcccaccgugccugagccuccccauugccgugggcuccugugcagcccgagccucucaggaggagugccucccccugcuccauggugccuggucccaucgaccacccaagggcugaggagugugggcacacagcgcgggacuggcaggcagcuccaccugugaccccaguguaggauccacugggugaagccagcugggcuccugagucugguggggacuuggagaaccuuuaugucuagcuaagggauuguaaauacaccaauugguacucuguaucuaguucaagguuuauaaacacaccaaucagcacccugugucuagcucaggguuugugaaugcaccaaucaacacucuguaucuagcuaauggggacguggagaacuuuuguguccacacucuguaucuagcuaaucuaguggggagguggagaacuguugucucuagcucagggauugugaaugcaccaaucagcacccugucaaaacggaccaaucagcucucuguaaaauggaccaaucagcaggauguggguagggccagauaagagaauaaaagcaggcugccccagccagcaguggcaacccgcucagguccccuuccacacuguggaagcuuuguucuuuugcucuuugcaauaagucuugcugcugcucacucuuuggguccacacugccuuuaugagcuguaacacucacugcaaaggucugcagcuucucuccugaggccagugagaccgugaacccaccgggaggagcaaacaacuccagaugugccgccuuuaagaacuguaacacucaccgcgaaggucugcagcuucacuucugaagccagcgagaccaugaacccaccagaaggaagaaacuccaaacacaucugaaccucagaaggaacaaacuccggacacaccaccuuuaagaacuguaacacucaccgugaaagucugcagcuucacuccugaagccagcgagaccaugaacccaccagaaggaagaaacuccaaacacauccgaaccucagaaggaacaaacuccggacacaccgccuuuaagaacuguaacacucacugugagggucugcggcuucauucuugaagucagugagaccaagaacccaccaauuccggacacauaguuugcugacagugaugguuuccagcuucauccaugucccuacaaaggacaugaacucauccuuuuuuaugggcuguguaguauuccaugguguaugugugccacauuuucuuaauccagucugucauugauggacauuuggguugguuccaugucuuugcuauugugaauaguguugcaauaaacauacgugugcaugugucuuuauagcagcaugauuuauauuccuuuggguauaacccaguaaugguauauacccauauauggcugggucaaaugguauuucuaguucuagcucccggaggaaucacuacacugucuuccacaaugguugaacuaauuuacagucccaccaacagugugaaaguguuccuauuucuccacauccucuccagcaccuguuguucucugacuuuuuagugauugccauucuaacuggugugagaugguaucucauugugguugugauuugcauuucucugauggccagugaugaugagcauuuuuucaugugucuguuggcuacauaaaucucuucuuuugagaagugucuguuauguccuucacccacuuuuugaugggguuguuuguuuuuuuucuuguaacuuuguuugaauucuuuguagauucuggauauuagcccuuugucagaugaguagauugcaaaaauuuucucccauucuguagguugccuguucgcucugaugguaguuucuuuugcugugcagaagcucuuuaguuuaauuagaucccauuugucaauuuuggcuuuuguugccauugcuuuugguguuuuagagaugaaguccuugcccaugccuauguccugaaugguauugucuagguuuucuucuaggguuuuuaugguuuuaggucuaacauuuaagucuuuaauccaucuugaauuaauuuuuguauaggguguaaggaagggauccaguuucagcuuucuaccuauggcuagccaguuuucccagcaccauuuauuaaauagggaauccuuuccccauuucuugucuuugucagguuugucaaaaaucagaugguuguagaugugugguauuauuucugaggccucuguucuguuccauuggucuauagaucuguuuuuguaccagugccaugcuguuuugguuacuguagccuuguaguauaguuugaagucagguagggugaugccuccagcuuuguucuuuuugcuuagcauugucuuggcaaugugggcuuuguuuuaguuccauaggaacuuucacguaguuuuuuccaauucugugaagaaagucauuaguagcuugauagggauggcauugaaucuagaaauuaccuugggcaguauggccauuuucacaauauugauucuuccuauccgugagcauggaacguucuuccauuuguuuguguccucuuuuauuucacugagcagugguuugugcuucuccuugaagagguccuucacaucccuuguaaguuggauuccuagguauuuuauucucuuugaagcaauugugaaugggaguucacucaugauuuggcucucuguuuuucuguuauugguguauaagaaugcuugugauuuuugcacuuugauuuuguauccugagacugcugaaguugcuuauuagcuuaaggagauuuuggacugagaugaugggguuuucuagauauacagucaugucaucugcaaacggacaauuugacuuccucuuuuccuaauugaauacccuuuauuuuuuucuccugccugauugcccuggccagaauuuccaacacuauguugaauaggaguggugagagagggcaucccugucuuaugccaauuuacaaagggaaugcuuccaguuuuugcccacucaguaugauauuggcuguguguuuaucauaaguagcucuuauuauuuugagauaugucccaucaguaccuaguuuauugagaguuuuuagcaugaagggcuauugaauuuugucaaaggccuuuucuguaucuauugagauaaucaugcgguuuuugucuuugauucuguuuauauacuggauuacauuuuuugauuuguguauguugaaccagacuugcaucccaggaaugaagcccacuugaucaugguggauaagcuuuuugaugugcugcuggauuugauuugccaguauuuuaucgaggauuuuugcaucgauguucuucagggauauugguccaaaauucucuuuuuuuauucugucucugccaggcuuucguaucaggaugaugcuggccucacaaaaugaguuagggaggauucccucuuuuucuauugauuggaauaguuucagaagaaaugguaccagcuccuccuuguaccucugguagaauucggcugugaauccgucuggucuuggacuuuuuuugguugguaggcuauuaauuauugccucaauuucagagccuguuauuggucuauucagggauucaccuuuuuccugcuuuagucuugggaggguguaugugucgaggaauguauccauuucuucuagauuuucuaguuuauuugcguagaggcguugauaguauuaucugaugguaguucguauuucugugggauugguggugauauccccuuuaucauuuuugauugcaucuauuugauucuucucucuuuucuucuuuauuagucuugcuagcggucuauuaauuuuguugaucuucucaaaaaaccagcuccuggauucauugauuuuuugaaggguuuuuugugucucuguuuccuccaguucugcucuggucuuaguuauuucuugccuucugcuagcuuuuggauguguuuguucuugcuucucuaguucuuuuaauugugaaguuagggugucaauuuuagaucuuuccugcuuucucuugugggcauuuaaugcuauaaauuucccucuacacacuacuuuaaaugugucccagagauucugguauguugugucuuuguucucuuugguuucaaagaacaucuuuauuucugccuucauuuuguuauguacccaguaaucauucaggagcagguuguucaguuuccauguaguugagugguuuugagugaguuucuuaaugcugaguucuaguuugauugcacugugaucugauagauaguuuguuauaauuucuguucuuuuacauuugcugaggagugcuuuacuuccaacuauguggucaauuuuggaauaagugcaauguggugcugagaagaauguauguucuguugauuugggguggagaguucuguagaugucuauuaggucugcuuggugcagagcugaguucaauuccuggauauccuuuuuaacuucugucucauugaucugucuaauguugucaguuggguguuaaagucuccaauuauuauugugugggagucuaaaucucuuuguaggucucuaagaacuugcuuuaugaaacugggugcuccuguauugggugcauauauauuuaggauaguuagcucuucuuguugaauugaucccuuuaucguuauguaauggcuuucuuuuucucuuuugaucuuuguugguuuaaagucuguuuuaucagagacuaggauugcaacccugccuuuuuguuuuccauuugcuugguagaucuuccuccaucccuuuauuuugagccuauuugugacucugcacgugagaugggucuccugaauacugcacacugauggguguugacucucuauccaauuugccagucugugucuuuuaauuggagcauuuagcccauuuacauuuaagguuaauauuguuaugugugaauuugauccuaucauuaugauguuagcuugcuauuuugcucguuaguugaugcaguuucuuccuagcaucgauggucuuuacaauuuggcauguuuuugcaguggcugguacugguuguuccuuuccauguucagugcuuccuucaggagcucuuguagggcaggccugguggugacaaaaucucagcauuuucuugucuguaaaguauuuuauuucuccuucaccuaugaagcuuaguuuggcuggauaugaaaugcuggguugaaaauucuuuucuuuaaaauguuggauauuggcccucacucucuucuggcuuguggaguuucugccaagagauccacuguuagucugaugggcuuuccuuucuggguaacccgaccuuucucucuggcugcccuuaacauuuuuuccuucauuucaacuuuggugaaucuuacgauuaugugucuuggaguugcucuucuugaggaguaucuuuguggugugucuguauuuccugaauuugaauguuggccugccuugcuagguuggguaaguucuccuggauaauauccugcagaguguuuuccgucuuggucccauucucccugucacuuucagguacaacaaucagauguagauuuugucuuuucauguagucccauauuucuuggaggcuucguucguuucuuuuuauucuuuuuucucuaaacuuuccuucucgcuucauuucauccauuugaucuucaaucacugauacccuuucuuccagcugaucgaaucagcuaccgaagcuugugcauuugucauguaguucuugugccaugguuuucugcuccaucaggucauuuaaggacuucccuacacugcuuauucuaguuagccauucgucuaaucuuuuuucaagguuuuuagcuucucugcgauggguuugaacuucuuccuuuagcucggagaaguuugaucgucugaagccuucuucucucaacucgucaaagucauucuccauccagcuuuguucuguugcuggcaaggagcugcguuccuuuggagggggagaagcgcucugauuuuuaaaauuuucagcuuuucugcucugcuuuuuuccccaucuuuguaguuuuaucuaccuuuggucuuugaugauggugacguacagaugggguuuugguguggauauccuuucugucuguuaguuuuccuucuaacaguuaggacccucaacugcaggucuguuggaguuugcuggagguccacuccagacccucuuugccuggguaucagcagcagaggcugcacaacagcgaauauugcugaauagcaaauguugcugccugaucauuccucuggaaguuucgucucagagggguaccuggccauguggggugucagucugccccuauuggcggaugccucccaguuaggcuacuugggagucaggcacccacuguccugcacccacuguacgacaagccucagugagaugaacccgguaccucaguuggaaaugcagaaaucacccaucuucugcgucgcucacacugggagcuguggacuggagcuguuccuauucagcgaucuuggaacugcccucuuuauuaagcauuuuaaggaauuuugaacauggcuuuagcuugaauuuuucacuauaaaugagauagucaaugcacaaaugcuuaaauauauagucgauguucccuuuauaguuuugggaauaucaguucaauucaaccuugaaaaauguuucauguugaagccaugagaauuaacaagugaacaauauuucacuuaaaaaugaaacaaaugaacaauguuucauuuaacgauuuccauuuuauauguggaugaauaauuuuuauaauuuuauauaucaauagaaauuaaacauuaaaaaugauaacaaaaguuuucauuuauguauaacucagaagguaugacaucucuuuagaguaucuuguuugucauuauaaaauuauauauauuacagaaacauagaguuuaagaauauaaaucugcucuuacuaucuuuauauaaacauuacaaaucauaucauugguccucaaacauagguguuuaacugaagccgcuguggaagucuuugaugauugaagaggcugccuuuaacaugccucaggcuggaaguuuuucuugucugcucuggagcacuagcauuccaaacacuugugcaggcagucauacagaucccacaugcuuucuaaaggaacucuuuggauucuagauauccccucauagaugccauugcaucuaagcggggagauaagucagacucuuguggaaugacauauuuuggcuucugccuuguuucucuacuuuuucccugcuuuacauaacugaauuuaaugacucaccaagagucagaccugacagaagcagaggcugguuggcaaccuucaaacugccacgugcuugggcauugaauuaagccgugggcugcaggccugggaucugucagccuugccccugcaucuguuucccugccuugaagccuucuauggccauuuagaucaagagaaccauuuaucaggggccagccgaguccuccacucauuacucaugugcuguaccaguucagggacuuuugccuagaucuuucacucugcacuguuauuccuaguuauucugcagggacacugucuuggcuucuugcacaagggcguuuacuucucugggguuuaguauugugagcuggaccuuuagugagguugaaacaaaaacaugacuucaccacaaccauuuuugaauauucaacaacauugugugaugcuguuguucauugggaugaucaacauuucuaauauaauaugauauguaauacauuucuuuuagaauugaauacauuguuucugaaaaccuagacuuuuacuuuucauaccaccuauccaguuucucuguguuagugucugggagggaaauaacuaauuuaauauucaguuuuaauauuuauauuagccaauuguuuacugaaguuauauccccccuuauuguauuuuuuaaauacauuuuauucuguauauuuaaguuauacaacauaaugugaugagauacacauauaguuaaaugauuauuuuagugaaauaaauuaaugcauccauuaucucacauaguuacccauuuuuccuccuguggcaagagcaacuauaaucuacucacuuagcaaaaauccagaauauaauacgcuauuaucaauuguaaucuucguguuauacauuagaucuuuagaguuauucauccugcauaccugcuacuuuggauccuuugacuagauuuccucauuuuaaaaguugugauccuccugucaugugagacuuuuuuuuuuuuuuuugagaccgagucucacucugucacccaugcugaaaugcaauaguaugaacacagcucacugaagccucgacuucccagguucaaacaaucauccugcuucagccuccuuuguagcugggaccacagacguaugucaucacaccuggcuaauuuuuaaaauuuuuuguagggacgaggucucacuuuguuguccaggcugaucucgaacuccugggcucaagcaauccucuugccuuggccucccaaagugcugggauuacaaaugugagccacugcaucuggcucaugugaaacuucuauugugaacuaaaugcuuuucagaauccuguaacuucugaucuuuuacuguaauuaauguugcacucucuacuauguacauuuaaguuuaaaauauuguuggcuacuguaaagggaauauuauuaacugcaugcuacauauuuccaagucuaaauuugugcauaacagaagaguuacuauauauuagguguaauuuuuuacagaguauaaauuuaauauguacuaaauaggacagcuguauuacauuuuuaaggacugugaguauuaugucucaaaagauauuuuuuacuacauaacuuauguccacugcauuuucaguguauauagguuagugugaacaaauuagggcugaauuguaauauauaguuuggguauugcaguggcagcuguucacauguuuacacuuuugcuugagagcuguguaauuuacuaggcuuugacaguugauuuaacugucuauuuaaccuuuugcagauucaugagauauuugauugucaagaauguaugaagaaauuuauuucagcuaaucagcuaaaacgucauaugaucacccacucagguaaacuauauacuuuuuuuguuuauagugauaucauuacaaaaaaauuacauugucacuuuuuauaaacucuaagagugguaaucaggggccuuagcuaugaauucugcuuuggaccuuuaguagucaugugauucugaacaaguuauuuaauucuuuaguccucaguuuauuuacagagcaaaggugcuuagaguaaaugauauugaagaucuucagaaucaccauguaauuugucacuuacuccuccuugagccucaguuucuuuauucuucauuugugaaaugggauacuggugccuaccuuucaaauuagcugcaaagauuaaaugagaucauuuagguacugugcuagcauagugucugacauuuaguagauauucaaaaauuauaauucuugcauuuuuagauacuuuuauauucuagcuaaguuacuaauacauguuaguaagaaaucuauaaauacauuuugaguauguaaguuuuuaaagcgguaguuucauuuaagcaagucuuaugaauagcucuguuuuacuaaugcagauuaaaaaaauaagcucugaaaauaguuuuuacuuuauggagucucuagaguuuaagauaucuguaauuugaggcgauugaagucagaauguuuuugaauaugcaaguuguugauacauaugaauauuuuaguaaauuaaaaucagaucaaaaccuguuaucuuuuagguaugcuuuauuugauacauauuauauauuuuuuauuuaggugucaauguuauauggauauugcauaaauacgaauuuuacauaccaguguaaauaucugguuccugccgagcauuggaagcucugccuccaugaggccuuuguggcccugggggaaggcagcucuguucuuugucuccaucucugucaggucacuuucuguauuuggggcccugacccugauuuaaacugucacauaucagcaugguuuucaucuggaaauaggaguccuuccuugaauguaaaccuuuucuuuauaucuaagcuacuuuaaaaauucaaaauacgucuguaagagaacaagcucauauuucauuuaggaguagacacauuuaugugucuauuauguggaugguagauguuuuuuaguuguuugaccauccuuuaguuuucuuaccguaagaaguaauauaagguaaggguguuuucucuuuuauccuuuaccuuuauauagauaugagauugucuccacucauuuuuuuaauagaaaaacgacccuauaauugcgagauuuguaauaagucuuucaagaggcuugaucaagugggugcucacaaaguaauacacagcgaagacaaaccuuacaaaugcaaacuuuguggaaagggauuugcccacagaaauguuuacaagaaucauaagaagguaaaacuuauuaauauuauuauuauuuuuuaugaauuugcugcugugauuuucaauuuuuauuuuugauaaagcuuuuguacaucuggggccuacuguauauaaugcaacaacuagagaagaucacucaccugggccauaaccccucacagccuccuuccugucuuccauucucuuuugaaacuguccuuauaagcagagugccuaguuuuucuuaacaccgcuauuagauuaauuuuaugggguuuacuaauugugaagucuuuauucucuuccuucuuuccauaaacuuugauguuuuuauuuacguuagcuuuuugaaauucucuucauccuugggauccuuguaguaugcucugcuaggucuucugccaauuucucugaacauuuuugacuuccuuuccccucaggagguuauucuggauccuuugccugugaaccucuucuguguucucucuccuuaagaaaugucaacuacauccaugacuucugcuaucaacaccauacugaugaauuccaaaugauuuauuuucuuuaaucccaaguuucagacucacauuuauaacugggcaucuuuucgacauaaugaauucagcaugccccagaaugguuuuuucauucucuuugcccaagauagcuucucuuuuggaguuuccucuuugucuuaaugacaaaagcauguaauuauccuagucucuuuauucaguauuggucccuuuauaaaauuagaagccaaauauaaagacucuacccuuuacauuaucucaucacuuucacagucaucccuuccuuuaccauuccaacauccugauuauuucuccccuggauuccuuuaauacucaucuaauuaggcuuaucacuuccugcugcaauccauccuacaaggcaaaucaucccaaagcaucacucugguauaucacucucauacucuaauauuaaaaguagauugccagugucuacauauguaauaguauauacaccuucaccugucauucagaguucucuacaucaugaccucagccuacuucuccagcuuuuuauccuuuuaucugcauuaaccauaccuaaaacaacuaaauauuugccugccuucugugugaccucucuaccuucuucuuucucuucaaguuauuaauauaguguccuaguuucuucuguugauuuugguuugcauuucuuauacuuuaccuuugcucaaguucuuguuucagaauguaucauguagauaauacaucaugcuugaauugaauucaggaaauugguccaaagauauucaacaucuuagaaaugcauguaaaaacauuuucaugagauacaaaauacuugcuuauugauuuuaguugauguauuauagcaugcuguuaaauaacauguauaugaucuuuuaaaaauaauuuuucaguuauuauacuccauggggauuauaauuauuauaauauuuaugggauacuuccaaagacuucauuuuaucucuuuugaaaucauuuaaaaauuaugauaccaauuucaacuuuaguccaaaaagagaaagaaaaaggcagauuuaccaaagaauaaacaguguugauuauagugucuuaaaucgucucugccuaauuucuuccuuaccaucuuuauguuuaccucaagcauuguacauucggggcaggacugcguucauuacugcugcuuuggaauuacgugacuguaaaaaauuaucuggcuaguuccuguuuagucucuggaacccucuuauuccuuucucugaugaaacugaucuauccacauuuaugaguuuuucacaguuuggcucauguuauaugccauaugggaauuuggcacaggaucuuugcaccaucucucauacuuuaagccauaaaucauauaaaaguaauaaugaugucuugggaagcauagaaacaaugaugcuuguaauuuccaaacuggaaagcaacacucaauccuucugcacuagacaaauguauuucuuacuguguuaugauccuagcauauauuuggcauuguuacaugaaaauaccugaaauauucuccaagaaucauguaaaaacagaagaucaaccuuuucuuccaucacaaucauuaauggcuaguugagaaacauagaaguaaggauaugccacagaaauuagaaaaaaacguuaagagucagugugaucuuuaucuuuuaguaugcucaaggguuauuacuuuuaauuaauuauucuuuuguuuuuugagaauauaauauauacauuuuuauuauacuuauuugaguuauuuuggguugguucuuaacauuuagacuugcuugaaaaauagaauauuauuuuucauugugauuaugauagcauauacagaaauuauuuuuauuuuuugaaauagagucucacucugucacucaggcuagagugcaguggcgcaaucuuggcucacuguaaucucugccucccagguucaagugauucuugugucucagccuuccaaguagcugggacuacaggcaugugccaccaugccuggcuaauuuuuguauuuuuaauagagacaggguuucacccuauuggccaggcuggucuagaacuccugaccucaagcaaucugccuaccucggccucccaaagugcugggauuacaggugagagacacggugccuggccagcauauagagaaauuuuaaagggguguuuuuuuuuuuuuuugaaaauuuaguuacucauuuauuucaucaucuugccaguuauauggguucaauagguuacuuuuucuucuucauuuuuucugacaaucauuugaucugaauuacaguuguauuuuaggaucuagcuaaaaaaucucauuuaucucaauucaaauauacuucgauucuuuaaaucacaauugaaccaguguuucagagccagaggagacagaaaccguucaauuacucuucacccuccauuguguucccugucauauauaaugcaaagcaaaauuuggguaaguuguacagugcuucccuccuccugcuguaggauacauguuuagauguagugaaccaucuuggauccuagagcuggcaccacuuacuugcugauggaagugaguauggagggguuuugcccucaugaauuuacaaacaaacuccuaggggacaggugugugccuauucaaaaaaagaaucuuuuuuccugacccuuuacuuagccuuccagggaugaaacuuuagaggcuuaugaggaaaucuagucacaacuucuccuggaauaauuccauugggccuuaaugucucaucaagucuuuuucaaauucugggccaugacugcuguguaggucuugaaaucaauuuacugagugaugacuggccauuaaaaaauagaauagaaggcugggugugguggcucaugccuguaaucccagcacuuugggaggaugagguggguggauccgcugagguccggaguucaagaccagccuggccaacauggcaaaaugccaucucuacuaaaaauacaaaaaaauuagccggguguuguggcgcacgccuguagucccagcuacucaggaggcugaggcaggagaaucacuugaacccgggagguggagguugcagugagccaagauugugcuacugcacuccagccugagcaacagagcgaaacuccgucuuaaaaaaaaaaaaaaaguagaauauaaaauauagaguaaagggucauucaauaagauaauacauguauuuguguguauuuguauguguguguguguguguguguguguguguguguguguguguguguuagauuuuggagucagaauuauuuauuuggucauagccaaacaauuuaaaaggcaauacaguucacucuuugccugguauaaauuuuauuagaccuuaaagacaguaacaaguuucuaaaaauaucauggauuagaaucuaaaaccaaaacauaugguguaaguuuaacauaguaaaaaaaaaaguucuugaaaauuuccuggaaagaugucaucuuggagacugagugauguucacucaacaguuagagcacagccacucuuuccuuuagcuuuugcaucagguuacucuucagugaugcugcaggagagguaguacccauucauuuaagguguugcuauauuguacaaaaucaccuaucuuuguaugcuagaagcacguucacaaugagcugcacacauuaugagggacaugcaggauuugaaucugacagaaggaaccacagauacaggucauuaucuaaauacuuagcuaauggcaaauugcuugccuuauuuuaauuguucuuucucuuaaguggaugaugagauagcaauguacaauuucaaacaauauuuuuuacuuauuuuuuuauuuauugaagcauaaugacaagugaaauuuguguauguuuaugguguacaauguaauguuuauauguauacacacacacacacauugugaaaugauuaccaccuaauuaauguauucauuacucacacguuaucuuuuuuuguagugaaaauauccaaaaucuacucuguuaauuuuaaguguucucaccacacaaaaaggauaagcaugugaaauaauggauauguuaauuagcuugauuuagccauuucacuaaacaugucauacaccauauagauacaauuuuuauuugucaauuaaaauaauuaaauacaaugaagaucuacuuucuuagcaaucuucaaguacaauacauuauuacuaaauguagccacaaggcuauacuacagugguccccagcuuucuugaugccagggaccaguuucauggaagacaguuuuuccauggaccaguguugggcaggggaugguuuugggaugauucaagugcaucauauuuauuaugcacuuuauuucuauuauuauuacauuguaaaauauaaugaaauaauuauacaacucaccauaauguagaaucagugggagcccucagcuuguuuuccuacaacuagauggucccaucuaggggugaugagagacagugacagaucaucaggcauuagauucucauaaggagcaugcaaccuagaucccuugugugugcaguucacaauaggauucacccuccugugagaaucuaaugccgccacugaucucacaggagguggggcucaggcgguaaugugagugauggggaguggcuguaaauacagaugaagcuucacucacuugcccgccacucaccuccugcuguguggccugguuucuaacaggcuacgggcugauauugugggguuggauaauccugcuguagcaggguuggggacccccugcuguaguauacaucucuagaacuuacuuauccuguguaacugaaacuuuguaucccuugaccaacaucuucccauuccucccuuccccugccccuuuaccucuaccccuaguuccuggcaaccaccguucuacccucugcuucuguguguucagccuuuuuagauuccacauguaagugagaucaugcaguauuugucuuucugugccugguuuauuucacuuaucauaauguccuccauguucauuaauguugccaaaaaugacaggauuucuuucuuuuuuaaggcugaauaguauuacauugugucuauauaccacauuuucuuuauccauucaucugucaauggcuucuuagguuguuuuuauauccuggcuuuuacgcaaugaaccugagaguguaggugucucuuugacaaacugauuucacuuucuuugaagauguacccggaagugggacugcuggaucauaugguaguccuauuuuuaacuuuuucagaaacuuccauacuguuuucuacaauggauaugcuaauuuacauuucaaccaacaguauacagggguuccaauaguucuugcuguuuuaguagauaucuuaugaaaauaacuuuaaaaucguacaugcaugucugguagucaguuuuggagcucgaguugugaaccuucccaacagcuaccuucuccugccugucaugguuucagucuccgcaccaguggagugacuuucuucaauauaguaaaaacuguacucauuauuuguacaaauuauuuguuaauuauuaccacaugugccaauauauaugaaggccaaugauccuaacuggaggauauuuuguagacugaggaaaacacaauuuuuaucuuuauuauaaugccuuugacauacuuucggucacaguuuguaauggguuugcacauagaagauuagagaugagauggugggugucuucaguuuaagcugcuauaacaaaauaccuugggcugggugguuuaaacaacaaacaguuauuucucacaguucuggaggcuggauaauguaagaucaaggugcuggcaaaucugguaucuagugagggcccacuuccugguuugcagaugacugucuucuuguauccucacaugagggagaaagagggagugcaagcucuccuaucucuuuugauaacggcacuaauccaguucacaaagcguccacccuuagaaccuaauuacuuccuagaggucccaacuccuaauaccaucacauuggggguuaagacgcaaccuaugaauuuuggucggacacaaacauugaguccauagcagugagaguugguggugguuggguggcagagccagggggugagggucagaauuggaaaaggugggcauuggaauggaaaagagagaaugagaugucacucaguguccugaggcugagaagagauuucaaaguauuagaucagacaggaaguuuucaagcgaaguauucuaccauagaaggcaccucuuucauaucucuuguaaaaucuuuaguaacauuugcauuucacacuaauguuuuuguguaagaggaaguucuuuuaggugaguuuggagaagaacagaguuccagcugcccaucugggagauaaguauauuuaaaaguaacuaguacuaugacacauauguaucauucaggaaccuacuucuuugccuuaacauaugauuugcagggauguuuauguuaguucauauaaaucuacucauuuuuuuuguaaccacugcuauuuugaacaauaaugcagugaacauccuuuuauauaaaacuuuaaaacuaugcuaagaguauuuuugugcauagaucucagguguggaauuucugggucaaauaggaagucuacuuuauguuuagauccuccuacccacugccuucugaaaagcucuacuuucucuuaacaguguauaaaaugccauuuuacucuucaccaauauuucauuuuguuagucuucuauuuucagucugagaauuaaaaagugauucucauuacauuuuaucagugaugaguaaaauuguauguguguuuuucuguuuuuuuguuuguuuguuuuugacaaggucuugcucuaucacccaggcuggagugcaguggcacgaucuccacucacugcagccuccaccuccaaggcucaagcagucuuccaccucagccucccgaguagugcacaccaccaugcuuggcuaaaucuaucuauccauccaacuguuuuuuuauuuaucuugccugacccaguauucaccaaauauuugaaauccuauuaccauuuuaguaucuguaaaaauucuacagauuuauguuauguagaaaacuauuugcuacucaggaacuggcuuuaauauuuauagaacgugauuuuuuucauaggacuaaaauugcucccuuguuguuugucucuuugaacuuuaggaaucuuuacguauuucuguauagaugguacauaaaucucaauuuaaaaaaauuaccaauuucuuuagccagccugccuagaaaacaaguuaucuacuagaggagcuaguauaguuacuaagaguuguuacauaugaguuauuaauauuaggcugccuauuuuuaugcagaaaauucuccuguacaauaacugugaugagugugaaaacuguaucuucaugagugaagcuacagguguauguuaucugguuauuucugugaagccacaugguugucauuuccaucuauuucaggagcuacauugcagaggagagaauacacuuguucagcacgcucuaaguuagcuguaauaaaugguagcuguuguaaaaaggcuuaacuuuucaguuaauggucaagucagccagccuaggaggucauguguuuguucaaagcaguguuugugagaagcguccuuaauuagagacaugaguuauggcucuuaccagugucguugaguggaagguuuccugacuuggaaucuuuguugcuaccuucuauaacuucaucugaaaaucugugguuauuucuucucuuagcaacuucccuuugcccuaaucaggauuguggggacucaguaguuggcucccuggcauuguggcuuuguacugauggaauuguggcuuugaagcagugggaagguuggacuuggcucugcaagacuauaguuauguaggaacaucaacuaaauuucaugcuuuuaacuucucuauguggagugagcuacccauuucucuacugagcuuaaaguaacugacuucuucaauaucuuuccaguuucaauuuauuuugugaggaggaguacuuuucaagaagucaguuauaaauuugacaguaaaaauuuaauccacagaccuuguaaacauccagaugacauguauuuuauguagcuuuagcuuuauuguguggcccacugggaugguaaugugcuaugacaugaaaccugagucuucaauaauaaaacucuauaaaaauaaucguucuagcaaacauaccucuggaauauuuucuccaaauuuguuuuaucuuuaguuguuucuucuaauuuuaagguaguuuuauugguuugcacauaccccaaagaagaaauaccauuaccaagaaauacuuuuaccauggaguaauauauauucuugauagucaguaguauaauuuuuaauuguaaaugguccuuaauuucauuuuauucucauggaauuaauauuugaucuguguggcuagaaauguauuaaucugguaauuaauguacauuacgccagaaaccuucugaagcauuuucgagacauucuaguagguguuauaaauagugcaacagauuuuauguauuuuuuauaucugcaaaagaguugguauauaaaaagauauguuucauaguacuuguucauggacuaguucauuuguuacauugggagauguuagugucaucagugacuuggcauacaaaugggauguucuacagaacaucauaggguuauuaaggaucauuugaucaauaaaucagugaaaagcuuggcauucauuagaggugaaagauugaaggacaaguaccuuuaaaaaagcuugauuucaucugauacuuguaaaauauaucuuggagacagaaguucucuauuugcaacaugcaagcaucuuacugugccuuacuuaaauuagguggcuucucaaugucuuccaguugauugaaugcauggguucucugccaucccaacccagauggugacauuggcauccuucuugacaaaaguauuuauucaccuggcuaugcacagacaucuuacuacuuaaaauaugucauuggcuuuaggccaauaucuagauguuguggcuuugguugaacauaguuaaaaggcauuaugcugucccagguucuuucauaauuaagcaacuuaagucauguuccuuaagucauguuaugucccaaauuuggaaagagaaaaaaugaauuagggaggaauauaguauuuuuagaagaugggagcaauccuguguuccaaccuggaugcucuaaaaacaaaauaguuucuaccuuuuuaugauaaugcugucuacuuauuguuuuguagaaaaucuaaguagcaaagaaagguauaaagaagaaagcaaacauucugucaaauaucacugucuuuccuuuaaaaacccuccucaauguuuuguagaaugucuuccuggacuccauucugugugcauauauguaugcggcuuaaaugguauucuuuauauuauguuuugcauucugcuuuugucaccuaaaguaugauaugcaugacuuuucauaucuaagaaaauaaauauagaauuauaauaucuacuacaguuuaguuaaccagguuuauaucuuuuuaugggcauuuaggaauuuuccuuuuauuuaaaaaaaaguaguuuuugcaaaaauuugucaguuguauuucuguaaagggaauugguuagucaagggaugugcacauuugucauuuugguacauagaaccacauuguuaugcagaaaauuuuuauucccaauuacaguaugugggauugccuguuuuuacucuuuagucaacacugaaugguauccaucaucuucaucuuuggcagucugauuaaucacagauaguaucuuuauuuuuaauuuuucauuccuuuaucauauucauggcuuuaaauauugauaccauauguaaucugacaucuccaucuuauaccuuauuauccagacuugaaauauucaaguaccuguagugcuagacaucucguaauauuuauuugaacuugccccaaauugaaccccugauguuuuacucagacuuguuucuugcugcucuucugcauaucuguuaguggcuaauccaucauugcauugcucagaucacaaaucuuggagucaugcuugccuccuucuuuuugugucucaugcuucauauccagguacuuucucaaaaccuguucacuuucagaagauauuuagaacucuacuacuucucuucacaucuguggcuaccaaccuggauaagcucuaauuaucucucuccugcugcauugcuguugcuucuccacuuuguguuuuccccuacauuuuguugucaacacagccaucaaggcauccuguuaaaugucaggugaauugugucccucaucugcucaaaauccugcagaaaguuacaucucucuuagaauaaaagacaaaauuccugcacuggccagucaggccguacacgauuugcuucuccuccucacuucucccauucuucugacugcaucucuccacuucucugcccauuucacauggcuccaaccacacuggcuuccgugauguuucuugacuaggucacccgaauacccacccuugcuccuucauauccaucagaucuuaucucauaggucaccuucucagcuagaauuuucuugaccaccuauuuaaaauugcuaccccauucucugaaauguuuguuaucuucuuucuugcuuuauuuuucuccaucacauuuaucccuuccuaauauaguacauacuuuuucauuuguuuauuguccuucuccucugcuaguguaaaagcuucgugauagcagggacauugucuuuugguucauggcuauaggcucagcaucuaaaauaggacuugcuaguagaggcaugaaacgcauagcguagaccuggcauaaaauaaaacgaugaaugaaauuuuaggagugcuauuuggaagggaguccuuuuguccauuuucaucuuuucuuauuaagaugccauaacuucuuauauuagcaacauuacacuucuguuuuauguugcagauauuuauuuugucaucaaagauuuuugcuuuggagcuuuaaguuuauuucugucauuucaaugucugguuuaccuugcuuggaaagccuuuccagacucaaaaguuauuuaaaaauuuacucggauuuucuucuaguacauuuaaaguguuauucuucauuuuaagaaaaauaccuaaauugauuugcaauuuaucuuauuguaggaggugagugguagauccaacauuacuuuugcccgaauaucuggacguuugccucaaagccauuuacuaaacuuucuacucuuuucccaccaauuuuaaaugccauauuucuccuguacuaaauguucauguauuuuauguaaugcaagagaccuacuuguuuuucuguuuuauugaucuauguauuuccaugcugucauuuuaauuucuuuggguaaauagcacauuagauuaucugugauuuauccugacuaaucuuaaauaucuguucuuucaugcuuucucuauaucuuucacaaauaaaaccaaacaugaaaaugucuuucucaccaacauuaugcuaauagauuaugcuuguauguuuaauauuaugucugcuaaacuaagaaaauauauaaauuaauaggcuauaaauaaagugacuuuucuuuaaauuacuuuuuuguuuuugucacauguauuauaaaaacccaucaguuaugauuuguuuuauguaauaugagauaauaguuuaauuuuugauuuuuuagcauuuaugagacuuauuaucaugccaucuauaguagaauaagauuuuauuuacugauuugugccgaauggguuuauacugguguguaauguaaaagagguggagugagcaguguuugcuguuuuguuuugguuuuguuuuugaauuuuagaucuaguuaguggcuuuucauuguuucuuguuugucaguauauuuuuguuucuuauguaccugggugcuuaauauuguuugggaaaucuaugcuguuugaccuucccaaguuaccgcaacuuuuugagccuuaguuuuaucauuuguaaacuggagucaguaauaguguuuuauuaauccaguuacuguuguaauuaagugaaaugauuuauguaaaguguuuagaauagcauuugacacaaauuaaauauuuaaugaauguuaauuaggguuaauuauaacaugaauaagugcucuaguguaauuuaggggaaaagcagcaccuaggacuagaauuauuugaacugauucagugaaguugagagaaaagggugaaaacaauuucucuuuuaauaauuucuuuuaucuguguugcaaauguuguaccagcagaguaaaagccuggccagugauaggggaggcuuaguuuucagagaaaguacgcacaguuucacuacaaaguaggcccugagaaaucucaguguguauucagauuagcaguuugagauaauaggaauauuuuuuuuuuacuauuuaucaaguuaauaauuacugugagcauucaaaaguuauuuuuccucuugcaaacacagcacauuugucuuuacaauuuuacgguggaagaauggcacuagaagaaacagauacuguccaccuucccuucuuuccucuuucgcaucaugaauccaagcuccacucguucauuguaaugacugguugauucuagauccuccugacucaguguuuuuccucugcagacccacucugaggagagaccguuccaaugugaagaauguaaagcuuuguuccggaccccauuuucuuuacagagacaccugcuaauacauaacaguaagucacgauucaggcaguugagaauauaaggaauuaucucauacuuuguuuuuauaaccuuugagaauguagacaucccagaggugugccuauaaguauuuauauaaucugacuguaaacauaagaaagaccgaaaauucugccuuucacuuuuuuucgcuuuauauuugcuuuauuuuuccacaguaauauuaauuauuuuaugagauauuuuauuuucuauaauuucuucccauuauuuaaaguuucuauauaaaagcauuuuccauauucaggaagacaucuuugaguuuuguuuugacacaugauuuuguuuccuuucaaauauaaugauuaagaaaacgugucagacucuuuaaaauaugcagauaucuggcaucguuuuaugagcucacaaacuuuucaaguuguaaaggaucagagugcacaucuaaucggacaccuuaauuugaggaggauacaaaauauugaggcuccaaagcaccaugacauacucaagauuucacagcgcaaggaguagcaaacaggucccugauaggugcuuuuccuacuuaccacugccugagauuucuucuuuugucagaggcaauuuuuuucuuuuggauuaauuuuauacauacacaccaugaggugcguuuccuacuugcuacugucucagauuucuucuuuuugcagucacauucuuuuucuuucugauuaaguuucauacauacgcaccaugaaagucuaacgccuacacuuagagcucuuuuuacaacaccacagaauguccaguuauaucacuaaaggauaucccuucauugagaagaacauguuauugccaagcugaguuuuaaaguggauucucuguuuagaugcugaaguagccagaaacuuacuacaguacuauaucuaaaauuaauggaaaaauuguguaccauggguaauauuuacacuucuuacuuuuaaguuaauuagcuuaaucaguagaaaauccucuauacacaugaaguuccuacugcugcuuaaacuuuuaauauuccugaggaaagaaaaaaguaauuaauuuugacaguugguuauacagaggcaguaucuuggagaauuuuccucuggucaaguguuuaaaaugccaaauaauaaagauacuaagauuucuuaaaauaaguauugagugguaaugauucugaugaaaugcaaucugcuuccuguaaaaaaaggcaguguuaugcucucaggucauucugcauucagcuuacaggucuaaagaaguuauuagcacaacuuaccaguuuucuuauuaaaaagaauuauguguuuaaaaauaaaauuuguugugcaauugcaggaauuucuauuauaguucauuaccaguuugauuuagaaaaauaacuguuaugagaugaaugaauguuagaauagagauuuggacaaguaaaccucauucauacuauugaaauauggcuaaauuugacuugaugcuugggaaauuuugcuugggaaugaugaaauuuuauuucuaauaacagcaaggaauucuuaacagaaguaaucuaccaccuuugcuuucaguuuuuuuguucucauucacuugagaaauaggauuaaagugacuauguguagacugugcuguggaguauguauuuaauaugauguugaucagcacauuaaucacaggcuuuaugaagaugcaucgugacauuuggccaggaaaaucaacuuugauaacugagugaguaaaugaguuauuuuagggaaauaaaguuagauaucaguuagugaaaagaaugggaaaaccagaaauggcuaaaauagggaggacaaaauacuacgucuuaugcaauaugaaaauuaaaacccauuuauuuaacuuuaaaauaugaaagcuguuguuagaaacuuacaucagcuuucuggcucaaaaugugaagaauaacuuguaaugauuuuggaaauuguugcuauuucccaauauguugaaaaccaaaaggcaaguugcuggcuagcuuguagguacuaagauagggaaaaaaucugauaaauuuaacacaaagaaaucugcaauuaaaguaugaaagaaggaagguaagaacuuccuugcuauagcuugaugagauuuuguacagggaccaacauuuuuauucacuugauaguuuaaugaaaaugcuuugauaggaacaaucuuagagguuuuuuuaaaaagaucucuuucaguaccugaaucgauuugauauuaacauuaauguuuacagucuuuuaucaauugauauuuccuuaugcuaucacugauuauacaacuuauacaaacagaauguuuaaauaaaacagaaaguauaaagauaguguauaagaauaauacucugcaacaaaaacacacaaaaaaccaagcucucagaauccacauaguucaugcauuguauggacgugacuuuguuucagacauuaaauuucaaaaggacucuaagagacuuuaaguuagagagggauaauucuauuuagaaagacaaagagaagguaauuuuucuuuuccuuuucuccuucuuuuugucccucccucccuuccuuccuuucuuccuuccuuucaugugaagaaauaauagagucuucauauuucuaaauuuagugcuaguuaugauggaaggaauuuagaagagcuuggcuaaaauugagauaaucucuuauuuagauauagaaauuuaauuauucuuaauuuugccuuguuaucaauaugauaugggaaucuauguuaauaugauuguuuucuaaaaagggaaauuauauucaaauacuagucugucuuauuuauauagucacauacuacauacauuuuauaccguauuguuauuaaacaucguguucucauugcacacauucauugcugaaauuguauuuaaaauggccacuaaaacuuaggcccauguguuaagaagaacuauaaaaauagcauuauaugaaaguuagaaaguaccauaagauuucuauauauguuuucugagguugcuuuccccucagccccaggcuggauaaugagaagaaagugaaauacccaggguggcuaauagucuugcuaucccaauuuaauuccucucugaaagaccccaucccucaaagccuuggagacuuuuuccaacugcccaagggcugaaucagggagccuccaguccaggaagcaggggcauuguaacuuucccucucccagaaugggagggccugagcucugaugcacacccucugcccucagaggcuuuccuccucagcucucuaccuacaauccaauucugccuauuaucuauucacaggagguuauagggaccguggugggauuugagggaacuuugggaggggcccaaaggcaacucaccuugcuugacagaggucuugugucacuggagucuauuuaccucaaaucccagcccccgcuguagaaguacauacuuuuaaaaaauguucaugguaacuuugagaauucugcuaauucaguccccacguuuuccaguugagaagacugaagauguaagaugaaaggacuucugccuagucacacagugaauuagcaaauaauggaacuggaauuuguuguaaaaaauaaaaaguuaacauucuuagagcuacaaagccaacauuuuggagaaagcaacuaagucuggcauacaugggaggaaauuaauaggacccugcuauugcuucuuaaauguuucucuuuguuucuaaggugagaggacuuucaagugccaucacugcgaugcuaccuuuaagaggaaggauacauuaaauguucauguccaggugguucaugaaagacacaagaaguauaggugugagcuauguaauaaggccuuuguuacaccuucagugcuuagaagucauaagaaaguaaguggaagucuucuguuaguuugaacagauuacguguuuaagcaguauggguauauauguuaacuaacaugugauaauuauauauuaaucuaucaaaauauuuacucaaaaugacaaaugcaugauuuauaucagcucuucagacaauguucacuuucuucaucuuucaggauagaccuauuuuuuuccaugaaugagaaccugaguuagauguagacucuucauaacccauagcuuugcugauagauggcuucuaaaaaguacucaaugagcaggagcuuaucaauuuuuauauauuuuugaauuaauguaggcuguuucuuucuaagaaauaugaguaguacuuuaauaauuuuauauuucaaagugaauucuuauguuuauuggcaaguuaauagacugaacccuuuuguuauugggauaggcuuugaucuuuaccucucuagagcauagggaaguuucugguacagaauggggacucgauaaauacuugcuuaacucaaagaaaauguucauauagugauuuggagauuuuuuugugugugucuuaugcuacuugggucauuaccucaagggaaucaaguuuauuuuuuacgugcucaauaaugcguuuuaaaguauauauuuuaaauaguaaaauuuguauuguaacaaauacacuuaaagguuuuaauguugacuuuuuuccuuauuuuggagacagagucucgcucuguugcccaggcuguagugcaguggugucaucauagcuuacuguauccuugaacaccugggcucaagugauccuccuguugaaaccucccgaguagcugagacuagucaugucucaccaugcccagauaauuuuuuaaaauuuuuguagagauagggucuugcuauguugcccaggauggucuugaacuccugggcucaagcuauccuccucugaaagugcuggaauuacaggcaugagacacugcacucaggcaguguuaacuuuagaaguaaccaugaaguaugguaguuuucugccauuagugugugauacugaaugaaugugaagaaauaacuccuguuucaguaucuaucuaucuuaucuguccuuaauacaacuguuucaaaaggauugaauugaguaacuuucuuuuccuguauuuuuuuaauauuuaauuuuuauggguacauaguagauauaguuauauacaggagauauuauauauauauauuguuuguuuguuuguuuguuuguuugagucagagucucacucugucacccaggcuggagugcaguggugccaucucggcucuccgcucuccacaaccugugccuccuggguucaagcaauucuugagccucaaacucccaaguagcugggauuauaggugccugcuaccacgccuggcuaauuuuuuguauuuuuaguagagacggaguuucaccaugcuggccaggcuggccuugaacucuugaccucaaaugaugugcccgccuuggguucccaaaguucugggauuguaggcauaagucacugugcccagccugagauauuguauuuugauacagguauucaguguauaauaaucacaucuagggcauauggguuccuguauuuuuaaugcugaguaauaaugauauuaucugguguuuuuagcucucugaauaaacuagucuuucaacuuucuuugcuuuaauuacuuuuugcaugaauuuaacacauuuuuuguugacuuucaauaaauaaaggaaaaguauagugagcuuucaagagagauuacuuugucugcaauaauagucacacaguauauucauaguguguugcucauuuuaaucucauaaauuuauucaguauucuuaaagugagcuguuuccaugcuuucuuguucauauuuaagguaguuuaguauuauaccuuuaaugucuuuugaaacuagcuaaccaaaauuggaaccuaauaauagauauauuuuugaguuaagugaaaggaauauuuuaauuuuuuucauuaauauaacccuaauauccuuuaguuuggaacuucuucaguuuggaaccaauggcagucauauaaaugaacaaugaaauacauagcagcaaaagaaaugcugugauuuuauaaauaaauuacaaauaaauuaguaauuaucuguuuggaauaauucagugcuauaacaauagauauguauauauaauuucuaaacaauaaugaaacacaaauuggcauauuuugccccuucugucagggaauggaaagaagagaggucuguuauaaguuaaaauguuauauauuuuacuuuagauugaaccauaauguggaccuggggaguaaaggcucuuacugaaauguaaagauaaauaacuauuuuguauaucagcuuguaguaaaaauggaaaguuaagugcuugccaaauacaaaauccaggagaugcuuguuuuacacaguguuguuggcuagcaugguaguugauucgauuguguuuuucaaacucgaguauaauauaaauuguuucaaggaaaaaaaaucaaaagacacugauacugacuaaggucuuuaguuuauagcucuuuaaaaauuauaaauaugauaguacauauccaaauacacauuuuaauaccaaaaugcaaauucgcuaauuaaauaauaaggcugcaaagucaauuauguuaauguuaacaaguuaauauggaagaugaaaauguuuugcuauggugaugguucuuugauguugucaggugaugagguaauugccccaccccuuuuucucuaugacagccaguguugucuucugagaaaugucauuuaaaaaaaccuuuuucuauucuuuuuucauuugucuaugucaguucaaauaccacuugucaguaauuuguucuuaacaacaaaggcaaacacaggcccuggaagcucuguuuugugauuauaaccuagaugauuguaaccuagaugauaacauuaauacuuuuauuaauuuuuagguuacauugaaaaaaaauucuaaaaguagucuuagaaaggauguguacauaccugaaggaauugcuuucaccuccccuuuucuccaaucucuuaaguuugagaaacacugggacuugagaaauagcucugacccuucauuuauuggaauuaucuguuuuuauguugggagcaaaacuggucuccuaaugagacuguagggccaguuuaaaaugcucugucucccuccucuuuuggggaggggucacuccuuucucuuugaacucuccagcauuuaucgaaacuugcuuuuaacuauacuuauucaccuuuccucaugugauuguuuaugccuagauuaaaggcauguugagggcagaaauaugcuuucaaauugacugcucaguuaccaccuggugauuuuaaaggucaaaucagauuuauauuccuuuuugcuuugcaguaaaaccagucuagucaaacaucauaacacaaguaauagaugacuuuauuaagauuaauucuguccucaagaguuaaauauacacaaagaaugugaaaaaugcuucaaaugaaguguuucuuggcagcugggaaggguagcuauagcccuauuuugauuaugugcuuuugcuagaauauacugguuuguauaauuuaaucauuuuuaguuggggcuccaugagggcuuaaaaaaguaaacugcagaaugauuuugaaauuaacacuaaugcaugauucuaaggcacauuuuuuugagccagugggaauauccaucauaaauuguuuaaaaucucauugugaaauuaaaucauuuuaaugaaauguaauccuacaaaauaaggauuuacuauugucagaggcauuuaaucaucuuuaccuaauucuuuguauuuauccuuagccuuuuuaucccuuuccuuuuagacacauacaggagaaaaggagaaaaucuguccauauuguggccagaaauuugccagcagugguacacucagaguucauauccggagccacacagguauggagauuguaauuagacuagugaaaaaaccacuuagagaaaucacaugcuuccaagacaggaaauauuguaauaauacaaauaucuuccagauuaagaauuaaucuuggcuguuuucucucucuuaaagcauuguacaacccaguuuuuucaucuagaagaauuuggaaugaguauauuuucuuaaacuaaguaaaacaucuaaaguggaaauaauguuuuuaauguuugguugugauauaacugugauuaacaucuauaugauucuaauggauggaauuagagaauaacaguuuuacuuuuuauagauaguuaagggcaucaacuugauuuauaauccuuccuguaacccaugucaaauguggccuuuuuaccuuggaauguugcuugaaugcuguaggauuuuauuggauaccagagugggugaugugaauguaauaucuguuaugccacagguuacuuccuaaagauccccuucuuuucuuagcacuuccuguguaauuucuccaaugaaagaaagcugugcccuagugaagggugaaugaacaacuaaauauacuucaaaaaccuugucuggauucuaccuaucacauagauaagcccuugaaaaagacuugaaagaauacuauuaauauugauagccagaugauuuuacauuagucugaaaacuuuuuucaguaccuagacucuaauuacauggauaacuaugugacuggauuauacagcugaagcuuccucuucaagggccguaguauaugacuuucuuuaccuuuguauccccaguaccuagcucaaugucuagcacaauaacuguauugucaauggagaaauguuaaaguaggccaaagaaucaauacagugaauauuagauauagguggaggaagggacacccuuggagcauaauuuuuaauuuucugacuaaaacuuaaagacauauggucagcuuaguauuuguuaucuuagaauagguacuuaaauacuuuuaaaugaaacacauaaccaagaacagauagcuguggaauaaugggugcucuaaagaagaaaaggaagauuuuucuuaauuagaagucaucuagagaaagugaggcuuuuaggaucaaguguugcagaagcagagagccccaaaaugaaaagcagagggcagcacaugggaaugagaagcagagaaccauguugagggcagguguacuuaaaauugugccaacggccgguggcaccagguacugaugguacauaaguaaggaacuaaugaagagggaacagaaaguuuugaaguuccuggcuagcacugcagucuagugguguaaucuuugaugucacugggcagcccucuuuuauguguauuuguggcuguauggaguuaggauggaguaagggcaagggugaaaucaacagcccuucacucugauaucaguaauucuuagaagauaucuuugugccauacuuagacuuaguuugcuuagcagauaucaugcuguauuagugugcauguacauauaauuuguguaugagaggagggcaaguagagaauaggaaacauguauuauauguacauaucagaauagucaguuuaugguaaugccccaagacaugauguaauuguguuauguuugguauaguguguuuuuaaaagguagggacuuacauuguucagaaugcauuaagacauagcuaccagcacagaaaagaugaacccaauccaguagaacccuugauuauucaaaauaauuccauccuugaggauauuguaugccuacauuuuauuuuacucauaguauggcuaggcaguggagaagaauaaagcacuuacacuaguaauugcuucuaaaauuuuaauuaguauuauccuccauaaaauuacaauaauaagaggauuuuuagaguuccaagaauucucucugauaaaauuauuaaauauaugucaugguuuuuguugucuuauguucuauauuauguauaauuuaaaguguauucuacacuccaaaucacuuuauguaucauuugguuauuuauuguauacacgagucugggccaaauuguuguacagauucuggccuauuaaauuuggcuucugaucaagagaacugguuaucuaaauucagacagcagugguaaggcacaaugaacuaacacauacaauuugauugauagauaaagaaauuauauauauauguguuuguguauauauauauacacauauacauauacacacacauauauacauauacauauacacacacauauauacauauacauauauauacauauacauauacauauauauauauauauauagaaagagagagagagagagacagagaaggagaaagugguguauguguuuguguguccacacagaaacucuaauucuaauugucuaucuaguuauuuacuucuaaccagauuuuucuguuuaaaauaaaacuuaccauacuuucucauuuuacaguucuucuuuggguuauuuugaugucaagccuaugcccucagugaccacugucuagcaguguggcugggguuguguuggaagugguugguggcuggcaucugggccuccauaacggcccuggcacaaauuuguuuuccugcauggacaaaugaugcuuucgcuucccuuuuauuugcuuuguccugucccucaaaugauaagcauccauuugcccucccaggcuacagccugguucaguaaucacaugguuuuaugcaguuauuucacuaguaugauagcggagcuccgaauguuuugauucuguaaauucaguguuuucuucucccuguguuacuuuuccuuaugaagucaccugguuuuauucagcuguuuuucagugcuagguguagcaauuuaugggugugcuaucacaugagcaaggugacagucacgaccuauucgucaagaaguauuuaguuguacauuauuuagggaggacacaaugaaguggcgaggaccaugagugaaggcaggguggggacagucagaagaggacagcuccucuguggagcaguguucuuuggaucacugaugcucauguuguggccucaucacuccauaccauucuuaaaaauaaucgaggauucuggaaagcuuuuauuuauguggguuauaucuauaacuauuugccauauuagaaauuaaagcuguuuaccauauuagaaaauuuaaaaauguuuacuuguuaauuuacuaaaaguaacaauauuacccauuacauguuagcauacauauuuuuauagaaaauaccugcauuugcuaaacuagaaaucauuuagugugaaaagagaaguuguuuuacauuucugaaagucugugguuuaagaggagacagcuggauucucguaucuguuucuucacucauccugcugcaauauguucuuuugauugcagaauuugaagaaaaucuggccucacagauauguaguuagaaggggaaaguauuuuaauaguuguuaaauaauuuuggguguuauuacaguggaugauauuaccuuggacauuauuacuacacuaaaacucaaaaagggcuaguguuuuuaaaggcuuauuguuguguggaaccuaaaauuaucucagugagcuuugccuauucugugacaguaaaaucaguuggacuguguugcacuucgaaugaucuuuuacccaugcgugauucuguaacaucaucauguuacagguaacuuggaaaauauuggcucacuaaguuaugcagaucuuuuauguuuacuuuacuuagaggaagaacguuuuaucuuauucaggggaugauauguuaauaucauagcugaucucauuaaauagccuaaauauucagaagccuucaagcacuugggagcauucuaaauuuuguuugacugcuauaauuccuauauuuccuaacaauuccuaucauuuccuuuuuucuuuauuuuuuucaaugacaggcucacuucuuuuauaugcaaagaacaaauguucacaaaauguuuaauaaccauaauuugucugucagucauuuuguuucauauaaaaaugauguuucaugaaaaaaacugccaggucagcuugcaacucaaucacacaagugcuuuuccuugagacaacuuucauacaucagcaugcguuacaagugcuuucagcuuaauuuccaaauauuaaaaagauuauacacaaagguuagaacuuaauaaaauuaauauguuuuacuuuaucacagauguucucaagugaaacugccauuuauauguaccaugauuuuguggcugugaaggcuacagugacuaguauuacaaauugaagucacuagcaguuaccaguuuuacucaccauuacuuuuauaccauuaguguaaaugucaacauggugaaaaagacaaauaauguaauaguaauauuaugaaaguaguuuugaccuugcagacguuguaaagagucuuggugauucccaggaguacucaggccauauuuagggaacaaauacucuugaagggcccccuggccaaugauaaauaccuagggaaaagcaauucaugugaaauauguguuggcucauguaaauaagagcccggcugacagaggccauucuguuuaacuggggccauuuccgucuugauuucucagacugguauugcuuccaacuauugcugcagcauucuucauaguaaauuuucaagcuuuugccacugcugcugccgccgcugcaacguuaauguccauuggcauugccuuugcugcaaaagucaguugaugaguaggucugccagcuuugacucuacuuuugcauaggaacuguucacuguugggcugauauuauguuuaugacuguaaauaggaaaacauuaaggcuuucuaaauuugggcuuacuuguagauauagucuagaacucaacuccaaaacuugccugcagauagcaaaagauagaaauuugauaaaagaucauccuaucaguaagguuuuugcugauauuugaaauuuuguagucaggguucaggggacucugaguucucaugagauuaaauaacuuuucccgccuagagaguugccgugauuaguagaaacaggucucaggguguuuccuguuauacccuccucugccauaggagucagucuugcauaauggaaagagcaggggcuuugggacagcuggcuugaguucaaacccuagcccccugccacuagcuagucauauacuuuugagcuaauuucuucaugucucuaagucccauuuuacauuguacauuuuugugaagaauaaaugaaaucauguauguaaaauacucagugcuaguucauaguagauggccaguucauugucauaaguauaauuucuaaaauucuucuauaauaucacuccuuguuaagaguacuuuuccaaaguuaaaugaauuguguuuauuaauauaccguggcaagccuuuacugaaugacauaaccuccuauauuauuuucuacuuuucuucuuacguuuauuuacaggacaucauauugagaauuuucauguucaauaccuuucccuuuuauuucuuccagcuuuaucaagaucuuaaauuguugaacguguugaaauuuucauaacuuaguuucguagauauaaucuugguugacuauugauaaggaauuaauaucaugguguuuggcauacuuaaaaucauggaauuuucuuaauauauuaauuuggggaaaaugcauuuuagauggcuauguuucugauuaacuaagacuuuuuuuaaaagaaggcuaagcauucuuuuuaauacauguuuaaaugauaacucaguugaaaaaauauuuuuggugguauuuaaaauucugaacuguguaugucccaccaauuuuuuccuugaaauuaaaucauaguaaccuccaaaauacgcuuaauaaauuguucuccuugccauauaaaacuuauccuaggcuuuuaauauuuacacugccuuauuuauuaggcauaaauccaaaguaugcuugauuccuaagucugaagagagguugcgggcaauaauguuuguuuuauaaaaagaacauuguuaugucccuugaaaaacuguuuauaauggcaaaaaauuggaaaagauccuacauauuuaacauuaaaagaacucauaauucaugguauauccauaaauuggaauauuauauagguaacaaaagugauauggauauauacuaaauaacaugaaaagaaaugagaaagauguuacaaaaacagaaggauauauuuuuguaagaauaaagcauuuguauuuaaauaauugaaaaguuaucuacuaaauuauuaacugcuuuuauuucuauauguuauaaauauguuugguuuuaauuuucuuuaugauuuucuguuuucuaauuuuuauaauaauuucucuugaauaauacaaauauuuaguguguauaucaugauugugcagguaacuguuauuauaagauuugugcuaaaauacuuaggugugaaacuucucugcaucuuauucucaaauggaccaggaagaagugcauauaaaaauacauguuaaaaaagagaaauuaucuaauuuuuuuuucugagacauagucuugcucuguccaggcuggacacaaccuuuuuguccaaucauauuuuaaaacagcuguccauacuuucuugaaccuaagcauacaauugaacuguuuccccugcaucuguggaucuucauucugaaggcucccaugucacguaaaacuaugaucaaauaaauuuguuugccuuuucucccauuaaaaaaaaaaaaaagagaaaugagaaggagaaagcaaauuuggugaaauguuaauaaauauuaaaccuaagugaguuuauacaguguccacuguacuauucuuccaacauuuccucauguuugaaauuuucauauuuaaaaauaaauaggggucgggugcgguggcucacgccuguaaucucagcacuuugggagguugaggugggcagaucaccugaggucaggaguuugagaccagccuggccaacauggcgaaaccccgucucuacuaaaaauacaaaaauuagccuuggugaugggugccuguaaucccagcuacuugggaggcugaggugggagaaucacuuggaccuggaaggcggagguugcagugaaccaagaucacgccacugcacuccaaccugggcgacagaacgagacuccaccucaaaaaauaaacaaacaaacaaacaaacaaauaaauaaauaaauagggauauuuuauuccaaugagagcaaccguguagaugcagcugccacuuaaguggaccagagaauuguuacuuuaacaucuagcuucauagcuuaagucuugugcacaucuccaccagagccugauucuuucaacaggaagacuucuauucccuaaauauaaacagacguuuuguuguuuuguuuuuguuuucuuucaguuauacugcuuagagaagcagucuucugaagaagcugaaugucauuauuucaugcuucauccuucuuaaggaugcuagauuuaucuccuugaaaaaggaaucccacaaaauuugcuguucucauggguuuuucagacauuuucuuugaaaugcauuggaaaguauuuguaagccuuagaaaagaagguuuaaacaauugauaaaaaggcucacugggucauuuuauuauccuacuuaaaaccuuucaguggcuuccccuugccuuguacaaaaugaaugcccuagacuuuucucaugagacuuaucaacuaccgaccccucacuguuuacauuccaggcugcuuacuggccuucuuucgcuuuucuccagucuccaauuacguguuacuuucuccuugacguguucccugaccuguccccuaccccugccuuguuaggucagcauauccaugcuccuuuacccuccucagcacugcccacuucugauugccugcaccuguggccaucuucaguagucuguggguccucaguuuucuuagggccaugcccauaacugauaccuuacuuuuuaccauucagcacacugccuggcuuagaaagagaacuugugaaugcuuauucaauagauaaaauaacuuacaaguggguugcauuaccuguaugauaguaaaaaggaugcauggguucagagugagaaguuccagauuugaauacaaauuuaguugaccauaaaauuauuuuuucacauacuacauacaaaaauccguaacauucacuuugagaagugcuggcauuaaagaagaaaaugcuacacuucccaaucuaugagcuggacccacccauauuugcuucccuuuccauuuuuuauccuguugcuuugucauguaauuggugggaaaacaaacuguauaacaaaugaucauuaauaacaugguucaagaucuaacucacuagugccuauaaacuuacagugcuuaaaugagggaauaaagaacaacauguggucaaccagcaccaaacuuacuguuugauuucagcuuggaguuuccuaguuuuuaaaguuucucauuagaaagaacguagaggaaauugguccugacaaaugcucuaucuguuuuguuugacaagggugagucugugcuauuggagcuggaauaauuacaaacaauuauguaguacauuauagucuuuugcaguuguguagcaaaucucaucuaguagagaucugggggcucucauuguuuauuauauauaaauaccuauuuucagcuauauuacacuguacuuugcuuaucaguuucccaugacuagauucuaagcugaaggacagggcagaucagacucaccucuuuaaucuuuaaauuuguugaaagaggaacguucucucaaauauaguaucuaaauuaauccuuucacggccauugaaaggauucagccauuucuaggaccauucucauuuucuagaugaggaagcacggauucagagaagcaaaugaccuauucacuaucaaaauaauaaaacacaggucuuuugacuucaaauucuguuuuaaguuaucucuuuuuuuucuauauagcuauuauaauuaccacaagaauuacagaaauucuguaagucccccaguauaaaagaugaggaaauaaaagucuuauaucauuuuaguacugugaaaguuuuaugcuuuagagccaaaugauguuuuuauuuauugauugaucuuuucacauuguuuuagucuguucucacccugcuauuaaagauauacccaagacuggguaacuuauagaggaaagagguuuaacggacucacaguuccacaugguuggggaggccucacaaucauggcagaaggcaaaggaggagcaaagucacauuuuacauggcggcaggcaacagagcaugugcaggggaacuccccuuuauaaagccaucagauuuugugacacucgcucacuaucacaagaacagcacagcaaagaucacccugugauucaauuauuucccaccgggucccucccaugacacaugggaauuaugggagcuacaauuugugauuuggguggggacacagccagaccauaucacacauucacuuguucauuuucugcuagucagcuuuauagugggcaguaacauacagaggaaauaaugauuaaguuauauuuacuaaauuucccuuuuuuuauuucuaggaaaugguuacuaauuggcaguuggaccuuugaauauacugcaaugugaugagauuuuuauggaguuagucuuuuaaucccauaccaaguaugccugaaggugucaguuuaacuuuguuuuuauaguauucaaacuguccaucaacaauuucggaaaucaaauuucuuuuuuaugauaucaaauaacacucaguuuuaugaagaggaaauaagacuccaguuuaugguuuuuccuuccaauuugccaguuggcguuuuucaacauuuccuguccaguacagugacaguauucuuuuauggaacauuaaaggcagucuccuucauacauauuauuuuuuuuuuaaaacaaguguuuuuguuaauuggcucaugacuaacggucauucuacaagacagugauaaauuagcuauuggauuauuaccuguuagucgugggaggaauuuuaguauuuauguuuuuauuuuuuguugauagugccuaaaauuaaaaacauccuucaauuccuucauuuuaugauugauuuuauccuucacuaccuuaaauaaccaacugguuguauccuugcuuccccuucguuccgcucugcauccuccuucuucccccuuguucgcauuaccaccauucuguagucugacaagacuuuguuuuuuccauuaaccuugaaaauguuauuuuuuauaaaucuuguauccaccuucuaaaguccauucauucugcacaguuugguaauuagaaugagaauguggcaagugugcacaaggcaucugcuuuuuuagaauaaaaaauaauauucuugacuuuagaauagaaaggguuucagaaaucuaguucaagccucuuauuugaaauaaugccaagcaaagugcaaugauuugccuaaggucauaaaacuuguaugugguucagcuagaacuaaaccgaggcuuaaacuuuuuccaauauaucacauugcugauauuuuuauuucuuauucuuugacauacccccugaccccugcuguuacucuugaacauaccauagaacuacauacacuccuuucaucauguuugacaauauuuucuuguugauauaucaaccaauugaagauaacuuuaacauagaaacuauaguuuguuaccuauggucaacugagaacuuaacuccagcuauggagaaacuuugcuaccguaaaauuaguauuuguaauacauuguuauuuaaugccaccuuuauauccagaguauugauucuggagucagauuaugggcuucaaacuccauucuauuuauuuccuucuugaaugaacauuaaugaguuggcuaauuuccuugaagcuugguuuccucaucucugauaaauggaauaauaauagucccagcugggugugguggcucaugccuguaaucccagcacuuugggaggccgaggcaggggaucaccugaggucagguguucgaaaccagucuggccaacguggugaaacccuaucucuacuaaaaauacaaaaauuagcugggcgugguggugcacaccugcaaucccagcuacucaugaggcugaggcaggagaaucgcuugaacccaggugguggagguugcagugagcugagaucgugccauugcacuccagccugggcgauagagugaaacucugucuaaaaaaaaaaaaaaagaaagaaaaaaaaaagucccaacugcauaguguuguuuugaggaacaaaugaagauauaaauaacuuugcacagugccugcacaauguaagcaugugauacugugagcuauugcugcuaacauugcugauguguuuguuucuguauuuagucacagguauucauacucccuugauacacuguuugacccucuauucccagugucauuaugcuuaucuuuucauaaacuuuagcuacagaauauagaucaucuauagaauguagaugaggauuugcugucaaacagggcugguuuagggugagugaaugugcauguacaguguguugcugucaucuucauugaaggggaauguucaggauugugccuggcgggcagcucuguaauuuaucauccggcuuccuaugcugaaacaacagagauggcacucugugggucagcugaaauaguagagcacagucuccuguugguuuauagcuucuuagggucagugagagcugagguuaauucagcaagggaauccacggacugugacaugaauuccaucaguuguucauaaauuauggaagaaauucuaggaacugcuuuuggguuuuuaaagcucugggccagaagguuaauuacuugccuacaguuccaaccagcuuucuguguuaauagauaccgacuguguaggcccuucuguucuaggcuugcuuacacauuguuauuugaauauaguaauaaaucacugucuuaggaaacauguaauuuuuuggauaaauaccugugaucagcuuagauauaaaaaaucaguauauuauuauuugaucguauuuggauuuuagccacuguuuuucuuuuuccuugaaugcuuuuuuaaaggaaauaauuuauucuuuuuagaauauuuguccaacauuauaaaaacaauagcuuuaaauaauuauaaguaauuauagagcaauaauaaaauuauuaaaaaauuagaugauuacugaauuauaaacacaaacgaaaauguaaacauuuuaaaacaacauuuuagcacauuuuuaauaagaauuagaugaccuccauauguugagagagaacuuauuuugcuauauuuauuuucugucucauuacuaacauuaaaccaaaucaaauauucucuuaccugcagauaaucuaagaguuaacagaaacguugaguagaauugacauagaaauaaaugauuuccuuagcaucacacuucaaaagcuucagguuuuccccaagaaauguuugaauggaauuuucuuauaagcaaagucuugaacugcauguuuuuagaugucucaguguuauguugacacuuuaaauaauuucagauccacaaccacaucaauggaauguacccuuucuuccacuguuuuuuuuuucuauacucagcuccuacucaguugauuuuggguuaaugacaaguauaucuaacaacuuaagagacagacauucauuuuggcuuucauuaguaauaugauuaucuauuuuuucuuucuucaaaaauaucagaggcccuaauuuucuaauguaaaaauuauagugcuaugucaaaguuugucauagguuggauuaaggggcacagagugaaaagugagagagugacauuuguccuggaauauaaugcuaugaacaauaaccaaaugaauuaauaauaucaucacagagacuaauaagauagaucauuuaaaauauacugucauuuacguaguucauauuuuuaucauuucuucuuuuuuuuauauacuggaguccucaaaaauggauauggccuaggccacaguuuacaucaacuguuugaacagcuuuaucuauugguaaauuauuagauaauagcauaccucuauuaaacuugcaucaccaacauuuuuccuuuggaaaauaaaaggagauuugauuuccccuaauuugugcuuucuucugcuguugcuaccauuuuuccaccaagaauaacucucuguguuguuuuucugcaaaucggcacuaugcuucuaggcuggggaagguuuuauaucuucucuagcuguuuuuuuuuuuuaaucuucucuaguuuuaugggagagacaauaauuuuauggguuucuugcuacucaacguuauauacucuugauacuuccuugcuggcacuauuuauaggaaacuccucuuugugcaggcaccuaagguuuaacugcuuaguuacuccaugaccacgguucaccaacuauacucauaaauauuggguuaaauaaaacuuugguagaaauuccuaaaaauagaaaacuacugggugaaaugauuaauaauuuucucaccaaauucugacucccuaacaacaaaaccacaucaaugauaaagaacauuucuuccuugacuuaaauuguucccuaccauagcaguguggaacacucauggaagaguuuuuguuuguggaugggaaccuugaaaacuuggccagugucuggauuguucagaucuuucugcuguuuguggaacaguccccuugcuuuugccagcacucacaucaagacccuuuauugucugucgucuugcucccuuagacaagucacauguaaugaggguaauuuaugcuccugguuggcugaagcaagagcauccugaguagggaaucuuuuacuuuugcuucauuaacucaccucuuuucauucugcaucucguauucuuuuuuaaaaaaauuugcaucaguaaaauucacuuuuuguuucacccucaguaaauccacccaaucuggcuuuuuaugauuuccgacugaaaaguucgugagcacguggcuguccuguuuuuuuccuucuucccaaugaaccucauguccuuugaguuggcaucucuucagaaaugagggagggauacuguaacuguaagauucuuaaggaaaauaaagcaucguuuaaagaaauagauuuugaaaaccagacuccauuuguuuugaaucagaugauaaaauuguuuugauaaguaaggguucucuuauuugauuuuuacauuuuauugcccacuuucuuacaacuguaaacucuguuaagcuuuuaaaaguagaggaucucuaaaauauucaaggaguaaugucaaguucagguuuuuguuguccuucuuucaaagaugguguccuuggguuuaacuuguuuagguuaagugagauuccucagaauuugauuaaugggaacauuccaagaguaacaaggugggguuccgugaggucggugggguuucauggcucuuuuugcugcggggaaaaaaaguauuucaauuacagaaagaugccaagaaugaacuugagcuacuccuauuugucaguguagcauuucacuucucucuaugguguacuucuaauuuauuagaaacuccauaaauugaagggauuggaagggugagauuggaaaaguaauuggguggugcuuucacaauuacauuuuugguuuaauuuucaccuagaaugauucaguuugcuguuuuguaaccauuuccuagucuacaaaagcaaaauaagccaguccccugauauucauggaaaaaaauguaaaguucuucuaaagaauucccauauaauacauauauuuuaaaguucaaccauguggaacgauaucagguauuuuucaugaaacauacacuuuugagguuugcuuuuucacuugaaaguguugccaucucuaaaacugauuuuuguuagaaaacucaaaguaagaaguaaagcuaugcuuccaaaaucuuuaaacauuauuuaauuuggauucauugaaaauaaaugaguuugacuuuauuccauuuuaaauuacauuuucuguguguacaucuuuucauauuuucaaggaauuaugaguucuuugaaaucuacguugguuuuugaaauauauuaaaugacaaguuaacguuauuaaaaugcuuauugaaaauggucuuuuuauauuaauccagauaauuaaauauauguauauuacauauuaagcuuugcugcuuguuuauaaaauguucaaagcauagggcacauuggcuguacacuuuuuuaaaaaauugugguaauauauacaugacacauaauuuaucaucuucaaaauuuugcauuuuuuaaucuucaaguuugaucauggucauuauuaacauauuaauucaguguauuuaguagcaugaacaaaaauuugauuucugugccucugcuagaguggucagguucacuucuuaaauuagauccauguucuaauuuaagauuaucaagauuaaagugauuugcaagguuuuucuuuauuaauuucauguauuguaaacauagauuuuuucgaaaggauuugugucaagauguugaauauugaggugguuacauaguaguagauggauauucagugauguggcuuuaggaucguuuuaucaguaagauucauguuauccuaaacugccuucacaaauuuucuuaagaugcucuuuuaauaccaguauguuaauccuuuggugagggcuagaauucuucugacgucuuuaauuaaaauuauauuccaucuauauggaacaucuauaugguaacauacauaaauuuuaaucugaaaggcauauauuaaacuaggauuugauuuuuuuccuauuguuauuagccauacuugcuagugggugguugucaucauaacacauuuucuuugucaaaggcucaagguagcuuguuggggccaggcugggcucaagucaaguaagguguuccauguggcauccagauguucccuuucauuacuacuggcugccuuuggaaagcuagcuccaauuuucuggagcuguuuucugaauauuccccacacacauuucaaauaguguagcuuuuaagcuacuuccaucucggguguuccagcagugagaauuuggauacacuuacuucaagccgaguaaguuaaaguaccuccaauucagagaugaagagcuacaagaagucugccugaauaauguuaaauuggcauuaaggaacugcauuuauucaguuauuuugccuuugcuaaugacuuuagcuaaguccuucaccugcccacuucuccagcccagggaucuuucuuaaaccuauauccuuguuuuguauaauuuaucagcaucugaaauuaucuuauauauuuucuuuaacuuuuucuugucuuucucaucacacuaguaaaauugaagagacagugauuuugugaaacuauuugcaacugcauucucaaagcccaggacaguaacuagaagaugguaugugcuaaaaaaaaaaaagucuauuuaaugaaugaauacauuagcuucauggaguauccacuuuguggcaccuuuaaaaaucaaccaaaaucaacuuuuuauaguuaccaucaugcuucuguuuguuccuugauguguuguucaaagaaaacacuguggcuuucaguguuauucagugucaacacauaauuuaaagaaagagaucuauuuuccuuuaguuaaaugaaaaauauuuuauucuguguauauauguaaauauuauuauuuaugcugcuguguucacuaaaucuauuuuauuaaucuaauaccuaaaucucauaggaugguaugacauauuuaccaauauaguauuucccuucuaaauguugcaagugacuaccuguauguaguucucaagacacagcuuauuauuaugauaguguuuggauucacuugggaacugcuuuaagacauaacacacauuccuaaccugcccccuacuuuuucuugaugagcguugauaaccaaaagaaugcuggaaucuaccagccagaaagaucugguuaauguaaacuguuauugucagaagcagaguuauugucauuaacuuuagaaagucuaacccaauuuacacaaaaugcuagccauauuacuaauuuaugugauggcaugagguuaagaguggguucaaacucggccuccacuauaugagaagcuaugucaucuugagaaaauuacuuauccuuucugugccuuacuuuccucauuuguaaacuagggauaugaauacuuagauuauaauauuguugcaagaauuaaaauugcuaauguguguuaagcauucugaacuguagaacagaaccuuauaguagacucuauacauuuuagcuauuguuauuauuuccauuuagauuuguuuuuagcuacuuuuuuggcuaauuuucagauuaauuaauuuacauguuaguuagaauuugaauacugugacuagccuaagcaaaauaaagauagugucuaaauauaccugagcuauuaaaacauagucguuauuugaaguuggaucacauuguacaucagagcccauguacugacugugaccuguguucuuagaguugacuaaaacugaagauaaguuuuuguucuccacaggaucauuuuauguguaggugaaaauauuuccuagaaacauucuucacaguaauuugaaauaaugaaggcaaauaucauaugcauaaugugaagaaaaccuaagaauaacaauuuaucuuuaauaugcaaauuaggaaaaugacuuuaguaguuauuaaccuguugacuguacagguaaccuucagguuccgauugugugggacagcagauagcuuuguccucggaguccaaaagagaggcaggauugcccuaaacauccuccaaccaagaggguagaaauuuaauguagagucuaagcugauuugcaaacuacacauuauaguuuucaaauaaauugcuuauaaaagccauuuacauggugaugcacuuuaaagcuggaguacauucuaggauagaaugaaggaauggaguugaacuuacccaaguuucccagauaugucagcucaguguuggcggguggcaugggguagaaauaccaaucaucuagacuagaggugcucugagugauuuacguagaccucaugggcaacauguguagauaucagugauaagaguaacugccaccguuaagaguaggaugacugggucgggcgugguggcucacgccuguaaucccagcacuuugggugguugagguggguggaugacgaggucaggagaucaagaccauccuggcuaacaaggugaaaccccaucucuacuaaaaauacaaaaaauuagccaggcgugguggcgggcaccuguagucccagcuacuuaggaggcugagguaggagaauggugugaacccgggaggcagggcuugcagugagucgagaucgcgccacugcacuccagccugggcaacagagcgagacuccaucucaaaaaaaaaaaaaagaguaggaugacuguuaauuuguuagggcuguuguaacaaggugucgcaaacugaguggcuuaaacuauaaaacugugucaccucucaguucuggaggcuguaagucugagaucaaggcacuugcauggccaugcucccugugaaggcgcuagggaaggaucugcuccaggccucucuccuggcuucugauaguucuuggcuuguggcggcauaauuccagucuucacauggcauucucccugugugucucugucuucacaaggccaucuuuuuaugaggacaucaaucauauuugauuaggggcccacacuacuccaguaacguuugcaacaacccaguucccaaguaaggccacauuaugagguacugggguuuaggauuuaaacauacgaauuugguaugggagggcacaauuccauucauaacaagugaccauguaucuauugucccaauugagacacuugugagagugaaagggaguaauauuguauuaggguucuccagagaaaaaagaaccaauagcauauuuauagauauauuauauaugaggagcuugauuaugggaauuggcuuacacaguuauggaggccaagaaguuccaugauaugccauuugcaagagaccaaggaaagccagagguguaauauagccugaguuugaaguucugcaaaccaggugagccaaugauguaagucaguccaagagcaaaggccugaaaaccaggagcagggguuuguugauguagguacuggaguaugaaggccagagaacugggagcuuccauauccaagggcagaagauggaugucaucucagaucaaggagagagauggagggagggaggaagggagagagacagaagaagaagaagaaggagaagagaagagaaagaagaagaaggaggaggaggaagaggaggagagaaagagagagaauuaauuaauucacuguuccuccaucuuuuuguucuaucugggagaagaagaagaagaaagaagagaaagaugagugagaagaaaagaaaagagaagagaaagaagaaggaggaggaggaggagagaaagagagggaauuaauuaauucacuuuuccuccaucuuuuuguucuauccggguccucaauggauuggaugaugccugcccacauugggugaggguggaucuucuuuacacagccuacuaauucaaaugcucaucucuucuggacacacccucacagacccagaaauaauguuuuaccagcuaccuggccacaucccuuaaccuagucaaguugacauguaaaauuaaccagcuauuacuauauuauucuaggauaacaggcauaaacugagacuacuuuagacgaaucuggauacaucgucacuguacucauaggauagguauaauuuauccaguuuuucaaagguucaauggcauuggaugaccuugucagaguuacagcuggauggaggaugaacaguauucaaacucaggacaaucacauuccaaaaaauguaugaaaaaagcuaugucuuaaaagaaguuagccuuuuuaagucuauggacagaauuccuauauuauaacaguagguaaaauuggaaauggauuuauuauguucccuucuuuaaaauuccucacuagucuuuaacuauguauuucuuucuuugcuugauggauuuuggcuguuaugaaaggaaauaguaaccugguauauuauauuaggauuaacauauaauuauuuaccugauaacugcaaaucuuuuguuuuuguuugcuggacucuguugguauuuggagaacaaaaccagacguaaagcuaugugauacaaagagaauagcuaugaauauugaauuaucuuaggcuugcuagaaaaauaauuuuacguaaguguaaaauaacauguuacuauucuuaucaugcuuuaucccuaauauagauuugauauguugauggauuucauuguuaauaaauaagaaggaaacauuuuagccuuguuuauuaucuaucacuaaaguaaaauaaacuuugaaaaucuaaaaaaugacuuuuuauacuuuaugaagaagaaaaugaaaaaauuaucuggaauugugugaugcaggagcuaccaccauuuagcagucacauucugcuauguuuucuuccuguccuuuuccuuugugguucaagguuaaaugauuaagaucucaguaaaugauagcuccugcuguacuccuacuauugcugcugaugcuguuacugcuauuacuauaauguucuuuuuuaucaucauccugaaauagaaaaauucuagauauaucagagaagcaaaaucauuaugacuuagagucuggauggagggagaagugaguaaaaaagugugggguuaucuuggauggcucccaaguuuuuaauuugcuaacuaggugaaugugguacaacuaaucaggacaggauuuauagcaugcauaagaccaaaggauaaauaccgcaaauucaaaacaaugcacacugauuuaagcuguuugugagauacccaaaggaggguaccuguuagacauauguguacauggagauuggggcucaauagagaucuggaauucugauaagcauguguuaucaacucaggguuaaaauaagaugaucuuuuccuagauguugccaagccuuuguccuacugacuuggaaaagccacaccuucccagagucacgaugauccuaaggucaauaauucuaggucagcuuaccuagugcaaagguugauuuugucucagagaaguugguaagucuggauagcucauuuaagggaccuguuccuguuuguguugugauuguuguuuuuaguuuauugcuacuuuggguguuugucaccauuuuacagugccugguccaaagggagaauccugggugcuucuccccaaggaggagaggcuggaaaaugucgcuuggcaggggacaccgcugcaggugcuuccguaugaugucucugcuggaaacaaaguuggggagaacagugcaaggccauugugcaauggggccagccuugagauccaggaauguaacugacaauuucaugaagcagugucagggacaggggagaggucaaggaaggccuuguugaaaaguagucacuggaucaagcaacaaggggcauuguugaccccaugagagaguugacugggauaaugcacaugauauccagauugaauuaagaucagaaccaaauggaacaugagagaguagaggaagaacauacacugcuagucagaaggccuggcucugaagggaagacaaaaguuuuacauuagcugaaggaaaauauuuuauuauauugaucuuugauugcagccagggucuagcauccugcuguguaaguacauuguuaaaugaaagaauaaaucaauuagugauuuugagcuacuguccauccuaaaugauuuggcuuugacaagagggcaucuucagaucccuuuuggagauuaaauuuugucacaguuuugucauuucacaguagaauuuuuuuugaaaugugcuguguauaugugugcuugucuugaaaaacauuuuggcuguuuucaaaauuauagccucuaggugagagauauuugauuauaucagaaaguauggauuaauuauuauuuaguuuaacuaccaaugguccuuuugaacauauaccaauuuuaugaaauucuuuugaaacucacagccuuaacugagucaaauucauuuauaugaaacaaaaaaauuaaacagaacaaggugucaaugaaucaguuaaauaauuccccuuuaaagaguaguacagugauagagcaaauugauuaacauaaaauauuuuuaacaaauucuuaaaaugaggagauuuaauuuggucucaaguauuaaaaggaauaugcagcaaauaugcuacuggcaaauguuuauuuuugaguaucggaagugcucugggcucagugcccucuccacaggaggggaggccacaguccacugcuguccugcacgacccaugcuuggaucugcccugcugugccuggagccacuucuugaaguagcacagggcauaugcgguggccaggaucugagugugugagaagugauagcacaggacugguucugcuacuucauguuuuucugacauggaggcuuccuuuauuuguaggugagcgucccuaucaauguccuuacugugaaaaaggauucaguaaaaaugauggacugaagaugcacauucguacucacaccaggguaagauuauauucuguuucauuaauauugaucaugaaaaccauacuuauuuuaaaagaaauauauuuaacuuuauauuacaaaauaaaggcaauacacuggaaguuguauaucuauauuuaugacagauauuucaggauaauuuuuuuuaaagauaaaacaaugaaagaaaagaagaaaaaaaacacaaauugaaaccucaaaaagguuuuuauucuuugaaucaggacucaauuuucaggaguuauaaaugaugaacuucaagauaaauagauuuuaaaauuuuaauacuacaauauuuaaagguuuuucuugcagaauauucaccaguaauaggaacauuuuuuaauagagucugcaaguuugucagcauuuggccauuaaguaauacugaugagcaaguauauuugcaagaaagacauugcagauaaauuaccaggacagguggaaaauaaggaaguguagcucagugcuucacagggcaugccuagugcuguggcuuauucuucccagggugcccuuuguuccuuugcugucaacacucucacuggacuauugucauucuguuaucuaugccuuuuccagacucaagcaucuguuucacaugcuuuuaaaaaaauguaagcagcuuacucaccaucacccaccauuucauagcucacuauucgauuuaagcacaauuagacacuuuaaaugaacuuuccacauggaaauuuuauauuguuuuaaauagcuauuguugauuuugcucuauacaacuuuucacugcauuaucuuucacaguuucuuuucaguuuggccuuuuaaagugcguauggucuguauguaaaugauguauuuuuuuuuucaaauuuuaagagacuuaucuaauccccuuuagaacaauucuaauuuaaaccucuccuggauuuuacuuuuuaccuuagcuauaaaauaaaaauuuuagagaaaacacauaauaauaauauucuucccgguauaauaauacuguagccuuccacuucaguucugcagcacguaaaagcuauccucugugguccccuuaagaaaauacucuuuuugucuuuguggugaagagagggagcuucuccacuuauuaaagcaaaucuauagcagguuucucacucuaguuuguaguaucauauucauucauauuauaugaauauuaggaauuggaguacuuccuagauauaaaaguacuucauaaaccauaaaggauuagacagauauuccuguuuauaauaguaugauuuaaauguacaauauccaaaauauuucacaaugaguauuaugaaagagguuuaaauuagcuugagauuaggagguuauuuuacaugugagcaguugucacagauguaucaauaauguauuuauuuaaaagaugccgacaaaaaggcaaaggggcccugguuccucuuaauagaaacuagugauauugacagaaauuuacauaugauguuguuuuacuugauuacugaagauagacaugauuacaacacagaagaagcuguuuaaaucacugcaggaaaaaauaucuuuuggguuuucucaagaaggugagacauuuccaauucaauuaauuuguuuuuuacuucauuuuaauauaaaguuauuaaugagaauaauacagauaguuaagaugaauaaaaauaaacacaaaaaucacuaauuacaugccaguacucuuuuaggccuucacauuuauuaauucaguuaagcuucacaacaacucuaugagguagcuguuauuaugauuuauuuuuguaaaacaagaaacugaggcacaaacaaguaaguggcagaguugagauuugaaccuagggagacuggcuacaaagaccauuugcauuuuuuugccuauuauuuaauugaauauuuucucauuccacugucucauauauuuucugguauauuuccacacuaagcaaauuacaguaaugaccccaaauuuaaaagucccauauucuuuugaauuucugaaccucgauuuaaggaucccaacacugucuccaaaguauucagcugcagauggucccuugucagaaguuuucugacauuaacugcacaaaaagaaaacaaauucuaggcuuugacuaagggaacucaagagaguuuauagaccagaagcacccaggauuuuaggcaggaucccccacaaugaguaaugaguagaagauccaaggaacaggguaaauauguguaagccuuuuggguuuuaccucaaacucuuuuuuaauuuuccuuuuucaugcauuuuuaaaauauuuuacccagacaguuuuauuuugaaaauccuguuuccuaagcauugaauaaauacagauaaucuuugcauauuaguucaaauuuucaaaagccuacuaagguuaucagcuaguacaaucaaacuauuauuaaaacucaaaagagauuuaaaaaaugugcuagaggaacaaccucugcaaggucauauuuucccaguauuauuugcauuuuguaagacuccauucaaaaaagauacuauuacauuugggccauaacacauuucaguuucaauuuugcauucacauuacaugagcauuuagauagcucuaauucccagacauuuuugguccuauuuuaaaaguuuuuaauuccauuuuaacaacaacagaaaaaaaauaagcuaucuaauucaguaagguacaucuuuaggaaguuuugguaagacaacccaagaugcugugucaggccuauacccccagguuuacauucuauggugacugcacgaaugcuuuccaaaaggaacacaaagccauuuacucucugguuauugccuauagggugcaguaagagccccagaugugggagauaauuuugccaaaauccaauuaaucauugaccuuucauggagagaccaggguuugaggugaaggcugguggauuuuauuuccuucaguauauucucuuuauauuugguuuucagcuucuacuguguuguaccuaguuguguuuuucauuguauuuuugcagcuuagaucuguagucugcuaucuuuaguuaaauuucagaaaauucuuggccauuuuuuuuucaacuuuguuuugucccuuucuuucugucuucuuaugggacaccaguuacacauguuagacuauuugauacuguuccagagcucuugagugccguauucaauuuuuguuucauuugcauuuuuaaaaaaaucucgguguuuuucucuguuucuaauuucuauugauauuuucaauuucauugauuuuucuaccucuguugugcucagucugccuauugaaggagugcauuuuugauauuauguuuuucaucucuagcauuuucacuuggauuuuuaaaaauaguuuccauaaggccuggcacaguggcucauuccuguauuuccagcacuuugggaggcugaggugcgaggauugcuugaggccaggaguucaaggcugcagugagcuaugacugugccacugcacuucagccuaaaugacaggguaagacccuguaagacucaguucaaaacagauacuauuacacuugggccauaacacauuucaguuucaaauuugcauuuaaaaauaaauaaauagauagauaagaaaauaaauaguuucuguauuucuguugaaauugcccauuuuuucaucuguguggcccaccuuuuucacuagauucuuugacauauuaauuguaauuauuuuaaauucuuucuuugguauuuccaccaucagggccaucugugaaucucauuguuuugacuauucuaucucuugauaaugagugggaagguugcaggaguuugcuuuucaaguguaacauaauuuuugauugaaugucuguuuugugugcgcguguguguguguguguguguguguguguguguaaaagaaacuaagucucuaagucuaggagacuaaaguaaauacugcuuaugccuggaaauagguauacuucuucugcuaggccguuaaugugauugagggcuugagucaguuuggucaauggcuaagcuagguuugggguuuguuguugcuguaagcuucuccagggggugggcugcugcugcuguguucuucaugcgaggccuggacgcucagcaggcuuuucuuaaggauccuuccucaccaucagguuuuggcagauccuguguaccuuugccacagaacauguuucucucucucugccuuugucccgccacuggcaguagcccgcuggugcuuguuacuaggcacaagacuuaaguaggccagagggcuuuccuggggccccugcucuagcauuaguugggcaggugcucugcacuugagucucaggguuguggguuuaucagcauuucugccucuacccuaguguuagguggccccugcuucugacaccacucagggucagcggcaguguccuaaccacuagcuacauguggcuaucaaaauuuaaauuuuaauuaaauccaauuaaaugcaauuaaaaauuuacuuuuucagucauauuagccacuuucaggugcucuauaggcacaugugucuggugacuacuguauucuguagcacagauacaggacauuauggucaccacagaaagcucuguuggacagcacaggccuagaggguggaugguuuccuggcccuacuggcuguggcaggugagcuccaccucauaucuuuagaguagaagguuuggggcaugagaaagagguuucugccccucuucccgcagcagcagaccucuccuguggaucacugggguucuugggcaagagcagguuuucugccccuccccuuggugucagugcaggauacguagucagguucugucucucuccagaggccacgggucauugccuggaacagaacaccugcgaguuucauguuccacccccagcagcugguagcuuuugccuccugucaaagcagagugacauaugggacguggcaggugucucccuccucacucagaggcagaaggcuuuuguuuccugugugaggcaggucuguggccugggugguuuuugcugcucccuggcagccacugcucaucaccuuguauucaugcagcacagggacagaaagcagauggguuccuucaaguacuccuacuccacccucggaccuugucugugccaccugggggcucucuaagguauccugcccugccucuaaucuuucuuacgaacccugauggagccaguggaaaacagaugaguggcuguggacuuuccaugugccagggcccccagguuucuaaccuaaaugcuaguccacaauccuuaaggaauuaaccaucacuuguuuucuuccuacccauuuugugacggguucucucuugcucugacaaaggugagacuauucuguguuccauuuuuuuuuuuugacauuuaguucaucugauuguuuugugaccuuggcucacaaaauguuucaugaccuuaagcuuaaaagaaugacuguaaauuuuucagcuuuuugucauuauuaaguugggggugauguucuuuguggcuuuccacauccuaugaauagugauuuauuuuuaacuguguaggguuuuugaggauaacuuuucccacuuaauucuagauuaauuuccugcccaggagcugauaaaaguggaacuucuuauauuccauguccaguuagcucccccauucagucagggaagcaccccuauuuagaggcccuaugugaacuuaggccguuuugcuaugguuucucuaaagggguucuguuuccuaggaugcagucagacccuggcggccucaggcaagccucagcaaacucacccucagggcacuggcauuuggagccauuucucaucccuuucuagaucuaccuuuuccugucccauucauggucuuuguucuuugcuugugugguggaggagagagcuauuuggagggagcagguccucuuuuggggaauuuuuuuuuuuuuugagagagagggucuugcucugcugcccagacuggaguguaguggugcaaucauaguguacugcaaccuugaacuccuggguucagugguccuguagucucagccuccugaguagcugagacuacaggcaugcaccacaaugccuggcuguuuuuaaauuuuuguggagacaggaucuugcuaucuugcccagccugaucuugagcuccuaggcuuaggugaucuuuuggucucagccucccaaaguguugggauuguaggugagaaauaccacaccuggccaagauuaucuuaguuuucacauuguagcuuuaaaccaagauuugguuuaaagauuugaauuuuuccaaggccuugggccuuggggguaccccagguaugcugccagaccuuucccuucuuaucucuguugucuuugucucaaaggucugcuuuaccacuccaaacuacacugagguagagaaaugccaguugcugaacucuuuguguccagugccucaaacccauuuuagucuuaggaacuauggaucaucuggaaauuauagaacuuauguuuuuauugcauuagacacauugagccaaaacagucacucauugaguuaggacacaagcucauaaauacccauuuuauaaacauuagguucaaaagaaauuguuguuuguaacuguuuacgauagaaaacuucacgucucguauaaccccuuuugauuucaacauggaaggcaccugggccaauuagaaaguuauuucagaaacucugccuuuugaacacauuucaaaaacccaauuaacuuauacagguuucaaguuucuaagaucgcaguucucuccagccuuguuugcagaaacagccaaauuaguucuuacaaaauuaaaauggaauugccagugguuacaaguaacagcaagucuguuauauuguuuuauauuuuauuaauuuucuuucaugaacuuucuuaucccugauccucagauuguucagauguaggucuggguuuaacagaccugugccuuuugcacuuugccuugacaccaugcagugagacugugagucucugaguccaaacgaggguggguaucucagaguuccuagguaucagacgcuuuugaauuuaucuagaggguuuggguggucuauugauguaggauuugaaaauuauccccccaaaaauuuauuuauuuauuuuuuaauuuuuuauuuuuuuauuauuauacuuaaaguuuuaggguacaugugcacauugugcaaguuaguuacauauguauacaugugccaugcuggugugcugcacccacuaacucgucaucuagcauuagguauaucucccaaugcuaucccuccccccuccccccaccccacaacaguccccagagugugauguuccccuuccuguguccaugugaucucauuguucaauucccaccuaucagugagaauaugugguguuugguuuuuuguucuugcgauaguuuacugagaaugaugguuuccaauuucauccaugucccuacaaaggacaugaacucaucauuuuuuauggcugcauaguauucuaugguguauaugugccacauuuucuuaauccaaucuaucauuguuggacauuuggguugguuccaagucuuugcuauugugaauaaugcugcaauaaacauacgugugcaugugucuuuauagcagcaugauuuauagcccuuuggguauauacccaguaaugggauggcagggucaaaugguauuucuaguucuagaucccugaggaaucgccacacugacuuccacaaugguugaaguaguuuacagucccaccaacaguguaaaaguguuccuauuucuccacauccucuccagcaccuguuguuuccugacuuuuuaaugauugccauuguaacuggugugagaugguaucucauugugguuuugauuugcauuucucugauggccggugaugaugagcauuuuuucauguguuuuuuggcugcauaaaugucuucuuuugagaagugucuguucauguccuucgcccacuuuuugaugggguuguuuguuuuuuucuuguaaauuuguuggaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuuguccauuuuggcuuuuguugccauugcuuuugguguuuuagacaugaaguccuugcccaugccuauguccugaaugguaaugccuagguuuucuucuaggguuuuuaugguuuuaggucuaacauuuaagucuuuaauccaucuggaauuaauuuuuguauaagguguaaggaagggauccaguuucagcuuucuacauauggcuagccaguuuucccagcaccauuuauuaaauagggaauccuuuccccauuucuuguuuuugucagguuugucaaagaucagauaguuguagauaugcgacguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggaaaugcgggcucuuuuuugguuccauaugaacuuuaaaguaguuuuuuccaauucugugaagaaaggcauugguagcuugauggggaugacauugaaucuguaaauuaccuugggcaguauggccauuuucacgauauugauucuuccuacccaugagcauggaauguucuuccauuuguuuguauccucuuuuauuuccuugagcagcgguuuguaguucuccuugaagagguccuucacaucccuuguaaguuggauuccuagguauuuuauucucuuugaagcaauugugaaugggaguucacucaugauuuggcucucuguuugucuguuguugguguauaggaaugcuugugauuuuugcacauugauuuuguauccugagacuuugcugaaguugcuuaucagcuuaaggagauuuugggcugagacgaugggguuuucuagauauacaaucaucucaucugcaaacagggacaauuugacuuccucuuuuccuaauugaauacccuuuauuuccuucuccugccuaacugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauaugucccaucaauaccuaauuuauugagaguuuuuagcaugaaggguuguugaauuuugucaaaggccuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaguguuaaucaaggauauuggucuaaaauucucuuuuuugguugugucucugccuggcuuugguaucagaaugaugcuggccuuauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauucuugccacaauuucagauccuguuauuggucuauucagagauucaacuucuuccugguuuagucuugggagaguguaugugucaaggaauuuauccauuucuucuagauuuucuaguuuauuugcguagagguguuuguaguauucucugaugguaguuuguauuucugugggauccgugguaauauccccuuuaucauuuuuucuugcgucuauuugauucuucucucuuuuuuucuuuauuagucuugcuagcggucuaucaauuuuguugauccuuucaaaaaaccagcuccuggauucauuaauuuuuugaaggguuuuuugugucucuauuuccuucaguucugcucugauuuuaguuauuuguugccuccugcuagcuuuugaguguguuugcucuugcuuuucuaguucuuuuaauugugauguuagggugucaauuuuggaucuuuccuccuuucucuugugggcauuuagugcuauaaauuucucucuacacacugcuuugaaugugucccagagauucugguaaguugugucuuuguucucauugguuucaaagaacaucuuuauuucugccuucauuucguuauguacccaguagucauucaggagcacguuguucaguuuccauguaguugagcgguuuugagugagauucuuaauccugcguucuaguuugauugcacuguggucugagagauaguuuguuauaauuucucuucuuuuacauuugcugaggagagcuuuacuuccaaguauguggucaauuuuggaauaggugugguguggugcugaaaaaaauguauauucuguugauuuggggugaagaguucuguagaugucuguuagguccgcuuggugcagagcugaguucaauuccuggguauccuuguuaacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuaugucauggccuucuuugucuguuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacacugaugggucuugacucuuuauccaauuugccagucugugucuuuuaauuggagcauuuaguccauuuacauuuaaaguuaauaguguuaugugugaauuugauccugucauuaugauguuagcugguuauuuugcucguuaguugaugcaguuucuuccuagucucaauggucuuuacauuuuggcaugauuuugcagcggcugguaccgguuguuccuuuccuuguuuagugcuuccuucaggagcucuuuuagggcaggccuaguggugacaaaaucucucagcauuuccuugucuguaaaguauuuuauuucuccuucacuuaugaagcuuaguuuggcuggauaugaaauucuggguugaaaauucuuuucuuuaagaauguugaauaucggcccccacucucuucuggcuuguaggguuucugccgagagauccgcuauuagucugaugggcuucccuuugaagguaacccgaccuuucucucuggcugcccuuaacauuuuugccuucauuucaacuuuggugaaucugacaauuaugugucuuggaguugcucuucucgaggaguaucuuuguggcauucucuguauuuccugaaccugaacguuggccugccuugcuagauuggggaaauucuccuggauaauauccugcagaguguuuuccaacuugguuccauucuccccaucacuuucagguacaccaaucagacguagauuuggucuuuucacauagucccauauuucuuggaggcuuugcucguuucuuuuuauucuuuuuucucuaaacuuuccuucucgcuucauuucauucauuucaccuuccauugcugauacccuuucuuccaguugaucgcuucggcuccugaggcuuuugcauucuucacguaguucucaagccuugguuuucagcuccaucagcuccuuuaagcacuucucuguauugguuauucuaguuauacauucuucuaaauuuuuuucaaaguuuucaacuucuuugccuuugguuugaauguccuccuguagcucagaguaauuugaucaucugaagccuucuucucucaacucgucaaagucauucuccguccagcuuuguuccauugcuggugaggagcugcauuccuuuggaggaggagaggcgcucugcuuuuuagaguuuccaguuuuucuguucuguuuuuuccccaucuuugugguuuuaucuaccuuuggucuuugaugauggugauguacagauggguuuuugguguggauguccuuucuguuuguuaguuuuccuucuaacagacaagacccucagcuucaggucuguuggaguacccugcagugugagguguuagugugccccugcuggagggugccucccaguuaggcugcucggggggucaggggucagggacccacuugaggaggcagucugccuguucucagaucuccagcugcguacugggagaaccacugcucucuucaaagcugucagacagggacauuuaagucugcagagguuacugcuaucuuuuuguuugucugugcccugccccuagagguggagccuacagaggcaggcaggccuccuugagcuguggugggcuccacccaguuugagcuggcuggcugcuuuguuuaccuaagcaagccugggcaauggugggcaccccucccccagccucgcugcugccuugcaguuugaucucagacugcugugcuagcaaucagcgagacuccgugggguaggacccucugagccaggugcaugauauaaucucguggugugccguuuuuuuaagccugucggaaaagcgcaguauucgggugggagugacccuauuuuccaggugcuguccgucaccccuuucuuugauuaggaaagggaacucccugacccuuugugcuucccgagugaggcaaugccuggcccugcuucggcucgugcacagugcgcgcacccacugaccugcgcucacugucuggcacucccuagugagaugaacccgguaccucagauggaaaugcaguaaucacccgucuucugcgugguucaggcugggagcuguagaccagagcuguuccuauucggccaucuuggcuccuccccccugauaaccaaaaauuuugaccaauacaucaagcugaugaaccaugugagugaguguaagcaugauguugaaggaaaaagaaaaagguucauucuauuugaauuaagauguuaaggcaggaggagugagggcugcuguaugcuaaagggagcaaaaggcaagaauaauuuuccuagcuccagaagcaucguauagaggauaugcagcguugguugagaacagaaaggagucuuuuaagggugagaaucaucuugaaauccucauggacacauuaggaggcaugcauaaaaagcuuaggaaacagaugcaaaagcaaguugguugaaucggauugggagggcugguggauuccaggacuagagauagaggaugauauuugaguuguguuugaaggaguaugguagagggcaggccagaaaaaaaugugacugcauaagcaaagugcacaccuacagauacaguaaggguggccuguccacuguaacugaguuugaggauacauguugaaggaugacuuauguugagacaggcugagauugagcaguugguaugaauugugaaaacauuuuauuguguguguuugguuugguuuugaguagaggagugacauuaucaguucuaucucuuagaaagguugcucugaaucauucuccagcaagaauugaaggaaguagcacuugagucagggaggcccauucaggagacacgauggagccaggugagcaggaauagggacccacaugagauggccaugggaucugagagucaggcacauauaugagggacaccuuugagauaaguauugacaaaguuuggacaagguuuagacauacucaguauagguggugaagaauagggaggagucacagaugaaucuaggacgccuaccaggggcauuuugggauauugugauuuuccacauagagacaggaagagcagcuuguggguuuagagaggaaggaggggaggagcggauacuggauucacaauuaucuggguuaagugccugaggagugcuaauagcuauuucuguuuuuaugucuggauaagaagaagagauguacaaauuuaauaacuuuuaagaauaguuuauuaugaauauggagaaaauuuaacauuuuuagaauuucuaaacuucaucagcuuuuguccuauaggaacaagagaauaugccucauugucacuguuugaaaauaucguuaauucgauuuuggaauuagugaaucuuuuauuguuucuagaacccauauauuucuuggggaauuuuauaugccuugccaaggaaucauuuaagauaaaugacuucaaaauaccguuguauuuuauuuggcuccaaauauauaccugcaugaaauugagcauucuuauucuaucacaauaaggcauuuucuuuuguaaaagggaaaaucagaccacuugaaaaaucacuuuccuuucagagaccgacagcaucauuacccccuuucuuuuucuucauuucuccuuugugaaaauucuuucugauggucaucaacccacuuggcagagugcccucuauucuuaaucucuguguaacuucugcccaugagccagucagcuaucuuaaauaucaccagaaaagaaaguuuuaaauuucccaguuaggaauacuuuuuuggcauaccaaaugaugcuccugaaauaaggacuuuggguccaggcaugcuagaucaugguucucuggauuuugauaggcuuugagaguaaaaggugaaauuuuaaaguaagcuugauuucauucucuugacaaauuuuuuggguugguuaauuaucccauaggaaaauagacaaaagucuuuguggaacaaaauucuguuuuacuauaguuaagguuacaagaguagaguuacauugaugugagggauugaacugacuagaggcauuggcugugauuuuucuacaguuuuuuaaaugguaucugcauucucauucuauaugucuuugccuaacuugaacuuuuuguggggaggggaagcugguacuacccaucuagaacauaaugugcauuaguuggaauaaugguguaguaagguagucuccaagguggugcugguaaucucuuuccucccuguaugcaccugcugcucuuuacauuaagaaguacaguccaguuuccuuuccuugaaucuaagcugggcacaaugacuugcuuggauaauagaauacagcagaagugauguucuaggauauccgaggcuggaacagaauaagcuuugaacuuuugucuguaucucuugggaccaaucaccauguugugaggaccucaaguaauguggagaggccagauaggcaugccacauaauagcuaacguguacugccagccaucugaguaagccauuuuggcuuucuagcuuaguugagccuucagauaacuucagcugcagccaacugacugcaacugcaagaaagacuccaagugaaaacuguugcagaacccagucaauccacaaaaccaugaaaaauaauguuauuuuauaucauuaaacaaaauaauuaaaauaaacaaauauuaaaccauaaacaauaauaauguauuaaguuuuggaugguuuauuauguaguaauagauaacuagaacaaguacuaaauauuacauaaugcugaauaaguacaauuuuaauuguguaauauucuucuauauuuuaaaugauaaacauuuauggacagagcucuaaagugagcacuuacuaaauguucccaaagagaaguuagcuguuguaucucaauaucaccauuuaccaaugggaguuguauuuuguuuuuggaaaauacacaucuuacaauucaguuuaaaaaaauauacuaucaguuguuuagaaaggcuuauaguauucuaaaaaagauuugggagacccaggaaagugugaacuuaaaggcucucauuauacuuacauacuauuuaaucuguaguuucaaaaucugauggcaaauuugcuuacauaacacugaaauuuauauaaauaaguuaaauuaagagcuuuccuuuuaaguaauuggccuuauaauuggugucauauuaggauggcuaaagugaauagguucaucaccauuauacgauuuucuccuuaguacuuuauagaacauugaaugacaacgguagagucugaaacugaguuaucuagcaguacuacuguaaucagaaugauacuuauuugggggcaucaggaagguaauucuugcuguugaggcugauggucuggcaaacucaagcgugggugaucucugcuuaagauuaggagguugguugggacguucccuauuugggacuuucuuuguuaaugcucucugacuaaagcuguuuuaaauacacaaaccucuguuuuugaauuuagaaaacuuauuuuuauaauuuguuuauauguuucuccuuuuuagguugugacuuucauguagacaggaauuguagcucacaucucuuuuuccuuagcagcugugugccuggcaucuagugaguuauuagguuuguugaaggaaugaagugaaauuaugucagaagcgaauuauuaaauuuaccaaauuaacugagcaaauauauagcuagauaagauauaugaauccauucauuuauuuauucaacaaacauugauuaaaugacuacacugugcuaagagcugggacuauagcaguacacaaaucagacauugucucuaccuucaguggagcugggagucacucauaaguuuaauucuuuucuaaucagcaauuccuucucacuaaagacuugacaagaagguaugagaaggcaagagugcgugcauucaucagauguuugugaugugcccaacugugugccagcagcuguagugucacaggcccugcuugugucugucaggaaagacggacacuaaggacauuauuuuaaguaacacauaaucccaaguaugccaagugauggcgugggaaaguacugggucccaaguauauaacugguaccaggccuacuccgagguccuggagucuuuggcauggcucucucuuagcucucaguugcccuuccuuguugcugugguugucuucuucaguugcaugugcuucucugcauuuccacauuuuaccauaugggaggcaguucuaucugucuaggcaggaauaagcaacuguacaccuauuacucugaacuugaugcucugcauugauguacacugggcccggccuucccugguugccugucuggaccauucuugucaucuggcucugaagaguuuguuuuuagagguauacuugccacagaaggaagccagagaucugugauccucugaugaagccacucucacccuaguuaucugccugacacgccugacagaugaagcucaggugggcagacaccucaggccacagcauggacuauguacaauucuucaagcucaagccuuaacucuccuacuuauugcuguuguaggacagcauacugggauggaaaugaaugaaaaugguguuauuagggguuaagauuaaaacccaccucauuugugaaaaggaaguagacuuuugcaaauuauaguauuuuauuuuuaauaagagaucacuuuacaacuagucacuaucugugugccauuaauaugucacugugccagagauugugcucauugaucuaaagacuguguuucuuggauaccuggauaggaaaauucacuaauucugcaaauguuuaguaagccaacuauaugccagcacucugcuagguguuagggauacaugaucgaauauauaguacaagaugccugagaguguccgauaacuucauaugggugggucguggaguaaaauagaagguguacuaaaaaagaggcgucugggaugcacagagggcagaugauaaaaggucgucucugaaugcuggauaaacauguuugggcuuuacgcucagggcucuugaggagcuuuugaaggucagugaucucagaguguuggcauuuucagcccugcuaauuacuuugucucucgcugguuacuggccacuaccagcaucaucaaucaucgauuaguucuguuugauccagcaagcccacuagugggugccuguccaaaugaaaagaaaucauuauaucaaaaagauaccugcucucguguuuguugcagcacuauucacaauagcaaagauguggaaucaaccugaguauccaucaacagaugauuggauaaagaaaaugugauacacacacacacacacacacacacacacacacacacacacaaaaggauaguauucaagcauagaaagaaugaaaucaugauuucugcaacaaaauggauggaauuggaggccauuaucuuaaguggaacaagccagacacagaaggccagacaucacauguucucacuuauaaaugggugcuaaaaaaauggacauacagaauggaaugauagacaguggagacucagagggugaggagugagaggaguaaggaugaggagaaauuacuucauggguauaauguauauuauuugggggauggacaaccuaaaagcccugacuuaauuacuacacaaucuaggcuuguaacaaaauugcacucguaccccauacauuuauauauuuaaaaaguauuagacaucucuuuucuugagccugagccuggguucuccucagccugcugacaauuuuuuguuauccuguccaggugauuuugggcagagauaagggagugucucaagacgaugcccccagucaucgucuugagaaucaguagagcccuuuccagugggcuuuuccuagucuccauuuggucucccucuuucucccacugcuuuagagcaaggaauaaaacaucugugguuaaaaucaaaagacuguaucucccauccagccuccagaccuggcaggagaaaucucagcauuuuaagugaacagcuuuuuuuuuuaugccccaguaggguacaguagcacaaaggccaguguccuguaagugccuccuuuucugucuaucacauaacucucagggacuguuaccacagcuggaaucaguguuuuaacugagguauuggagacacuuaugagcucauuaucauuugaacauaugaauaauguaaaauuuagacagaguuucauuugaaaggauuauuuaaggaacuuuuaguuuacagauugauuuauauugcuguuauucugaacaguaggaauaaaaucaguucccuguaguguaaguuggaugacaccauggugacacagggccuuucuugauuaucucacauaaugucaaaaauuaaaagcaaaagaauugaucuuagggaauuccaugacaguuucuauuuaacuucacuuaacaaugacuucaaacaguuguuacauguauagagaacuccugauuaaagggacuuucuuugaccaauguguuauguuucuaauuguaacucuuuaagaacaugcauuuggucucagauggccaacuaacuguuacagagucagcuucugugcuaugugccguguacugaaggaacaguuaagaaaaggcugcagcccuugcagagucugggggagaagacaacgagauaaagcauggcaaagaccacgcugaaaguaucccagggugcuguaugugcacauaggaagaucacuuaccucagcauaggaggagggcuaggcaaggaaaggugucggaagaaacagaggagcguuuagucugcagaaguagaaaauacacuggagacaucuauguggaauggaaaaaaaaguggcuaagccccagaauauuguccaaaaggaaaccaggaaggagcagccaaagaggcugaaggagaaccaggagaaaacagggagguggcacugaagccaagggaagggaagcguuucagcauuucugggaaaaaucacaugcucugucugaaucuugcaguuuuaugauacauauaaccauauuccagauucugagaaauccagcaauaaaggcauuucuuauaguuuguuuaggcuaguguuugccaggcuaguuugaacguagugaguaaggguguguguguguguguguguguguguauuuguguguguguguguguguguguguguuccacuaacaucucacuggagcuagucuuuuacaaaacacaauucaagaaucucuggucuaaugcaucccauguauggcugcaucaauacuuauaaagauugcuuugaucaacugucucaguugcuaaaaaaaaaacaaacaaacaaagcccucccccauccccuacagcggcuccucucugccugcagaauggagcccagguggcuuagccugggugcccugugccaggcuggcugugcugccugccgucugccccgcccgugcccccuuccuccuggacacucugggccucagccaguuuggaccauguguccuucuccuaaggaugaccaugcuugccuagguccacuucaauacuuuuugaggcuacaaauaaagcagucccucuccuggucaggucucacuuuuuauacauucuucccugccaccucugccaucggcauacuuuacugguacauuaauuauauuagcccaguuuuuuuguuuuuuuuuuuuuuuacuuuugugucauuguuuuucuucuguuucuuuuuuucuuagagcuuaguucacguauucauucagucuuuccacaauauaacugcauguuguaugauuuuauccucauccucauugguauuuauauaucuuuuuuguaaaaauggagacuuucuaaauagaucuuuauuaacauuauuaacaucgaaaggacaguguguuuaaaaccuggucucagccaccuggaguucucugcauacccagaaggggagugggaagcuggcauuguugcauuagauauucuuacagugaaagagaaccaugugugauggcaacauuggaacauggaaaacaaagcaucuggcucugccccagggagaccagguaggguccacugaggaagucugaauuggaucagaaaguaugagucugaguuuucuaggaaaaggaacaagauuggggguagggcauugcaaaccaacugagugucgugugcaaggaugugaagcugugauuugugggugggugagaagcccacuguaggagagagcccaaggugugcguuguugagaacuggagcaugaggugggggucaggcaggcauggcaagacugugaggagucccaggugcugggacaggaagauaggauugauuguguugauaacaguaagucagaacaggcuuucauuuguuucccagugagagaauggaguaauaaaaugaacaauaagacuagguguucccucuuuacugaaacacaaaccuaugaaauaaagaaaauauucaguccaagcagcucugucuaucccuugaacuuaccuauuuuucuuucauaucuuuuuucuuuuauaucacacaaauggucuuguagguugagacuaguaaaacuauaacaauugcuaaggcuguagguauuugcuauuacuagcuagaacaaaauacaaugcacaacauuucuaaaaugucuucauuauuugugaccuauuuugagugcagucuagagucacagaauaucccagcugcaaagcauauaagaggucaguugauccaaccccuuuauuuaaaaaugagggaauuuaagucaaaauaucguaaagacuggguauagcuaguuauagcaggaauauuucucucucugcaagcacuucgaugacauuaucuuuccucaaauucauuuggucaugaaauuaaagggaaacugaauaacagguuagguuagagagcaggaguauuauaccauuuuuuaguuuuuauaguuuuuuauuuuuaguaauauguuauauaaaauuauuaccuguuuaaaaaauuuuauugugaaguaaccuguuguauuguccugagguaacaaccucagagaucaguuauuuucaagcaauacaucugauuucaagagauaaguuacaaugaauauaaaauuuacuuguuaggaauuuauauuguuauuacuauuggaauuugucuaucuuuucuguaaaauuggagaucuuguaaguggaucuuuauuaaugugaaaaggacaaaguuucugaaagugcauaaaacaaauaauauuaucugauuacuuaauauuagauguuaagaaguauauuuuagaaugaguaacuuuuuauugaucauuauauacuauguacugaguuaaguacuuauauucuaaucaagaaaucuuccuaaugaucauaugaacuguguauaauauauucagucuuaagaauaaaacaauagauaauagacccugcaaauucucccuuuuuuauguucagcuaccagucuuuuagaugaccuccauaugguaaagacugcaggagcuccucuuaagccacccaaaugccuacccuuauccugagaugguucaacauuaauuugaacaccucaucagacacacaguuccuuaacuaucuuagcuauaggaaccauuacaacuucugucaccuacucacagaauuauacccuuaauauuuucaaccagcuuggugucagaaauuccuugccuugcuaaucacagagacccagccaugucucuuaaacaugaagggguuuauuuauaagugugcagaaguaggcauuccagggauaguuugacacuuccacaaagucauccaggcauguggcuuccauugucaagguuccagugugacucaagauggauuuugccacucuggccaucacauccucauuccaggcaacaggaaggaggaggcaagagaagguaacaggauacgccccugcugauuacacuuccacuaaggagcuuucuggaaguccuacccaccaacuuccacaugaccacacuuggcggugaggaauuccggaauuaucaucuuuucuuaagcuuguugccacacuaaauagaauuacuuucuguuacuaaaaacaagggaauaaauauaaagcagauuuuucuccagucucauuugccagcccaaaauuauaccauucuuuuucuagacuuuuguuaguuuuauugcuuuaacugacaucuccuucucugcuguacugccuggccucuuacccauaaguaaauuuuuguaaaaaaaaaaaaaaaaaagaagaccucuguuuaauugaaauugccuccuccaucauuuucugaccaucucaucucauagccgggugagggaccccuucucugugcuaucaucacuuguuguacauugcacugcacugagcucuuuuggugucacuuucucccucaaauuacaccuguaaaaaucucuugcucauggugggcggaacuucagggucuagcugacugccuagcacacggugggaaauuguuagguuguuugcugaacugacuguaaagugucauagucaauauucaaguguaaauagcagggcuuuaggugaguacuguuuuagucccugucucuuuauuucucacagcugcugcaagggaaacucuuaagggcuuuuguaucuuaucugcaccucuuuuuuuaagggccugggcagaguggugucagagaacaacuucgucucucuggcuugggcagccccauuuguaacaauaauacaguagaguuguuucaggaaugucuacuaaacuccuuuaugaacuugguauauccacaaagaguguguguacagcagauugcagauuuagcuaaaauaaaccucuauaaauauuuagcauugaagcugauuguugcuucaccaccacuguauuaucuuuagacuuuaauaauauacuucaggauuuaaaagaaaguacaugcugucugaaauauauauauaaagagaguuuuucuuuguuuuaaagauaggcaauaugcaauuaauuuuuaaaagaaaugaggccauuauucuuagaaaaguaauacaguauuuccaaacuauuuucuuucuggaacagaaauuuauguucaucuuguucucuauucagagaauuuuaauuacuaagguaucacagguaucuugggauaaagacuuaucuguaugaagaucccauuaauggauuucaagaacuaugcuauguugagauuccuaaauaauuuuauuucuacauaaaguuacccaguuauauuuacaugauucaugugccuuuuucaauuuuggguaacauuauauuuauaugcauauugcaacggugaagagaagaaagguuaauauaauacguaaaauauccuuauuguguucauauuaugugccaaccauuaagauaagcaaaaugcuaugacauagauauaauauuccauguuacagaagagggaagugaggcuuagagagcuuaaguagcuuguccaaauuccagguagucauuacuacaaugacuauuaauaggcagcccaagacuggaaauuagcuuaucuuaaaaaccguauucuucauuccuagauaugcagccaucaagauguucuaaaguauuauguuccguauugaaugaacuaaucuuuuagaaaaaucauaagaaaacugguaucaauuucccauugaguucaauaacaacuuguugcugcuacaguaucucuugggucuaccggacucccucaguacaugguccucaggauuccuguucugauguuucuugcugggaccacaccaagaugacuggcauggggacaccccacgcaggaaaucauuuaguggugccacuaggaccucaacaccauuuucccuucacuuauaccuuagaagcuauuuucuuugaaauauuuuuaaaacuuugaaagccaccaggaagagauauuucaugucccuuguaauacauuauaauaagggaaauuucaauguagagagacuuacuguccacauuuuuaccuaaauuccuuguauuguaguuucuuuuuaucguaggaaaucaaaacagcauuuucaauaugagucuuucauauccuugaagauggcuauuuuugauaccauaauuuuucagggagauacgucuaggccaaugaugacucacaguaggucacauggcaaguuuauaucaagauugguguuuaggcugugugaauuauugcuuugaaggaccuauggggccucucagucaugcugccuucaucucauggauguugugggguuuaaaaaaaugcuugauuucaguauuucuagguauuauaauaaaacauauucuuaaaaucaugaaggaaauagagucuuaaggguaaaggucauucauuaaaauagaguuauggaucuuuccuuuugcuccauaaaaaagcuguuauucuuugauuucuuuauuuuuacucuaauggaggcaguuauauguucuaagaacaugguaucauuuucaguuugaccaaaaccaugcugaugcugaaguaaaaaccugcuuauccugagaaacaucaaggcucuggcucucucuuucuucacuuccugcuugagacuucaucucuauacacugugucaaccauaauucauuagagggaaagccgucuccugcgggguccuagauucauaucuuucuaggcaggcuucaguuuccuagcuucugaggaauauuuaauugugcuacuuguaaaauuauauucuuuaccuucaguuuuugucucuccuuuaguucugcuuucaauuguaaauuacauuucuuuaucacacauuuggauauuuuucagacaaaucauauuucuuguguguauuuucuauuugguguaccucuccauuauggaagcucuguaguguggauguuacccuuucuuguaaccucaguucuuuucuagagcauuuuaaaauaugaauauuaaaaggccaauaccaugcuucuaacgcaacacuaggcgacguauguaaggggcagggggcgggguagauguugcuuggugggaaaguggaggguaauaauugguacaaaacaaauuaguacaccagguuccaugaugucauauccuugcaaaaugaaagcaaacauucaccuaaagaaaaaauugacgagucuuuuuaugaauauuguauauucuuaaguguaaauguucucugaaauaauaauugucuggaaucaaaucagaaaaaaauauauauauguauauauacacacacacauacauacaucauuuaguuuccuaugucauuauguguucaagauuauaaauggaaauaauaggaaacagaagugggaacaauuucccaaauacauuuucaucaccaaaugcuauuuauuuauacuguaaugacauaucagacagauggauuauuaagguuuuuccugucuuuuauaaaucucugauuuacagugauuaugauggugcugauugcuuguggccuugauacuagauucuaacagaugaauaggguagacaacugaucugagauuuguugucuagaaaaccugaagcaggaggaaagggcaagagggucuggggacuggcaaugagaccggaagccuuucaccccggggucagcaguugggccaggcuaagcugugagugauauaaaccacucaucuaaggaccagcugugaucaugacagaaaacugacagugaucugauguucuucacugguacuuucucucucucucuuuuuuuuuuuuuucuuacugagauggagucucacucugucacccagguuggagugcaguggcgugaucuuggcucacugcaaccuccaccucccggguucaagcgauuccccugccucagccuccuaaguagcugggauuacagacgugagccacuguccagcuaauuuuuuuguauuuuuaguacagucgggguuucaccguguuggccaggcuagucucgaacuccugaacucaagugauccacccgccucagccgcccaaaguguugggauuacaugcgugagccaccgugccuggcccuucacugguacuuucaaaaugcaaaauacuuuucugcuucagcaaaaagugguagacauuuggagaugcuuguuaagcuuuaguaccacucuugaggcccacugagugccuggugauccagucuugcagcacuggacuugacccaagucucaaauauucuggaguuuucaugccagacacagacuggaucguaauccaaaaacucagcacaucaguggggcaguucuagaggcuuucccaggacuagugucaaucugcauuacacugaauuccauuuaagucaaaccuuuuucauuaccuuaugaaucauaucuauauguuucauuucauacacacacacacacacacauauauacauacaucuuucuuggaugcugcuguagguugcucuuucagcuacuccuucuauucggugaaugaauguacuccagucaaauguucacugugccaguguaaguuaaaaugaacauuuuacuggaauguggugugccugacugcuuuggaucuauuacauauauuuggcuuuguagaggcaacagagugaagggacuaaaauuaacauguguuuucagacauguaagcagucucccaugucauugccaaaaaaaugacauuccaccuagaauauagucuuuaacaugcgggacaguuuaucaccaagaaauauaugacucaauggcugaauuuuaaauuuuuuuaaauacugaauuauguuucuacuccccacuggcagagcaugaguugaguuuuccacaucugucccauuaggagccauugccaaugcuguggcugcugcaugcuaagugucuguuccuuuucuugcaauacuaggcucaaagccccagaggcuucuaucacucuccaucccacccccauuugugucuucaagugcccaguguaucuucuuucaucccugccuggagagaggcccuuuggagauuguuuguggacauucuuugaggggagagaaauguguacucacugaauucucucugagcauucaggcuuaguuucuuuauguacaaaauaagaauuauguuaaucgaaucuucuucuggguguguuauuuauguugacuugacauagaggauaccuggcuauuaguagaaaaacaacugcaacugcaauuguaaaaggagagagaacaaaguacugggagauugugcuggcaguucuuuucuuacagguuaacauucucugaaggcaccagugugucuaaaccaaauaaccaauguaaagaauuacagcaaaacaaaaucaucuaagcaugcaaaggaaugauucagcacugagauccgugaguccaugaggcucucuaugucuuuggauauaauuaaaacaaggaaauuaccucaauucagccuuguuuuaccuaauauauucugagaauggguuggaugauuucuuaguaaccuagacagcuuauaaguagcucucucuguaaaaauauuuuuucuuaaaauaacaaaauaucauccucuugagggagaaagcauuuuguuuggccugaggcaaaacuuggcacuucaguccaaagcacugcccuucucccucccuagcccaacccuccaucccugccccuguagcacucuaccuugugcccacucgggugagcagccacucuucgcaguggggcagugugugaugggaaagggcuagcuagaggucuugacaguacuuuuccuugguaacuaagcuuguucugccagugggaugcuagacugugacuauuuagauacgagaugagagaucagggcauaggaagaaggggagauuguguuagcagaauucuucuuaucuaguacguugcccugugacagcuggguggauuuacaggcugacacauacagugugucuccuagauaguaucuaaauggaccauuacaaugagcugugauuccugaauucagaugaugcuguuuaauauagaaacggaguuggcauuuucuuguucuuaacaugagcuuucugguuugcaccaaauggagggguuacccaggguguaggauuuucagggcuaaaaccaggcuaguccugggcaaaaagggaugguucaucacucuuuccaugguuuuugaaauaaguuaauggguguucuuucucaaggaacacacugaacugaaaacagccaaaagcuaguagguaaaaagucaccaaggccuauuaggaaaaaaagugaaaugugaucuguuucugguuacuacugaugacaguagggucauuuuauuuuggagguaggagugguguuuugcagaggugugaaguauauaucugccugaugaagucuguguagcaucaucagauauuacaaaaguuuucacaaacacccauuugugaaagaagauugaacucaaauuugcuuacagaaaaaaaaaaaacaacuguauaucagaugaaaaguguaaauaguaaagaugcuaauuuucuaaguaaaaaaaaaaaacuucugcaguuaccuuuggaauuuuaaaauguuaaugguguucaaguuuagaauaaacauuucucguuuauuacaguaauacuguugucaucuuuuucuuuguuuuaaucuuuuaggcugaaugacuuuuugucagaauauuuuaugacuuuugagcaaacuaaaaucuagcaagaucucugccaggacaacuauagaauccucaccugugcaaauaagcuguuuuuucagcauuuuuaaguuugacuggggcagguuuaugcuacuaccuccuugcaucugugcgguguugacucagagauguaauuuauauugauaugauuuccucugacuucugcccgcuccuugaugguuuuguuucaccuguugacauaaacuuggcugaaaugaaugcucuguuagucaugggugaauuagcugcaugugugauagcaccuuucugcuguguucuuauuauuuucaaaauuguguaaugggauaaguauguuuuuuuuagaauuagauaucccuuuucuaaggcuuuacauguacauaauuccuuucuccugcacaccucugaauaaacuuuaugguuuuauucaaagauggauuacacuugccaccaucacauaugucagaaagcaugcuuguuauuuuuggaagugaccaaauugaauuaguucaguucuauguggacuggcuggaucugcuucuuaaauguaagagucugugacuauguugaauucucauuucacuucauucucuguacuccuauauuaucugccuaaaucgacaaggauacuuuguauuugcugcauaccauacuucaaauuguguaguaacaaaagcugaaggugauggacaagugcaccucaacuugaucuacuccacccgccaggauuuucuuuacuaauccauuguacucuucuugaggauaaggaccccauuuuaaaccuuuuuguguuucccuugguuucuaacacagugucuugccuaauaccgcauggagacuuuugcugaugaaauuacucucaaugacaucaucuaaucaugggaauuaucuugauugcugucagauccuuuguaaauagagcuuggaacacuuaaauuaauugguauguaagcuuacaguacugguucaaauauaggaaaagaccuuuuuagaggaaguauuuaauauuuuucuuccuaaauuuaccuuuggugauggauuacugggucugagacuauacacuugucaggaauguuccauugguaaaggaaacucccagcaacaugcaaaaaaaaaaaaaaaaaaaaaaaaaaaauucaagcuaucuuaaauuuguaagacuuacuuugauuuucauuagcaauuuuuuaagauaaaacaacgaggaugauacaugacaagagaaaaagacaguuacaucagaaaccugcucucccaacucugacaauuuauuauucucuuaguugacuuccauucugaauguuauuugaaacucaacauuuuugccuuggacacuauauauaucagucggcauaaguguguguauauauauguuuuuauauuuucuguauaucuucuauauuuuuuaucauauuuacuucccuuauauuucuuucucuuucauuuguacuuccuuauauuuucuuuacaauuugcauugauuuuucgaaguuugcaucauaauuuuuuaagauggugagcauaacuuuuuucuuguaacaaaauuuuccuuuucauaugauuauucuucuuuuguaagauuaaaauaaaaucuaaacacuuagucauuaugcagggaaagaaguaauuucccauuagauacuuuaaauaauaacacucuuucacuuaaccagcauuccuuuucuuucaaggauuacaaaggacauucuuuacaaugcacaaguacguuguucucagaauucuuaucagcagauuuuuuucggcuuccuuuguaacucuuguuauguguguaagaaaaauguugcuguguaaaagaacucauucccauuuuuagagucaggauucuuagacuguguuguguauuuucauuuuuaauagccagucacugacuuugaauuuuucguucauugucagugcuaugcuucaauguaagcuggaaguauucugugucacuaggauagggccauuagaauaugguguaaugauugggaagauguaggcaguaggaugauuuuuaucccaaacuaaccaaaagcccaacugaaagggccuuaaaagaugaggauuuauauuaagucacaugacaagaauuucagaggaagggccauccaugguugguuaauagcucaacagggucguuaguggccccagcuuuucucaugucuccugcuguccucagccagcuccucgcgugcucagcacauggcugcagcagcuccagcagccucuccuuauguggucuguaucaacaggcagaagaggccuuuuccagaaucucccauagacuuaccuucucuucucaguaaucgcagccaggucgcaugcucuaagcuaaacccaucacugcacgggaaguggaauugcugucauugguuuagcccaucaguccccaaaugcgucugcaaaucagaaucaccagggaauauuucaaaacugccaaagcccaggccauaccucagaccaugaaaucacaaucucuggggguaggcaucagcauuuuuugaagcucuucgggugauaacaauguguaggaaguguggagccaaggcuuagccugaucaagggucacucuuuuggcugggcugggaaggguccuccuccagggugcuuaaccaagcagaaggcaacacccaaauagaaucaggguucugcuagcagugauauagacuagggaagaggcucagguaggaagcagagucacccaagacacaggccugggauuacaagugccuuauuuuuuguucugcucucucugauuguguaacugucagggucaugacuacgcuaaaugucacgcccagggucagguucugauccgugcugagguucgagggaguggguggaugagcagaaagaacacucgggggaucguaggcaggugaaagaugauuuuauucagcagcagcucucaucaacagcuuucucacacuguccacccugucuuggcugcuuaguccggcagcccccauacacaucugcguagccggcucucccuugccuucaggggcaguggcuuaacucuuucucucuuuggccacaagcaagccgaacguguccuggcuccccucugucccucugcaaagacggacaacucugucucucucuuucucugggcacccgcgugcccaccaugucaagccauguugagcugagccugucaacagggcaauuauaccuuuuacagauaauaguggcuuagagccaagugauggccuucccauguuacggcuacauggcugugauaacaaguggaguucuacaccugcgcuguagacucgcugagucacucuggauguuuaccucgaccuauccuuuaccaaagcacagccauugccuuacaauaaccuugaucacguuuuuaaacaaauguuucuucauuguaaagugagaauaaccauagcaaauuugcagcauugcuuaacaacuuaaugggaaaacagucucuaaauuucuuagcacuuugccagccagcagaaaguaggcaguuugugaacauaggcagcagugucggggugguagaguauaauaguaguaguagaaagaguaggaguucuuacugaugcuguuuuugucauuguuauuaucauuacaaugcuuaugguagaggauggugaacuagaucagaaguucucacuucugguugcgcauuagaggcaccuugggagcuuuuaaaaagcuagugccugucccuacccaaacuaguuaaaucagggugagggugggcccuaggcaucaauguuuuuaaaaagaucccuaggugguuuaaaugugcaggcaggguugaaguccacuggacuagaaauuaggagaauauuagggaaaaguuuaguuucaucaguuuugucucacgauuccaaauggacuaguuugagucacccugcagccccaggaaaacaaggcuuuugagcugguuuggaugauucuuugcaugcuuuaugccagauaagcucuuuuaacaccucuaugcaagugacaggacuuucuggcugcccagccauuucauuuauacacacuauucugugggccucagaguggauuaauuaaaagggaccaggugccuccuuguuucuauuuaaagacuguaugcaacacuuuaauauaaaaauuguauccuauucacugugcuuguuuuuaguguucuauguguugcuugugcaauucauuuuccuaauuuauagaaguguguuuuucauuagcuacaaugcaaaaccaauuauggauguguuauauagaaaccugcuuuaaauauucuccuagcuuccuaagaguuauaauuuuuagaugcauuguuuacuaggccauggguauguuuugucauauguugaaagaucacacuggcuauaaaaauaagacggugaauaaaaagccacaaaagcuauaaacaucuguaaaagaaguuuucuaagcaaggcugcuuguuagagggaaacucaaugcauuuugauuguaugcagcugguggcacaugcacuuucagaaaggggcccauuaagaggaacuguuagauauauggcaugccguacugugggcuguagcucuguucccucagcuguguguaauagaaacccauggggccacacuugcaaacccuccucuaaauuucacccacgauucuguugcgaauuugguuuauagaagcaaguagucaucuuuuggucucaaagcccaucaugcuaaacgaagauuacuaaucuuaccugacuccuagaaaaguggaggacuccgaaaaucacagcauggguuucacagccucugccauggugaggagcacacaucagucugaccucugaucaguggucaggaccaccacaggccccugucuguagcucucuuuuauucuuggaggaucuguugugggauugccauaugaaguacagauguuggcccaguuauacacauacccuaucauauaagaguacaagaagcccuuuacuccagacacaugugaacagcuuggcuaugcugggguuggggagagaagggccagguuuugggaaucuacugcucaccagucugcguuuuuguggcucacagugaggccagucccuggagcgcuggguugucucaaagcaggcauacaagacaguuucugacuucugagaugguucaauguuuacaugauccaucuuccugauaucaaaaauaguuccccuagauagagaaagacaaaaccccugaugcagaaggauaauggcgauauuuuuaaguuuuagaauagcaugaaagcagcuuuuagaaaaacaaauuuaacuuuuuaggagaaaaaugugaaaucuacagaagcagagaauaggauaaugaauccccaaguagccccagcccaguucaacaaguauuaauuuuuuuuuccauuuauaacuuccucacuacccuagccauaaaacuugaauuuuuauauguaaaauuaaaauuauaucuaauucaagguguaaguguaauuaugacguagacaucuuuauauaaggucuauuguagaauuuguucaucuagauuaugauaaaauugaauuaugggcauccuaagaucaaagauauuuucauucuagaccagugcuuuucaaaaguguggcucgcagaccaguggcagcccacaaacucuuuauuucuggucuaugauaaauaaagaaaccgugaagaaguguuuagaacucuuacagcauuuuggcauugcugugacauucaaguacaugauaauuuuucuaguaauucguuuuuaauauauuuuauaaaagcaucacucugcaacagacugggaaaaagucuuuaauuacagauaguuugagaagcacugucuauaguguuucugugguuugccccccaggggacguuuggcaaugucgggagauauuuuggguugucacaacuggguggaagauggaguggggaaggguguacuacugacaucuagugggugcacaggacaguccucacaccaaagaauuaucuggcccuuuugcugagauccagaaaccuugcucuggaccagaguggggaguuuaaguacucugugccuugucuaaggaaaguuuggcaaauaguuucuuaguacaggcuagaaaguaagucaacaacugacugucuguaaucuuccucacaguugaggcuccauauuccacaguggaaauuagugagacauuuugcagaagagaaaguuugaggguuaagugaaccugccccacaucuuuuaaaaauauaacacaagccuuuuuuguuuacaagucagugucaucuaugccacaguuuguaaugugucugacagaucagccacuaugguagcagcugagaagaugggaaacuaggaauuuauaaaauuuaguuuauguagaaauuucauauuuaagaaauucacaccaaaucugugccucauggauuuuuuuaaauaaaacacuauuuugcuuucagcugaaccuuuguuuuuaacauuuuuguuaaggcaaacuucucuaaaaucaaugauauacaauuaaaggcauuaaaauguuccacuuuugcagaaaggucuaaguguaaauugaugaugugguguucucaaggucucuccuuagugagagucccuuaugaauuuuuuagauuuucuuuuaaauuuagaaauaggaaauaauuaucugaugaaauaugucauuuuugugaguuuuaauagaguaaacauuaauggcuauaaaauaaucuaaucuagaaaaaguagccaaacaaaauuaauuuggaacaaaagguaugcguacccuuuaaguccuaaaaugucuuucugugugugugagagagagacaaagacugucuuccacaucugauuccucuuugauaagcuucucuaaauuuuauaugaaauccagguuggucacauggaaauuauuucauuaagugcauacacuguggcuuuauuacagcuuugagcaagacaaauagagaaaagguguaucccuagugcauucacagaagauauaaccacagaggagcuaguguuucacucgcaaguugaaccuucuccuaagcaaacucaugauuauauauguucagaagaccacaggcucugacaguccucgccaugcucacuagucuuccuguuuucuuucauugccuacaaguuucccuuucucaauuucaguagagucagcuaucacggucaugaaagagaacuauuaagcaucauucuaugauuuugugacaccuuuaccuuggccucugacuauaagagaaagagcucacugauuuuauuuuccauuuuauuugauuguggucuaauguaaaccauagacagcaaccacaggaaaucuuuggauuauguaccuacuguauguggaucauccaccugugauccauucugggauggauccauccagggauccgagguugacccauccuuauccuugguagccugucugauggggucauaccucuaaucuuuuagucaggaauucuuagcucaacuaaaagaaagcuucuaaucaauuucuauuucuaaagacuucauguucagaguccuccaaaguauaucuaaaauuuaacuuuguuucuguagaacccucucagaugauguugagauuuauuaauucaguuuaucuuaucaaaaaaauguaacauuugaagauacuguucuuuuauauaggugggcauuaacuacacaaaauacgacuuuuuauuaccuagauuacaaggugcagcacauagagcuguguaaauccuaccuuuugaaugaaaucugccaaguauuguuugauuaaagcuagacugaugagacuccugauuaauucugccucuaauagauuacacaguuuaacugacaaauacauugccuccauuuaguaaugauucccaaguugugaugacaaaggacaagcuauuugucaguuaaacuauguaaucauucagaaacagaauuaaucaagaaccuaaucauucuuucucuacugaaauucagcuaaugaguuaaaguguauaauuuauacuacauauuccacucaggaaggcucuagaggcaaugaaguuuuuuuuuuuuuuuuucacaauguucaaagaaaggagcaggaacagaagucagugccucuccaaucuuauccccuguaccacucagccuguucuucuaacuguguugaccauguucugauugguauuucuuuggcauggcuuauuagggguaaugaaaagaaauuaguaagggagggucuaugugaggguuuacucucugagaaagaaaaugcguuuauuuucuucuauuuugguuuauuugguucucuuaacuuuagaggugaguggccuaugaccucuuggcucugccucuaguauaagagccauuuacuagagcaagaauucucuaagacuugcuuugaugacauucacuauaaauuggaauccuuuuccaugguaggcauuagaaguuccuucaaggagcacuauagacagucugacuaguaucugccaugaauuauauaucuucuugugauaucuucaggaauagugcaggcucuguguaagaucugggaugaagaagagaggcauuugaaggacaaacacagcugccuguugauauacuuaguuaugacagagagccuuucuugccagacuaacauagaaguaugcucguggggccuucaugugcuucucuuagggcaaaaccccaaagacucccuggcuuuaaaugguucuagguagagaagagggaguccaggcagauugaaaacuacuuaaucaaauggauuucucuucaaacuucuuuaauuggaagaaccuuucuaacacuacacauuuuauccuuuacuuuucugccaacaugcauauauaaauacaugguuguuguacuuguaguauauugugaaggagaaaauaaggaaagguaauauaauuucaacgacauuuguaagugaaguauauuaaauuaaucagcaauagcauguauaaacaugugaaaaauaucaguaugugaguggauaauguguguguguaaguauauaagacauuauucagcuaaagcaaugauuaauacguguuugcauuuuuaaaccucuugugauaacugcaaagcccucaugccucaccagaaucucaguauacuagcagggagucagucuuuuaagcaucuguaugagcaaugucuaggauacucacccagauagugucuccuaagaggaaauuugggaaggaguaaaaggguuguucuuaaucuuuggugcccaggucuugauuuucauugccuuuucuucccugauaccucuucuugcucuuaggguggcauuuugacaguucugucuuaggauguucucugcaaaacccucaccugucauuggcagcugccauggugccaugcccaucaugucuucacaacuucuggucuuacaaguaaaguguagggauuaagcuuuuuguuucuucucauauacuucauaauaaugucuuuguauguuuuuuuaaaauaaaaguuuaaguagaauauuuggauauaauacaagccuuaauaagaaaucccagcaacuucaaacaaauucugauccaaauacuuaaaacuaccuuuucauuuucaaguuuuugaaaaacuguggaauauuugaagaaauauuugaaguugugaaaagacauuauguuuauucagacuagaggggaaagcacauuauauuuuuuggacugcaaagaaaauugaacauuuuuccugaugacuggggaagacucauuaaacauauuuuuuuacaucuuuaaaauuacacacauaguuacuuucauuucuggcaacaugguagauacuccauaucccggaaaaaaggcccuauaaggagcacuuauuaaugcuggauaaaacaaagcaaacagaaaacaucugaacuuguaaaaaaaguaaugauagcccucaggauucaaugaacaaaaauggagcugaaagugagugauaaguucaaguugaggaugcagcaccuguaggguaaucucaagacuugauuuuucauggugucagggaaaaugagacaaacuguauguucagauuauagggcaagauggaaucccauaccacuuuuauucuuggacucuagaaaugcuaugcucaaaauaaaauuggggacuagacauaaucugccuuugguaaagguugguacuugagacauuuaacuguuuuggaguaauugcuggcuagggaaagcuuucuucuuagaguuuauaaccgcaauccuucccucaaguguggaguucagacuuacaauaucugccucaccagaaaacccuaaggcaauaaaucaacuuaaaacagucuuugauugauagcaucccagagugccuggcagcagcaaacacaaaugcugucuggagggacuuacccucaaccuaggggucacaggauuuuaacagauaaagaccaccaaacguguccucacuauuucaaaucccagacacccaaggaaacaaaagccacgagcaggagacaggagaaaccacaaaaaagagaacuagacuuccagacaucuuaagauaaugcuuuaucagauaaaguaaauuauauaaaugccuagaauauuuucaaauaggcauaaacaacaugcguugcuuaugagaaaaaugagauuguaucaaaaauggaauugggaaauaagcaaauaaaacuucuaaagguuaaaaauaugauaacagaaauuaaaagcccuagggucccauuaaacagcaagcugaaaagagaauugaucaacugauuuuuaaaaucaauugacuuuaagaaauuagaguacaacagaaagagauggaaauguuaaagagauauuaagaaauaugaagaguaaaauuagucuauuauauaucucauuggauuuguagacuuucauucaacaacaaaugagaaaaguagucauauucagucaaaaacaauuugccaccaacagauccuuggaaaaucagauacauaaaaaagccugaaaaguaaagaaauuguuaaucauguguaaagcuaaaucacguugauuauauaaaaugauaaugauuucauauuaggcauugcaauggacugaauauuugcauucuccccaaauucuuaugugaaauccuaaccaucagugugaugguauuagagagugggaccuuugggagcugauagggucaugaggguauagcugucaugaaugggauuagugcgcuuauaaggaacugaagagaccagaguacuuuccuuccaccaugugaggacagggaauucacaacccagaaaagggcccucaugugaaccugacuaggcugacacccugaccuuagacuucuaaccuccagaauggugagaaauaaaugucuguuguuuauagugacccaguguaugguauuuuauuacggcagcucaaaaugacuaagacaagcauuaaaaaucaagauauaaauaaaauacugcucuaaguguaagaggaucguucuacaguaccuguauuauucaguaggagauaaaacauauggauaaacuuuaguuuuaaacauacaaaguaaaauauuuuaaggauaaccauuaaaaggaaagaaauagagauaauaacuuuuaaaguaguaccaggggaaaggaucaaucuaaaacauguaauaaaauauaugggaaaaacuuguaaaacaaauaggauaauaguagugcacaaaauaaauguuggaaauauagucaaguauaucaguaaucacaaauuuguaaagaggcaaaacuugccaucuuagauagaaguaaucuuuggaucacaaaaaagcuuggguuaaaaaaaucuagucauaugcuguuuauaaaagucacugcccaugcauaaggauauaggcuguuugaaagcaaaaagaugaguauagcaggcaaauacuaauuuuaaaaagcuuuuauagcuauauggcagucauauuaauuucaagguaaaaaagaauuauuacagauagaaaaggucaugucaaaaugauaaaagguucuauuuuccaauagcauaauaguuuaaaauuuguauauacuuacauaccuaaugaaagucucaaaacaucuaaaauaaagugauagaaucacaaggauacagugaauauuggaguauaaaaugguuuauuagcuugguuuauuaacuuugcagaguuauuuguuuauucauagaaaaguugaagauucagucccacaucuagguacacaugccuuagagaauugcuuucaccuauauucaaguguacaagauuuuuucagaggaacauuauuuauaagagugaacaacugggaauaacuuagcuauccaucacuggagaauguauauaaauaaauugugguauacagcuauuuaaugucauaugcccaacauugaaaauuaguaaauaugagcuacauauguucacaaaaaugaaagcgaggacuagaaacuugugaggauaauguugaacaaugauaaaguacaucucaacagaacacacacaaaaaguggauacggaaugauaguauuuacauacuuucaaauggcaaaauaauacucuaucuuaagguuccauucauacauagguaguaacaauguagagaaaggcaagggaaugguacuuaacauaucugagggagcugucaucccugaggagaugggagagugcugcagguggugggggaggaggcaauugagagcggcaccuguauugaaaagguuggacuucuuaggcuaguuggugggcagauguaugucucucugguuauuuacauacuguuuuuuauaggucugcaaaaaaaguuauagauuuuuugauacuagagagaaaauauaaauacagcuuguuaacaagaaacaugcauacacuaucucaauucaaaaauguuuuuguuuucuuuuugagagggaguuuugcucuugucgcccaggcuggagugcauuggagucaucuuggcucacugcaaccuccgccuccuggguucaagcgauucuccugccucagccucccgaguagcuggaauuacaggugcccgccaccaugcccagcuaacuuuuguauuuuuaguagagacgggguuucaccauguuggccaggcuggucucaaacugcugaccucagauaauucguccgccuuggccucccaaagugcuaggauuacaggcaugagccaccaugcccagcccaagaauguuuauagcaauauuuuugaagauauauuugauuaaaaaaauggaucucacugcaaauuuaccuaaaucugaacgaaacuuuuugaugaugcacuaaguaguaacuugcaagcuguuggaauggaauaauauuaauuaauuuauuucacaauuaauccgggcuaaaaagauggugauaaaaagauggugauaaaacuuagaugacuaaguuccugguaucaaagaaggcuaaggaauucuaaauuauuuuuucucuucauuuugagguacuucuuugccuuaaguuuucuuuauuguuuuuauaauaaaaaugccucauuuaaaaauguaauuuagauuuuauaaaagaacauccuacuggaaaaagaugagguaauagaaaugaaaacacaggugcaguggcucacaccuguaaucucagcacuuugggaggccaaagcagguggauaauuugaggucaggaguuugagaccagccuggucaacauggugaaaccccaucucuacuaaaaauacaaaaaaaaaaaaaaaaauagcuggguauggcagcaggugccuguaguaccagcuacucaggaggcugaggcaggagaauugcuugaacuagggaggcagagguugcagugagccaaggucgugccacugcacuccagccuaggugacagagggagacuccaucacaacaacaaaaaggaaauacauaaaucacaguugauucauuuuuaaacuuaucccccaaaaucuguagaaaauuuaguucuaaaguuuuuauuucuaggaauuccucuuagaaaguaaacaauuuguacccucuagaucaaggguucucaaacuuucuucauucaugaugcccugaguaucucaguagauuuuuaugguacccauaaaccaaaagaaaugaccuagaaguguuaagcaguuacaucacagcaaccauccagcauccagcauugcaaagacaggacaucauuggaggaaauguagcacaauccaauguugaaacugaacugccuugagcuagucauuuucagugucugacagauguggguuauuccuauuucuccugaaaauauaaaauugcucauagcaccuguauuaguuuguucucacaccacuaugaagaaauaccugagacugggugauuuauacaggaaagagguuuaauugacacuacaguucugcauggcuggggagagcucaggaaacuuacagucaugguggaagggggaagcucacucauccuucuucacauggcggcaggagagagaagcauggagcaaagugggaaaagccccuuauaaaaccaucagaucuugugagaauucacucacuaucaugagaacagcauggggguaaccagccccaugauucaauuaccucccaucagguccuucccaugacauauggggauuaugggaacuacaauucaagaugaaauuuggguggggcacagccaaaccauaucagcauaccuguaaauuugcugcaguauucuguggaucccauaacacacaccugaauauggaggacucugcauucauucauucacuggcaauuuugguggucucuuuuuguugacugcaggagaagccguacaagugcucagagugcagcaaggccuucagccagaagcgaggccuggaugagcacaagaggacgcacacuggagaaaagccuuuucagugugaugugaguuuggauuuuuuucccccauagugucuuccaauaacagaaaguagggguguguguguguguguaugugugugugugugugugucuguguguguguguugcauugcuggaaugugccuaugccuguuaaugucuuaugcuauuuauagcuuguucuugcauaauacauguaacugcauuguaaucauuuuauucaucugguuuacuggcagcaaauaaauucugauuuucuuuuagacaugcuuguacccuguuuuaauaccguugaguuguucuuccaagguguaaaagcaugaugauuugaggcagcuuucaugugucuggccaaaucuuuacugauuaaugacaguuaaaccagagauuugacuggucauacauauuauuuacuugguuaaagccaagcauguacaaaauuccaaaaugcauauaaacuccuuuguguuaaauaaugcuguuacuaagugucuagguuuucugcuuaugacauuuggauugaaauggaauuauuugacauagcauacauuauuucugaaaggaaaaaaauacuacuguugacaguaaaauuaaucugaauauugaucaauuuaggggaaaaaaaaccacuguucuuuugugcgggauuggcaguugacagagaauugacacagauguuagggaaucaauguaagaaaaaacauuaaagcugugcugugugauauggcacagugcagaauucugcuuaaauauugagggaaauuccagaacuuagauccaucaucaugucccaauggauacagcauaggguaagcaguccauaugaaaggaaacucacaaacacaagauguuuuccuuguccuuccaugaaacuucagugguaagguuaagacaacaauguacucccagugggcauacucauaaaaauaccuuuauuaacaguacacuucuuuuaaggaaagaaacaguuguagaggaagaaaugcacacauauaaagcucuauacugaacagagcuacagcccuaguucagugauuucaauuaguuuaagucauugcugcuuuuauuggaaggauuuucauaaaggcaaaaccuauuuagaugguuuaauuguacugugacacaaguagcugauauacagcccagaaauuaaaugcuagcugcauauggacaucuuucuaccaugacauuuaacucauccuuuuaucuaugcugaaugcuuuuguuggauauuuccuuaggugaauugaaccaucauguuauguuuuuugaaacuaugauguuacaagcugacuuuuuucuaucugcuuccgucccauuuauuucuaugauguguuuaaaauucugaaaucuucauuugcagcccauacuaaucugcuguguagagauccauauuucuaagugccuccuaaacauuucugaaaugcagacugcucaguauagaacugucuuugcuccaaaaucuuguccucuuaaccuacucauuguggauagaagucacuguuucccaccccacuccaaucucucucccucuuaaagagcucucagauucauuaauuccucuuaguuuucauuucuacuuguaacacauagcucagaccuuuacuguuucaucuacaugcagucuccaguguguguguucucuacccugucacccuaccaaggugcugcauuuuuuuaaauugaggugaaauucacaugauauaaaauugaucauuuuaaugugagcaguucagugacguuuaguauauugacuguguuguacaagcaccaccucucuaacuccaaaauauuuucauugccacaaaauaaaacuccauacccaauaaacauuuacaccucacuccccucaucccuuaacagcuaccaaucugcuuucacuucuauagacuuaccuauucuagauauuucauauaaaugaaauaugcaauaugugaccuuuugugacuggcuucuuucauuaagcauaauguucucaagguuuauccacauuuucucauguaucaguaggucauuccuuuuuauggcugaaugauauuccauuauauuuuuauaucacaauuuguuuauccauucaucuguuguuggacacuucuuucuaccuuaugacuauugugaauagugcuguggugaacaugggcauacaaguauuugaguaccuguuuucaauuauuugggguauauaccuagcauugaauugcugaggcauaugguaauucuguuuaacuuuuucgggaacugacauacuguuuuccuuaggagcgacaccauuuuacauuuccaucagcaaugcacaaggauuccaauuucuccccauucuugccaacacuuuuuuuuuauuuaauuauccaucuuggugggugugaaguaucugaccaugguuuugauuuacauuccccaaagaacaaaugauggugagcaucuuuccauauacuuccugaccauuucuacaucuuuucuggagaaauguuucuucaaguccuuugcccauuuugaaauaguauugucuuuuuaagagguuuuaaauauuggauauuaggcucuuaucagauauaugacaugcaaauauuuuuuucauucuguagguuuucuuuucacuuuguugaaaauaucuugagaugcauaaggccuuuuaauguugaugaagugcccuuuaugcauuuuuuucucuauuugaucauguuuuugguguuauaucuaagaauucauugccaaauccaaggucaugggauuuguccuucuguuguuuuuuuuuguuuguuuuuguuuuuuuucucuaagagucuuauaguuuuagcucuuauauaugguauaaggaaagggucuauucuuugcauucuuuuucagucuuucacuauugaauauaguggguuuuucauaaaugcccuuuauuuuguugagaaaucucccuuuuuaccuagcuuucugagggauuuuuuuaaucaagagaggauguuggaguuuuucagauaccuuuucugcaucaauugagaugacuauguuuuuuuuuucccuuuguucuguucguaugauguauuacuuuguuugauuuuccuauucgaaccacuguugcaguccugagauaaaucuccauuggucaugauuuagaacccuuuuaauaugcucugagauucaguuaguauuuugcuugcuuguuuguuuguuuuaggauuuuugcaucugaauuuauaagagauuuuggucuguaguuuucuuuuuucauaacauauuugucugacuuuauuauuaaguuaaugcuagccuuacagaaugaguuggggaauguuuccuccucuucugucuuuuugaaagacguacagaauugguauuaauucuucuuuaaauguuugguagcauuuaucagugaagccaccugauccuggacuuuuccuuguugguaugcuuuuuauuugauucaaccucuuuauuggucuuuuuaauuuuucuauuucuucaugggucaguuuugguaauugcuguguguuucuagaaguuuguucauuuaaucaugguuaccaguuuguuggcaaauuggguaaccaugauaaaaugggcauauauauauauauauauaaaauuuauauaauggacauauauauauaauuuauauauauauauauaaaaccaguuuugcccaaaugacacguuacucaucaauacuacuuuaaccucuuaggcacagucauucgaggcugugcaaauggcccagcaugccuauagcaauaacuuugaaaucuuucuuucuccugcccaggucucucuuuugaacccuaggcagauauuuucaacugccuauaggacaucucucuuguacuccaaacugaaaucaugaucucccagauuucuuaaucucucaacaugauccuuuugauuucccauaucucugaggacuguaccauccccaaauaacccaaaucacauaucugagccucauguuggacaccucuuuuccccuaagucaugaaugauagccauuauucuaguuaagguccucauaugggaaauacacagagauccaugguuugcauauauucucucugaucuccacuaaaacucaggaauauauagguguuauuugcauauauaugaagaagucgagguucacugagguugagugacuugccugcaguucacagcagucaagauucuagaguuuaagguuucagugagccaagaucgugccacugcacgccaucuugggcgagggagcaagacuuugucuccaaaaagaaaaaaaaaaaaaaaaagaucuaggaucaaaacccagaucuuucugagcaguuuaccaugcagcuuucacucacacccuguaauuccugccuuugcaucuaccuguuuuucaaacauaccaccaucucuaaauucucauugucaccuuuauuucucuaauucucucacacccuacaucuaauccaguagcauauccaauugguucuacguuaaaauaaguucagagucugaacguuucucauaacuccacagcuuuaucucagucuccuggaauauugcaauaucuuuuuaacugcucucucuccuucugucuuugcucccaacagucucaugcagaguaaucuuuguagaaccugagucagauuauauauuuguaaaaugaauauaguauucauuugcucaaaccuucccaugacugugcaucucauuuagagugaaaaccaguuuuaucauggucugaaagaccucaggugaccugcagcccucacccucccacucugcucucuuugacuccaucagcacccuccaccucacucuggucacauggccucuuuagucuuuuuuggacacauugaaccuacccugaaucuacaucuuggccuuugcaucugcuguugccucugccuagaacacuuuucuuccgguuccuucauggccugcucaugugcuucuuucagaucucagcucaaauuacuuucucucuuaucuccauuacuuccuuagcucucauucuauauuauuugucuucauggcacuuauauccaccaaaaauuuguuuaauuauuuaucauuuauuauaagcucaaugacacaagguuuugucuuuaucauuuauuguuggauccucaagccuagaacagugccuggcaugugggaagcauucaauauuuugaauggauaaagaaauuaauugauaacuacugcuuuuguucauguuuaaaucauuucuggucuggaguggaacaauaguacuggccuccuuggcuccaguuucauacucucuugcuugcuaacugaauuauacuuuaguuucagucucuauuuagaauccuuuagugaauucccaccacuuacaaaacauacguccacuuucuugaaaugauuaccaugauuuccaggauuuguuuccagcuuucaacucuaaauuauuuucaauuuauuucucuagugacaucuaaucuuuagcuuuugugaauucuuuucacuuccccagcugagccauguucuucacgcucacaguaccuguaacuaucuucuucccccucccugucauaucauucccccgcuuaggacaugauaaaccgcgaugcauccuuccagauccaggccuucugccaauuuucccuuaaagccugccuucuucucuccaagccauggacugcacgcuccucuguuccucucuuuguacuaugcuugugacuuuacaaauguuuccacuuagaacguggacuccacaagggcuagacaguguguucuuugucauuuuguuccuagcagaagugguaggcacauuguaugugauaaguauguguuaacugaagauacuuaucuagaauuuaggugcuuucuguuaaauaucuuauuucacuuuauuuuaaaacaaaaucaguuuaccuccagucuagaguaagaauaaauauuuuccuaaugcacuccuaaguuggaguagggugaaaguuuggauacgaaucacagauggaaagaaaaggaagcauccguguuguacuacuugaacuaguuuuugcucuccccuguuuguaaaaugaaaguucuugaauuuggcugauuuauacagagcaucauuuggagucuuuuacugacugcauucagguucaugaaaacagcuuuuaaugucuggguagucaguuuuacaacugugacaucagguacucucuccugauauuuaauccuguacucuggcucucauucagcaagcuguuggaguguucccaucucaucccuaguguggagcuucuaggacuuccuuaauucagacccauuaucaaugauuucagcaucuugcucaacuuccuuuccguuuuuuccagcuugccauugcucucauuuucccaugguaacuguguaaauggacuugcacuuuguaucccucccaccacaguggcaagcugaacugucugagaaccuuucuuacauuuucacagugguuuuuauauauauuuuuaauggugucagccaggcaaauggaaaaaguagggugagcucacauaucucuguuugaaaugagauauuuuaguaauaguuggcccuugggagggaggauagacucugaacccagacugucuggguuuaaauucuggaaacaccaccuaguucuuugaaccugggaaaccuagguaaccuuuuguguguucauuuucuucuguaaaauggguuuaauaguaauacuaauaucuacuuaaaagcaugacugugaggauugagcaaguuaauauuuagaaauugcuaagaguggcuccuggaacauggugaaaguuguaagauaguuaagccuaggcccugugcuggacacugggaugaaauaguagaagaugccauguccugcccucauagaacucacauucuuguagaguauagcauuaaacaaauacaugagaccaggcauggugacucaugccuaucaucccagcacuuugggaggccgaggcaggaggaucguuuaagcccaggaguucaagaccaaucugggcaacauagcaagacuccauguuuacaaaaaacaaaaauaaaaaauuagcuggcauggcggcacacacuuguagucucagcuauucagaaggcugaggugggaggauugcuugagccuaggaauucaaggcugcagugagcuaugaucagaccacugcacuccagccugggugacagagagacaccgugucuccagagaaaaacaaaaacaaaacaaaaaacaaaauacaugaauuaacaugcaauuacaauucaugauaaagacugggaaagagaaggaagaaaaaagccaugaggcuauaaguaaccuaaaagaugagaagaaucagccauagggaaaagagcauuucaggagagcaacagcaugaauugaggcugggaaugggcaugggggaaagagaaggcugguggagauggagcacagugagagaaagagagggaugcagggugaaguaaaaaagagaauuggaggcuuugcagccaaguuaggaaauguauugugaaucuaauuuuaauaagaagccauugaagaauuugguaucaguuguuuauggugacauuggguuuggagaaggggcgagagaaauagaacaugggaauaaauguuaaaucgaucuucuuuaugauuaugaauuugaauauauacuuauaaaaacaauuuagcauuucuuucacuugaaaauacucuccauugauacuuucuucaauuucuccaggauuauucugcagucuuuggggguacuuauauuguccauagagauuuaaucaaucaaucauugaaucuaucaaccauuauuucuuccuuuaauucaagaaauuuuuauguaguggcuacucuugcccucauguuccuuaguuuagcaaggagacagacauaaaaaaauaacgcaaaucaugaaugacacuugaggaaaguguuguuaaggaaaaguaaaggccgcuaugagagcauuuaacagagaccaaccaucaccuggcagaugugucacgugggcuuccuaaggaugaguaggaguaagcuggguaaagagaagcgagaaaguucugaggcaggaagcccaaugguuucuucaagaaccuagaggaggccuguuuaguuuggcuagagcucagugauuaccuuacaaguagcaaaacaccauggaacaauuuuagguaauauugugacauuuguguuuucaaaaagucauuucaacuguuaugugaagcauggacuggagaggaugaggaggaaugcagagagauucagaaaguauuuagcaguggguuacuuuuggcuuguaugagcguguccugcacauuagaaggcauuacuugcaugcuugccccuaugcaaaaugcaaguaauauuccccauuuguugagacagugagauaccccccacaauuccaaacauuuccugcagagaggggaaguuguaccaccucuauuugaggaugaugaagcuggcuauugcaauaaucuaggcuuuaguuuucagagugaagagauguauauugcagcaggcauacaugacauccauuggaauaugggaagaaaaaauuaccucuuugauucccauuuuuuuuucaauuucuauuuuagauucagagaguacaucugcagguuuguuguacauggguauauugcaugauacugagguuuuaggugugaaugaucccaucagccagguacugagcauaguacccaguaguuuuucaacccuuaucuccuccccuccuucucugcucuacuaguccccagucgcuauuguuaccaccuuuauguuaauguuuagcucccacuuauaagagaauaugcaguauuugguuuucuguuccuguauuaauucacuuaggauaguggcccccagcugcauccauguugcuacaaaggacaugauuucauucuuuuuuuauagcugcauaguauuccaugguguauaugcaccacauuuucuuuauccaguccacuguucauggcaccuagguugauuccaugucucugcuauugugaauaguucuucaaugaacaugcaagugcauaugucuuuuugguaaaaugauuuguuuucuuuugcauauauacccaguaaugaaugggauuacuagaucgaaugguaguucuguuuuaaguucuuuuagaaaucuccagacuguuuuucacagugguugaacuaauuuacauucccuccaacaguguauaagcauucccuuuucucugcagccucaccagcaucuguuguuuuuuuuuuaccucuuuuuuuuuuguuuguuuuuuguuuuuguuuguugcaacagagucuugcucugucgcccaggcuggaguucaguggcacaaucuuggcucacugcaaccuccgccucccagguucaagcaauucuccugucucagccucccgacuagcugggacuacaggcacccgccaccgcacccagcuaauuuuuguauuuguaguagagacaggguuucuccauauuggucaggcuggucucgaucuccuaacgucaggugauccgcccaccuuggccuuccaaagugcugggauuauagaugugagccaccaugccuggcugacuuguuaacaauagccauucugacuagugugagauaauaucgcauugugguuuugauaugcauuuaucugaugaucagugauuaugagcauuuuuucauguuuguauccacuuauaugucuucuuuugagaagugucugugaaugucucuugcaauaauauauaaauacaguagugcauauauauguuuuauuuaaaaauacagauauuaguugcauuuuuuaauggggcuguuuuuugcuuauucaauuguuuaauuuccuuacagauucuggacauuagaacuguuggauacaguuugugaauauuuucucauucugucaguugucuguuuauuuuauugauuguuuugcuaugcagagcucuuuaguuuuauuagguuucacuugugaauuuuuuguuuuguugcaacugcuuuugagaauuuagucguaaauuauuucccaagacuucuguccagaaugguguuuccuagguuuucuucuaggauuuuuauaguuugagcucuuacauuuaaaucuuuaauucaucuuaaaguuaauuuuuguauauguugaaagguaggaauccagugucauuugucugcauauggcuagccaauaucccagugcuuauugaauagguguuuauugaguagggagcccuuuuccuguugcuuauuuuugucaaccuugucaaagaucagauggcuguaggugugugacuuuauuuuuggcuucuguacucuguugcauugguguaugugucugauuuuguacuagcauccugcuguuuugguuacuguagccuuauaguauaguuugaaauuggguaaugugaugccuccagcuuuguucuuuuugcuuaggauugcuuuggcuauuugggcuuuuuauuuauuuauuuauuuauuuauuuugguucuauauaaauuuuagaauaguuuuuucuaguucuguggaaaaugauauugguuguuugauauuugauaguaauggcauugagucuguagauugcuuugagcaguauggccauuuuaaugauauugauucuuccaaucucuaagcaugaaauauuuucccauuucuuuguaucaucugugauuucuuuuagcagugucuguaguucuacuuguagagaucuuucaccaccuugguuagauguauuccuaaguacuuuuuguauguggcuauuuuaaaaacaggaacacaguuaaacuuuauuaucauuaaacagaugauuugacuuuggugcccuggcuugggcacugcuggcuggucucuuaugaggugcaguaucacaugugaucaaagggaagaacgccaauuccauguuggugcugguuggcugacagucccaaggcacuuguuugcuuucagggcacuguuaggauugcaguuugugucucuugggcuaacagagauaagaauuauauuaucuguuuuuaaauaaaguaaugcuuacaaaaugaacaaguugcuaaaagaagccuguacagaaaugcagauugaaaauaauaaugauacaaacacaagauaacaaaaagaaagcagaguuaauacuacuagucaguagcaauuugagauaaaauauaaugacaucaucauaugugaugagaaguaagccaaaaauggaaauuauuaaggagacaucugaaauauauauauauauauauauauauauauauauauauauauauauuuauauuuccuauaauugccuauacauuuguuaaagaugacuuuggcccuaaauauguaucccaucuuaaaaucuugucuagugaaaauauaaagccauaaauauuaauuuagcauuaaaauauuuauuuugucuuuauccucaaaauuuugucugucuuuaauauaauauauaaauacaguaguacauguguauguuuuauuuaaaaauacagauacuacaguugcaugcugaaacauuuucuuagugaaagagaagcacuggucugaguaaacagugucucugacuaaggugguggcaguggagauggagacgauuagaugucuucaugucuuugagaaaaaugugcaaagaagaaccgguggaacuuuguaauugauuagaucagaugaggaagagugagacauugggugaagguugacugccacauuuacagucaaaccagguggagggucggaccauuuuuugagacuuagguuugaaagacaagaauucugaguucaguuuuagacauaguaaguuuggaguaccagugaacuauccaaguggucaguuaaguacuccacuguugagaucagaagggggacuggacuaaaaauauuacuugcuagugaucuccauauaugugguaacaaaagguaugaauacgauuaagaucaccagaggagaaaauaccuagugaauggagaagaaagccaaggauugggcacugaaauccugacugacuuaguuaggauggaggaagggccuauuccggaaaauaaaggggaauaaaaggccagauaauuagaaggaaaacaaggagaguagaucauuauagaaacuaaaggaaugacaggggaaaggcaugucaaaugaugcuaagaauucauguuaaaugagggcucaaaagugccaggauuuggcaauguagagauuauccauaacauuucagagagcuguuuggagaguuaagaaguccaaggcagaagucugaugugaguggacuugcugcuuaagugaacauggaaccaucacccaacuaacugcauuuuuucauuccaaaauaauauuugcuuucugguuauaaaaauguacuuuuuaauuagagaagaaugaggaaauauggagacaaaagaagacaaauaaaaugauucccaauuuuccaaccaaugucagcuaauauuaauauuaaucuauugacauuuucuuuuuuuuuauuuuauuuuauuuguauacuuauuaauacagauaguuauaauuuuuauuugaguauugucgacuaaguugccuugaucuuauuauucugcuuucuuuucucuauguuucuucuugccuuuaaguauuuuugaaauuacaaucucggcuggaugugguagcucacaucuguuuucccagcacuuucggagacugaggcagaaggaucccuugagcccaauaguaugagaucagccugagcaacaugguaaaaucucauagguaaaaaauacaaaaaaaaaaaaaaaaaaaaaauaguuagcugggcaugguggcaucuggccuguagucccagcuucuccagaggcuaaaaugugagucgagggaggucgaggcugcagugaaccaagauuaaugccacugcacuccagcaugggugacagcgacaucuugacucaaaaaaaaaaaagauuaauauuuuuaacagcugaaaaauauuucuaaaucugauuauaucaaaaugaauaugcuuauuaauuuuaauuggccaaauaagucauuuguaauuuucacuuuuauauaugauucuguaugagcaucauguauauaaaucuuugacuaggagacagucauacaagugauacuccugguucuucaaaggcuugcucucucucugucuauccaagauucuucugaggaaguacuacuuaguacccauuacacucuaucagccucauuuuguacacuuucaugcacauucuaaucccucucuuaaaauaguguuuguguauguguuauuuuuuguaaauguauuucucaaguacaguaugcguguguuugcauuuugcuuuuuacccuaauugagucuuaucuuuuaauaaggguacuuaauacuuuuauauugauuauuauaauuuauauacuuuguagucugucaucauaugcuaugcuguugcauguuuccugggucuuuacccuuuuccucugauuuuugcaacauggacuuggcuuuguuuugcaguugccucaaagguauugaguuacaaaccuuaugcuuacaagcuauuccaaaagaaaaugucauuuccugagauaaauuggcugcauuuuauuguuuugggaaauuauuuguuugcaaagucacuuguauauuccaggggacugccacucuuuagaacagugguguuuucuuucuauuccacuugugcuggccuugccucccucucauuaacauuugucuauucuuuccaaucugcugaggaagaugaaagagaaaaaaaaaauguacacugacauuuauugagugucugcaguauagcccuuauuuacacagaguauuuuauuuaaucuuaauaauccugcaagguaaauacauugucauuuuacaggugaggaaacuaaauuuaaaaggcauacuuggucauuuaauuuccuuaguaaauaguagagucagaauuccaggugguucuucaacaaauacuuauugagugcuuacuuuacagaaauuguuguacccuuuaggggacauaagggaauaaaguauaugaagaucccugcucucauggagcugagacucuagugaguagagagagacacuaaacaagagaguagguaaauuacagugggacagaaagugacagguacuguguaaaaaguaaauuugaacagaguaaagggaauccagaaaggaugacagauuucaguuuuaaauugggaggucagagcaggcuuccuuggaaagugaucagacucuaaagcuuauuuucuuuauaccacacuaugcugcuacuucugugucaaaauucauuauuauuggauuacccccuucuuacccaauuagggcccugagccuuucugaguuucuuauugcugugaauguaaaucuucuuuccuccguaaagaaagagggcaaggauuuuuuguuuuguuuuguuucaguguaagguuuucccaagccuaaccucaauuaaaacuccagcuuucuuuacaguauuuuuacaagccauuuccucucucauuauauuuuucaugguguuuucacauuauuuaacaugucuuauuucacaacggauaugauuuugaagaguuucaugucaguggaauuuuucugaauaacaucaaacuuuaaacuccauuuuuuuugguaacuuggacaguugugccuugcauuuucuguguuaauauuuuuaguuauggggcuguuuaaugcauguugagccaggugggaauguggcagagcucauaugaaauaaacuuguuaccuuccuuaguuaaacaaaguguauauaauaagaaauagaaaaaagaaauaguguguaauaaauuucugcuuaugauacuuaaaacagcauuagcuuuuuauuucacaagugguacuaaacugaagggaucacugcugagaaaugucuuaugccauuuauguuauagagagagaugccaucuagaccguaaagcauuuugcuuaaauaguuuaauaugaaauggcaaauacauuccauuaggauaagaaagguauuguugccagggaguuguuucacuggaaauguuuaaauccagcagcugggaaaagggaagggugacucggguacaaaggacaccgauuaaaugcaguaacuuauuaauuuucuuugccaauagugugaguguuaaauuuuguuuauaaauuuuguuuauuucaguauaauaugguuggucuuugggucuuuucuagguuugugauuuggcuuuuagccugaagaaaaugcugauucgacacaagaugacucauaaucccaaucguccccuggcagaaugccaguuuugccauaagaaguuuacaaggaaugacuaccucaaagugcacauggacaauauccaugguguagcugacagcuaauaggggcuguaaaggaauuaaacuauucagaagggcuccuaauaugaaucccagauuuuuaucaccugaucagcauaacagaaguagccaaaagugacuuacuggucucauaguucuuauuugccuacauuuagagucuguagaugcauaugcaaccaaaaaaaagucuuacuuuuaacaagaaaugguauaaauggaaaaaaaauacaacuccauagccuugcaaaaugcaacuugugcucugucuuauaaaaauggagaaaggagucauggcucucuuucuuggccaucccucuguaaugaaguuuauaauauacuucccuaauaggccuuuuuauuuuauuguuauucuuugugugucugugugucugugugucuguaugugucugugugugugcacucacuugcaaaugccaguuguugcagcugguuuuaccaauuuaaauagaaauaaaucaagauauccaacuauuucuuugcagaugaggauaagaauaaguuaucaaagucucaaguuugauaggaaaauaaauaguugcuauuuuauaagacaaaccaagagcugagcuuaucuaauagcucugugcaacaaaugaguuuaaaauagauauuugauaacuaaaacaucuauuaaaauauugcucauuuuagaggauucuuaggaaacauuauuuauucucaucauucagaugcagacauucauggucuggaauacuuuuauaaguucuacacaaaaaugaccaucacauuuaaauauucagcaggcuaccccucuugaauuuagaccauuuagcuuuagaaauuaacaguauaccaauauauauaauuaaaaauagaaaccaaauagauucucuguauuuggcaacagaguggcagaacaauaguggcaucuccacauuuguuaggaugaacauagcccuuuccccucuccuuccauaaaagugcacagaacauguuagugcagauacaguccucagaacauuaacauuccauuuugcaaaagacauuuuccagaaucuuggcaguagguaauucugaaacacuuuugaauuaccuucaaucaucccauauaauuaggaauccagaauac

SEQ ID NO: 14672 - RNA, 3134 nt, Homo sapiens
gaaaacaucccagaaaaguggaccccagaagucaagcauuucugucccaacgugcccaucauccugguugggaauaagaaggaucuucggaaugaugagcacacaaggcgggagcuagccaagaugaagcaggcaugaucuggggcaggacugucuuguaguauucuugaacuagggccccaaguuuggagguuuggggagcccagcaggaaccuucacaggccagguuguuuuagaggcucagaagccccucuguggcccucugacccucauuaauugggaucuucacagaagaucccuaagauaguucaccaguccugugagauggaauguuuuuuuaugagguagugcuaugcccauaaggacugcuggccugagaaugaaccauuucauuaguagcuaguaaucaguggcucuagauguaggaacuuucuuuuuuuugauauggagucucauucugucacccaggcuggagugcaguggcgcaaucucagcucacugcaaccuccgccuccgggguucaagcgauucuucugccucagacucccgaguagcugggacuacaggcacccuccaccaugaccggcuaauuuuuuuuuuuuuuaauagaugggguuucacccuguuggccaggcuggucuugaacuccuuaccucaagugaucugcccacuuuugccucccaaagugcagggauuacaggugugagccacugugccuggccucuguuagacucuuuauuuuuauuuuuugagacacaguuuugcuuuugucacccaggcuggaaugcagugaugcuaucucggcugcaaccucagccuccaagguuuaagugauucuccugccucagccucccaaguugcugggauuacaggcaugugccaccacgccuggcuaauuuuuguauuuuuaguagagacggguuuucuccauguuggucaggcuggucucaaacuccugaccuuaggugaucugcccgccuuggccucccaaagugcugggauuacaggugugagccaccacgcccgggccuguuagacucuugauugccuuccccagcuauuacuuugguacaugugaggccaaagauaaauuaguggcaacugaaagauaaggaaaucuugaaggcugggaguccagauagaaagcccuaaugccuucccucuccuccacucccaaugccuuuuuaaaagugaugauggauguggcaucuuggccucucagaaaccagcuggccuaauggcagggcuuccucacuggaggagaagcauugagaucuucaaccuaaguucucuuacucagguuucucugucugaaugucaaggguaggcuuuauuuccuucagggcauuuaguccuggauugguagcuugaguaauuuugcucuugauugacuccuuaaccuuccagggcuccucugaccucuucccucuacuucccagugaauaccauguuuauuagagauuuuauguuugguaggggguaguuaccauaugucaguuuaaaaauuucauaaguuuagcaguuuguuguuuuuuuuuuuuguuuuguuuuuuuugagaaggagccucacugugucgccaggcuggagugcuguggcacgaucuuggcucaacugcaaccuccgccucccagauuuaagcgauuccccugccucagccuccugaguagcugggguuacaggcgcccacuaccacacccaggugauuuuuuguauuuuaguaaagagggguuucaccauguuggccaggauggucuugaucuccuaaacucgugauccgcccagcucagccucccaaagugcugggauuacaggugugagccaccacacccagccaaguuuaacagcuuuugaaagucuuuuuuuuuuuuaggcuggguacaguggcucaugccuguaucccagcacuuugggaggccgaggugggcagaucacuuggucaggaguucgagaccagccuggccaaaauggugaaaccccaucucuacuaaaaaauuacuugggcgugguggugggcaccuguagucccagcuacucgggaggcugaggcgggagaaucccuugaacccaggagguggagguugcagucagcugagaucaugccauugcccuccagccugggcgaccgacgagcaaaacugucucaaaaaaagaaaaaaaaaucuuuuagaugaauuugaauacuuuuuacuuacuauauguaugccacacuauuagcuaaaaggacuauuuuuuuuucuuugcuaggagccggugaaaccugaagaaggcagagauauggcaaacaggauuggcgcuuuuggguacauggaguguucagcaaagaccaaagauggagugagagagguuuuugaaauggcuacgagagcugcucugcaagcuagacgugggaagaaaaaaucugggugccuugucuugugaaaccuugcugcaagcacagcccuuaugcgguuaauuuugaagugcuguuuauuaaucuuaguguaugauuacuggccuuuuucauuuaucuauaauuuaccuaagauuacaaaucagaagucaucuugcuaccaguauuuagaagccaacuaugauuauuaacgauguccaacccgucuggcccaccaggguccuuuugacacugcucuaacagcccuccucugcacucccaccugacacaccaggcgcuaauucaaggaauuucuuaacuucuugcuucuuucuagaaagagaaacaguugguaacuuuugugaauuaggcuguaacuacuuuauaacuaacauguccugccuauuaucugucagcugcaagguacucuggugagucaccacuucagggcuuuacuccguaacagauuuuguuggcauagcucuggggugggcaguuuuuugaaaaugggcucaaccagaaaagcccaaguucaugcagcuguggcagaguuacaguucugugguuucauguuaguuaccuuauaguuacuguguaauuagugccacuuaauguauguuaccaaaaauaaauauaucuaccccagacuagauguaguauuuuuuguauaauuggauuuccuaauacugucauccucaaagaaaguguauugguuuuuuaaaaaagaaaguguauuuggaaauaaagucagauggaaaauucauu

SEQ ID NO: 14673 - RNA, 536 nt, Homo sapiens
ucauagguauauaaacuauuuauuaacagacaaggccuacagacuuauuucuucuuggacacacccacggugcggccacggcggccaguggucuuggugugcuggccucggacacgaaggccccagaagugacgcagcccucuaugggcccgaaucuucuucagucgcuccaggucuucacggagcuuguuguccagaccauuggcuaggaccuggcuauauuuuccauccuuuacauccuucugucuguucaagaaccagucugggaucuuguacuggcguggauucugcauaacggugaucacacguuccaccucaucaucagugaguucucccgcccucuuggugaggucagugucugcuuuccucaacaccacaugagcauaucuucggcccacacccuuaauggcagugauggcaaaggcuauuuuccgcugcccaucgauguugguguugaguacucgcaaaauaugcuggaacuuuucagggaucacuagcgacauggcggcagcacaagcggcggcguguaggccucc

SEQ ID NO: 14674 - RNA, 481 nt, Homo sapiens
uuuuuuuauuuuuuacaaauauacuggagaaucaugcaaugcugccagcacuggacgcaauccagggccacaagucugcacacuccuuugcuacugguccuguaauggcagaaccuuucaucucgccuuuauuguucacugugaccccugcauuaucuucaaaauaaagaaacacgccaucuuuucugcgguaugacuuucguugucgaauaaccacugcuggauguaccuuuuuucugagcucugguuugccuuucuugacuguggccaucaccgugucacccacaccagcagugggaagucuguucagccaucccuugauccccuuucacggagaugacauacagguuuuuggcuccuguguugucagcacaacugaucacacuccuaccagaagacccaaggaaaucuggaauuucacaccagaggacccaccacguccucgcuucaacaucuugaaagccggaaagaagaaaaaagc

SEQ ID NO: 14675 - RNA, 31828 nt, Homo sapiens
uucucaaacuaucugugauauuuuauuuucaaucuguugcaggcugaugccuuuccacauaaaagaaaaaugaaauagacauaaaauacaaagcugcauuuuaaacgauuuaacagacauaaaauuacucugucaaauugcuguaaguuucuacaugcucaucuucaauuucuaugcucaucccuuuguagauggguaacgguuugcagacugucacuauuccaugaaccacacuuugaacagcacucaacuagaaaaaccuucgacaagccgcuuaaguuacugguggcaauaugugguguuccagcuuccagguuuuuucaagagacuaaugagagaaaaguaagaguaaguacaugaaagcacuuauuaaacuauaaagugucccaggaaggaaaauuaguagcauagcuuagaggagucuauucuguggucuguggccaaaaaauacaaacuccaguaugccacccucucagucccuguggugucaagcuguucuguuucagguguaucauuugaacuguuaguacuugugaaucagucaagcauuuccuaaugcugaacagaacaggaaauaaagaccccucuggcagucuguggcuugcaucccacaaaccaccgccauccgcagcuugcuaagaccacacuccuggggcaaggcaugcauucauacaccuacucuaccugugacaccucuucuacaugugcaaaugauuucacuaaaccugaaacuugcuuaggggucagaaggaaagcaagagggaauauaaugcccugacugcagucccuaguucccagauuccccagggcccacuuguccucaguuggugaaacucaauacacagacaucccucaccaaugcuuucagacuccauuucaaguguggacucugcccacacugguucuaagugaccuacuuuggccucaccucuuuucucuccacccugucaaacaagaaagcggcuaccuaggaauacucuagaaguccgcugagugguuuucugaacauccagcuucuuuacucuuucuggacuccaagaaggcaagccccuugucugauucaucuuuguaccucucccaucaccuuuagcaucgcaguugguacacagcgggugcuugguaaugucugucgaauggccaaaggaauaguacaaaaucuguggaagcggaaauggcuccuccauuuacccgaccuugaacccuuccagaaaagaccaaccaaaucccauuaauucauuaggcagaacucugccagguacuggacauucggaaacaaauuucagggggucggggcagauggacgggaagcucaugguggguggauguacuacaaauucuauaauccgcaguuauaccuccacuuucugggaaacuucucuccguggccccagggcccuuuaaauguuacuaugcguguuuuccuccauaguuucuggaacagaaccaaacuuucguguagggguuuggcagcgcucauccucacagcccuggggaccgcuggcacaggggcaagcgaggcguucgcacgcgaaggaaacuugcgaggagucagggcggccccgcgcgggggcgggucguagagugggggcccucaaguccuagaacuucagguccuccaugagaauuagaggaagggggauggccaaagacgaccagacguccaccgagcuuccacaggccaggccucgccccuccuccugcggggccacaacgcgggcuccccggcccgggacagcacagccagggcguccgggcgggaggcagggcccggcgcggaggaaggagcccggggccgccgccgccccgcccaccccagcgaggcggagccggcgcccggaggagcaagaggaggaggaggaggagaggucggagccgucuccaggagcccuuagagaccgagucccggcggcgacggcggggcagcgcaccggcaggcgggugaguaccaagcggcgggcgcggguggugagucggguccccgcggggucggggcgcggcgcggggcgucggccagcgaguucgggggccgccuccgagucccgggugcugggaagcgagauggagggagggagcggaggaaggaaggaaggagggaagaguguccugcuggagggcggggacuggucugggcgcugggcgccggagaccggggggagggggaggaaggggccaagggacaccgagacccagaggcagaaacggcgcgcgcgcccucgacgggcggccgcccgagguugcgggaagccgcccccacggcuguggcuggggcuagggcuggggguggaaggaaaggucuccccuugagcucgcuugccuccucgccagccugcggccgugcgccccgcgccggguugggaggcccccaguguucccagccguggcuugugguggugucaggcguuggaggagggcuggcaugugggggcgacagggacgccacgccccucugccuacuuucuaccucccgggaccagccggcgggagcgcagccuuggaauccgcugggcgcugggggucuagcagggaaauagcgggucgcagaggggagagcccauaugacgcaccccgcgagggacccccgaguggggacccgaggcugcuuuucugcagacuguauuugcaagugguaagggggagguugaggcuuagucuugggugauuuuuuuuuuuuuaauuauugccccgacaguuaucccguggggcagggugaauucuguuuuucauuuuaauuagggcauaucaauuaaagcuaacuuuaaaacgcugucacuuagcaccucccgucacucacucgucccucgcuuuguguguccuguaaacuuggcuuaaaucauucauaacucacgauaaggaagccgugauucuuguucacgucgccgcaguggagugaaacuuugcccaacugggacugaguggaggcauugcugcggccggucaucugguggucauccugccgggcgugguuguauacaaacaagugggucgagaaggaaaucucugaacaccagagguagaagggagguuccugcgcccacgugucagggcgcguuuaauggcugcucccagcggaaacaaacgggaauuuauuagaccguguggaguuggacaaacuucacaugauuagcuuccuucccaucaguuacuuccucuccccccugcugucuuugccgacacaguuuauauuuccuggggcgguuguagcuucgccugaauaggcuguguauaaugaaucuuuuggaugucgucagaggcagggucugcgucugugccuucucuauuuuaaaagcggaguuuggcuuuguuuuuaaaagugcuagucaccagacugcacccuugccagcgcuucgcagcucucgaaguaaauuaucgcaggauggcggcccucaccuaggagaaccaggaaggcaggcagcgcuagaacgacgggauugaauuuuacuauugccaaaacaaucacauucaaguaaggagcuguuuuguuuuguuuuuguuuuuuuaaccaaauuauauauacuagcaagccccuuuucuaguaaacuaacguuauucacacacacaauuuuuaaaguaaucaaaaauuuuacagagucuuaagugauaaaaggacuuucagauaaaauguucagucccuuugccuucucuaauaguuaaccagcgccguaaagcccugguuuaaguccaaaaaaugcugaaaagucuacugcgucguuagaccuuauaaauaaugcaguccuauuuuugcuguauuuaacucauguaauuuacuagauaucgaacccccaacagggcacacagcacuuagauuuguguagaaauauaugaaaaugugaaucuguguuucacaagagccugaaaaaaauagaauuauaaaaauuuccuguccagaaagcuccagucuuacuugaaagcucucuaacaauuagauuuguggauuuguguugucacuuguuagagaauaucggugguuuauuaaagugugagagcaaagggcuucauggucagaaaacuugaggaagugguuagccaauaucaaauuaguuuuuuuuaaaauuagaauuaugugauuuauuguguuuugcuuuguuuuggaguuuuaugucagcuuaagcuuaaccuaggaaggcaaguugugaaagcaaguaaauuuuucugagcccuaacuuggaagagaagcuuguuuaacagugauuugggguguuggcuuuggagucagacagacuuagaugaaaauauuagcuauuuaaccuuuuucagucugauuuauaagauggggauaauaauggucucuaucuguagggcuuuacagaaaguauaugaaaacuuugucuuuggaaaacacuuaaacuggacuuaacacgcaguacauggucaaaauuauuagauauuuaucuagcuuguucaagcagcaggcuacuggauaaauugcaggguggcagcuugaaccuuccggaaaugcuagauagagcaauuucaaauucuacagaaaguaacugguguguguguguuuguguguguguaugugugauguuucuaccacagcaauaugaauaauuaugauuaaaggauuaauaguuuuaauaugcuuuuagugcuaaaguuacaguugcauaguaauuuugacagucagaaacauugcauuauccuuuacauuuaaagagaauuuauauuucaaauaguuguguuuauuagcccuagguaagaaauuaagccaggaacagaaguauucaucuuuaaccaaguguaauucuuaaucaaaguaugaaaacaugugacccaaggguauccgguuauuuacuuuugcaugugcugauguccaaggccaacagauaagccauaagaaguguuaggcugauugugagucguuguuuuauuuguaaacuuucaugagauuggguguucaguuaauucaggaaaucuacucaucacauuguugacucauuuccuaaaaucuaaaaaauuuuuuaaaugccuucaucuugccaggcgcuguggcucacaccuauaaucccagcacuuugggaggccaaggugggcggaucaccugaggucgggaguucaagaccagccugacccacauggagaaaccccaucucuacuaaaaauacaaaauaaaccaggcgugauggcgcaugccugaagucccagcuacucgggaugcugaggcaggagaaucacuugaacccaggaggcggagguugcggugaaucgagaucgugccauugcacuccagccugggcaacaagagcaaaaacucugucucaaaaaaaaaaaaaaaaaaagccuccaucuuuaaaacaaacccuuuaaagcuucuuguuuuuguccuaaugcacgucaggugcacagaauugggcugaaccaggaucuuagcucaugccacagaugauuucucauuuuacuaauugcuccacugggacacagagaugugguuuauaauaauuuuaaauaacuauaaaggguacagugugauuauuaauuguuucuugccuaugacauuaugcucugaaacaacugaagcauuugauugaguaaauuauugauucguuucacuccuagaacauaacauaaugauuucuggcucauacuucuaggugaguagacugugagcaaguuacuuaaucuaugcuucaauaaguguugugaggaauaaaugagcuaaucuauguauauagcauuuggaauagugccuggugcauaguccacauucaauaaauguuaacauuaaauuauugaaauuuucucuaaauguuguauaaugagcaugcauuauuuuuguaacaggaaaacagcuauacaaaauuuuaauauuucccccaaaucuaaaaaaagcucaguaauuuaaauaguccugccaaauaguacuuaaaaaguaagagaauuagacaaucaucauuuugucuuuuaaaugugaaaugguuugcaauauuaauuuguuaaacaaguuaauucuuccaaaucucaauuccauuuucuuuuuuauuagagacuuuaaaaaaucaguaauacaugaagucuguuacaguuuaaaauggggaaaagcaguaugcacaguuacauuguguuauuacaauuacagcuagcuuaaaaauuauuuuuaaaccauaagaaaagccuagaagaaaauacagacaaauuggugaugggauuauggugcucucccacccccaaccugcuuuuccccuauuuuccacaaugcgccuauauauauacuaaaauauaauucauuuguguaauaguuacuaaacaaaucugguuuauuaacuacaaauacuaaaaaaaauuugcguaauaguuacuaaaaaacaaaucuggcuuguuaacuacaaauagcaggauuuuauuguuguuuuggaaaaagcaccaacuuuauggcaguugaauguccuucgguuaaaugucaaaaccuuugcagugagaauuguuuagcgguaaaagagaaggccuuucagaagcuuguaguuugaucuucaugaagaauauuugaaaagucuaccaguggguuuuuaggaucugcauauagaccuaguccaccaaccuugacuuuauggaaguugugacuucccagauccaggccugccuugaugagcugcguuuuuacagcaccuucaguauaucagacaccuggaagacaguaaugaggcagauauuggugcacuuaguuuaacaggaagguuggauagauaaaaacuaauuacagcacaauuguauauauuauauauccugagcccuuucuaaacucuucccguauacagucuugcucaguugucacaacagcccagaggaggaagcugagguuccuuaaaggucugaaccuugcucaaguugcaaggacagaauuugacccagaagcaucuuaacuccacaucucaugcccucugcacggagauggaggugcauccagccagaggugagagugaagugggcuuuauggagucaguuuugcuuaaaaacuauaaaacuaaucaagagaaacaugaggaggagacuccuuuuaggugaccuuccugaggagaaucaucagugccucuccaucaggcuugccacucuuuagccauagcaguuaacacuuccaaauggcugcugagacccagcaggccugaagcgcacacaaaggcccaguccuuggugacccugugaagccuaccucuuucaucccuggacuuccaaagggggucuggauaguacagaugaaggaacugacucgcuaaauccuguucuagaaccagcacauacccacagauccugaccuccccacuuuccucccuuaggaaugacaggagaguaguuaacagguagcauggauccagggcagaugguggaggugacuugacuuaagauaacuuguagcuagauuauuccauuuauuggagagucucucuugaaaaucauaucugaugucacuuaaguguuugguuuaucauguuagucuuuauugggugucguaaaagugcucaguugugaagugucugguuaccauccugugacaaggaggguuuuugucuucuuuuaaugggucugcauuucagagaauuacuguauaauaaaaacuggaguguuggcugggugcagucgcucacgccuguaaucccagcacuuugggaggccgaggcggguggaucacaaggucaggagagcgagaccauccuggcuaacaugaugaaaccccgucucuacuaaaaauacaaaaaauuagccgggcgugguggcggucgccuguagucccagcuacuuggaaggcugaggcaggaaaauggcgugaaccugggaggcagagcuugcagugagccgagaucgugccacuguacucaagccugggcaacagagcaagaugccaucuuaaaaaaauaaaaaaaaaaacuggaguguuggagacuguuaagaauuaauacuuucaguucugccagaggguuaguaucuagaaguucuaagagauugguugcuaaaaucuucuguaauuuucaguuucauugauuguauaauaagugggugacuuugggcccagagagucagaaggcuuuguauucuguaugcuuucugacacaguaggccaccacuccccuugcaggcaaggucauguaauugacauaggauccccuuuaguugaccgaagagagaaguauaagcucugguugaacuugaguuugcgugaucacacaugcucacuggagugaagucugaaucaguugccaucucugcacuugcauuguguguagagaauugucuugauucagaauggcuuugugcaaacucacaugagcccauuggaggcagaaucuuaacuucauugaugugaaauaaucaggcuuuuauuuagcuucagauggcacuagccaagacguccuugaccacuggacacuaaacccuuaacuccccacugggacccuuugacucagaccccaagcuugcaguuaccucaaauuuuguguuguuuuggggggauaaauuauugcagaggaaaaacauaagguuuuuucucaaaugaagacucaaacugaaauccauuaaaucccaacaugagcuaaaucuaaggguggaaagaggaaucaaaaucuaaaagccucuuggacuuuauugaggcuuauugaagaccuuauugagauaacaucaucauaccaaguuuaaccagaaucucaggcaaauuagaaagguguaaccuuuagacuaggugccugagcugugccuagacuaaugaaaucuucugaauuauuagaccauggccugcacauuagaccauggggcuucauguggguauauaaggucaugauuggcugugcagauaaguugucaugggaggguuggaugucuggccaagaagcagaaggaauggauugugacuucuugacagggauaccuugaacuguuauacagguuguucacugcacaaaagugccugggcaaggaggcaaaugggaggcucacaucugcuaaacaaacaaaaccacaugcauccuggaguaggauugccucugcuaggagaaaagggaacuucuuucugaugcuaucaagccugcaaaagucuagguguacauggaaggaaugccuuuuuuuaacacacacaaaggcacaauauggcuaccagcagcucugcuucucaaagccccuguagccacaguaguccucuagaugccaucagcuggcagagucugucacuuaaccauuugguuuaucaugucaggcuuuauugggaaacauauaaacuucaugaaugucaguggaaugaaggaauaaaaccauguuuucugugguaugucagcaagguacauguaaaaaaguaauacugauuauauaugcuaggaaacaaacauucagugguacacauugccuaugaugaguuucuuucucuucaauucauuauuucugagggguagguaaagaccagcacuuugggugcuguugacauuguuuauugcuacuuaaacaccagcaugcucaguauugccuaauacuugccagggucaccagcacccguuguguaguuggccuggugcagggaauggaguaguaguaacuccugggaacguggagagggauucauguuauuuauugaccagccguaggccuuuuuccuuggggacaggaugcaaguaacagugguugcaggagccuuuggaacuuaccuaugaguagcugcugcuucuggaaaaaggcuucuaguuuagguuaaaaggugcggagucuuguuaucaaagguaccacaaacucagagaguuugucuguguuccccuuaguaccaacugguacuacuuucuugcuuuuuuaaguugauccuuuagaaagccuguagccagaaucaacuuccuucuccuggcuccucuucugggaggcauuugcacagccuguaggaucagccauguuuagugaaucuaacugcuaaggcagugguccugaggaucaaggugcugguucauacuucggaccuaggccaucugcuguuuucuggagacaauacaccuugugaaaaaaacuaaaagaugcagaaacgugaaugccuuucacauuuaaccugguuaaaugcagcuaucuucagacauacucagauucccaaagcagaaagagcagaagaugacaauuccuaagaauuucuuacagaauuucuuuaaauagcaaauucaccuguuguguuuauaguaugauuugauuacacaaaauuccaggagucucaaguuuucaaggaauaucucugucaaauucagcagaauauuccagcacaugccuugcccucuuuuuuaacauaaauauuugaugagcagcaugcuuuauccaagagcaaaucaaugcuccuggcaggcugccuagaagguaauccuaguguuccuaucuuugccucccauucaccuacaguucucugacuuccuauggcuguaauaaauauccgggggcucagagccacccacauccagcagguaauauaacacagggcagaaauuacccucuccacacucacugugcuuaccuccugaauucuggacugagauuucucugacugacuuucacaugagaaccuaccugccuaaacccagguuucuucgacuccuccuccugagcuguugaacuccaccuuagcuuuaucucuuccaugccaaucuuguccuguucuucacacuucugggaaaauugcuuauacaacuucaauauuuuugaaaauauauaauauaugauccucaagaaacauuauaaccauauacaaagguaaacauuuuugacaauuucuuacaagaauucccuacaagauuucuuuucuuuucuugcuuccuuuuuuuuuuuuuuuuuuugagacaggaucucagucugucauccuggcuggagugcaguggcacaaucauggcucacugcagcaucgacuucccuggcucaggugauccucccaccucagccuccugaauagcuuggacuauaggugccugccaccacaccuggcaaacuuuuguguuuuuuguagaaaugggguuuuaccauguugcccaggcuggucucgaacuccuagacucaagcaaucugccagccucagccucccaaagugcuaggauuacaggccugauccaccgugcccagccccaggauuucuuuaaauagcaaauucacaaaaaucaaaaguuuucaaauucaaaaaccuugcucccaucuuauccccauccaugccuuucccauauucucugcaaguagcaacuuguaaacacaagcaaauaagaauauaugguauuuuaauucuccccccuucucucauuaaaggugguguauauacucuucuuuaccuuaccuuuuaaaauuagugguauguuuuagacaucugucucugcaaguaucucuuucucacacacacacagaauaacaaguuuuccaucauguggauguaccaugguuuauuugaccaaucucuacugcuggaccuuugggcuguuucccagucuuuugcuauuacaaacagugcugugaugaauaaagauguaauaaaucauuuugcuuugugaagguguacuuaaggauugauucccagaagugggacugcugaaucacagugcucuguaguaccccuccggaaagauugaaccauuuugcccucccaucaggaauguauuggaugucccgguuccguacagccaauggccauaaaagugucagcucuucuuauuuuugcuaagcugguuucugcacaacgguaauuuagagccauugaaauauuuuugauuaugagugagauggcgguuuggggcgguucuuacaucuuuucuagaauguugauccuccugugggcauuuguugaccuuuccucuugcauacaucucugucagaaucuccuaaauacagacuuacaaaugugauggcucuuuugggccuaaggguagagugggcugccaaauugucagugcaaaaucaagagaaguggaaaguaggguuuuaugccaguugcuaaugucugaauuaaaaauaguuuucagcuaaugguauuacuaaacuggggcuucuccaaaaaacaugaugaagaugaucuucuagccuagaauuucucccucucaaacaaaaacaaaagagagagauugagaauauauacauuucaauagcauuuccugcaaaacuuaaaaacuuccuuuuaagaagccuagaauuuuccacuugcacuguaucuccugaaggaagguuauacaugccguauuuuguuguuguuguuuacugucugaauugggcuccuguucucccuuuaauuucaccaucagagcucugucuacuguauuuccagggugaaagagaagaugaaaguaaaagcacaauguaagaagucaaaccagagcucaggacucuacaaaggaugugggaucggaguugcauggaaucaucuuucuuuuugaagugcucuuucagucagcucuugggaugcuauuuuaauauaaaauuaauuuucaucuuucaaaaacuaaaugccauugaaagagagggaaauuaugauuugaugggaagauggcaguggcuuuguuuuuggaaauucacaagaggcagucuuaugaauuugaguauaaaguuagccuauaucuccaucaaaaaacaaaaaaaaagcaaaaaaacaaaaauaauuuuuaaacucacaacaaaaaacucugucucugggaguaccuacacuagcaaugaguggcccaugaaaaaucccaaaggaaaaauuuuaucuuccaggcccagugcucuguuucuuuuuagcuccugaauauguacauucugacuuuuaugaagguugguuuaaagcucucuggauguuuuguuuuccuucuagcacuuaucucaaucaauuguuauauuaaccuaccucacugcagugucagcuucauaaggacaggaucuugguccaguaccuagaagggguaccuagcaccuuugggugccuaaucaaaagggguugacugcuucuggagcuagcugggucucugugguccuguaucagacaugggccugaaggaggucaugucagccauuccuuggccuuuugacaagauacccuagcccagggguguccaaucuuuugacuuuccugggccacaguggaagaauugucuugggccacacauaaaauacacuaauacuaaugacagcuuaugagcuuacagacaaauugcaaaauaaucucauaaugcagggcgcaugcggcccaggacgacuuugaaugcggcccaauacaaauucauaaacuugcuuaaaacauuaugagauuuuuuuugcgauuuuuuuuuucagcucaucagcuaucguuaguguauuuuguuuguggcccaagacaauucuuccccuuccaguguggcccagggaagccaaaagauuggacaccccugguuuagagcuugaguuugcgguuucagucuccugggcaaaucaccugacuucucagauccuguuuucccguuugcaaaacagagauaauaacaccguauuucaacagauuucagaugucauugauuagaugugccgguauucuaugugccauuauucuaugugccacuauucuaugugccacuaagaaaaaaaaaaagcugcugauuaaauuauaaugcacaucagcuguaagaguguguuaguuuuucuauggccgcuauaacaaauuaccacaaauuuagcagccuaacacaacaaauaugaauuaucucacaguucuguacauugaaagugagggugggcuuggcugauuucucucaucuggguuuuacaaggccacaaucaagguguuggccucuuauugggaggcuuugggaagaauucauuucuaggcucauuuagguuguggguagacuccaguucccugcaauuacaggaugagggccuccggcucuuugcugccucuuagcugggaggcauccucgacuccuagagaucucccucugguccuugcccuugagcccauaucagaacuagcaacauuaugacaaauccuucucgugcuugggaucucucugauguuuuuuuuuguuuuuguuuuugcugcaucucuuugccuccagccagagaaaauucuguuuuuaagggcuccuuugauuagaucgggcccaccuauaggguacucuccauauauuaaggucaguaaccuuaauugcauaaugcaaagucccuuuugccauguaauguaauauauucacauguugcagggauuaagacacagacauccuuggagcuuucugccuaccaugaagaaucauuccaauuaucagggaucuuaaaaugugaacaaaauaugcuucuuagaauugaugaaacaccauauuuggcuuaggaauaaaacagcuacugauauauuuaaaguacuuaggguguuacuaguaagugcucagauguuaacuguuguuauaauugacaucauuaucauaguggucacguaauauccaucaucuuuaauaucaauuaaacuuauuucuacaguuaaaugcauuuauuaaacccuaauugagagaguauagugucccggcaguaaacuggaugaagcugaugauaguuacccuuugaguaucagcauaugcuaggaacuucacauacacuuucucacuccuuauaguagcugagcuagggaauacuggcuccauuuacaagugaggaagcagguucugagagguugaauacugugcuuggaagguuauaggcacaguagugaguggucugacucugaaaucaguacucuuuucauggcaccguuuugcuguccaacagccucugguaauaccacauugaaaagugugacaggugaggcauccgccagguggucuggaggaaugggcuucugggaguggaagggacacagggaggagacacugcccuguguugucucucucguacuuggauguuucuuugcuauuuuuuguggacaaaggcccugucucuucaucuguuuuucaguuguuaauaagcuccaaguugaucuuuuuuuuuuuuuugagauggagucucacucugucauccaggcuggaguauaauggcacaaucuuggcaaccuccgccauccggguucaagcaauucuccugucucagccuccugaguaacugggacuauaggcauaugccaccacacccagcuaauuuuuguauuuuuaguagagacagaguuucaccauauuggucaggcuggucuugaacuccugaccucagaugauccgcccaccucggccucccaaagugcugggauuacaggcgugagccgcugugccuggcugaucuuuuuuuuuuuuuuuaauucagcaaauguuuauugauugucuacuugggggauacaacugugaacaagauacacaaaauuccuugaguaaaaaucacaugacgaggucaauucagaaagggguaagugcugugaagguagcaaagcaggggacugagacagagagauggacuggggauggaggugaccaggaaagaccacucuuuggaggggacauuugagcugagagcugaaugagcaggaggcagccagguuaaaucuggagaagagcauuccagguagagggaacagccagugcaaaggcacugagcugggaauaagcuucgcauguuugagcacaaaaagaaggcuccugugguaggaguguaaagaacaaugaaugagugaaugcaugguaggagauaaguuuggagaaguagacagagaacagaucacauaagccauuauaaagaaucugaauuuaaugaaaaugcaaauaagaauuugcagggaaaucugcuuuuuguucagaaauaagcuguaaugaguguggcauuuugcauacacacuguguuauuuuugaagggaggaaaguuuaggguuuuggaacugcugcuuuuuaaacuauuuuaaguguaaccagugcaaaggggaaagaggaggaggaaagugguuuggcagaacuaggguaaaaauagugacuaccugaauucaguaaacgaagaucacagucuguagaauuuuccuaagacacaacuguagauugucucaggcucuucaaauucagauagacauuugcugaaaacugaucucaucaucguccccuuaaaaccugcuuuccugccuguuuucuguaagacauuuccauccacccagguugcuaagcucugaacccuugagucaucaggaacgccucccuccccuucaucucucccuagcuuggacacccugcccccaacuaaagccuggguccaccuccuaaagcgcccgcaugucugcuucucccuacccccaugccucucaccuggauuguuguuguggcuuccuaacugaccuuuacccugcacacugccaccagcaugauuucuugaaaacauaaauuucagugggucacuuccugaacucauagacaauagaaaauugucuaugaguuccccaaaggcaucgcagucuaguaaugaagauucacacugcccagguucaaggccucgugaugcuucuuaccaccucuggcuugggaauguuuuuaacggcugugucucaguuuacucaucucugaaacgggugugauaauagcacuuaccucacagauaaguuaugaaauguaaaugaguuaauaggugugaagcacucauaaccaugccggccacacagaaauccucagugaacauuauucuugaucucucuuuccuuuguagaacaagcucaucuuucuuguggcucuccacaauagcuccuaccuccaccuuucucagugccaggcaaagcuugaucagcagacagaccucuuuguuagcaaucugcagcuagauaaguccauauuugguaauuuuuauagcaauuugaccaucauuuuacaucuguugaaucugauuaggaacuggacuuguauuuugucccauuuuuggcaguuccuuuucgcugaauuuuuaugaaagaauugguccauauugaauuggaaguaaaaaaaaaaaaaaaaaaaaaaaaaaaaccccuggucuuuccccaugaauaauuugagaagcacuucuguguccccacacacccacuaugugauucacauuggccaaguuguccaaacucacuguguaaccuuaaaucucucuggauuuccucacacuguuuccucugccuagaauuuguuagacauuuauuaaguaccuguaauaaguacaagacucuggggacauaaggaugaauaagggucugccuuugcuuuugaaaauguuuccuucaaaccaccuaguaaauuccuaccagucugucgaagccuaguauaguuucauuuuuuccuucauccauugagaaaacauuuauugaccaggugcaguggcucacaccuguaaucccagcacuuugggaggcugagguaagaggauugcuugagcccaggaguuugagacuagccugggcaaccuagugaaacccuaucgcuacaaaaauuuuaaaaauuagcugggugcagugguaugugccuguaguccuagcuacucaggaggcugaggugggaggauuuucugggcccaggaguuugaggcugcagugagccaugauugcaccacugcacuccagccugggcagcagaaugagacaucgcaaaaaaaaaaaaaaaaaaaagaaagaaagaaacaaaagaaaacauuuauuaacauuuauuaaacaccagacaccaaacaccaacuguuuacuaagcaccugcugccuucccuuucuucccuaaggaccaguaagcuaaugaggaagacagacacaaaaacaaauaaugacagaauaauaggcauguuauauggcagugugaauacagaaguauggaagcacagaggaggggugugccgggcuaugccugagccagggcaaggcacuggggagaucaggaauggggucauaguuaggguggagacaguguguggaaagauuaugauccagguuuugggcccacagccaaagcccagcucugccauucacuagccaugugacuuugagagacugccucucugaacuugccagguagguagguauugcuuuccuuaucuguaaaauggggaaagcaguacuuaccuacuucacaagguuguuuugaggcucacuugagauuguauacauaaagugcucagaugaguaccugaccaucaguguuuaccugaugucaccuucuuguccucuucucucccccaucucuggacauauguaaauuuucugcugucuggguucccaguagcaugcuauucagccaucauacuaauuauuacauugaauuauguagcuuuaucuaccacauuucuguuugcucuguggaauauauuguacccguugaauucaguggccuuuuuuucaucuuuauauugucagugauaggcagugucccaugcauagaagauucaauuaaugucuagagaaguuguauuguaucaaaauaacuuaaagcacuuugcacuuuucaaaaagcuuucugaggagucuagucaaacauuaauuuccacuuuacagauggggacacugaggcacuuucuagaaagcuucuguuacuugcacaaggucaugggcuagcagagggcaaagguggaguuagagccccacaccucuuguucuccugcuuuugugcugccucauuaaaucuagugagcugggaguugucgggugcuggccaggcucaggacgucuugucaccgggcccuaccuguccugggaggacggcugaguacgcaggagucaguccuggagagagccccaucuauacucuuccccaccccucuggcucacugcugccccacagguauuuaggagucacaccguaaguggcagggcccaccuggaaaccugggguggggaugagggcagaggucuccagcuggcuugagcuggaggcagagggcccuguccuaagagugaauaauuuguaacuagacuggagggugaguguguccaggaggaacaggaguccagaugaaggcaggggcuuggaaagucgugaaagcccuugcacgcauauccaaagagcagugaaucuguuucuuaaauuucuuuacuccccuucauaaacuucccaauacauuucccuuccaccuucuuugaaagggugcccuuugcacucugcccaggagcacgcucuaugcuccaguuacuacggucggcuguaaucuucauuaggguggguggggcaaagggauaaacucacacuaaggacucugaccuaaacuuucuugacuugaggaaagcucaaaauguaugauuucguacauuaucuuuuucuuucauuagaagaaaagaaaaaaaagucucaagauaauaggcucuagcagcuuccgcagccucacugaaggcagaagggaccagggcagcgguucauaaacuuaugugcauguuaggaucagcugaggagugacugaaaaucauggagccccggccgcacccagcccuggcauggggcccagaggguacagucucuaauaaagcuuccagguaacuccagggcauggucaaggcaggagcacugggagagcagccuucuugcugccggaguguacucuaagucucugcagugcagaugauugacagaaggagaacucgggauuuggccgcugaggagucuuguggauccuggcucauuuccucaucuaguuacggagucugugagaagccuuugggcacaaauccucccucaugccggcccucugagccccuccccgcagcacauaccgagcccuaccuuugggcugucuaaaucuguccauuaagaaaaaaaugaacagaaaacucuuccuacuuacaaauuauugguguaugcugcuagguaaaaacaaaaggaaugucccugaaggaagaacgucaccgcuuccauuucgacacaguaacccacaggguaacagcacagcacucuggggaugagggccacagguacacaaggagccuccgcaaggccuuguccuggcaagucguguuucauggaaaguuuucuugagaaagcuaaaucugaggauucugggacaugaguguuacucauggccagcgucaucauacggagccugggagcaaauuguuuuuucaagagguguauguaggcuauugaauuuugacuagaaauggcuuuaguggucaacauuaauuuugcuuuauauccagcagcauuucuuauuuuuaucagggauauaagugaaggaaaaauugugagggaaggcaaccuguaaaguucucauucauagaaacgauuuguggccuugauuuccuggauacaaauaccauuuaaaaaauuuuuagagagguuuuguuuggauugaauuuccaauccacauguauuucuccauucccccuugagaacuagaagucuuuuguaugguaacacuuuccagaagcaccugaaaggaguccuuugggaauggccacaaacuggauaaaaaugaaaaauggaaucucaaaagugcagcuugguuuugaaacuaacuuuuuacaacuuugauuaugggaaguaacuuuguugugugucuguuguugaccuggcauuacaacuccauuagggcaauauaauuaguucauuuuacagaagacaguacaacucaagagagcuucaguaacuuguacaaggcugcagagccagaauugaaaccugugccuguuugaguacacuaccccuaggacuaaagaaacacauaacucaaguguuaauuuucuaauagcuuuaagagacguguuuccuuuuacuguccacagaagauuguccugauaagcauauaaaacaugaaagcauauaaagcauuguaaagcucgagaaucagaaucuacaagaggacagaaaguccagggaagagaaaguggaacuguuuccuggcagguaccauguuuauaaaaagcccagcaaucacuuauguaaauucauuuuuaaacugucucaugacagcugcaaagacuggaauugucaguucccagcuucauugucuuuuuauuauugugacccacccuuguuaagcaaggaauuaauagguaggaacaguuuugcuaaugguuauuaugccuuuaguugacuguuacacuacaugcaggauuuuuaguuauuucaccagaaaacaaugcggaagaaguucagagugaauguuggaaaaaugacagaauuaaagaguuggcauucucuaaaauuucuaaacaggaagggcucauggcuggcaguguagaagagugcuaagggacaaaucugaaagcuguuugcuaagcaagcacaauuuuuuuuuguuuacuuuauguguuucuguaauguuuucuaaugauguuuuaaauuuuuacuuuuaaaggugggaaaagguucauugucaguauuaaaaagggggcucauguaguauuagagagcaggagccugacuggcaggguuuaaaucccagcucugacacuugcuaccuauguaaacuugaacaaguuaccuuaucuuccuccugggguuacugugaggcauaaguuuuaauuacauauauauguguguauauacuacuauauacauauauauauacacauauauauaugaauacuuacaacuaugccugacacugaauagauuagauacucaauaaaugcuugccauuuuaauuaauuggaacuuaauuuaauuggaggaggugauagagauaaugggggaggaaaagaugcaaaaguugccacaauucagccuucugcaaauucuuccaguauaauuaauucuguuuagcucagugauuugagguucauuuuuuuuuauucucaucguauuccauguuuauauucuacaguaugguauagcgggaucagugaacuauuuaauuuuuaaaaacuuaacauuuuaacucuacuuuuaaaaaguguuaaauguggccucugcugaaaauguacuuucaguggggucaaggaagacaggagcucugugcuggagacagaauuguuccaguuuccuuggaacaggggccucccaugcuuaggcccuaacugaugccuaaaaaucauaaugaacaauguuguuuucauucugugguuaaaaggaagcauaccaauucuucuggagaaauauacuuuuuuucuggcccuaaacugcaccagauuuaucauguagguguagguucuuacgagaggggcuuuggggauagguucuucaccaucuuaagugguucuuccugguaaauauuuagagaaauuuuucuuguggcuauuucuuaugaugacccuugaaauaauuagaggaugcuauucguauucagcaacugcauuucuacgggaaauaaguccaagagcauguucucuugaucuaauuugauaaagggcccaguuuggaaagaagaguggccagagucaggagcuugccaucuggagcuuuggggacagaauuaugggauguuacaacagaaaggggccaucgucauuauggagccuaacuucuuuuuacaaaugaagaaauggaugcccagagauuugccaaguucacauagcuaauugguggcagcuccaggauuccugauuccagcugcccauuccagcaacuauauccuugucaugaagaguguacuuaagagcaucucugugcaaaacguucugcaaugaaggacagguucagucugucuggugucauagccaccagccacuugugccucuugagcauaugaaauaugacuacuguaacuuaggaguuaaauuuugcuuuauuuaguuuuaauuaaacuuguuaauauauagcuaccauuuuggguagcucagcuuuuauagacauuuaggaggaggaaaggccuuauccuuaucuccuaccucauucucaccaagugagaggccuucuuuucgaauggcuccugugcagcugcuuugugccaaaccaagagaaucacucuaagucuuaucuccuccccuccuaccucucaagaugaaaguuagcuccucuguaaaauugacaugaguggaguagauggcucauugaggccucuuccauucugaagcauuaugacuuuagaccuggcucucuagugauuaucagugaccuuuagcagggcacauagucugcccauaccucaguguccuuaucugucagcugaaauuaacacccguucuacccucucucagauuaggagaggcucaaaguagaaaaucaaugagaugagcuccauuugcaaccuuuauuuuuuaauaaucuaugguaucuggaaauauuuuugguuuugauacagauuuuuuuuuccaauaagcugcagcagauccucauugccagaguagagaaaauaauaacccacagcccauaugaaauaugagcugggagacaugguacuaaugaaagaugacugauuugaucagugggugcuagcuuuuauaauaacuugcuuaacuuggcauucccuaagccauuacuccauagucagcuguuuaucuggaaacccaaagcacaucccuuuuccugagaacugugacugucuaucuugauuuuccuucuuuggcuccuuuacuuauugucagccuauguaaguuucauuugaauacuuggcacugcauguucuuccguaaacaaauacagcaaaaacccucccaugauugucuccuugguuauagccucuacaucaauaguuuucaaacuuaauuccuagacagugauucucaacugacaugucuacugcuuacugcugagccucagcucucuucaggaguaugccaccaaacuuugauugaaacauaaaauguguuuuugacaccacagaguaaguaggucuuuugaccugaugugaauaggguacagcuugcucugggcaacaggcaguguaacaucaaguugaggcuagauguugcaaagauguaacaaagagauguugcaaagagagccagaugucacuucugaaaauuuuugucccaagcauguaagauagccaagucaggccagugaugugguacuggagggugacccagugcagaguggcuuaguuguggaugccccuggaaaccccaggaaguauuauuuuaccgcagcaggguuugccuuguaauuaugguugaaucgcuuaguguuguguuaguccuuuaauucugucaauggugccaccaaaaauuguaguaucucuaauggccaaagagcauuucccugccccagaggucccuuggggauggcugcagggaaccaggugagaccucgaaggcacacaucgagcucucccuacccaguucaaucagaaccaguucaacuguauguguuccacggaucagcuuucugaauaagaucccuuuugaagaaaggauuccucugcuuauaaagaaaaaaagaaaguugaaaacuaugacuucagagcagcaguucucaaauuuugaugagcaucagaaucacuuggagggcuguuaaaacacagauugcugggcccaccaccagaggauucaaugugccugaguugcagcuugaaaauuugcauuuuuaaccaguuuccaggugaugcugaugcugccgguccagggggucgaaccacugauucuagcaaacagaaauguuaacacuaacuaccuguuguauuacauguaauaaauucagugucauuuggugcuaaaaaccuuuuagaguauuuccguccccauguacaaagaauaaaacugagacauagugaguuucaguaacucaucagucaucauugcggucaucacagaacuggaguuagaaccaggucuggguaaggccagaucccuuccauauccaaaaugccacucaccuuccuuguagaccugucauucccaaccugugguccaagguggggaggaggagggagaauuuauuguauugguuugcaaauccagauguaaagcagacauugcggcagacuaaaugucucacaaaucaaucuuuuuuuaguuuuaauaaacuuuaaauuuuauagcaguuuuagguucacagcagaauugagcagaaaguacagagaguuccuguauacccacugugccuaugcauagccuccuccacuauccacaucccacaccagagugguacauuuauuguaaucaaugaaccuaaguugacacaucauuaucagccaagguucauaguuuacauuaggauucacucuugguguucuacauucuauggauuuugacuaauacaugaugacauguauucaccaguguaguauuauacaaaauaguuucgcuguccuaaaaguccugugugcucugccuauucauuccucucucccuccuaacccuuugacaaccacugauauuuucacugucuccauaguggaaugucaaauagucagaaucauauaguauguagccuuuucauauuggcuucuuucacuuaguaauacgcauuuaaguuuccucugugucuuuuaauggcuugauagcucauuuccuuuuagcacugaguaauauucuauuguauggauguaucaaaguuuauuuacccacugacuuacuaaaggacauuuugguuucuuucgaguuuuggcaauuauguacaaagcuguaaacauccaugugcaaauuuucgggcauaugucuucaguuuauuuugguaaauauaaaguuguacgauuacuggauuauaugguuaaaacuaugucuaauuuuuuuuuuaacugccaaacugucuuccaaaguggauguaccauuuugcguucccacagugaaugagaguuucuguugcuccacaucuucaccagcauuuggugccaucaguguuuuggauuuuggcuauucugguagguguguggugguaucucguuguuuucguuuguaauuccccagugacguaauauugaaccuauuuucagacacuuacuugccaucuguauguuuucuuuggugagguauauguucaggucacuuuugaucauuuuucaaucaaauuauuuucuuauucuugaguuuuaagaguucuuuauauauauuuuggauaacaguccuuuaucagaagugucuucugcaaauauuuucucccagucuguggcuucucauucucuugacauugucuuuggcagagaagaagguuuucauuuuaaugaaguguagcuuauucucucuuuugugguucaugccuuugguguuguauguaaaaagccauugccauacccuuggucaucuacauuuucuccuauguuuucuucuaggaguuuucuaguuuuguauuuuacauuuaguucugugaucaauuuugacuuaauucuugugaaggcuauaggucugugucuagauucuuucuuuuuuggugggggcagggaauguggauguccaguucuggcacuauuuguugaaaauacuauuuuugcuccacuguauuaccuuugcuucuuugucaaagaccaggugacuaugugggucuguuucuaggaucuguucuguuucguucaccuguuagucuguuucuuuacuaauaccacacugccuuaauuucucuagcuuuauaauaagucuugaaaucaaguggugucaguccuccaacuuuguucuucaauauugaguuggcuauucuaggccuuuugcuucuucguaauacuuuagauucaguuuguuuauauccauaaaauaauuuucugagauuuugauugugauugcacugaaucuauaggucaaguuagggagaacugacaucuugacaauauuguguuuuccugucugugaacauggacucucuuucauuuagaucuucuuagauauauuucaucagcauuuuauaguuuuccuuauacagaucuuauacauguuguuagauugauaccuaagcauuucauuuugggagugcuaauauaaauaguaauguguuucuaauuucaaauuccacuuguucaugacuggucuauaggaaagcaguugacuuuucuguguuaaccuuguauuuuacagccuugcuauuauuucucacuaguuccaggaaucuuuuugucaguuuuuucagauuuuuuacauagauguucaugucaucuuugaaaaaggcaguuuuauuuccucuuccccuaucugugugucuuuuauuucuuuuauuuacuauugcauuaccugggaauugcagcaaaaaguugaaaagcagugaugagagggacaucuuggccuuuuuccuagucauagagcaggaaagcuccaaguuacucacuauuaaauaugggcuauuuuguagauguucuuuaucaaguugaggaaguuccccucuauuuuuaguuuacauaguuuuuuuaaaaaaaaaucaugaauagauguuggauuuugucaagugcuuuuucugcaucuguugauacgaucaugugacuuuucuuuuuuagccuguugaugggauggauuccauuaauugauuuucaaauauugaaccagccuuacuuacccugagguaaauccgcuuugguagcaguguguaauucuuuuuuacauuguuggauucaguuuguuaauacuuuauugaggauuuuugcaucuucauucaugagagauacucuuaaguuuucucguaaugucuuuaucugcuuuuggucuuaggguaguguuagccucauagaaugaguuaggauguauucugucugcuucugucuucugcaagagauucuagagaauuguuauaauuucauccuuaaguguuuagaagaauucacaagugaauccaucugaacuuggugcuuucuguuuugaacaguuauuaauuauugauucaauuucauuaauauaaauaggccuuuugagauuaucuguuuucuuuugugaauguuggcagauuguaucuuucaaggaguauguccauuucaucuggguuaucaaauuuguguacauagauugugcauuuauucccuuauuagccuuuuaauguauaugggaucuguaguaguguccccuccuuuauaucuaauauugguaauuugucuucuuucuuuuuuucucagacucacuagaugcuuaucaauuuuauugaccuugucagagaaacagcuuuugguuucauugauuuuucucaauuuuuuuuucuguuuaauuucauugauuuuuuuugcuuugauuuuuuucuuuaauuugaauuuuuuuauuuuauuuuucuuuguauauuaaucuuugcccaugcuuaauuugaauuuaauuuauuuuuucuaguuucuuaagguggaagcuuaaauuacugguuuuagaucuuucuuuuuuucugauauauguauuuaaugcuguaaauuucccucuaagcacugcuuuugcuucaucccauaaguuuugauuagguguauuuucauuuuuauuuaguucaaaauauuuuuaaauuucagauuucuuccuugacucauguauuuuauagaaguguguuguuuaaucucuagguauuuugagauuuucaaguuaucuuucuguuauugaauucuagcuuaauuucauuguugucuaaaagcagacauuguaugguuuauauccuuuuaaauuuguuaagguuuuuuuuauggcccaguguguggucucuguuagugacuguuccaugugaacuugaaaagaauguauauucuguuguuguuguuggaugaaguagucuauagaagucaauuauauccaauugauggguagugccauuaaguucaacuguuggcuuuaaugauugucugccuaauagaucuguccauuucugauagaagggcauugaaaucuccaauuauaaugguggauugaucuauuugucuuuuaaguucuauuaguuuuuuaccuagcuuauuuugauacucuguucuuaggugcauacaugacaaauauuguuauguuguauuggagaauugaccccuuuaucauuaugugaugccugucuuuauuccuaguaacuuuccuugucagcucugucugaaauuuauagcuacuccuguuuucucuguuaguuuuagcaugguaugucuuucucuaucccuuuacagucauccugugguauacacaggggauugguuccaggaccauccccucugcccugcauguaaccaaaaucuguacauacuuaagucccacaguuggcccuguggaacgcacacauauggaaaguuggcccuccauauauguggguuucacaucccguaaauauuaaauauuguauuuuucauccuuguuugaaaaaaauccaaguagaaguggaccuucucaguucaaaccuguguuguuccaggaucaauuguauguaugcacauaaacauauaucauuggauauauuguugcuauuuuuuaaucaaaguauuaucuguuaaaucaauuaaaauucacuuaugcauucuucacuuaugcauucucugaugcuugcuuucuuucuuuauguagaucugaguuucugaccuauaucauuuucccucacucugaagaacuucuuuuaacauuucuuacaaggcaggucuacuggcaccagauucccucaguuuuuuuuuaaucugagaacauuuuuauuucucuuuuauuuuugaaggauaauuuuucaggguauguaauucuagguucguuuuuuuucucucaauacuuuauaugauucauuccacucucuugcuuacaugaauucugagaagucaauguacuuauccuugguccuggauggguaagauuuuuuuuuuuucuuuugucuuucaaaaguuuuuaucuuugauuuucugagguuggaauauguuaugccuagguuuuuuuuuuuaaguauuuauucugauugguguuucugagcuuucugaauucugugguuuggugucugacauuaauuugggggaauuuucagucauuauugccucagauagugcuucuguuucuucuguccuuauuuuucuagcauucuuguuacauguauguuacaccuuuuguagacaugccauaauccuuauucuguuuugcuucuuuucauguuuuuucucuuugcuuuucauauuuugaguuucuguugucauaucuucaagccuagagauucuuuccucagcccuguucagucuacuaaugaacuuaucaaaggcauucuuuauuucugucuuuuaaaauucuuagaauuuccauauuucuacuuacauuauucaucuguucuugcauguugccuacuuuuuccauuaaagcccuuagcuuauuaaucuuaaauuuaaaaaauuccuggucugauuauucagcauuccugcaauuucugauucugguucugaugcuuguuugguuccuucaguguuuuuugucuuuuaguaugccuuguaauuugaaugaaaggcagacaugaugucccagaugaaggaaaugugauaaauaggcuuuuaggaacauggaggugaagugugggauaacagaaguguucuguaccucugugguuagaucugaggcuuuagaugagucuugcauccaggacuaugaacucacaagugcugcccaguauuuuuucuucccuuaggugggacaggguaacaggagaguacuggaguuggguauuucuuuuccccagauaaguuaggcucugauaaaacccaaacagauuaggcucuggaaaaauaguuuccucugagggcaguccauauuaagaagaauagaauguucugguauauuucagaaugcuuuuuucacccucccccugcuggaagcaugaggggauuuuucuuccccauucagugaggaccugagagagcuucuagagguaaaacucacaaacaugcuuccccuucccccauuacuagauuccccugaaguuuuuaacucccugacuuguccacacgaagucucuagcaauuuguugguuacagcucagguuuuuccaucuuggugcugguuccuacgcaggcuucugcuugaagguuucuauuccuguauacuaugauuuucugugucuaccugccuaucucuccaacuuuuggggcagugguuugcccugucacuuuacuucucuacugcauccaagaagaauuguugguuuuuccauuuguucagcuuuuuaguuguuaggagcgagugacaacaacuaaacuccuugcuugcccaacuggcuaaauguuuauuuuucaaaugcauuuuuaugauaaagacacuauggagucauaucaguugucucaacuggacagaguuaaugugcaccuagcauuuucucagugcacgcugaaaguacagcuucuccagcugagugcuuggaaaguuuuugguuuuuguuucuaauggcacgaaguugucuucauaacuagaaaagauggggaauuauuucacuaaagcacuuugguugccuuuucuaagucuagggucagugggaaguaagaaggcauaauauuaauuaacugauuuuuauuugaagagguuacuggagaaaguaauaguaucauguugcuuaauuccaccaggaauucaugccaugugaccucagcugcagggccccagugggaacaggauuucuucccuccugcucucuacugaggcccugcccucaucucuugaccacaaccuuuaaccugcuuucucagcuucugccuaucccucuucuuucucucuuguuugccaaagccagccguucugccuggacuccauccauccuguugucuagauuccuuacccaccaucaucuccucuccaguugcguguuuuuugcuucacugcuguuucauucaaauaacgugggcuuguuuuguuuuguuuuguuuuguugguacacuugcuguguagcagaaacaucauucccuccucuaacagauguguucaggccugccuccucugcucaugguuaugauaauuaaacccuuacccugugucagacuugugcuaaguauucaucuugcaucauuuaccacugacuaguuaugggacauuggauaugcuaucuacauuuucuaagcaucucuaaaaagggaacauaacuucguaagguuguugugaagauaaaaguaaaauaaugcucgcaaagcacuuaacacagggccugauauguuguacacacucauuauagauauggcacaggaggcucacccaugaagaaagggagaaaagucauugucaccacuguuuccucgugauuugcuucugcagucaguccuuccaggcugcuguucucucacuccuuuuaccgaa

SEQ ID NO: 14676 - RNA, 3185 nt, Homo sapiens
ugcaauuauucauaccaguuuauuguagguauuguguuucaaaaaauuuauagcauaaauaacuuuucaugucauaaaauaacuuaguagaauuuauaauaaaacuuugagaauuuaauaucucaucaaaauacaauaaaauaugguuuucaaauaugauuaacccuuucggcuuuucuuuuacuugagggcauauaaaccaaaaauacccaaacuauggcugcacacuuaaacuuuaacauauuugguuuauuuuaauguaacucaaccauucuaaauuaauacauaguuuuccuuccugcaugguucuuuguaauuuuuguuccuuuugacuuauuuuucuguuucaacacagcuuccuucuucauuuucaccucuuuccaucugcaaagucaucuaucuccgggcccccagaacauguaguugaacucacucagccccuuggcaucaguuucuguaauccuugcaucaguguagggaguaacugcuugaguaacuacaaagguauuucaaaaacuucagugcaauuugguucaguuauuuucauucagaugccaucaccguucagggagauuaaucacuggaacccauugauccauguagcgacuuucccggcaaaaacaaauaaguugacuuaaggcaggauccuuccauugagaugaauguggauucuggaaacaaauuuauaaaaauaaacuuauuuuaaaaaccaguauauucuaguaauuauacuuuugaggagaaaacacuugaacauucuauauuuuggcuaugugacauggagacaaauuagaagcacaaaaaaauuaaaguuucuucaagguaguuggguucccugcaaaagcguuaaggguaauuaccuauuaaacuacacauugcaaagucugaacccaugcaacccaagcugaaccacauacauauguuugcauaucuguucaguuuugcaugagaguaucauucaccgguuugcucuaccaaacuuguuacccugaccugagugaaacaguuuugagaaagauuuccaugcugugugcacaaugagaugagagcugcacagcaguuaacuggaauugccaucaaccauacuccaagagacagaauaguacuuuuaaggaguagcaaaauaaucgggcugucacuugacuagaccagucaaaaaagagcaaaauuuagaagacaaaaguagcacauuuaccccugaaaacauaacuucccuaccuaccaaagguuuuuaucaggaaaaaaaaaaagagccauuaaaaaaaugcaagauugcagagaaaaaaaauuccacucuauccucuuaauguauuucuagggaauuaacaagguuugucuccuacacaauuucuauuuuuagcucugacuggcagagaaugaagcugacuccuuaaugaggggugagccaggaauucauuuggcuuuaucuaaucugcccugcuaaaggaauuagucacgggaggcagugcagauguagguagggaguagcugggcugacugcugacucacagggaucucuuccgcugcuggcaguccccagcaugcuuagacauguucuguaccacagaaaauccuggugaugaaacuagcacaucucggcugaaaguccagccacacucuagucggacaaaggcagccacccuccugacccccaccuaccacagauccacaaucaggcaacccagcccugacucccguccuuccggggcucuacccugcaggcugcagucccccagucccuuaccgucaccagcacgcagugcagguccgggggcugcucggcgcccucgcucgccgcggggccagcgucggucuccaagagcaggagcuccgccagccggcccggguugcugacgcgcaggauguugaugucguucucgcagcaaaacgccuggaucagggugaaguggaucugcagagccacaucucugucgucguccucguccgccgccagcaggcacaacaccacguuaucggggucgcugggggcagcgggcggggccagugagcgcagaagcgcgggcgcccucaaccacugcccgggucccugggggucgccgcccggcccgcucgcccccucccuuccgagacaggcagaaaagcgacaggaaguggcgcggccgggcgaggggcgcccagccaaggcgaccucccgggcuggggcgggaaggggugccaugggggacgcgcaagggccccacuuacacguugagcagcuuggccgcuucguacaccccgacagugaucgugcgcugacucagggcuuugcugagcacuuccuccagggcaucccccaccuuauccauccuacacgcgggcaagggcgaggggucccgucagccccggugcccucggggccaucgccgccccccucguccgguaccacgccccucccucucgaaugcaagcaccaccgcgcaccugggcucuacgaaaacccggcgcucccgcggccccgucaccccccaugaccccugcacgcccaaggaccgggcgucccgugagaagucccgagagugccccugccacaggcugccagccacgggagccgcacgggcagcgacggccacugcugcccuuugcaaaggccccggcggggcucguucggguuggggggcacgcucuuucaguccgugggagcuccacggagagucccgagggagcaagggcgggaguugcccugugcaaacuuuuuagcuuccuccccugcaagccuuccacagcccggcugcaccggggagcgcgggguagguaagagaaguucgggccggaagaguccgcaggccgacucaccuuucggucuucugcucuccagccgagaauuccuccaaagucauauugcaaacugcaggucgcccagggagagagcgcggcgugcgggcugcuccugccacggcuagcgcgcgggcgccugcuuucugcacucacucacaggcgccgcuccggcagcucaggcccuggcgcucuccggccgccccucgcccgcccgggcuccuccuccugugccagccgccgcagcuccggccaccccucccgccuugcuugcucgcucgcuccccggaccucgccucgccacgggccgcacgacacuaauugggccgcugccucccagccacugccuaccagccacuggaggacaaagggccccgcucuccgggguuauccugccaacccucagccaacca

SEQ ID NO: 14677 - RNA, 1964 nt, Homo sapiens
ugauagaaaucuggagggacuuuucacaaaugccgacuucugguuugugccuuucccauauuuuauuaaauucguguuuuauuuuaaaaaauuacagcaacauuaucaaagacaacauauguacaaacauuuuacaaaaaagaacauuaccaauaucaguggcaguaagggcaagcugaagaauaaauagacugaguuuccgggcaaugucuguccucaaagacauccaaacugcguucaggcagcugaaacaggcuucuuucccagugacaagcauauguggucaguaauacaaacgaugguaaaugaggcuacuacauaggcccaguuaacaaacuccucuucuccucggguaggccaugauacaaguggaacucaucaaauaauuuaaacccaaggcgauaacaacgcuauuucccaucuaaacucauuuaagccuucacaaugucgcaauggauucaguuacuugcaaacgaucccggguugucauacagauacuuguuuuuuacacauaacgcuaugccaucccuuccuucacugccccagucagguuuccuguuguuggaccgaaaggggauacauuuuagaaaugcuuccuucaagacagaagugagaaagaaaggagacccugaggccaggaucuauuaaaccuggugugugcgcaaaagggagggggaaggcaggaauuugaaaggauaaacgucuccuuugcgccgaggaaucaggaagcgugacucacuugggucugggacgauaccgaaauccgguaccccaccccauccccugccccgccggguaccuacaagcucgguuccuuucucaacucccccaguuccuugaucuccaccuucuuguacuuccccgacuuucuccgguuggugaucaccaggacggccaugccggcgacgagggccaccacgaccaccacgaugacggcgaugaggccggcggugaggcgcuucauggagaacuucgggggaaucucguccagguaauagaugagcgugcgcuccaccugcagggguucuccgcgcacgcgcaaguccaggccgccgcggcccuggaauagagacucgcccuugaugucccucucgaaguaguaggcggcaucgccgauauccacgucaccggcggccuucugagacguguucugccgcagcucgaucuggauggugggcugcucguagugcacggccgccacgaacuuggggugcagccgauagcgcucgcggaagagccgccucagcucggcguccaggucugagugguugaaggcgccggcgguggggcgguggcgcaggucaaugaggauguggugggugcgcaccagcucaucgcagcguaggcucaggucgcccuuguccgugcggcgcacgcccaccgaguucacgcaccagcacaccgacgucugguugcacuggcgcgccuugaagcggcccucggggucgcagucggggucguagaggccaucguuguccacgagcgcgugcucacucggccgcaccagcgugcgggcguucuugggggcgcucaugcgcgccuugagcagcagacacuuggaggucagcguggagcagucgaccgccaugcccgagcccagcgcgcggcacuggcagcggccgccggggccgucggggcugcacacggucaucuuguuggugggacacgugcaguuguccugcgcggccguguggccggucaccgccgccagcaccagcagcagcagcggcagccgcagcgguggcggcgcgaggccggggccccgagccaugguggggcggaggaacgcggaccggacgcgggcggaugaggcgcggggacucgucggggcucgggcuccggcgucugggauggucugcaggcgucugccgcccggccgcucccuccggcucuuauacucuacccgaccugcccggcugguuccaccaccgaccguccccacugguauuugggugacacauccc

SEQ ID NO: 14678 - RNA, 826 nt, Homo sapiens
gacugaucaggacuccucaguucaccuucucacaaugaggcucccugcucagcuccuggggcugcuaaugcucugggucccagguaaggguagaagggagaugagggaggagaauggcauggaacggugaguucuggggccccacugccucuaacaacagugaucucugggggucucacuacacuccuauguguguuccuuuccuguauuggacaugcacauguuguccuccagaauggggcaugugaugaucagaucugugagagucaggaagauucaagaagaaacaaggaucugugcucuggggaagacugacacagaaaggggaugguguggggucuucuggagaccccuuugagccuuggaucccuugaguuccauuuugaaacuguauauuuuugaaauaugaacaaauacauauauagccugagauaaacaacaaaucaaaauuuaugaaaauuacacauaaacuuuauacauaaccuugcucuucuuucuauuuauuucaggauccaguggggauguugugaugacucagucuccacucucccugcccgucacccuuggacagccggccuccaucuccugcaggucuagucaaagccucguauacagugauggaaacaccuacuugaauugguuucagcagaggccaggccaaucuccaaggcgccuaauuuauaagguuucuaacugggacucuggggucccagacagauucagcggcagugggucaggcacugauuucacacugaaaaucagcaggguggaggcugaggauguugggguuuauuacugcaugcaagguacacacuggccucccaca

SEQ ID NO: 14679 - RNA, 824 nt, Homo sapiens
cugaucaggacuccucaguucaccuucucacaaugaggcucccugcucagcuccuggggcugcuaaugcucugggucccagguaaggguagaagggagaugagggaggagaauggcauggaacggugaguucuggggccccacugccucuaacaacagugaucucugggggucucacuacacuccuauguguguuccuuuccuguauuggacaugcacauguuguccuccagaauggggcaugugaugaucagaucugugagagucaggaagauucaagaagaaacaaggaucugugcucuggggaagacugacacagaaaggggaugguguggggucuucuggagaccccuuugagccuuggaucccuugaguuccauuuugaaacuguauauuuuugaaauaugaacaaauacauauauagccugagauaaacaacaaaucaaaauuuaugaaaauuacacauaaacuuuauacauaaccuugcucuucuuucuauuuauuucaggauccaguggggauguugugaugacucagucuccacucucccugcccgucacccuuggacagccggccuccaucuccugcaggucuagucaaagccucguauacagugauggaaacaccuacuugaauugguuucagcagaggccaggccaaucuccaaggcgccuaauuuauaagguuucuaacugggacucuggggucccagacagauucagcggcagugggucaggcacugauuucacacugaaaaucagcaggguggaggcugaggauguugggguuuauuacugcaugcaagguacacacuggccucccaca

SEQ ID NO: 14680 - RNA, 824 nt, Homo sapiens
ugugggaggccaguguguaccuugcaugcaguaauaaaccccaacauccucagccuccacccugcugauuuucagugugaaaucagugccugacccacugccgcugaaucugucugggaccccagagucccaguuagaaaccuuauaaauuaggcgccuuggagauuggccuggccucugcugaaaccaauucaaguagguguuuccaucacuguauacgaggcuuugacuagaccugcaggagauggaggccggcuguccaagggugacgggcagggagaguggagacugagucaucacaacauccccacuggauccugaaauaaauagaaagaagagcaagguuauguauaaaguuuauguguaauuuucauaaauuuugauuuguuguuuaucucaggcuauauauguauuuguucauauuucaaaaauauacaguuucaaaauggaacucaagggauccaaggcucaaaggggucuccagaagaccccacaccauccccuuucugugucagucuuccccagagcacagauccuuguuucuucuugaaucuuccugacucucacagaucugaucaucacaugccccauucuggaggacaacaugugcauguccaauacaggaaaggaacacacauaggaguguagugagacccccagagaucacuguuguuagaggcaguggggccccagaacucaccguuccaugccauucuccucccucaucucccuucuacccuuaccugggacccagagcauuagcagccccaggagcugagcagggagccucauugugagaaggugaacugaggaguccugaucag

SEQ ID NO: 14681 - RNA, 782 nt, Homo sapiens
guucaccuucucacagugaggcucccugcucagcuccuggggcugcuaaugcucugggucccugguaagggcagaagggaaaugagggaggaugauggggugggagggugaacucuguggaucccgccaccucccauguguguccuguccucguguuagaugugucuuguccuccaggauggggcauaugaugucuagaucugugagagugaggaagauuccagaaggagcaaggacauguacuuuagugaaagcugugacacagaaagagggggaugggauaggugacuucuagaggccggcuuugccuugcaaauauugguucuuuuuaaaccuguauguuuugggaggauuaaucaaaaucacacacacaaaaauaauugagcaaaacauaaauaacagacagaaaaugauuaaaaugacucacaauguuugcacauaaccuugcacuucucucucauuauuucaugauccaauggagaugcugcgaagacccaaccuccacucucccugcccaucaccccuggagagccagccuccaucuccugcaggucuagucacagcccccuucacaguaauggauacaucuauuucaauugguaccuacagaagccaggccagccuccuuggcucccaaucuauuuaguuuccaaucacgacccuggagucccagacaaguucaguggcagugggucggggacagauuucaugcuaaaaucaggaggauggaugcugaggauguugggguuuauugcugccagcaaaguacacauuauccuccc

SEQ ID NO: 14682 - RNA, 289 nt, Homo sapiens
gggaggguaauuguaaucuuguagacaguaauaaguugcaaaaucuucaggcugcaggcugcugauggugagagugaaaucugugccagauccacugccgcugaaccuugaugggaccccacuuuguaaacuggaugcagcauagaucaggagcuuaggggcuuucccugguuucugcugauaccagccuaaaucauuucuaaugcccugacuugcccggcaagugauggugacucugucuccuacagaugcagacagggaggauggagacugggucaucuggauggca

SEQ ID NO: 14683 - RNA, 19445 nt, Homo sapiens
gauggaagcugcacauuuuuucgaagggaccgagaagcugcuggagguuugguucucccggcagcagcccgacgcaaaccaaggaucuggggaucuucgcacuaucccaagguggguccccggggcgcucgcugacauccgggccugggggcugucgccgccgccgaggcaccagccacggguggagcccgaguucccucagcuuucaguugggggcaagucugcggccuggggucgcuucggcggccuuggaaggugcgcgguuugggggagagcggccauguccacgcgggccggagccggcuucucccgccgugguugccgcgccuggcauugcccugggggaggggaggaggccggcgcggccgcgugcucagguaacgucccgcgcugggcggcgggcggcgcggcccggggugguuuugcggcccgcgccucccgacauuucccuccguaguaguuggcggcaggggccccaggugggggucgggggcgccugcgcggguugccuccggcagguguggcucggcgggcuuagucaggcgcuaauucgggcgugccggcuucggggaauggagggcgggagcggcgcuuguucuugccucgggcgcggauaggaggggcccucccggccuugucugaggggcuggcgaagaggccucccacccgcggcggccgcgggcagcauguggcguucgggcggcggggauugggcgggagcaguuaugucgcaguggcggggccccaccgcuccccuaacaugcucugcgccagagccuuuucggggcggcugggcagacggcgcaguccccggggccgcccucgacacggccgcugaggccgcugggggcugcuccccaaucucuugaccuuggguuguguaaccugcuacggagccggcggagcggggcgggagaggugcggguggagggaggcccgccugccccaggacauaaugccucuaaugccuuaagcuugagcaaaggaaucuggggcccacucccacugcgggccgucacgcgagagauacuugggcugaccgcgccgaagaggcguuuuaguugguauugcuguggaaauccaugcuuauauaaaagcccagagaucccguggaugcuuaggccuuguuccuggcggcggucgcaccgguggccaccaauggccuuccuaggcccugccaccggaucccuggcuccucugcgcacgagugcggcuaggguggcggugcagcggaguaacuggcguggccagcuucauugagaggcggcgaccaaugggcuccugggccgcacucagagccuggccccaggguguggaccaaugggcguuuuaggaguguuagcuguucuuggagcugucccuugacaaaaagcaacuggaaaagggaauccaggcagacacgugcuaccgagacuuuaaggcacgacgggaaacccgguuucuagcaguguaucuugaacgauuccauuguagaaaaaaauacuagucauagcuaaaaugucacacgucucauuuuuuucaagcuucgugugacacuuaaaaugucuauagcgcuuacuacgugccaggcucacgugagauuauaggaagcggacuuuggucauggagaagcuuaguauuuccuucauuucacagaugagaaagaugguauuugugauagacguuugguaaaacgauugugaucaggauaauuaaccuagaaaaucuuggcaagaaccuagaaaaucuuggguaagaacaguccuagaaaacgaauaacagaaguugucacuuuggcuuuuuaaauguuugagcccuuaaauaauaguaaguacauguucuuaauaaagggaagaagauuuuguucuccccaaguucuuggcgguuuggcuguuuagagcuuccugagucaaaguggagagaggaggaagaggcuuuuuacaaagcagccugcuuucuuuaaauguuuaagaacccuuuuuacuuuguacuuuaaucagcccaaauuguuuuacugcuccaguguggcuuuuaaaaucauggccaaaguuaaacuuugaaggacaaaauauucccuuguguagaugauuuagugccauccauuuuguggacauguaacauucauugaacaacuauugguaguacacugccacauuguaacuguuguagauaaagcaaguuaagcaagaacugaaaaauauguugauuuaacuaaggucccgugauaaccuucguuggaacauuuuucagugaccacucaagugguuagguuauuuaccaggauguuuaaaaaagccugaaauaguagguguuccuugaaucaccuaaaaucaacagccuagcaaagagaguaucauggacggaguccggucgguggggacauggggccagccccagagaccccagggaaggauaaucggucaucuagaagaauaaagcgugacauguuuuacucaaaugacgugauuaagugcauagccucuggaauaacaagauuugaauucaaacagcauuuaauagcugugugagcuguuuccucaucuguaaaauggagacaauaaugguacauagcucauggaaguugugaagaauaaauaaguuaauauguuauauguaguacguaaacuguuaucuuuaacacuuuaaagacaggaucccucuauagcccaggcuggagugcaguggcaggaucauggcucacugcagccuugaccuccugggcucuauuaagaugugaauaaacuaaaaguagguuaaaagaugaacagauggaauuaaacaaaucuguuuauaaagcauaauaaacauagggacauaaaaacgauuaagagaaugaaaggcuuaaauguccaaagagagcauuaguauugaugcuaaagacaaggauaacaagauaaggauaugagggagaaaaaaauccuggaaaaauagcuuuccaaaacuaaugcaagaagaaauggagaacccaaaacaguccuagaacaccuaaauaacuugaaucagucaaucaucuaggcccagaugauuucacuggaguguucuguauaauucaagggagaaaauauccaacuuuuuucacgcauucuucugggaaacaacauacuucccucgguuuucucaucccaaagucugaaauauuuuuuucuccuacacgauauuuaccuuucauauuuagaucugcaauccaucuggaauugauuuuguguguggugugagggaauacacuuuaaacaaacuuggcucaucaguccaagcuuuaaugcuuggaaucuuuucugaauguacaccuuuuuacuaaacacugcuucccucuuguagaccauuuaagauauuuuaucuuaagugaacaaauuauguaauacugagaaauuuaacaaagaaaaaucuuuuaugauauagcuuggguuaaacaauacuguuggagaaaagcagcaguccagguauauccagaugaauaaaggacaauuaagggagaggcgguuucuuagggguaaccugcaguuuucucugauuuuucagauuuuacggauguugaauaaaaaucagugaccauuuaaaaaaugguuuaguuguuggaucaaagugcuguaacaaacaaaagcuuuuuauaagacauggcagcuuuagggagggugagaguaguaagaaggaaaucuguuagaaaauagaaaauuuugcugagaaaagaaugauuuuucaggacuggaaauccuauuacugugcuuuacucagauuuuauaaacuaaaacauaauuuuuaguaaaggauuggggcaguuguaaagauagucauaccucagcuuaacuuuccccaaacucaugacuuauuugacuacaucauuaugcagcauuauugcaauaucaauaauuuacauugaaggaauuuacaacccguugccaaaaaaccuuuuaguguaauguuucagaguagaaaugcuuccugcuaaagaauaaagcuucucguuacauuccucccagcaguuucaaaaagguuucauggcugggcuugguggcucaugucuaaucccagcacucugagagaccaaggaguuugagagcccagucugggcaacauagugaaauccugacucuacaaaaaaaauugaaaaauuaucugugcgugcugguccauccuggugcgugucugcaucccagccacucgggaagcugaggugggaggauuuuuuugagccauugggggaucgaggcugcagcgaaaugagauugcaccagugcgcuccaucugguggcagagugaaacccucucaacaacaacgaaaauauuucaacuguuguuuacaaaccauguaucuuuaagaagcacauguugaaaguagcagaaaacugagaggaguaucccgauuugggguaaaaauuugagauagagaaacaauaaugugaugauaauagguucauaucuuugaacaaaagggaggaggcuuauuucucagguuaucugaauucacugccgcaggaaggcacccucagaaucuaacuucuggucagucuagcuuuacucaagaaugaucugguuuuaggaugccuuuuaccuaaagacugcuuacuaccugggguagaggcacccugaugaauguacuguaaugagagccucuaaaacagaccuaaaaauaugagguaagagcagaauugagaagcugcagugacuuuggauaaauuaccugaacucugaaaccagcugguuuuacauuaggaaguaaugaguaaucuaaugaccuggaagcuuuucaaauaaaaauuugcaggcaucauccucagaaagugucugaccuaacuggguaugggaauagcaucuauguauugaguuuucaggugauuagagcauaacccugcacuaaugggauccuucuguauuuaaguucuuggucuuuuuuuuuuuuggacagucucagucacccagguucgagugcaguggugccaucucagcucacugcaaccuccgccucccagguucaaaugauucuccugccucagccucccuaauaguggguacuacagguaugcaccacgaugccuggcuaauuuuuguauuuuuaguaaaagacaggguuucgccauguuggcuaggcuggucuugaacuccugacuucaagugauugagccaucgccccuggucccuuuguccauuuuuuaaucacuuuuuguugaguuguguguaggugugucuuuugcuuuggauauugaccccuuaugaggugacuugcaaguauuuuauucuguagguugucuuuucacucguuucuuuugauguauagaaauguuuacauuuuagguuuucaaguuccauuugucuguuuuugauuuuauuguaugucauauccaagaaaucauugccaaauguaaugcccugaagcauuuacccuauguauucuucuaggaguuuuauucgcuguuaauguuuagguuguugauccauuuugaguuaauuuuuguuuaugauguaagguaaaaguccaacuuaauuuuguuugcauguggacauccauuuuuucccagcacuauuuguggaagcgauguuuuucccuguuauguaggcuugggacucuuguucaagauaguugagcucagucauuuacuucuuuuuuugagacacgcuugucuugcucugucucccaggcugaagugcaguggugugauuuuuggugcacuguagccuccgccuccuggguucaagugauucuccugccucagccucacgaguagcugggacuacaagccugcgccaccacaccuggcuaauuuugguauuuuuacuagaggcggguuucgcuauguuggucaggcuggucuugaacuccugaccucaagugauccgccugccucgggcucccaaaaugcauuuaaucaggcgacauagagaagucuuguuauaauauaauuaucuugucccuguagacauuucuaaauucuauuuuuauuagaccucagccucuaagaaaauguuuuaaauauaaaauguggcaugccacuaaaguguuguuuuucagacauacaauuugugugcuguuauuaauauagaacaucuauuuuucuuugggaucauuuaucaugaucucugauuauauuuaauauuuuaguaucuagucuuuaagugaaauuaggguaucucaaccucagcauucuugacauuuugauucagauaauucacuguugucaaugacuauccuguuaauuauaccguguguagcagugucccuggccucuauccacugcaugcuggcaacaccaccaccaccccaguugugauaaaaaaugucuccaaauguugccacaugucuucuggguggcaaaauuacuacaaguugagaaccacugaguuagaucagagagguggcauuuaagaugagaaaaaggaauucaaaucaggaaauacucaaucuacauauuucuuuguguuuuauaaccaccuaagaauugugugcuucgggccaggcaugguggugcaugccuguaaucccaaaucccagcacuuugggaggccgaggcggguggauugcuugaggucaggaguucgagaccagccuggccagcauggugaaacaccuucucuacuaaaaauacaaaaaaaaaauuagccugacaugguggcagaugccuguaaucagucccaacuacucgggaggcuggggcaggagacuugcuugaaccugggaggcggaguuugcagugagcugauagcauaccacugcacuccagccuaggugacagaacaagacugcaucucaaaaaaaaaaaaaauugugugcuugaauagcuuuauaauaauuucuaaugacuagaucaguauuacgugagcuguaaugugaacaaaucccaaaaucaucuugcuaucuugcuucucuugauucugcuuuauauccaucaauuugauuuauugacucuuuaaauagcaaggauugccaaauagaucaguuuuauaaauaguuuauaauagacuagugcuucaaagucucaguuuguaguguacuugggagugaagcagagacaagaccacuaucacuacugagccugauaaaacauucuagcuuaauacuaucuuuucuauuuuugacacacagucucacucugucgcccaggcuggugugcaguggcacgaucuuggcucacugcaaccuaauuuuaaaaauggcucugucgacuguauaaagcacuuugucuuuuccaucauuaauuugaucagaaagcagaccacugaaaaccuuuccuccaaaacaagagucagcaaacuuucuguaaaggacuagggaguaaauuuuaaauuuugcaaggcagacagucuguugcaauuacucagcucugcccuuauagggagaaaauaaccauagucaauguauaaaugaauggguguggcuagguuccaguagagcuuuauuuacaaaagcaggccauuuuuucccacagaaaugugauagaaauaauuugugcugaaauuuucagcuguugcagaguuuuucaccucuuuuauguacauguauagcauuguauugacuacuuuuuucuuucgucuauuuugcccucugauuuauuuuucuugagcuuaguagcucugguaaaugccuuuaucaucacuagguugauagacaguuuaacuguuuguccuagguugcuuaaaguaauugcuuucuuuugauacuaugauugaaaaauucugauuaccggagcauuacuauuaguugaggaaagguuugaauggagaauuuuauuaacugaugaugagugaguauaagagcauuuugaagccaauggguuggcacgugccuauaauccuagcacuuugggaagcugagaugggaggaucucauuagcccaggaguuugagaccaaccugggcaacauagggagaccucaucucuacaaaacaauuaaaaauauauuaguaagguguagugauacaugcccuguggucccagcuacuugggaggcugaggugggaggaucucuuugagcaugggaggccaaggcugcagugagcugugauugugccauuguucuccagccugggugacagugagacuggcucagaaaacaaaagguuauuucucugccauuacagaagaagcaugcuacacugucuucucuuauuaaaaugcaauuaauaaacccuggacagaaugcauuguugagcagcuauccaaggacucugagaaguaaauuuuagcaggugaaauggagaagaaagccagaacuuuaaauuccacugaaccagcagugaauuuccuguuuuuuuuccccugugguaucuccucgcugauuucuccugggcuugccagaaacccagaacugaaaaguaggggcaggcaaaaauaguuccaagaaaggcucucuaguucuccucugcaaagaaagaaugagaggccccuuugaaucagaguggaagaaaucucuuuuuugcuuuuguuuuguucuauucugccccaauccucuuguaggccuuuagcagcuguggcaguuaggcagaugucuaaaacaacgagagaagggaaucauuuuuuguuuguuguuuguuuuugagacagagucuugcucuguagccagggcuggagugcagugacacgaucucggcucacugcaagcuccgccuuccggguucaugccauucucccgccgcagccacccaaguagcugggacuacaggugcccgccaccaugcccagcuaauuuuuuuuuuuuuuauuuuuaguagagacgggguuucaccuuguuagccaggauggucuugaucuccugaccuugugauccuccugccucccagagugcugggauuacaggcgugagccacugcgcccggccaaagcccuauuuuuauagguaguggaugaagaagaguccuuccccuauccccuaugugagucaggcauugucagagagauuauggaagguugaagaaaguaaaccuauaaaguuuuauaugaacacuccuuagccauuuugcauggaucugacccuaaacagcacaucagaggcuuugaaaacuagaauacacaauagacugccucuccagggccagccuggccauuggguggcaaauaaguggggcagaugcaaauaacauagcaaaggaguucauaacaaaccugacacuggaaccauaacacaaccuagaaacauugaguaaaaacuugaagccuaaaccaaaccagauugucugcugaaaguuuuuaaaaaucaagaccuagaaugauguaacaugucaaaauauccaggaugccauccuaaauuagucaacauacucaaaaccaggaaaaucuuaacaucucaaaggaaaagacagcagacaccaaccucaaggugacauggaccaagacuuuaaaguaucugugcuacaaguuguaagggugaauacuuuguuuuaagagagggucuugcucuguuacccuggcuggaguguagcggugugaucaugguucacugcacccuccaucuccugggcucaagcaaacuucccacaucagccuaccgaguagcugggacuacagaccugcaccaccacucccagcugccuuuuuucuuuuuaagagacuggcuauugcuauguugcccaggcuggucuugaacuucuggucucgugauccuuccuucuuggccucugaaccacagugccuggccacaacagccuuuaaaaaaagagaaaacaaaaauaagaaaggaaaagacuguuacacuguuuaguucagccauggaacguguuuaaaagucuuaauagaaauggugaauauaacugagaaagggagggugggauuuguuagugcguccaguggguaaaaaggaguaugugcaagaauaaguuauagugggaagucaguaggugaugacuuaagcagguagcauuauugauggaccugaauuagauaagcucuuuaaaaaucugaaauuguaauguuucuaauacuuaaaucauaguggauauuuuuauuuaccuucauauucaggaaugggagucuuaauaguagauaauuuuugcaaggauuuuguaaauuuaucuuagucaagugaagcaggauuucauucccacgaguaguuuguuuauuuuuuugagauggagauucacuuuugucgcccaggcuggaaugcaguggugcgaucucggcucacugcaaucuccaucucccgcauucagucuccugccucagccuccagaguagcugggauuauagacgcccaccacuacgcccagcuaauuuuuuguguuuuuaguagagaugggguuucaccauguuggccaggcuggucucaaacuccugaccucaggugauccaugcgccucggcugcccaaaguggugggauuacaggcaugagccauugugccuggccaaguuuuuguuguuuuuguuuuguuuguuuguuuuugagacggagucucccucuguugcccaggcugguaugcaguggcaagaucucagcucacugcaaccuccaccuucaggguucaagugauucuucugucucagccucccgaguagcugggauuacaggcgugugccaccacacaagccagggguaauuucaaggguugucacaguauauaucccacauauguauucuuuccauauaugaacaaauuguuagcacccuuuuuaaagaaccuuaaaacuuuuuaguagcucuuuuaaaaaaguugcuuagucauguuauagucuaauacaggaacucagcucuguaaucauuagcaagccuuucacauuaaagauuuuuggauggguauugguacgcagaugggucaguaacaguuucuuguagcaaaauggugagacaggcacaaaauucuaccaggcauguuugguguuguguuugcuuuuuaauacaaacgaauaaaaacauuuugcuguuggauuucgcucaaaaggucuuaucugguuaacaaaagauuugccggcugggcacgguggcucaugccuguaaucccagcacuuugggaggccgaggcaggcggaucaccugaggucaguaguaugagaccagccuggccaacauggugaaacccugucgccacuaaaaauacaaaaauuagccaggugugguggcacgugccuguaaucccagcugcuugggagguggagguugcagugagcagagaucaugccacuggacuccagccugggugacagagcaagacucagucucaaaaaaaaaaaaaaaaagauuugccauuuuuaugaguguagagcaauggccugucagauaucauaaggcuuaaaaauuuuucuucuuuuuuuaaagaccaggguauuacucuaucgcccagccuggucucaaacuccugagcuuaagccaucccaaucccaaagugcuaggauuacaggcgauucuccugccucagccucagccuccugaguagcugagauuauaagcaccugccaccacgcccggcuaauuuuuguauuuuuaguagaaacaggguuucaccauguuggucaggcuggucucaaacuccugaccucaagugauccaccgccuuggccucccaaagugcugggauuacaggcgugaaccaccacgccuggccuaaaaaauauuucuggcaaacagcugggcaugguggcacaugccugugguucuagcuaccugagagacuaaggcaagagaauugcuugagccugggaggucaaggccgaagugagcugugauugcaccacugcacuucaaccugggcgacagagugagacccugucucaaaaaauaauaucugucauguuaagcuguuccauggaauuacauugucuuuuuauaaugggcacacuaaugaaagaaugaacacuuuccuaauucuauucucaggcaaauuaagacuaguuucuucauguccauaugaccuucauugcuaugguugcuuguacugcacauuuccuguuaaacgggcuuucucauugcauuuggagagcugcguaguauucccaaaaucuucuagguaugcuuguaauuggcagucauuccaguuuuuugugagugcuauaagaguaacaucacucacugugucccgacagacaggcuuuuaaauuucuaugccaauuagauugguaaaauuaugcucuucuuuuuuuuuaaguguuucuuaagguuaaaaaucugcacauuuuauagacaaaguaucccauugaauuucuguaaucauugauuaguuaaugguuuaccuugguuuauggaccuuugaacauuuuuuugccuauuuuucuuuaaguaauuuguaaauacauaguauaaugaccaauuuuuguuucauauauagcauaauauaccuaucauuuaucugggugugucaauauagauuauuuugaaagaaacuaaaaguugguguacaauauuaauuaaaaauguggucuucaugagaaaaagugugagcuuuguaauuuuuaugaguagguggguacuauuguggauuaaucguaacuuuuuuguuaaaugauagaucugagugggacauacuuuugaaggaugugcaauguucaaucauaagugugacaaaaacugacaagcaggaagcuuauguacucagguaaguccuguaaaacaaguguuagguagcuaauuucaguccuaaucauaaugugaaacaguuaaguuccucucaguuguaguucuggggguuuuuuuguuuuguuuuguuuuuuugagacggaguuucagucacccaggcuggagugcaauggcgccaugucagcucacugcaaccuccgccuccuugguucaagcaauucuccggccuaagccuccugaggagcugggauuacaggcaccuuccaucaugcccggcuaauuuuuguauuuuuaguagagacgggguuucaccauguuggccaggcuggucuugaacuccugaccucaggugauccauccaccucggccucccaaagugcugggauuauacacgugagccaccgcgcccagccuuuuuuuuacauuauucuuaaaaauaugguauaaaaggaaacauuuaguguaacguggauguuucuaggacauagguuuugaagccucaccggacaguucaagguguuugccgucuuuuccucccaauugguaaagaaggaccucuuaauuagaaguucaggcaaagggaaaguuagcuucucuauacaaauacaguugucuaauugguauauaaaagcucaucaccuuuuuuguaguugcagaguuaauuuauuccauaaauacuuuuaaugcuuauaguauauauugugaugggccuugcugggggauacuggacuaaacagccccucccccccuuuuuuuuucugaggcggagucucagucuguccaggcuggagugcauuggcgcaaucuccucucacugcaaccucugccgcccagguucaagcgauuuucuugccucagccucccaaguagcugguauuacaggcgccugccacugugcccggcuaauuuuuguauuuuuaguagagacgggguuucaucaucuuggccaggcuggucuugaacuccugacguggugauccaccucggccgccuaaagugcugggauuacaggugugagccacugugccuggccucucucuuuuuuuuuuuuaaacuaaguuuauauuaugaauauacgaauguuuaucaaaaugcuuaccaugugccaagcccuggggauguuuuguauacuagaaaaggaaaagaauaauguguuacuugcuuccuugagauccuaauauuuaaaaguacuagccaaaauuguaaaugauaauuaaauugguugauugcacccucaguaguacauuaguauuguuauaauauugugacuuuuuucaacugcagugagaguagcauguuugucuccaagagacguuucauuuugaagacaugugguaccacccucuugcugaaagcacugguuccccuguugaagcuugcuagggauuacaguggguuugacucaauucaaguaaguaagcaaacauuuaaauauuuuucaggcauaaauguuagcguucuuauccuguaauaugcgaaguaaauaaauuuauauacuuacugccuuuguuacaaugcaugcaaacacgugguaagguguucauaccuuaggaagagaucugauucucaagaacagcagaaaauaggaagcagagaaugaguuaggaugaaauucaaaugggagaaagaaaugaagaagccagacacuuccaguaguuaauuucuuaacauggcuacuuauaauaauagagaaaugguaagaaaagaaggaaaagcaagaaaaaugucguuacugaaauuguccagucuuuauaaugaagaguuaggaugaagagcaacagucaguauugaguuaaauucuuauacuuuucaagaacuaagguguuuuuaccuaggguauaauuuucugauuagcaguuguuacauuuuauuuauuuuuuauuuuuuugagauggaguuucgcucuuguuucccaggcuggaaugcaauagcacgaucucagcucacugcaaucugcaccucccagguucaagugauucuccugccucagccucccaaguagcugggaucacaggugcccaccaccaugccuggcuaauuuuuuuuguauuuuuaguagagacgguguuucaccauguuggccaggcuggucucuuaacuccugaccucagguguuccacccaccucagucuccuaaagugcugggauugcaggcgugagccacugcacccggccugaauuuuaaucuuuaacuucauaaggaaaggauggauugucauuaguacucaauacaguuuuuguuguuaugaauugauccuuguaagaaaucuaaagcaaugugugcuuaaccgaugcuuaaaacuaauauguuauuccccccaaauuuuugcuuauaugacuauuaauaagcucaguuuagaaacuacuguucuagaaaggaauauacuugguguuaauaguuguuaugacccaucaucacuagacugggcuuuuuaaaaaaaagagagagagagagagauggggccucaguauguugcccaggcuggacuccugggccaagugauccuccugccuccuaauagcgagacuacaggcauaugcuaccaugccaagcuaaaauauuugaguuuugauuuugccgaguuuuugauauguggacaauaguugauuagcuucgaaaagugauagaauucuacaucuaaagucaucuuuuuuuuucuuucuuuucuuuuuuaauaaagagcuucuuuuauucucguaagaauuucaugaagccuucucaccaaggguacccacaccggaauuuccaggaagaaauagaguuucuuaaugcaauuuucccaaguaaguuuaaauaaaauauaaaccuguugucuucuuaaagauagaaagugcaaccucagagaucuuucuauaugagagcauacuuaugcauauauagcauucuacacacacuaauacuugcuuuucuuguggguuuuuugguuuguuuuagacaggggucucauucugucacccaugcuggugcaguggugugaucacagcucacugcagccucaacaucccaggcuuaagugauccucccaccuuagccucccaaguagcuggggcuacagauguuugccaccccaccuggcuaauuuuuuuuuaauuuuuaguaaagacaagguuuugccauauugcccaggccggucuugaacgccugggcucaagggauccaccugccuuggccucccaaagugcuaggauuacaagugugaguuacugcaccugguccauauuuacuuugacuuagauguuuugggaguacaguagugaucuuuauauagcuuguaauucaaaauaugcagaauuuauaaagaacauuaaaauaucagauaaaauauuuuuaguuaagauuaauagcuuauugcaaauuauguauacacauguaaaaauaauuguguaucauaaaucagugcuguuuaaaugauggaauuuuaaaauguagaauugaucaccugccaccucugauuuuucauacagcauagagagaguucaucuucaucuggccauucacucuacuuuaugucucacucagugguucuuuuugcguuuuuguuugagacaaguuucacuuugucucccaggcuggagagcaguggcaucauuauagcucacugcauugucaaacucuugaguucaagcacccagcuaauuuuuauuuuauuuuuaguagagauggaaucuugcuguguugcccaggcuggucuugaacuccugcccucuagcaguccuccagccucagugguucuuaacauacagaucauaauguccuuugacaauaugaagaaggauaugauucccuucagaaaaaugccuagugcucugcuccagcauuuuauauaauaauugaccuggcuuuuuaaaauugcacaguguaaauuaguguuucuugaaugaaauucguaaggguuucuuucauccauuuacuaagcuuuuauuuauagaggucagggaacaaagguuaucugauaacauccuuacuuccuagauaaggcugaaaaccuaagauaauuuaguaacuuugcacaaagucgcucauaagcaugaaaauugaacuuagcacaucuacuaauaugaaaccaaaccaggcuaaucagaguguuggguauuuacugcaaauacccgccaagucagucgauccugcuuaucugggaauuuaccuacuguuuccauuccuuucacugaugacauuucuuuuuucuugagauggcgucucgcuuugucacccaggcuggaguggaguggcgugaucuuggcucacugcaaccuccgccucccggguucaagcaguucuccugccucagccucccaaguagcugggauuauaggcaugugccaacacgcccagcuacuuuuuguauuuuuaguagcgaugggguuucaucauguuggccaggcucgaacucuugaccucaagcccaccucugccucccugccaaaaggggugggauuauagacaugagcuacuaugcccaguccacugauggaugacauuucuaauaaguggcaaauaguaucauucugcuuauuguggaaggguaguaacaaaccauccuauuaaauggauguguuauauuuauuuugcguucucuucccucaacagauggagcagcauauuguaugggacguaugaauucugacuguugguauguuuaaugcaauuuuguggauuuuuguuguccuauguaagauuuaaacugccaauugucauuuuuaggaacuauuuuuaauuuuuauuuagguacuuauauacucuggauuucccagagagucggguaaucagucagccagaucaaaccuuggaaauucugaugagugagcuugacccagcaguuauggaccaguucuacaugaaagaugguguuacugcaaaggaugucacucguguaagcauuuuuaguaauaauuguugcuggacucuucugcguggggacuaaauuuuauuuuucauucuguaacuuuuaaguucaggguaacaagugcuaguuuguuacauagguaaacuugugucauggggguuugucguacacaguauuucgucacccagguguuaagccuaguacccauuaguuauuuuuccugguccucucccuucucccacccugggacuaaauuuuggacucaauugaaguuuauuugucaaacccuuguuaaacucggucuuuuuccccccccaggagaguggaauucgugaccugauaccagguucugucauugaugccacaauguucaauccuuguggguauucgaugaauggaaugaaaucggaugugaguaguuauauauugcuucaauaauuauuuaaaugugaauagucuuuccauucuuaacacugugaacuuuuucucucagggaacuuauuggacuauucacaucacuccagaaccagaauuuucuuauguuagcuuugaaacaaacuuaagucagaccuccuaugaugaccugaucaggaaaguuguagaagucuucaagccaggaaaauuugugaccaccuuguuuguuaaucagguaauuuuauauuuuauuauuaaucagguuauuugauuuuuaaaaucuuaaaggaaaugagacagugaggccuaagauguauucugagauagcacauauaccagccacucagauauccagaaguaauauuguuugagguuacugguagcugagaagcuuuguuucauuagaccugugucaguccuuguuuucugucuagccaaacugauggguuccuccugucuugcuauugacaggccucuggugggaggaaccauaagaugcccuggccccuccagcacauaagaaggcagcuaaaauaacucagaugucuuaguuucauuaagauaaaagucugucacuuaacuguuuugguugaaaauacuucucuggauugcaaacacuaacgguuauuuaauuuuuucccccagaguucuaaaugucgcacagugcuugcuucgccccagaagauugaagguuuuaagcgucuugauugccagagugcuauguucaaugauuacaauuuuguuuuuaccaguuuugcuaagaagcagcaacaacagcagaguugauuaagaaaaaugaagaaaaaacgcaaaaagagaacacauguagaaggugguggaugcuuucuagaugucgaugcugggggcagugcuuuccauaaccaccacuguguaguugcagaaagcccuagauguaaugauaguguaaucauuuugaauuguaugcauuauuauaucaaggaguuagauaucuugcaugaaugcucucuucuguguuuagguauucucugccacucuugcugugaaauugaagugcauguagaaaaaaccuuuuacuauaugaaacuuuacaacacuugugaaagcaacucaauuugguuuaugcacaguguaauauuucuccaaguaucauccaaaauuccccacagacaaggcuuucguccucauuagguguuggccucagccuaacccucuaggacuguucuauuaaauugcugccagaauuuuacauccaguuaccuccacuuucuagaacauauucuuuacuaauguuauugaaaccaauuucuacuucauacugauguuuuuggaaacagcaauuaaaguuuuucuuccaugaguugaguccuuaagaaaaugauuccaguuacucauuuugcauauuugcuauuuuaacauuauuggacccugcauuuauaguccuuugauuucuucccucucccuggugucucccccaagaccccaaauaaagcaauacacuguuaacacuguggguuuauauacuaauucuauaccccagauggggaaugggggagauggucccugggcuuaauauucuuuaaagggcaugggaauuuagccucucuuuuauuguaaugugcucuuuuggaaaauaguugguuagcagggaagacccagaguuguagauugagauuaggguguacuggcugaacuguggaaaacauacaauucuguguuccucaguaaaugagauuagcg

SEQ ID NO: 14684 - RNA, 1261 nt, Homo sapiens
uacuacguggcggauucugacugugaagaggacugucccaagugaagagugggaggcaagugccuugugaccgggaggaggucgaccuuaaaggagcugguauuguagcucuucuaaagccuagucuacuuaggaaggcaaaagcgaagcagcaagaaguggccacagaagccguguggucccuagaaguagaaggguaaggaggaugcaggagaugguccuacuuguggccgcaacggggcucagaaguccgcuuguuagagauggcagugaccugugacaauccagucugcccgacacgccucccgccuccuuaggaacgggaaggagccccggcccagugcacugacguaguuagccuaagaucacguagcugguuggucacagaaucaugacuuuaauucaugucuucugacucugaccuggcacgcuuuguaccucaccaaagacagugaugaaauugcaaaagggcagaguggagaagacuggaauguucagccaaggcauuugaacuuuuaaugcugcaagucaagacuuccugaagauuuuugagcagaugagugaagugauaagaaaaugcaucuucagcagugacagcaucaacgaggaggagacuggccgggaggcuauuacccgcaucaaaaccagugaacauuaaaaaaaauuuuuuuuuuagagagagggucuugcucuuuugcccaggcuggagugcaguggcuugaccauaguucucuauaaccuugaauuccugcguucaagcgaucuuccuuccucagcuuccggaguagcugggacuacagaugcgugccaccaugccaggccaauuuuuaauuuuguuuuguaaagaugggguuucuguguugcccagguuggucucaaauuccuggccucaagccauccucccgccucagccucccaaagugcugcaauuuacgggcauuagccaccgcaccugguccaaaaccggugaagauuuguuaagguguuggcaauauggguauaccuagauuauccuucaucugcuaaaaacaugcucuaaucucuccccagcccaaaacaaacaagaaaccucucuuccccuuccagcuccuaccacgugucuuugcuccucuguauggcaaaacucaaguguucaaaauuccuuaucuucaauuccucuucucccauucccaaguacacuacagucaggcauucacaccaccaaaacugcucucgcugaggccaccagugcuguauucaaaggauaaucuuuguuuuauca

SEQ ID NO: 14685 - RNA, 70760 nt, Homo sapiens
gcggaaaguuugcucaaugggcgauguccgagauaggcugucacucagguggcagcggcagaggccgggcugagacguggccaggggaacacggcuggcuguccaggccgucggggcggcaguagggucccuagcacguccuugccuucuugggagcuccaagcggcgggagaggcaggcgucaguggcugcgccuccaugccugcgcgcggggcgggacgcugauggagcgcgccaucagcccggggcugcugguacgggcgcugcugcugcugcugcugcugcuggggcucgcggcaaggacgguggccgcggggcgcgcccguggccucccagcgccgacggcggaggcggcguucggccucggggcggccgcugcucccaccucagcgacgcgaguaccggcggcgggcgccguggcugcggccgaggugacuguggaggacgcugaggcgcugccggcagccgcgggagagcaggagccucgggguccggaaccagacgaugagacagaguugcgaccgcgcggcaggugaggggcugccgacccgggggaggcaacuuguuuacgcgcgcgagccgcggaggaugcgguguaggggggcggagauccgggacccgggcgggcgucuucccucggcugcggagggcagcuggcgaccuggggacgagcgcggggccacgacgcccucccaucccccggccagcgaccugccugggcucggcucccgagggccuggugcuggccgacgggucagagcagcauccucgcaggugcgggagaauggaauuccaggguugcaaagaaacgccacuuccccucuuucauuguuuucgggcauugauucucuuccaaggaaccuuucccucuuuuuccuuacgcacaucaccuccugucugugcuggcgugacagcuguuuugagaaaggacuuuagcaaaagacgucugcauuuucuuucaaacacaacucuguagugcccccggacaaggauugagaucagugucuaauugagaucugcggaacaccugcauccgaaucaccugggguugcuggugaaaucuacaguuuucuaggcccuaccccaguuuuacugaaugagacauucccuggguaagagccuggcaucugcguguuuaacaagcacgccggauaauucuugcacgcuaaaguuuaagagcuauagucagauucuugaauauugguucuugaaccuaagagccaugguuagguucuugaauaagggguuuacuguauaaacauuuaauauaggguuuucuuugaguuucucagcauucaaaaaauguuacuucaaggugauuguuuuaaagcacuuuucaaagucuagacacaauguaaggcauguuaacaguaaauuugggggacagccaaucuuaucacacccguggagaaagugaugucccauuuuauaaauggagugcuaaagggagcauuaaguaaauuaaacuagggaaggcugggcucuggauuggaacauauuuuagacuuauagucauuacuagaucguaacaaguuagauuuaauuuuaaauuaauauuagaacuuugaucuauauaucuggagacuacuauaaauaggauaaguacuaaaauucucuaggcaccauuugaauauauaaacauuuguaaauauauauauauaaaacaaaguuuucuuagguuugcuaaugagucaguuuuccuggaagaguguuuuuguuuaucauaaauuucugaagcuccugcucaaaaugaauuacaugaaguagaguugagacguuuucuuuuucuuagaauucaaauccacuucaacagguacuuacugguuaacaagagcccaaggaugcccuggguggcagagguuaggcagguaguuccugccuuccaggagagugugcagucuaacaguacggaugaaacgagaagaccuauaacaacauuacagacuagaaacagugccagugucagggaugucccaagguuuuugugguguucuacuaggugagguaugggagugaggguagguaagaagauaagagaagguuguggcagaaugaguugguuccugaaaaauggguaaaauuguaauggaaagucacuggacuugaggaaacagcaagaggcacagaggccggagauuauguuuggaaaacauuuugucucuguguaugucuguguguguguguguguguguguguguguguguguguguguguacguaagcgauauagacaugcacauauguaugcuaggcagggagaaguagaugaggauagaaaaaauagguuagagccgacuguauaugcauauagucugaugcuaauagcaucauugucacuugggaguauguuaaaacuccggaguggggcaccaccccacacucccugaaugagaguaucugcauuuuaacaagaucaccgugugauucacaugcacguuaaaguuugagaaauguuggguagaguauccugagugccaggcuugaucaaaauuacaccuaaggaauguuucucuagcaauaguguguacugaaaacuugaguuaagaauaccaaaaggagaguguuauagcaguucagaugagagguuuaguguaaagugguauaggacagaggggacagaguugagauauuugaugcaaaaucuagguuccuggcaagugaaugcauucuuccuuucuugguacccuuguccagagauugagacugcguggccagaaguugacaaaagagguuuaagggagcagggaagaaaagguaagggguuugguguuggacaugugacucggaggugcaggcaggacauccagagggagguaggcggguggaaaugagugacuagagccagugagaaggcagcauaaauaugaauaggugaagcugugggaaagggaaagcucaugagaaaaccucaggaaaugccuuuuauuuuagggaggaagaugagccagcaaaggagacagaaauacagcuggcuagguuggagguacaggaggaggacugggaagaaagauuuggcgaugagcacacuuaaagaguuuaaaugaagcagcagagacaauacucaaauugcaagagguuaaagauucaggcccuucugccccaaucccuccuuuccucacugaugagguaauuuuuaggagaaggaaccuccgaacuuacuuauguacugaaaagagggagccuguguagauagaaugaaaaugaaaggggcugggcgcauuggcucagccuguuaucccagcacuuugggaggccaaggcggguggaucaccugaggucaggaguuugagaccggccuggccaacaugaugaaaccccaucucuacuaaaaauacaaaaaauuagccaggcaugguggcgggugccuguaauccgagcuacucgggaggcugaggcaggagaaucacuugaaccugggaggcggagguugcagugagcugagaucgugacacugcacuccagccugggcaacaagagcgaaacuccgucucaaaaaaaaaaagaaaaggaaaaugaaaggaacaggugaugaggugaagguaguuagagaagauccacuuagcaaacaggaggaucauuucuuucucauaaauugcagugaaaacaggaauuuuggcuugaagagcauacaugaucaccaaacagaauugccuaggaagagauagagcccaguuuuggggucugccuuguaguguggacuuaagauaguguggaauguuugagaaaccuugaauaaguugauagucaacaggagauaaauacgcaguuuauaaaaguuuuuucuaaaugcucuuaaaaaaagauaaaaacccagagaauauuaauuaguucaguaauaauagaccgguaauucuguuuguuucaaggaguauuaggggaacagauuugaauuaaccaagcguuuacuaugaacagcugugaagaacugcaguacuggcaaaacuuuuaaaaaggaggagguguggaauuaucuuuauuuuugcauguugucuuuugauacucaagaagcaauccgagauucaccaguucauugauacuuuucucuugauggaauuuucaaguuucauucuaagugcuuacucugcauaucaagcaugugaaugagugaauaagcuauuuauuuucuuuaaaaguuagcuaaaauaaacuuguuuuucugguaccaaucucguuguccauguucuucugcuaaacauuacauuaguugauauuuaagugggauggucauugcagaaaguugggaagaaagucucaucaccucacuguuagauuuuacauauguuuauguaauuuugugaauuaccagucuucugacuucaacacaaauagcaaauugcaaaguguuacuugggguucuugggauggguugggaagacauucugacaaucucagaaguucuaaagaacuaguuuuaucuuaacuaucacuaauuugcaaaguacauguuccuuuuuccucuggcucuaauuccucucuaacaaaaguauuucuaaauuugacauuaaucucuggugcuucuucaauuugugcaucugcaaacugauuuuuuuauuaaaugagauaacaugaaaauauuugcaaauauaagaugauauaauuucucuuuuuuuccucugucguuuuacaaagugaucugaugugaaacaaagguacagaaaucuagucuuccucagacuuucagauuuauaaucauuuuuuuguuuguuuuuuuaacuacuaggacccuugaauaguagcauaucagaauaccauguugaaaggaagcucagucauauaguccuauuccuauucacucacccaacuccagacuuuuaaaguuaacuaacagucaccuuuaaggaagaauuuacacagaacuuucaaagcaaguaauaagccaaaauaaauauacuucaggcaaguaaugaacuauccuuugugucugcaauugucuuuagcuuaauugaugccaggacugugcuuagacuauguggacagggaugggagauugcuuuuuaucugaucucaggucccugcauucauaggcaucuuccagauugcagagaggaccugucuuuaucaguugcugugagcuguagcuucagcgugucucuuuacucccuaaacauugccugauaacuccauuugcuuuucuccuuuuuuguaagaggggaacuucuuauacauuuuuauuacaaauuguuuuaaaauacaaaggagaaaacuuguaaguugcagagcuaaaugugaggggaggagauaaauuuguguguuuaauuccauucuauuuguaaaugaccauuuugauuaaaagucuuucauagggccgggcgugguggcucacgccuguaaucacagcacuuugggaggccaaggcaggcggaucaccugaggucaggaguucaagaccagccuggccaacauugugaaacccugucucuacuaaaaauacaaaaauuagccaggcaugguggcacacgucuguagucccagcuacucaggaggcugaggcaggauaaucaauugaacccgggaugcagaguuugcugugaaccaagaucaugccacugcacuccagccugggugacagagugagacucugccucaaaaaaaaaaaaaaaaaauuauagaauaaaguagaaaagguacuuucaaaaauguuuuaauguaacaggaaaaggauaucuguuacgcuuauguuaaaccuguaccacugaaaacuuagauuguaugucuuuaaggucuagcugauaugccaaaguuauaaaguauaguugguaauuuuugauauauuuguuaugauuuggggcauggcuagucuugucauauguuuaaguaaaggagguuugacuugaagauuuacuuaguaggugaggaccaggaaguauagucuaaucaguacuacuuuguuucuaaacaagaacauaugccuccuuuagugagggcacaaguuugggcaaaggauucucagcuacgccaaaaaaacagguucaaccaaaucacauuuauaguuuugugaaauaacgcccucuccccaacccccagaaaggauauuugaaauuuuaaaauaagcaguuguuaauguagaaacuauuuaauccauacaauguucuccuaucaccugcuugucuucuuucacaucggaaacuuccacaggaaauaaaaguuccuuuaaaaugauuuuaugaagaaauuuagcauacacuuaucagaauuugauaaacuuaacuguaaauaggcagguguucuggguaacuuaagucagcacaguuuuucuuuuuuuauugcguauucauuguggcauaaagucauuucuccuggauugaggacauaaucagagcaauuacaggaugaacgacaucuaugagauuucugagaggaauaaaaagcugcacguuuuaguaauauaguaguugccacuuaugcaaacuuacaguuaacagaauaaugaguuaaaaaccugaauuucugcuccuguucaaaauuuuguauuuggugcauaaccuuagguaaaucacaucuuuucccaucuucucagccuuuuugguggugauuguuuuguguagauaauauguuuguccuaccaagguuuauucauucaacaaacauuuauuuaguuuuacuggggcccagguacugcuaggcccugagaguagauaaaugucuuuuccguaggaagcuccaagccugacagaucauuguguuaaagaauuaacuauccucgaauggauaauaagugacauaaaaguagugugagugaaaagaauggaaguggcaaguuauugagucccggaaugagaaaaauaucaaggacaguguaggcaacagaauagugugagcaagggcacagagcagggaguuuguacagugagcacagagcagugguuccuaagccagggcuccaggaccccuacagaucugcaaagauaaaaauggggauccaugagacugccaguauuuuaaaauaaccuaauggaaauuaaauauuuaauagaagguacauuaaaaagugaaguuccuuugcuuugaacuagaauuauauaaaaccuuauauaguaauuacaguucuuucaagaaauguugaauauuuugauugguucuuaaguauuuccucuaaagaugggagaauuuauuauacacaguguucauuuggcagguggaauaauuuaagacauggaggaaaauauagacaagagaacuuuugaaaaguucaccccauggaaaggggggaguguggagcugggaaggagaggggagagaggguugggcugguacaagaggcagaaaaaugagauuaggaaaguacaccgaaaccaaauugugaaaggcuuuaugugccacaccaagcagugugaccuuucuuuuucagugggcacagggaaccuuggaaguuuaucagaucucuauuacagaaacaaaacugugggaagaagagaggggaaagaaaccugaggcaggaaaauguguuagaaagcauuuuaagguguucugaugagaaaugagaaucuucuagagcaagagcugugguaaugaagaaggcaaagauuuuuuuuuuuuuuuuuuuugagacggagucucgcucugucgugcaggcuggagugcaguggugcaaucuuagcuuacugcaaccuccgccucccagguucaagugauucuccugucucagccucucccaauuagcugggauuacaggugcaugccaucacacccggcuuacuuuuguauuuuuaguagagauaggguuucaccauguuggccggguuggucuugaacuccugaucucaggugauccauccgccuuggccucccaaagugcugggauuacaggggugagucaccgugcccagccagaaaagauuuaagagaagcuucagaaauagaauuaagaguacauggcuguuguuuaaauguagaggaugagggagcacaaagaguugaugucugauuuaaauguuagguaauaggauggauggcuacccuuuuaaguggcaggaauagauugugggaaagaaguuuccugagccuguuauggugauaacaaguagauccugcugaagaugcagaacuaggauaggggagagauggugaacuauaaauccuguacagguuugggggcugucauacuauagauggaggugaagcuguagacauugaccaucuagguagaacauguaguacaaacaggaaaaugccugcucuauagauagaaaacuauaaggaugauaggugaggccgggcacgguggcucacgccuauaaucccagcacuuuaggaggcugaagcgggcagaucaccugaggucaggagcucgagaccagccuggccaacauggugaacccccaccucuacuaaaaaauacaaaaauuagcugggcaugguggugggcaccuguaaucccagcuacuugggaggcugaggcaggagaaucgcuugaaccugggaggcggagguugccauugagcagagaucguaccauugggcgacagagcaagacuccguccccccaaaaaaaaaaaaaaagaaugauagaugaggacccaggagggacugguccuguagaaaccaggaaagaaaaauguccagaaugaggagcuggccacaacgguggcuuuugugaagacaggccugaugaggggagugaaucuggcaguuaggaaaccauugaaaaucuuucuugagaguggcuuccaaggauuggaucaugggugagaguucagggcuugcugaggaaucauccaaauaaaugcuuuuguaagcuacagcaaaauguaagugagagacagaagucuccaaaguauuuacugacagagauguucaauaugccuucuucauccacaucauaaauuuaauuuuucucuauggaaaugacuaagguaaaacaguguuugcacaacuggucuuaugagacucaccuggggugcuuguuaggcuacauucucccagucucccucuuaggaugagacgugggaaccuuuaaugguuuuuaacaagcacuccagauuauuuuuaugaucagguacacuuggguuacacugagauaggugaaauaaccauauuuugccuaugaaaaaauaacucgaaugaagccaugaggagaaugagaggagagccuuggggauguacacccaggucugacuuaggcuuugguucuuuccacuggaaaagcugucucugcaguuccuucaauucuugaauaaguuaagaguuuuucaucuugaucuuggaacccucaaaauagggcaaguggucuuggggagauaaauaaccuuauauucuuccuguuuugggagguguucauuuuucacuuuuuaucucuguuuauguuucuucuucuuucuggagacagcauuucacucuaacacuuaggcuggacugcaguggugcaauaacaguucacugcagccacgaccuccugggcacaagcaauccucccaccucagccucugaguagcugggacuacaggcaucugccaccauacccggcuaauuuuuaaaguauuuuuguacauuuggagucucaguauguugcauaggcuggucugaaacuccuggcccuccaagcaguucuccugcgucagucucccugaguguuggguuuacaaaggaaagccacugcaccuggcuguguuuguucuaaaugccauaccuuuuuuaaguucaacuuuuauuucagauacaggaaguacaugugcugauuuguuacauaguauauuacacccagguagugagcauaguacccaaugguaguuuuucuuuuuuuuuuuugagauggagucucgcuguguugccaggcuggagugcaguggcgugaucuuggcucacugcaaccucugccuccuggguucaagcgauuccccugccuuagccuccugaguaggugggacuacaggcaugcaccaccacgcccggcuaauuuuuuuuuauauuuuaguagagaugggguuucaccacguuggccaggauggucuugaucuccugaccucgugagccaccgcaccuggccccaaugguaguuuuucaacucacccccggccaguacucugcagugucuauugcucccauguuuauguccaugugugcucaauauuuagcuuccacuuauaagugagaacaugcaguauuugauuuucuguuccuguguuaauucgcuuaggauuguggcuuccagcucccuccauguugcugcaaaggacaugauuucaucuuuuuauggcugcauaguauucuaugguauauauguaccacauuuucuuuauccaguuuacugcugaugggcacuagacugauuccgugucuuugcucuugugaauagugcacuaaaugcuguaucucauugcuauccucuggucaucccugcauucagccugaggacuuuguuuuuuagcauuaucugucuacuugauguuuuucuugaucuacauuaugccaaugagcaccucuuucuuagacugugauuagguauaguagcaaaucuuuauugcuccgguggugcuucuuaauuccaaccacagcagaaggggugccuccauuccagagacaugcuucuggggaggagcccauaaugaauacuacagcuggcuuguaaugcaagagagucuuggucaacuugcggcuuuacuuugaauuuauauacauugugcaucaagugauauagaagagauaaaguugcaucuuguauuccugaccaggaauauaacuauacaugcuuacagugugcauggucuuuaaagcugauaaauacacauaaugaauucauagaacaacuguacaagucauccuuuaaacaacuauuuaggccgggcaggugggaucacaccuguaaucccagcacuuugggaggcugaggugggcggaucaccucaggucaggaguucaagaccagccuggccaacauggugaaaccccgucucuacuaaaaauauaaaaauuagccgggugugauggcgggcaccuguaaucccagcuacuugggaggcugaggcuggagacuugcuuaaacccaggaggcggagguugcagugagccgagauugcgccauugcacuccagccugggcgacaagagcgcaacucugucucaaaaaauaaauaaauaaaaacaaauaaauaauuuauggagagucugcucuguagcuggagguguauguuccaggcagaaggaacgguagaugcaaaggcccuaagcaaaaauuuugcaugauguauuugaagaguugagggggucugucuauggauaugcaaacucugaaaagccuguuagacagucuaaaucagguaggugguuagguauguaugucugcaguucaggggagaggccugaaaccagauauaaauuugggaguugccaggauauagaugguauuuaaagcuaugagacuggaugagaucaccaaaaaaauuacauguagguagagacuauuuuaagagauaggaaagauaagaaggaaccagaaaaugaaacugagacagaauagcauagaacugaguccaaaaaaaaaagagcguggugaccuggaagccauauagaguguguuucauggagggcagaaauggcuggucaggugcugcuggguggucaagugaagcaagaccugaccacgggauuuaucagugugaaggucauucuugacucugacaagaaccauuuuagugaggugguaggggcgagaacuugauuagaaauaguucaacauagaaggagaggaagagauuaggagacaguauauaacaacucuuucaaggaguuuuguugcagaggggcaagaaguagauuggaugcuugaggaggagaaggauucauuuuguuugaucugguuugguuuuuaaguuggggaaaauaguagcagguuugaaugcugcuauaacaaaauacuguagacugggugguuuauagacaacagaccuuuauuucucauaguucuagaggcugggaaguucaagaucaagguacuggcagauucaguaucuggugaagacugauucuucacagaagcacuccuacaugguggaaggggcaagggcaucucuggggcugcuuuuauaaaggcauuaauaucauaagugaggaccccaccuucaugaacuaaucaccuccuaaagccccaccuccugguaugaucaccuuggggauuagguuucaacuuaugaauuuuuugguggggacacaaaaguucaguuuauagcaaaugcugaugggaauauucuaguagggaaugacugauggugugggagugacaggagacauuugcaggagcaagaccucacgaaugcguaagggggagcucuguugcuuaaguggagguguuggcgguagaugggaguguggacaguucacuugcacuaacaggagggaagguggaacccaugguccagguacuguugcauagauagaggugguagggggaaacaagcugauuucuccuguuuuucccuaugaaauaggaagcacagucaccaagaugugugagcuugaaagagcuggcaucagaaguuugaggaacagggagacaugaaugguuaacaugguucaguggcauaauggauagacuagggaaggguguuaugauuguugagcauuguuaguagccuuuuugagguugguggucguuaauuaaagugaggauagucaacaugguauguuucucuucagauacguucaacugcacagauguaggagugagaaaggggagaagauugacuuuaaccaguucuuccagagugugacaugugagaggcaggguagggaguugaggugugugcaaaguagugcuuaagaugaaggacugugggauuuuaacugguuaagaaagaagugagggcauggugguagugaagguuguaguaucaguggcuuguagguucucauagggucagaaguuucuuggagucagggaaguagaggaagugagcugaaaagagagggguuggugguuaggggguugcggugauuuguaaugacaaggucuagagucugaccacaggagcagcugaagcaagguagauagauauugaaaacccaaagaauugaggcagaaguauguuaaauauguuagguggugacaguaaaccagcagcugaaauccuccaggauggggcuaguuaccuaagggucaauuagaugucuacuaggagggguaagggacaaaacagucugauccugaggauuuucagagaggagaggaaaaaaguggucuggaaauggcaaugagauacauggaguccacuuaccccauucugagcaaggguuaugggagaaaaaaauuaucugugcuucuguagggaagcgauauccucagggaaagcccgguuucuaugagagcaaaaagauaagugaacgaucagggaagacaguguuucaggggaaaggcuuucaggagguauguagguagaagaggacauaccaggggacauuguguuccuuaugggaauuagaguguggaaugaagggugaccuaugagucaggggcuuuucauaaguuacauaaacagauaaagggcauauugaaauugucuugguccaaagacagugguggcaagagugguagaaggcccccucuuccuuucuacgaauagaggccuggacaugggcugguuuucuuuugagcaugugggauaagugcccaauaucuuagauaucuguuaauuuuaaaaauauuuuuaauauuuacaggucauuaguaauuaucagcacuuuagaugggagaauugcugccuuggauccugaaaaucaugguaaaaagcagugggauuuggaugugggauccgguuccuuggugucauccagccuuagcaaaccagagguaagaauuuucuguuaacuguugacuagaaaacuuaauucuaaugaguaauugcugauauuaagaaguuuggggcccuauugcccagguuugaggccugucugccucuuacaguuugugucccuuuagggcaauuacuuaacuuuucuauuccucaguuccccucuugugaaaugagauggauaauaacaucuucuuaggauuacuuggggcauuaagugaguuaauccuauaagugagcagcugaggauacuaucugccauaucagcaaagcacauuaucugagcuauaaaugauuguuuauuaucaucacaagaucucuaggaauaauaagauaaauauaaauaaaaacuuuauugaauuuuacuaguuagaaaucugugcugcaaaaucccauaaauuauuauucccuaauuauaagcagaauucaucugaaauuuuuuuguaauguaauuccagguaaauuugauuauuugcagaaaaaguguacuuaauaauuuggagcucuagaauaguagaggggaaagagcauagauucaaagagaccucgcuuccaaaauuacucugucacaugacuucaagccccucagagcuuuaguuguucucaucaauaaagugaggacacagccugcccgcaugggguacagaugggggagauuaaauaagagaagcugauuuuccucaccuuuaguuucaauucugauggauuaagucucucugcuuuucuggagcuuuagucuguuguuuaaauuacuuaaaaauaaguccaucuuuugaguggugacuacuaacauugaagcagucaccucuguuuuccagaaugccuguggccuucuuuuauaucgaguuguucuuguaggacacucccuaggguagucuuuuuucucuuuugucaucagucuuuuucuuuaaaaagcuuccuagcugauauuaaguauggaaaagacaaaaucguacaugagggguuugagaaugaccugaauauuggugaccaaacuuuccaaugggaaacugcuaccagugacgcaucuauaauaacagacuuuccugugcuuuccaguaaacccagcccaaaucuuuucuggugcacccaaacugauauuuaaggaaacaacacugccaaauuuccacauuugcugugugcugaacccugaguagacuuuauaaguggcuacuguuucucaguauacugaaaauauauuuugagaauagagaacuucuauuguauuaugaauuauuaauacaaauagcaauuugauuguaaauuacauuaaguuuauaauugaguaugguauucaagugaauuacuacuuaagauaaacuuguuuauuuuucuucugcugggauuaugcuuggguaugcauguuuuacuuuauuuuuaaacuagacauaagagaugaucagcaaaaugagaagauuguaagcugcuuacaucugagguaauaucacaguguguuguaguaguucaaagcauguguguguuugcaaacugaaauauauauagguacaaaaagauaaguugcaugguauggcaaaguagaaugcaaauaguuguaauaaccugagugcuaguaaguguguuugaguuauaagcagcuaguuguauuugaagguuuucuuacacauagccguuauauuagcuguuuuuaaaacuacaguucaacauucuuacugucuuuaguucgcaccauuuucugugguuuauuagggcucccuuguuuucaguguccucucucacacccacccacccccaauccuagaucuuuuggauaaaauuuuugcuuugaaauguugaaucguaggccgggcguggugacucaugccuguaaucccagcacuuugggaggcugaggcgggcggaucacaaggucaggaguuugagaccagccuggccaacauaguaaaaccccgucuaaauacaaaaaauuagcaaggugugguggcaggccccuguaauccuagcuacuugggaggcugaggcaggaaaaucacuugaaccugggaggcggagguugcagcgagccaagaucgugccacugugcaccagcccaggcgacagugcaagacucccaucucaaacaacaacaacagcaaaagaaauguugaaucgaaagccuuuucagaaagcucacuggucgcuuuucaugcaggaaaagaauccugauaccucuuugcauuaucuagauuuucauuuucuacuucauagaaaaaaaaaaagaaaaucugaagguauugaaacagcugcgauaacaugauagauuaacuagauuuuacugcugccccaaauucuugggaccauuucuugagaguggauguuuaauauguagagauacugaugauauaacguuguucccagcauuguaacauauacucgaugcugcuuacacaguguaauccucauaguaacccuucugagguugauaaguuggucccauuuuguaaagaggaaauugcagcucaaauaaauuugcuugagguugcugaccggcuauauauauggaugaaguuggaacugagcccgagauugccugacuguacuccauucugccugcucugaagcccuuuugccaccuuguauauaccucccuuucuuuacaagcucaggcucuucauagacuacagugguucugagacuguuuggugucaggaccuguuuauacucuaaaaaauuauugagggcucuaaagagcuuuuuaucaggcuggagugcaauggugugaucauaucucucugcagccuugaauccugggcucaagcaauccuccugccucagccuccugaguagcugggacuacagacaugcaccaccaugcccagcuaacuuuuuuuuuuguggagacagagucucgauauugccuaggcuggucucgaaccccugggcucaagugaucuucccaccuuggccucucaaagugcugggauuacaggcauaagccaccacgaccagccuaaaacaaauguuuaaaaaacauguauuuuauuaaagaaauaacaauaaacccacuccacaauaacguaacauuuuuaugaauaauaacuauauucuuuaauacaaaaaauuuaaugagaaaaguagcauuuuacauuuuugcaagucucuuaaauuuuugguuuaauagaaaacaguuguauccgcgucugccuuaaauauauugcauuguuguuuugauuuaacuacguaaagaagaaaauccagccacauacaaauguaguuggaaaagggaggaauauucuaguagccuuuucaaauaauugaggccauucuuuuuuaauaaucugccaaaacaaguggaaguuuuuuaaagguuaguugcaguguggaaucagaaaccauaucaaugaacauuuuauacucugaacacuaacauccauuggucugucuugccuuuuacucaugcaugauuuuauaacuuagaaaauacugacugaguuacauagaucuuuuaaauguuggcauauuuccuuauagaauauuuuuuaaaaaaacaaauuuguugcuguuaccacugaucucaucagaaaagucuguaaguacugggaagcugugaagcgcaaauuggcagauccaaguuguuuuguuuuguuuuguuuuuugucuuuuagagacagggucucacucuguugcccaggcuggagugcaguggcgugaucauagcucacaguagccuccaacuccugggcucaagcaguccuuccaccucagccuccuaaguggcuaagacuauaggcgcuugccaccaagcucagcuaccuuuuuuuuuuuuuuuuuuuuuuuuuuguagagauggaguuuucuuauuuugcccaggcugaucucgaacugcugggcucaagcuauccuccugccucagccucccaaagugcuggaauuacaggcaugagccaccaugccuggcccaaguuuuccaguauucuagaauucacuuaaaaacauaaauuuuaucacaaauaccgucagauguguucuuugaaguaaaaaguucacuuuguucauuuuuuagaaaaugucuaccaaauacccaguugacuuuugaguaaaauuggagcucaaugaacaaagcugcuaguucagcucacaacucaguucuagaagugcuuuuccucaagacaugcuuuagcauguggagaaaggcuuguuacauacuuccuaauuagucaugcagaauaauaaaaagauguguuacucagggucaagauuuaaugaaaucagucauuuuuauugcuucaucaagaacauuuguaaguggaacugucucuguuuuuuuccuuuaguucagguguaugacagugaagaauaccauuguauucuuaguuugguuccugaauugugccaaggcaccggcaguuuuagucagcauugcuuuuauaccuucagggcaaauagcaaccuuugugaaaaggcaaaucacaccuuguuugaaaacugugugcuauuuugcaccccugaaagaauccacgaaccauacuuugaaaauuacuuaauugguauaugauagaaauauaagaauauuugugaaauuauaaacauauuagcaaggagagaagacuguauugugagcaugagucaucuguuauucagcaaggugugugcugcucagcaucuagaaguuauguucaaaaguugaacauuuguccaguucagauuuagaaaaaaaaaaaguuggacaaaacaccacaaaaggaucaucaaggccgggcgcgguggcucacaccuguaaucccagcacuuugggaagccaaggcagguggauugcuugaagucaagaguucuagaccagccugggcaacauggcaaaaccccaucucuacaaaaaauacaaaauacaaaaaaaaaaaaaaaauacaaaaauuagccagguguggugacaugcaccuguaguuccagcuacuuuggaggcugaggugggaggaucacuugggccugggagacggagguugcggugagucaggucacaccacugcacuccagccugggugacagagugagacccugucucaaaaaaaaaaaaaaaaaaaaaaaaaagaaaucaaaaacugccauuugaaaugcugugaacuggaugcauagaguaauacuaccuucaaaaugcaucuggugcaguguuuucuuaagguccuuaaccuucauaauaguuaacuuuuuuaaaaguaguuaacuuccucucucagaaacccaguguguuugguuguaaaggcugguguagggaagagggccaguuguagcaggcagaaagagcuggcauggauauauagcaggugucaccucccagguaacaauaaauagguucauggcuuccuguggggacuccuguguuagaaugucaguuucuccaagcuuucaucaagaaugguaugaaaguugggcacaguggcacgugccuccugaguagucgucccagcuacucaggaggcugggcccaguugagcccaggaguuugaggccagccugggccacauagcacaacccugucuuaugacgaggaaacagauguaacucagaagaccagagaagauguauucucugcaacuaucaaaguuacuuauuaaucugagaagcugaaggauaaaggauuugauagacuguauaauaauuuuuaaguuauugauaaaggaauugauuauggaucccauguacuuuugcuggaauacuaaagccacacaggaacuuuuuagacugugugguauuguggaggagggacuaggauucaggagcuucaguuuuagucuuaauucuuccauuaacuuacugugugaacuggcuaaauuauuuaaucaguagagcuuuaauuuccuucucuguaaaguuauagaauuggacuacaucucuaaagauaaucuaacuucaugcaucagguacagucacauacaugaaacacccaaguaaauuaucuggagaaauuuuugaacuuucccuuuuacuacauuuaaggauucuucugaaaauaaagaacaaauucacuaggaauuaccauuagguacauacuugccuccuggcuugcucugauguucuuaaccuuuucugauccaaaaggcuuacagaauaguguauuuuguugcuuuagugggauuuugauuacgucaauggaaaaaauaagcuccuggaagauaagggaaauugacaguuccacuaagaacagauguuuuaaauuacauuuagaaugaauuguaugaauuguguaccuugggacacacaucucauuugccacuaucuccugaaaagaguguggauacauaaccaagcuaaaaccguuaaggugcauguuugugugucuuagaauaaauaaugcaccuaaaguucacucuauuagcuuuaacagaugugcuuagguucuaagcauaauauuuuugccaguuaauaguagcuaagaauuuuguuuuuaauuuucagaugugaaaucugauuugcuuuccucuaguaauuuauauucagauucaaccuugauaaaagcacuaaggaaauuugucugugauuccucacugauugccuuaaaauuuuguuuuguaacacaugagcaucguuuuuucuuuaggaucucugggcuacauuuggaucacuucaccaaaucuaaguagauugaacuaucuacuucuuuaugucuuggaacucauuuuuaaauaugaagaccuuccuuauuguuauucagaaugcauauuguaauuguguauauauaacuaauuuguacuuagaugaauaccuuuaucuuuauuuagagauaccauauuuguuuucuguuuugguuuucuguuaaauaugcccuuuuuuuccucuuaagaagaacaaacaacucuaucgucuaaacuuagauaagguuugggguuuugcuuuauuuuaggcauguuucuccccaagggacaccgccuuucuguuucagacaggugcagaaacagacagcucugaugcuggugcucuccagccuccucccccuccccauaucagacuacauuccacuaauauaagggcuuugaaaagugggacugccuuugaaaaggguacagcuuuacugguuacugauuuguuuagaaagagucuauuaguagacccuuuuaaguauuuauuaaaagaggaucuguaaucucuuuuaaagcuucucuuacuuuuacugaaagcuguccaaguuguuuugcaguuuuucauuugcacgcaaacuagcacauuuugagucugugucaucuaagauggcaguuuauuuugaagcauagcugucaaucauguagcaagccaauauuuaaauaauugccuggguuaauugcuuuucuuuuaauuauagaaaugaaacagugcuuuaauuuaauuuuguuauauuaaucccuuagcauggcugaaagcagugcugugaacuaagcuaauuuaucccagcauugcaugucaccaaaggagaaacugauuuggcccuguuuuuuuuauuuuuuauuuuauuuuuuuaggaaauugacucuucauguacauuguuuaugucaugaauauauauuaaucuaggugaaggcagagauaguuauuaaaaucaguguucuuuuaucaugacugugagaaguaugcuuaaaaagcuagucugguaguuucccuugaggcauuuuguuuuguagguugauuaaauuagugaaaaaaagaauuaaacaauuguuaucaacuugauauuucucugcucuugaguacuaauuuacauuuuuuaagauaaauaccaaaucauugcagagguuuuucucaacauuuaagcauauagcauaucacuugggaugcaaucugacuaauacccggaucugcugaacaaucucauuaccccucccguuagggcaucaucaucuaauggugaugccccuucccuugucuuucagguaugauuccuggagacccuuuacuuuuaucaaacagucuuccuuuuacuuuccccaauguuuccagggaaguaaaaauauauauuuccauaauacaacaauguugaagcaucuuuuuuuuuuaagucacaaauagucaauucugauaucuaguaguguagucaguugcucauuuugguuaauuaagauuuacuguuuauguuccauucaaguguaucauuuuugaagaauuaaaauauacagacauauacuuguuaauuuuucuuuagcacugauugucuuuauugauuaauaaaguacuuucaauccguuagaguuuuuauguuacaaucaaagaauuuuaggcuugauagagcuuucugauaaaucaaaaacugcagcaguuugauauauucuacacugaauuaaucuuuauuugguuuugaggccuuguuuuuaaacagaugugaauccauguuugggaaagaaauaacugaccuugcauaauuaagcuuucugucugcucccgccuuuaauuuacuuguggagcagguauucucuagaauucaaaaagcuuuuguuauuuuugaaauuuuguauucaugaauaauaguucucuccugaaguuuccaauagagaauaaaauaaagcucacaaugaauuauagguagucacaugagcuagacugaguuuauauuuuugcuuuuaacuuuuuucuuucauaaguauacauguauauauacacauaaacacauacaaauuaccuuagaaguucaaaguaagcagcccuggaucauaaacuuuuguuugaguagcacuuuauaguuuguaaagugauaucuauucuuagucauuuacauagcccugugaaguaaauauucuuauuaacccuaauuuuuugcaugauaaaaucggggaucaaaaagguucagagauuuaucugauauaguaaaggugagacucaacccgagaucuuuguacuuacaucuuucccucuuuccaacauuuaaugcuuuuuaaaauaccuuaaugcuuaccaauuuauuuguauuuucucuacuaauaauucuucaugugcuuuauggagauuaauuacucaaagacaucuugcguacagcauacuuagcacguagcucagcacauuuugagcaucuaaacugcuucuaggacaacccuagugggauagucacaggcaccaaaacuuaacacauccaaaacugaauucagcauugcgggauugcaggagggaggcgugcagaauugugcacugcccaggacagaugugauucuugccuuucuagaacuuauaagguacuguguggagccagcuagggaggcaaauaugaaauaauuauaguacaaauaaugcaauugagugugguaacuggcacaaggcaggauagagcacaaagaaagacucuaacaagcauaagugcuuaccuagccugauggucaaagaaggccucucuuguaugaucaggaguuacugaggcaagagauggauagagaggagggggaggauuaugcugggagaggaaauagccuaucucaaggccuuaaggcgagaguuaucauggcauguuuggggaacugagagaaguugaggauggcaacaggaaugaggguugggagagagcagccgaaaugagcccauugaggugggccaggaucagguuaugcagggucuaguaagcuauguuagacauuccagauuuuauccugagccaugagaaaccauugaagguuuaaguggaagagaucacucugacuguagaaaauggacugaaacaacagcagaaauugggagacuauuucuagucucccacacuaguuaagagacugcaugguagucauccagauggggaugauagacuggauggagacaguggaaaugagugaaguaaagugacagauucaaaagauguuuaacgaggaagauaaaauuacaagaccaaaggaggauuuaguaguaaauuaagaacagguauagaaaggaagaacauguguuguuuagauaugaguugggagagaccaugagagcucuccaagcagagaugcuaaagaaggcauuugacuuuaugggucuugugcugacagaggaaaagucugggcugaaguuaaaauuagaauugcuugugucaugggaacugagaagaucaaucaccuugaaagaaaguagggugagaagaccuaugaccaaagcuuugaaguccaacauuuuaaaauugagagagacugauaaguuagagaaaauugagagaaaaaguguuucaaugauagauuuguuuuaguaggauuuuagggauuauccugcuuuccuucagauuuuugcaucugcuacuuggugugaagacuuuaugaauauguauaaauauaaauacuuccauaauuagagauaacugauuuauaaugcaaaugccucuucaaacaacuccuugauuuguuagucuuauugaaaguuuugcagcaaaacagaacaucagaaaacccuuuccacugucaacuggggaacuuggaaagcagugggaaaaagcaggaagccuguggaugcccaaagugauaaaagcauuagucagugguugaagaccaaaaaggaaucccuuuuaaguuaguuguggagagcgauuuugagaaucaagugaaauaaggaaacgugagacauuuuguaaaacagugaaguguucguuuuuauccgaggucacauaguaaaugaguaguagagucagggacccaggggauggggcuggaugaggugcagucagcuggucugguugguauggauacaucuugauuuuauguuuuggaugugugcuguugccccaucaccuugguuugcaaaacaacuaguauggcuaggaaaguaauuguucuaggcaaaggagacuuccagauaauaaaaaagucaacaauuuagcauuuuuaauggcauauuuuuauuuuucuuuuuuuuuuacuuuaaguuccaggauauagcagaaugugcagguuuguuacauagguauacaugugucauggugguuugcuuuaccuaugaacccaucaucuagguuuuaaaccccacauacauuagguguuuguccuaaugcucuuccuccccuugcuccccacccccgucaggccccaguauguguuguuccccucccuguguccaugugaucucauuguucaacucucacuuacaagugagaacauuaaugguguauucauguauuucacaucuucccaaucuuaaugaguuguaucuuuuuauuuguaaguuguaagaauuauuuauuuguaaauauuguaagaauguuauuguauuauccuagaaaugcucucugggguucuuaggugggacagggaugugugccccuuuaauaaauauucuaggauaauugguguuuuacacucucuuucuucauggccuauguucauucuuccuuaucucuacauucagugagucugcaucuugccacacucuuuuucuuacccccucuucuccuuuuuaaaccuuguugcuucuuagcuuauacacagaacuuggcuuuuguuaacuaucagggccaguguguuccugguuagggaacacacuggucucaccaagucuccugaacccuuuucaauuuucaguuuuauagugggugaguuacuucuggauacaauuuuugggauuugagaguguuuaaugccugagucacuaaucaagaaaaugcuaguguaugcaaaucuggcuuccaaaaccgaaugaggaaaaguucuuuauagaaaaauccuaacuaggccgggaguaguggcucacgccuguaaucccagcacuuugaaaggcugaggcaggcagaucacgaggucaggagacugagaccacccuggcuaacauggugaaacccugucucuacuaaaaauacaaaaaauuagccaggcauggugguaggcgccuguagucccaccuacucgggaggcugaggcaggagaaucacuugaaccugggagguggagguugcagugagccgagauugcgccacuacacuccagccugggugacagagcaagaccccaucucaaaaaaagaaaagcaaaaaaaaaaaaaaaaaaaaagaaaaaucuuaacuaauaaaugcagaaagaaugacaaaauuagaaauugcuauucuaguucuuuuauugaaauaguaggccaucaagcaauacuaaaaugguaaaaaguugaugggacacuuuaaauggagggaucaggcugacucccccaaacucaagugauugauaguaacaucauuaaaaguggggcaugcaaacacuaugugccuccuaauaugguauagcauaggggccagcaaacuuuuccuguaaagggccagauggugcuuaucuuaggcuuugaggaucauguggccuuuaguugcagcuggaaagcagucauagacagauacauaaaugaaugaauguguggcuguguuccaauaaaacuuuucuuacaaaacaggcauuaggcuggauuuggcucaugggcuguaguuuguagaccccuaauguaauaggaagugcguagcaccagauacgaaggcuucuugucaaaacaacugaaccugcaucagaucaaagcuccaagucuaaucauacuuuucaggaaauauaggaaauaaaggaacaaguuaaaugacauguagaauccugacugugggacauucuauaggacagauaaucugguuucucaaguaaaucagugcauaacaaagggguugaaagaaguuccuuuguggagggaaaagaaucagauguaauauguagacuuggaauuccucaucauaaaguagaucuuugagauaauaggagaaauuuuaaaauuugaugauuuuacuccaguaaacaaguauauaguaggugaguggagauagaugaaacaguuggcaaaauguugauaauuguuggaacuggaugauagauacauggggauuuauuaaucuccacauucuauaugcuugaaauuuuuuauaaccaguuaaaauaaaguugaauguacuccaaaaagugugugagucaguuggggagagggguuggcugcauagaaaaauagggaagaaucaaauggaaaacauuuuuucuuaugguuagaggaauuuuuguuuuuuaaugcugguagugcucauuuuaguaguaguacuuccuuuauuuucucauaugaaauuccuuccuccacuuuaaaauuaaaguuauuuucacauuuuaauuucagauagaagucccugauugcaagugccacugguauucauuguaccacuuagguuuuguuaagaaacagaaacggaauuacuuuacuaaacugcuuuaugauuacacagauagacucugggaguuugcuagcaccuuuuauuuuaaauuaugaacagggaaaaaacaauaaagaaaauaaauacaaaaauuuagacuuuuuaaaaugacuuaagggagaagcaagucacacaauaaguuugagaugcagagcagcgaaucagaacaaauagcugcuuacaugaacaaaucagugggaugugaaaaugcaucaccguaaccuacauuuuuuucuaccaagagauuugcagcugacuaucgggugacucauuccuaugcuuagggggugagguaaugcuauugugaagggugaugucaucucuguaccugaacugcaugcauauauugcuucuguggcucucaaggaaaagcuccaucugcuuucacauaugcagccugaaagacuugacaagauuggcacaaaggucagcagccauguguaugacucauaagcaaccaauuagcgaagagcagcuauuuaaaagugaacuuuuaaaaucacaauccagaaauaugacaugaugauucauuauugaaucauaaugccuuguuguuguuuuguguuuugcacuuacugaguuaaugcuguugagcauuuaacuuuuaaaauaaggaaguuuucucaguauggucaaugauaucaaaucuugaaucuuuaaacuauauuuuuaauugaagauaagguugguuggucagucuguugguugauuggcugguuuuacuuuuggaguugcagagaccauccuuagggcaaaaauggauucuauuucauauuaguuuggcaguugauuuuugcacuuaggagacauuguauucccuaaggacccgcuacugcuuuagaggaaaagagguuuuuaauggaagaggaaauaagucaaaauaaacgcuaucuguuuacugcagacacacuuaacuccucuuccucuuuuagucaugcacaccugcuuucucuguuuauacuuuaaccuaauacuacuguugagaugaccaauuaaaauaucuauuuuuaacuuuauuauuugaaucuaguguucugguaaauaaaauauagaauauuuaacauaauauggagguagauaaugguaaauacuugauuuucuaucugauauguaacucaaaauagaagaucauaucggcuaaauacuacuuauuguuauuauaggguaugugcauacucugaccuaaauuuguucuaauggcaacuucaaguuggacauucuacaaaagauaaaaauaaagguuuuaauuuuugagaauaaaauuuguuaucuauuaucaggaaauagaaggaaacaaagaauaaaauaguuaugcuaagacucuaagguaauauuagguaagguauauaccagugucacuugagaacuuacugaaaaucaaauguuuuuucaguaaugaguaauaggaacccuuaaaugucuagaauuaugguaaaccuucauuuaaugguauggucuugaguuugauuauagagcuccugcaagacucuugaguaccuuucuuuuguuuuuaaacucuuguuuggaaauaauuucaaacuacagacaguuguacaauaaacgugguaccaaaaaagaaaaaaaaaaaccuuaugugcucagacuuuaccuaccccaaccugguugccugcuuuauaugcuugcccguguccucuugcccacucucacucuucucccccauucccucauacacacuuguuuuucuugaaauauuugaggauaaguuaaauaugcaucauggcccuuuacucuuaaauacaucaguguauauuuccuaauagagauauucucuuacauaacuacaaaaguuauaagcauuaucaauuuauauuaauacaaugccuuaccauccauaugcaaguuuugucaguugaccuaauaauauccuuuauagcauccucuaugccuaguacagcaucuagucuagggucagauauugcauuuauuugucacauuagccucuuuuaaucuaguuuuuuuuuucacagcccuuucuuuaucugacauugacauuuuugaagaauaugguuucucuguuauuuuuaaaauggaauuuuccuuacuuugugcuugccugauguuucuuugugcugagauucagguugugcauucuuggcuggaauacuacauaggugaugcagucucucucagggcaucuaacucucauugaugauuuuuacuuuugguuauccaaucaagguauuaucuccacuauguaauauauaacuuuuguuuuuuaauuucuuguaacuaauaaguacucuguaaggagacacccuagaacauguagauauucuguucuucaucaaaguuuccaccucaguuuagcaccauugcugacucugguaugacccagucuuuacugugaugguggcaaaaugcuaauuuuuccaacuccagcccuuccuuuucccucauauauuauuuauuuuaucuguuugcuauugguaugaacaugugaauuccuauuuuuaaaaauucaguacuuaauuauuuuggugcuuaauugucccagauuuggccaguggcccucacccuuuucaagcacauccuuguuuuuugaaagaauaagaugguaaaggcucaucucacaucuacacugccccagcccuggaaucugccauuucucugaggagcccugguuccuuuugguggagaaugaaauuagauaacaaaauuugggcaccggguaugagugcacuacuuuuacagccacuguauaaacauaaauauaaacauuagcugaccugguaaguauuucuuggagguacagugaacaauuuuugaggauaucacggugucucggauuauagugacaacaaaaaggaaaguuaaggaaugggaagauuuuugucacuaaacuuacauugccaaaauuuucuuagauuucaaagcaaaaaaauacaugaugcuagguugaaggcuagauaggauuucuguggacaaaguugguacagaaggauguuccagaaagaagaaaugacauugacaaugacauaacugaacaauaucaguaacuuuaaauguuguguuuaaauaaccaugccugauuuccacccauugggggagaacuaaaagacagggaugaaagguuuauuuaaggucaguuuuagaggacuuugaauguccucuaaaggauuuuggaucuuuaggauuuggggucuuuaguaagaagauaauagcuguugaagauuuuugaauagugucauaacaagcuuaacucugacugaaagagauuaaucuggaagauacauagaagauuaaggaaauuuccaguuaagaacuguaaagaggcuauuauaguaguuaaggcaggauuugaacuggauuugaacuggaaaauaauaaggauuugaacuggaaaaugaaagaaagaagugaauuagaauagugguuuuuaaucugucuuccaaaaccccagguuuggggcaaaguagaugugugaguugaacaccaaaugagaacucucaguuacuguaugcgaguuuucaaguaaguaucccuuuaaagaaagcaaucugcugcuuaaagaacaaaaaacuauguagaaaaauuuuguuaacucuuacuucucucguauuccuguuuccuaaaguuuugagccuggauaaucaggaaaauaauugugucauuaauugauguaggucaaauuaugcguuuuuuaaaugccaaaggucaaugucacaaagacauguacuaaaacucuuacugaagaaauaagauauucuuggccagaagucuuggaauuauccuggacuccuuucuuuugcucaugccauaaagagaauccaccaugaaauccuauuggcuuuaccuuucaauuauaucccaaaccugacuaccuuaaacagcucuacugcuuaucaacuaaccucuuaccuucugccugcucucucugccuccacucuugccucucagccuguucacuuuccuugugguuuuucaaacaugauggguaugcuuccaucuaagagccuuugcaaagccuggccuggcgugguuaacucucucacguuaagacuuugcccaaacguuacuuucucaguggggucuacccuaagcucuuuauugauaauccccucuccaccccaugcguauuuaccauucucccuuuaucuuguuccauuuuuuuaacggcauuuaucaccuaacauaccauauaauuuacuuauuuauuaaguuguuugucucgugacaccagaguuuaaccuucacaaaggcagugauuuguuugcuuugcucgcuaaucuaucccaaccaucagaaugugccaggccauagguaagcccuuaauaagcauuguuaaaagaagggagggcaaccgagaacacaaaaccaguaagcuuacuuacuaggcuucuaucucauugcagauuugagaaagcaaaugaaagaagggaugggacacuacuugaaucaguaucucuaaaccuguguuccuuggagcugagucuaugacaguaauuggccuugauaaaaauagcccuagaaaauacugcauauauuaucuauuuacacauuaaauauucauauuacacauauuacacauaaucauguuacacauuaacauacuaauugcuauaagagcuccuauaguaaccucuucuugaacucacuugaucauaaaacucucuuuugguaacucaccuaccauuaugggacccuuuuggcccaugguaaacugaguuugagaaaaaucuuacuagaguacuauguguagggccugggagugauuggcaguucuuuuaaauuacuuuugguugauggacugcacugcuucaugugcuacucagaaggaggcuggaguacaucaggaucaagacuccagcucuuaauuacuauuauucuuuuaaagguaugaugcuucuauuuuucugggagaaauaagaaaaaaauaauaauuaauguuauggcccuuuuaaaaaguuagcuucuguuuuagguauuugggaauaagaugaucauuccuucccuggauggagcccucuuccagugggaccaagaccgugaaagcauggaaacaguuccuuucacaguugaaucacuucuugaaucuucuuauaaauuuggagaugauguuguuuugguuggaggaaaaucucugacuacauauggacucagugcauauaguggaaagguaagugaaaaugcugaauuuacuuuggggaaaucagaguaaauuaggguagaaaaaguaauuuauuaaacuacacuuauuauuaguugaguuuuauuguaauuuuccccugagguugucauuuguuuuaauaagagaacugugagguaggaaggggaaacuaauaacagaauaaauggcagagccaggaauagcaggaggaagagaauucauaaauauggucuacugugucucagguguuuuuuuuuuuuuuuuuuuuuuugagacagagucucacucuguugcccaggcugaucucagcucauggcaauccccacccccaccccauuccacacccccucagguucaaguggguucaagcgauucuugugccucagccuccugaguagcuaggauuacaggcacaugccaccaugcuuggcuaauuuuuguauucuuaguagagacaggguuuuacuguauugccaggcuggucuccagcuucuggccuuaagggaucugcccacuucagccucccaaagugcugggauuauaagcaggagccaccaugcccagccucagguucuuuuuuuuauacauuauuuugcaaucuucacagucuuccuaaguguaacuuucguuuuuuuuuuuuuuuuuuuacauuuugacagaugaagaaccuuauaaagauuaauaguaauccuaaugauaagaauaauugauacuacucauuuauaggguuugauccuauaauaaggugauccaagaggaaaguuuauacucauuuuacagaugaagaaacugagacuuuaaaagguucagaaacuuccagggucacauuuaacuuagaucuaucugacaacaaagucaugcuguuaauaaucuagacuuucuccaacauuagcucuuaggauauaaucauaauauaaucugcuucuaagauugggucuuauaaauccauuaucaagaguagcuaauuaaaagcauccuuucaaccaggcaagguggcucacacuuguaauccuaccacuuugggaggccaagguggguggaucacuugaggccaggaguucgagaccagccuggccaacauggugaaaccccaucucugcuaaaaauaaaaaaauuagcuggggaugguggcgcacgcacgccuguagucccagcuagucaggaggcugagguacgagaaucacuugaaccugggagguggagguugcagugagcugagaucacaccauugugacguguaaacgguuuauauacagacuuggacuaaaauaaggaagaauagaaacguggucuuuuuacucuugcauuuuucaacuuuaacaauuccuuaucuaaguguuaggcccauagcacuuucuugcucuugcagaugcuuuucugccuucuccacccaccugcaucugcauuguguugaggaggccaugccauccuaucuggccguuuuuugagcaaagcacuucaaucucuguuuacuucgguagucucaucuguaaacaacaggauugaacccgaucaccugguuuuccgauuugaugugcugcuacauaauucugguauuguagaagguaugcuuuucgugaggauuuuaguuuggaucauauuaacucuuccuuuuuucuuuagugaaaauuugaggcaguuacuuuugaauacaaaaagcucucagaaaaguuucaaauuuuuaaaaaccaaacacuuuuguuauacagaaacucuaagguugauuuuuuuuuuaacucaccugaaauuuuauuaaugauauuguagaaaagcuaucacaaguagcuauccauuucuucuuguauauucuauggaaaucuccaaaguaaggcuaaaauuauguaaauccuuaaaaucauucccugaaauaaauauucauugguacugucauuguucuaaauaacucauuuuaggaguugguaaucuaacugaugcuucuuaugacuugaguacuucauacacauuuccuuaguuuccuuucacuuuuuaaaaauuacagauuccuuuaauaucucugaucuauuaugaguugucuccuuuuacuaauuuuguaucuaauuuugucuuuucaggugagguauaucuguucagcucuggguugucgccaaugggauagugacgaaauggaacaagaggaagacauccugcuucuacagcguacccaaaaaacuguuagagcugucggaccucgcaguggcaaugagaaguguguauucagauaauguugcuguugguauuauuuagaaauacaccuaauaccaaaauuuaucagauuucuguuuguggagauuuugacuauuuuguugccuuaaaagcauauauauauauauuuuuuugauacggagucuugcucugucgcccaggcuugaguacaguggcgugauauuggcucacugcaaccuccaccuccuggguucaagcgaaucuccugccucugccucccgaguaccggggauuacaggcacgugccaccacacccaacuaauuuuuguauuuuuaguagagacgggguuucaccauguuggccaggcugguguccaacucccgacgucaggugauccaauguggguccuaaaauaaaaaugguuucaugguuauuaacaaauucugaacugaacuucucaccauaugcuucgggauaugauaaccacagggguucucauaugauaacuauuaguuuagucucagguuaaugauuuuuuuuuuuuuuuuuugagaccgaguuucacucuuguugcccaggcuggagugcaauggcaugaucuuagcucaccacaacagcugccucccggguucaagcaauucuccugccucagccuccugaguagcugggaugacaggcaugcgccaccaugcccggcuaauuuuguauuuuuaguagagaugggguuucuccacguugguuaggcuagucucaaacucccaaccucaggugauccacccaccucagacucccaaagugcuaggauuacaggcaugagccacggugccuggccuaaugauauuuuuuauagcaaucucaucauucaaaguucuuugaauacagaaagauguuaagacaaaauugauguguuucuuugagcuugaacuuauuugacucucuaauuaugucuaguagguaguuucauaguuugauuaucucaauuuuaaaauaauaaucaucuuauucaauuuucuugaaguauuaaaacauuuauuuagccuaauaccuuucuguuuccuucuuuaaauaaugaaccccuuauguaauuuuuauauuuaaauaugugauuaaaaaaugugauaccuagauuagauacgcugauucuacaucaaaugcuugauuuuuuuuaaaccuaauauuuaaguuuuaaauugccuuuguaguaaaaauaacuuuagauuccaucuuuaucuuuugaaaaugaaccagacuuucggguuuugucugauccgaugcaguguaauucaguuuccuuuccugaaaacuguuuucucaaacucaguuaagaaugcauuuauucuuucuacuuuggacuaugaauagggcuuugcauuuacagacaacuugaccuucuuuauccugacuggauuuuguuuuuuuaaguguuugagugcuuacugggagcucagccaccauagcagcagauguccaacuuaacagauuuuugaguuaccagaauaggaaggaucuggguuucuaagauccaugauucuuuaaaauauaauuauuuccauaaaugucagaauucuuaacuaugccauuuuauaucuaagugaaaagacacaauacucucaguaguugagugauuuuucuauuuacuaauuauagaggaaacauuauuacugccacuuuaggauaagacugcugaaacuuacuuaggaaaggguaaaugacuugccacaucuuguucaguggagauccaagauuggggcugagguauccuggaucacauugccuuuuugaggccauguuuuaguaugaauuuaagacuggugcauucaucuugacuuuuacacugguuuguuagggcauauuaauuuugcugcacuuaaugaaauguauccugccuuuaauuaagagguaaggcagacugugugcuaccucauuuuaaggugacauugauguguuuggggaaaaucacucugauguagaaguacaaacauuuguaaguuuuugagagaaaaucugucccuuagcuguuguaagggacacaucaagucaguccacaacccucaaaaccauugugucugaagggucaggacaaaguucuugugggcccucuuguggcauaaaucaguagagcacucuuuuccagaagguuauguuguuaguuuucucaucacauaauuuuaguauuugcuucuucaaucuagaagaguucuauauuauuuugucccuuucuuuaaauguaaauuucuaaaacacaccuuuguaaauuuaagguggaauuucaguguuggccacuuugaacuucgguauauuccagacauggaaacgagagccggauuuauugaaagcaccuuuaagcccaaugagaacacagaagagucuaaaauuauuucagauguggaagaacaggaagcugccauaauggacauagugauaaagguuucgguugcugacuggaaaguuauggcauucaguaagaagggaggacaucuggaaugggaguaccagguaccuaacaccacugaggauuuaaaauacgguucuuccucucccagucugaccaaacuuauugauuggguggaacgaaauuacuacuacuuggggcucucagcuuguucucugugcuuuuauaaauuugugauuuuaaaugguauuuuauggguuggaacuauauaacuacugcuugaauuauuuaagaccuuuuuuccauuuuuguuuaguuuuguacuccaauugcaucugccugguuacuuaaggaugggaaagucauucccaucagucuuuuugaugauacaaguuauacaucuaaugaugauguuuuagaagaugaagaagacauuguagaagcugccagaggagccacagaaaacaguguuuacuugggugaguaaauguaucuuaucuaacgauaguacacauugacaucuagauuuucuucuuacauuguuccuuccuacuucaggagugccuguaguaguuuuaaauccuaauaucaucucugauguacguugcccuugagauuuauacuucgauuuccauuccugcuacuuuuccauuuguccaauucugaaaauuuuuuuguuguuguuggagauggaguuucacucuugucgcccaggcuagagugugauggcaugaucucugcucacugcaaccuccgccuccuggguucaagcgauucuccugccucagccuccuaaguagcugggauuacuggcaccugccaccaugcccagcuaauuuuuguauuuuuaguagagaugggauuucaccacauuggccagaauauagugcaccugaccucaggugauccacccaccucggccucccaaagugcugggauuacaggcaugagccaccacgcccagcccaauucugaaauuuuuaauuacugucgcauauucuuuuucucugaggucuauauuagaaaggcuuagaaauauucucauuauauaacaugauuucaaauuacucauuagccaagaaugguggcacgcaccuguaauccuagcuacuccagaggcugagaugggaggaucgcuugaccccaggaguuagagccuaccccaaacuauaaucaugucacugcacuccugccugggugacaggacaacacucugucuguuuauauauauauaauuauuuauaaguaauuacauauauguauuacauauauaauuauuuauauguaauuacauauaaaauauauaguuagguauauauccucaaagucuauaauuuucuguauuuguauuugcauccauauuaguuugugacccuccccucuuuaagauuagauuucuuucuuuuuuaucagugcaucuguacaacugaucuaaaaaauaaaacucuggugugcuucugggcaauugaaagccuuuaauauuauaaauuuugaaaacucuuggaucuaauuugaacuagucugcaucaucaaauacucauaaaauucuauaagcucugacaaugugccauccaccuguugguuugaaugaaaagcaagaauuugaaggaauaacaugucauuuguguuaugauaguauuuaacugaauuguuagcaauauuucuagaauuauagguguuuagguaaacuuucuugagaaaguuacuuaguguaagcuauuuguuuugugagaguacagugacuuaucuuugaauuuuucuacuggaacaauuuuccuguauuacugaaaaugugcuauuauucagugagaaauaucauauggaccuuuuguguaacuuucccucccuguuuuuguugaauaaacauugaguuuaucuuugagugcuucaagcauguuucuucuuugacaagaguuuugugguguauguagaaauaacuggaauuaauguaauuuuauuuaauuaaaaaaaccuuuuuaaaaaaaucaaugcauaauugacaauguucugguugauucaggaauguauagaggccagcuguaucugcagucaucagucagaauuucagaaaaguuuccuucaagucccaaggcuuuggaaucugucacuaaugaaaacgcaauuauuccuuuaccaacaaucaaauggaaacccuuaauucguaagugaauuguaaacuuuucuaaauacuguuaguguucagagaccuaauccugacugucuuugcccuaguuuugaauacugcagagauaagaacuguuauauacuuuauauuuuauugauaaaccaugaugguauuucagauguuaauaaugaauuuuuauuuucauuuagagcaucauuucuuggaagcagcaguugcuucuaaaaaauguuaaucaaauauuucucuauacaacuuagaaaaacucuuaaucauucccugaccaugccaaaguaacauuuagcgcuuaacauacuuauauuaagacuguuuaggcaaaaguuaucugguuagcacaucauauucuuugagacugaacgaauagaaaucaaauacugugcaccuacuucuuucauuaucuuucuaaaccuuguacguguuuuuuacuacauaugucaugucauauuuuaauuguuuguuuaaacaacucagauucucuguaaaacugugcuuuucaaaggcaagagcucugggccauuuguuuaacuuauauguuugaauugaauuaugguugaauaucaguuuauucaauuaagcacgugcauuuuuauucaagucauaacaguucagacuuaagaaauauuauuauuaagaaaauaauaauuuucuuuuagauucuccuuccagaacuccugucuugguaggaucugaugaauuugacaaaugucucaguaaugauaaguuuucucaugaagaauauaguaauggugcacuuucaaucuugcaguauccauaugguaagugaaaauacugaguuuuauuuauuuuauuuuuuaauuugaaauuaauagaauucaaaugaagaaaagucgauuagaguauagacaauaaaacaucuugggagacaauuucaugaaugauuacuaagcauacaagcuccaaaguuagguugccaggguucagaucccauuuuugccacaugcuagguugggcacaucuaacuccccugugucucaauuucuuuaucuguaaaauuagaauaauaauccuaauaucuauguauugaguuguugugaggccuaaaugagauaacgcaggcaaagucucaguuaacaucauacguggcacauagugucaguaaacauugguucucguuauuagcucuuauuuaucagacuauauuauguaggcuguauaguugccuguauaaugaagaaaauguguuuuucauaaaacuacaugaaaaugaugcacaaugagguuaucuucuuacucagacaagagaaauuagugcaaaagucaagaauaggugagauuuggcaugaaauacauuuucuauuuaguaagcagcaguuuuuugaaguuaggauauauucagauaugaaagccuuuuaaacaguuguguaauuaagaaguccucaaaucuguaucagguaaacacguagacgacucaucaguuacccuagauguuagcacuggaaaguuauuauauaaauuaaauugauuaaaaaaaaauggcucugaacuagaaacagcagccuuuaucuuuuuuuuuuuuuuuuuuuuuuuuuuuugagauggaguuucgcucugucacccaggcuggagugcaguggcacaaucucggcucacuacaaccuccaccuccuggguucaagcgauucuucugccucagccucccgaguagcugggacuacagaugcacgccaccacgcccagcuaauuuuuguauuuuuaguagagacgggguuucaccauauuggccaggcuguucucgaacuccugaccuugugauccaccugccucggccucccaaagugucuggauuacaggcgugagccacugugcccggcuccuuuaucuugauauugaucaaaagacaaguuaggcugggagugguggcucaugccuguaaucccagcacuuugggaggcugaggcggguggaucacuugaggucaggaguucaagaccagccuggccaacauggugaaaccccaucuuuacuaaaaauacaaaaauuagccaggcauugugguacacauguguagucccagcugcucaggaggcugaggcaggaggaucaccugaguccaggagacagagguugcagugaggcaagaucacugcacuccagccugggcaacagagcaagacccugucucaaaaaaaaaaaaaaaaaaaggcaagauaaaagagaacuguguagucugaccacguaguacaaaauagaagacaaaaaaagacaagcuauuuuucugggacaaacucauuuugacagccuaaacugaaccaaacagcauggauguuuuccuuucauuuugugaagaaugauuggugguaaaauuugguauuuuauugauaacuaaacaaaaagaaagcuaaaaauacccugaaggaagauugaguauuaauucuuauauuuaaagaauugaauuauuaaugagguuaugaauggaguagcccuuaagauuuuuuucuagucuuauuacuuaauauaaagaaaauuuaauaugcuuauaggauaaaggaaaaugucuauauuuacgggagaaaaaugagacaaauuaagauguuuaaaauacguuaaagaagagagacaaaacuuaaaaggaauuaaugugauaagucacaggaaaauggauaaauuuuaauaguuaaagacgggccuauuuuugauuaccuuuaaaaaaaacguuuuaauguuucuauuugaagauaaugguuauuaucuaccauacuacaagagggagaggaacaaacgaagcacacagauuacagucagauuccucgacaacccacauuacaacaagaauauccgcaaaaaggauccuguucuucuuuuacacugguggaaagaaauaguugcaacgauuuuguuuuguaucauagcaacaacguuuauugugcgcaggcuuuuccauccucauccucacaggguaagaaucaugguugcuuacugucugguuuccacuuccccaccuccuauuugcuucucaacccaucacagucuggcuuccaucccuacugcuccaccaaagcuacucuugccaaaguucucagugaucuuccuuguguuaaauguaauggacauuuuucaguccuuaucuaacugaaccucuuuguauuugacacuguugaacaucucccuuugaccuuucuugccugacuuccuugacaccaugcucuccuggucuccuugggugugauguggaugcuucaggaccugaucuuucucauccucucaguauuguugguauuccucagcacucccucuuuucacuguucaucccacaaacucuccuuagauggucuucccuacuuucccagcuccaaucuucuuauauacuaaugguucccaaaucuguuucucuggaacagcuaucuaguaagugcuacacaggcacuucaaaugagccauaucucagacuguccucauuuccccucccauuccccuccccuccccagccuguucuagcauuuuucucucucaaagaaacguacugccguaugcagucacgaaagccaugaaaucauuuugcucucccuuaucagucaccaaguucugucgaauccuuccuccuagauaucuucacauuuuucuucuucucuaugugucaguuuucauuuccacagcacaaauaccaucaucacaccucuccugaaucacugaaauaacuucuaacuggccucugugccccuaguccucaggcuaucuccaguccauucuccacacccuaacucuagcugcauuucugggcuuaaaaaccucuaauaccugacccuccuccccauuguuaggcucaaguccaaccuucuuaaaacaugcaagguucugaaugauucguacccugccugcacgugacccauccuucacugguacccuaaucccuuccuccccuccaccgugcucagccacuaggcugagcugcuuucaguccuuccuguagaccgugcucucgcuuagccugguggugcucaucccucuaaccucgccuuggaaccuuguuccuuaccuccucucccuucccucucaaauaauuaacuccuggguaauaucuuuuaguuugaaauuaguugccacguccccugggaagucuucuuuaaccucuuauuucugaguuagauuuccugccuaugucuacacucuguacuccucuuacuagaguauuuacuaaaauauuuaauagguaauuccuaauuucucucucuaccucuagacuguacauucuuuuuuuuuuuuuuuuuuuuucagagacagggucucacucaucucacucugucacccaagcuggaaugcaguggcaccaucucagcucacugcaaccuccgccuccuggguucaagcaauucuuguucuucagccucccgaguagcugggacuauuggcauauaccaccacacccagcuaauuuuuguauuuuuuguagagaugggguuucauuauguuggucaggcuggucuggaacuccuggccucaagugaucugcccaccucagcuuuccaaaguguugggauuacaggcaugagccaccacgccuggccuagacuguacauucuuaaggacaagaaccagucuacacuguuuaccaccaucuccucagccccuuacacagugcuuggcacauaauuggagcucaguaaagauuuguugaaagaaucagugacuaaacaggugacccacagugccccaauuugaccaugauaauuauuaacauccucuaaaacaucuuuuaggagauguugguaaagaggcauugccugauuuaauuuccuguucuuaaaagcauuuuaaugcaaucuaugaaacugguuaggaaggaaaucucucuagucuuuuuguuguuguuguuauuguuacuggguuuuuuguuuguuugcuuuuuuucccuaccuuauuuugucaaaagaaaucacucuagucuugcccaggaguuuguguuuaugcuuacaugugugcauugucuuucuaucuaguuauguaucaugcuguacauaugacauacccacauuauaaagaaacaaaauccccucaaagacuggagggauagcagugggaagauaaacuuuuuuucuuuuauaauaaagcaaaaugcugcacuuuguuuucauaaugcuuuuauuuuucuugaugcuacuuauguauuuuucaguguuguuuauuuuauaaccuaaaauuguuagcuaacuucaguucagcuuuguacugguagugauuuuguuuuucaccuuaucagcaaaggaaggagucugaaacucagugucaaacugaaaauaaauaugauucuguaaguggugaagccaaugacaguagcuggaaugacauaaaaaacucuggauauauaucacgguaagagucuuauaaaauacaaccaucugaaucaaagaagaaaugaccuaagaucuuguuuaacuuuuuuuuuaauguguggauaucuagaaaaauaaaacauaggcuuaacccucaauaaauaaauaaauucagguaacuuaaauguauuaaaagugguauauacccuaagaaagauaaaaauagaguguuauaggaauuuagaauuucagcuaccaaauuaaguucuuauucaaguaacuuaguuauuuagggucuacuauguacuaggauuagcauuuauaguaccagauaauaauuagguuuauaagagugugauaugagucuccacguuucggaauccucauuuauuuucauuauuguucuaucuguaauaggaaguagaaauauagggaaaaaaacacuaauagaacagauaguuuuuaaaagcagaagggggagauggauuagcuaaaaguaggcaguuuaaauaaaaguaaagaagcuauuagcaaucucucaaguauaaaaugucaccuuugaugcauugugauaacuggaaaugguguuaugguuuauuuuucauauuacauggauuauaccuauuuuucucuuugucuugauagcauacuucuuaucacuuuagugauauggggacaaggaaaagacguggaacuauacugcuuaauaucuaggguaaugauuuuauggcagaaaagauugaaaauaauagauaaauauguauauuggggcccuccaaggaaacagaaaugacaagaugugcauauauaucuuauacauaggcauauaucuuuauauauauacuucuauauagauauagaugcacaagcauauucacaacaaauuaaggaaauacuugugacaauuacaguucucauuuuugauaccugucauguggucacagcugguaguuauaaguaccuuccuccucuauccaucccauauucccuuucccauuggagaacaacaccucagccgguuguaauucuauaucugguagggugacccaaauccacaguccugaagggucugggagauugguaguucugccuggauuggauuguuguaguuuuccauugaccuuaaucacaaggcaugauuauacaaagagaucccuaagggaucucauguauuucagaccuacucuuucuuacaccuccacugugaaacagcaauccaauuuccccuuaguagucaggauuagucauccagccagcacaguagcugucuucuuuguugauuggaaggcaugaggaguucaaaguugcuguuguaucuccugguggaaguguuccucucccuuagacaaagaccucuaggccugccgaacauaaggucacaggaacaggaagcaaaaauguugccaguggaucacuaggugguaauggugggugaugccacucgcauuuccaucccuugaucccuggaccuguaaauacuggcuaugggagaaaccaugcuauaauauauuagacacugauucagagcauauccagcuuucuggagaacccuggcccagcccugcaagguaccuaccuggcaguguaauggagucuuaaaaggccauucuaccuuucugucaaaccagcugcuucaggaugguggggaacagguaaaaacagucaauuucauaaacaaagcaaaauuuacuaggugauuaacaaaugcuaaaggcuacuuuaauaccuuugcuaauaaaaauacuaauauaucagugacugucaacaccagcaggcagugagagaaagaauaaaggauccaacaacucccaugagguagucuacuacugaaguuauucacuguucauuaaacauuuauucggaacagcugugugcaggacaauauuucaggcuuugggagaaauaaaaagacugcuccuauccuggagaagcuuaaagucuaugggaaagauacuacuggguaaaacaagcauguaagaagaaagccaugaaccaaaucacuaaaucuguuugugaugaucuaggaggacaucauaaaugaagucauauuugaacugaauuuuaaauugugagaguucggcaaguagagaugagguuuggggaguagaauaaaugcgguaucaugaauaaagauguauuugucaggcuuuugucaagaaaauuagaaaaauauacucaaaauugaauuagacuuaagucaguuuaacuuuauucaauaugaagaaugcagcucuugggucuuuuuuuuuuuuuuuuaauaugggaguucuauaauaauaccuaauguuuuuuaguggcgacaauguccuaggcacuguuaagaacaugaacucugcauucagucaugaguucaaaucucagcucuguuauuuaucagcugacaacuuaggcaagaugauacuuacauuucuagggucuguaaucacauauaagauguuacucuuuuuagaagauaauccguuuuuauauagguguuuuccuuaauaugggaagauaauucagcuggcccuccaggaguaggauaugaaguuugugggcuuuugcauuuggggagacugauuuguacugagguaccuugacuggcuauuuuuaggaauacagauuauuacucuucauuuucuaugaaaggaauuggcccauggaacguugaaaucuauugcuucuccuuaacuccaugcuuuaaccagcugaggcaacuacuaaauaaaugaguauguaagucauaauguaagucuuaaaguaaauaaugaguauguaagucauaaacuuacccuuauaagggauaucagacaucaucuaauuuauucauuaauucaugcauuuauucaacagacauuuguuagacuuucgguuugucagguagugcccacccauuggaaauacaaagagaaacaagaaugauuuucugcauucauggcccccaaaauacaguggcggugggagaagggagcugcuuacacauaauugcaaaaaauuaagauuaaguuuaaauacuucaaaguauuaugugcagaguguuaugggaaugucaagacaggggucuaagaaagccuuacagaggugaggagaugagcagaaugaaagaagaauaggguucauuaaaugcaaagaggaaggccaucccaguggagcagacagcagaagcaaaaccuugaauugugagacagcauggugcaaauugacuggaugauacagugcaggucagugaagucagcacuaaagggagaaacaggcugcuuaguggaggccccugugagugacagauggugaguuggcuucuguuugacuugguaccuccagugguagguacacugacucguggggcaacccaacccaugucagcuuugguuccuaggaagguuuauggcuaaaauaguaccuggguauaauaggacugauuaaaauuuucccauaaaauugacagguaauuagcuaagauaaaaacacauuuucuguaauugauuacaaaaugucacagaauguaaaagauaugaggauuaggaauaugauauuuugguagaugauaggaaguauuggacagcacacaucacuagugcagcaguuguaagaaaaagugauuaacaagugauucccaauuaaacaugucuuuuuuauuuuuaauuuuuuucuaggaaacauaagaauguguuugcuucauuuauacaaacaggacuaaaaaugcuguuaaucaaauucaaaauauacuauuuauuaagaugaguucuaugaguuuauacauuuuuaugugucauaagauugaacugauuuucacauuaccacaaaauuuaaaacuguugcaaaccuuuauaaauuuuaucucuuuuuaaagauaucuaacugauuuugagccaauucaaugccugggacgugguggcuuuggaguuguuuuugaagcuaaaaacaaaguagaugacugcaauuaugcuaucaagaggauccgucuccccaauagguaaugggugguaccuucaguaaacuugaaaucagcacagugugaucuaaucucauggguaaaauauccuucuuacuguacucuguaaacaccauagaaaacaguuucagacguuucaaaucuuagguucuaagugcugccaauuaaccagcugucuaaaaguuguuaucucuauagguugcuuucuaucuacuuuuaaaauaugcccuuguuuuuuauuauuaacucaggacuuucguuuaguggcuuauaauaacuguagaccaguaaauugcagcauuuuaaaacauucuauauuuuuguauaaauaaggaaaaguacuagaacaaaaacauuugaauuauauugucucuaccugguaauaacuauuaacacuuuagaguauuuccuuuugauuuuguuuucuggucauauauuuaccuaacugguagccaguugccaguacuguacaguuuugucuguugcuuucuucaucauauccucuauauuuuucauguuauuaagaauauguuauuagaauccuaaaauauauuaaaaguauuuuauggcuugguaauaguccauuuaauacacgugccauauuuuguuuaaccauuucuuauuguuaaacaauuugguuucuaauuuguuagaauuagaaauaacuuuaccauaaaaaaaaccuuugcaguauucaucuuuuuauguaccuuuugacaauaucuauuuccuuaggauagauuccuagaagugugauuucuggcucagaacagugugaugcuuaagaugauaggguuccagcaauaccuuuuauucuaacuauguagaaggcccuuguugcuuuuuuuuuuuuuuuugagacagggucuugcaccgucacccaggcuggagugcaauggcacaaucucggcucucugcaaccuuugccucccugguucaagugauucucaugccucagccucccgaguagcugggauuacagacacccaccaccacacccagcuaauuuuguauuuuuaguagagaugggguuucacuauguuggccaggcuggucucaaacuccugaccucaggugauccaccugcuuuggccucccaaagugcugggauuacaggcaugcaccaccacacucggcuaauuuuuguauuuuuaguagagacaguguuucaccguguuggccaggcuggucucgaacuccugaccucaaaugauccacccgucuugcccucccgaagugcugggauugcaggcaugagccacugugccuggccucuuguugauucuugauuaaaugcacacuaauuguugugcugucaucauaucugguagucacagcuuuuucaaauuccugucugguagguacaggaauuggaugguuuggguacuagggaacuauuuuuuuucuuuugguaaauaacuuuugaguaguuuaaauauucauaugugccaggcacuacauaagugauaaaaacugagcaagguuucugcccucaagaagccuguaccuuuuuggugcuucuguauguacacucaaguaaauacaaugcaagaaagauuuugaccuuugccuuaucuuaguaaauauuaauagcuucucaugaagaagagcagauguggccaaaaggcagucaaggaagucaagcuucuuagaaauggcggcauuugcucugggugcucaagaguagccuuucccucaguaggagacagguggggagggauggccaagugcaugaaauggcccgagcaaaggcucucacaagcacuuggaggugguauggagaauggugagaguucuggaguagauggaacaaaggguaagaauaggggaggauggaagagaggaagaaaaagauagguuggccagguacaguggcucacgcuuguaaucccagcacugugggaguccuaggcggguggaucauuugaggccaggaguucgagaccagccugaccaacaugacaaaaucucaucucuacuaaaaggcaguuggagguuacagugagcugagaucgcaucacuguacuccagcgugggugacagagugagacccugucucaggaaaaaaaaaaaaaaagauagcuuguagcaccuuaaaugccaagcaaagaaguugggauuuuaaaacuuuauuuguacgugcaguagaugcgcuuguagcauuuauuuccagaagagaaaaacaaacaaaacugaaauacuuguauuuuuuaaaauacaggacuuguguggccuuuuagaaguauacccuaggcuagccgggcacgguggcucacacuuguaaucccagcacuuugggaggccaaggcagguggaucaccugagguuaggaguucgagacuagccugaccaacauggugaaacccugucucuaccaaaaacacaaaauuaccugggugugguggugcgcaucuguaaucccagcuacucgggaggcugaggcaugagaaucacuugaaccagggaggcggagguugcagagagccgagauugcgccacugcacuccagccugggugacagagcaagacccugucucaaaaaaaaaaaaaaguauaaccuaggcuaacucaucuguuucuaauuuuaguuucaagaaaagauccuauuuuauuauuuuucuguuuucacuauuagauaugaauacuucagauaugaacagccuucaguguugucuuacuuucucucuuuuucaggcuaauuuuauuucuuuaauuuuccuuuuuuauugguauauaauacaucuacauauuuuagggguauaagucauauaauuuguaaagaucaaaucaguguaauuggaauauccaucaccuuaaauauuuucucucuuucagggaauuggcucgggaaaagguaaugcgagaaguuaaagccuuagccaagcuugaacacccgggcauuguuagauauuucaaugccuggcucgaagcaccaccagagaaguggcaagaaaagauggaugaaauuuggcugaaagaugaaagguaacuaacuuuguuacacauacacuuaagcuaguuuuuugcuugugugauuacaaugucaguuuuauaacuuuagggauuuuuuuuuuuaaagaaaaggaacagcagaguucuguuguuucauguuuugaaaaguucucuagccacuugugaaauuuugguuuagauuuugagaacauacacgggugacucaugccuguaaucccagcacuuugggaggccgaggugggaagauggcuugagcccaggaguucaagaccaaccugagcaacauagugagacccugucucuuagaaaaaauaagagagaacuuacauuuuaaaaaauuacuaguugauaggacucuauacauugugauugauugagggauuuauagugacuuuucucaguauaagguaucugcuucugucuccauuuuuuaaaaauguuuguuauuuaguucucuuagcaguuaacaauuuacagcuccuuuuuaaguaguuuugaacuauuugcaguuaaaaauacauaaacuuagccugaauauauuguccauauuaacuaugaugugcuauaggaaggaaggcccuuuaaaaacuauuaaaggagaagaaaaaggaagcauguguagauagacugccaccaaacaacuggagugaaacuccuaccuacagguaucuaagcaacauuagauccacgugagguaccuuguuaaaguggugcuuauuauagacucaaccaauaacuaagccauagaaggaccaagugaaguggccccaugucucaaggccuugugaggcgcugcccuuuuagguuaauuuuaagccaccaaggaauccuguccucacuuugcauaaaaggcuuuggcugcucuggcagccccagacagucccagguaacuguuucauguauaaaauuaagcuuuaaaauuaaguuuuuuagaaggaaugaauggaaugugauguucuguaucucacauugcauguuuuuauuuaguuuguauguuguuuuguugucauuugguaaguggccuuauuacaguugaagcuuuuuaaacagagggugcaguucagguacuugaaucaauauauauucacucuuaccccuuuguauuucucccacuuuuagcacagacuggccacucagcucuccuagcccaauggaugcaccaucaguuaaaauacgcagaauggauccuuucgcuacaaaagaacauauugaaaucauagcuccuucaccacaaagaagcaggucuuuuucaguagggauuuccugugaccagacaaguucaucugagagccaguucucaccacuggaauucucaggaauggaccaugaggacaucagugagucaguggaugcagcauacaaccuccaggacaguugccuuacagacugugauguggaagaugggacuauggauggcaaugaugaggggcacuccuuugaacuuuguccuucugaagcuucuccuuauguaaggucaagggagagaaccuccucuucaauaguauuugaagauucuggcugugauaaugcuuccaguaaagaagagccgaaaacuaaucgauugcauauuggcaaccauugugcuaauaaacuaacugcuuucaagcccaccaguagcaaaucuucuucugaagcuacauugucuauuucuccuccaagaccaaccacuuuaaguuuagaucucacuaaaaacaccacagaaaaacuccagcccaguucaccaaagguguaucuuuacauucaaaugcagcugugcagaaaagaaaaccucaaagacuggaugaauggacgauguaccauagaggagagagagaggagcgugugucugcacaucuuccugcagaucgcagaggcaguggaguuucuucacaguaaaggacugaugcacagggaccucaaggucuguauuuguggagcaucacccuugggguuucaaucugacguuuugugauucagagcaguacuugcaguacucugaaggauccuuaagaguuggggagaguaaaagcaucugagagcagaggucugagaaaguagccucgaaggggccugcugcaagaauaagaagucuuaugucugaaaacuuuaggcaaaccaugcauucauugucuucaguaauguguuuguguucauuuuacuguaaaagguauucucaguaguccaggugagggaaaaaaaagaaaaaagaaucuuuagguaaaauccaccaugagcagauauagccuguuuuuuuguuuguuuguuuguuuuuguuuuucuaugguuuugaguaacccugacaccaauaccuccagggcucugaagcagcauggugaaagggauccgaauggaaggagagacauggguuccuucauuagccagcuugaauuggggcaaaucuccacacuuuugcuucuuuuucugaacuguuuagacuuugggggaagggguaagaagccgaauggggaaagguagcaaauaguuaacagaugacuguuuacagcucuaaaaccuuggauucuauuuucaauauauucaguagugaauuuugcaguaauauaauaugcaaaauuauuaaagagucuuacuaaaacaugacauuuccguaguaguguuucuaaaaauaaguacauggaacuuuuauuuaacuaauuucccacauuccauauacucuuagccaucaccaguagauguggagugaauguauaaauacuuuucugaugaaaguagcuuaaagucuugauagauguggauccauuuuaagucuuuucagacuuaaaacagacuuguuucaggcacaaaaguagcuauuuggacacaaguuauuuucuucuaaaaucagcaguagguuuucaaauucuuggguauauuuuaagaguuuuaggguaacaagaauaggaauuagaaauaauucuuauuuuuuaauauaauuguuauuuagucauauaaaucauuaugcuucagugauuuugacgugggcccaaacugauugccaagaauuguucugcacugaaugaaaaguucagagaugaauuauuugguuggauuggagaagacaguuuacaggagaccacacaccccuaauuugagagaauacuagcaguuagguuugaauauaguaaacgcuuaucacuaggugggaaacagcuagcugaaauacacauucuucuuguacuuaacacuugcuguacacacaaaugccaacuugaaagacaaugaaucauguuuucacuaauaaugaauauucuucugcuaauuuuauaauguaaaugagauauugguaaauauccauuuaaugcuacaauguugucuaaagauuuuucuguaauugucuaugcaccagaaaaauugcaagaagaaaguuaauauuccuguuaguuuuucuagaaaucagaaaguuuuauuccuuucuaaauagaagacaauuccuuuuaaagauuucuagugcgccacccccaaccaaaaaaaaaaaaaaagccaagauuuuuguuccugggugaaaaagcuguacauuuugcuacguucugaccuaaaucuuugagcucaauguuaaaccuucuaggcccucucccccuguuauauuuuggucacauuuuugucuucaggacuuuggcuccugccucuucagacuaacuucuagucuucuauuuucuccacucugaacuuuucucaguuccucuugauauacacuguucugacagaaaccugguccuucuucauuauucucaucacaccuggauuauuuauucugugguuucuaugggguaugaaccauaucuguuucuuuuaccuguuauagucucaguacaaugccugaauguucuagauggucauaccauuuauuuugaauuuuauuuucuuugcacucaaaaguguuuauacugacuuaaccagaaaaggaaaucuguuggcccacauggcuaaacuguugagaauucagguaaagcuuuagcugagaucaagugauuuagccagaaccugguuucuguccuccccauuucuuguuucuauuuaagucuuuuggaguuggugggguagaggguggagagaaaaguauugcuuuuucccacuaucagaaauuuuauucuacuuaaaccaaggacaccuacccaucccucaacaaucccuagccaggcaaugggauuccauggauuggcguaagcaacuuuuagagcauggaugccuuccacacuaaccgugggguuuugcugcacagucagcaagaaggaaguucccaaaguaaagucaagauacuucugcuggaagcacagggagauagauacuggagagccaaaaagcuugucuauuauaggguucaguaaauaacaacugccaucagauguugggaguugggaagaaagaugacauuuaaugcaggauagucuauuauugccucugguacaaaguuauuuauuggagagcugcagauuauuaccauagaucuuauacacaauaacuucaugcuuccaagucaaaaucguuuaaugguauuuuagaguuugggaaugcaauguuauuuucuggcaguauuugaaacaugaugaaauucaauuucaugagcuaaauggcuuccuuuuuccucauuucaagggcuaugaaugguggucauauuacccgcagaguagaguagacucugagggagaggugauguauuucauguagggcaccuuggguuugagaagcccaugagaccucugguuagauguauucaauaaacaguguaauaugaguuuagaacucagggcagagaucugggaguagauauagucuugagaacauagagguuuuacgagaggcagcauagaguaguagugaagagcucuuaucccuucugauaaucuauaucccccucagacgcaaaccaaaagaucagucuguuucauucauucaccaaauaguaauuagcuaccauagagcaagaacuggacugaaaucugggcacguggcaguggaucacaagguccuuuccucauagagccagacugcucaggucugaaucccugcuucaccacuugcuaguuggguaaccuugggcaauuuguuuaacuucugggccucacuuucuaugucuguaaaaugggguuaguacucaucuaaugggguuguaguacaugaguuaguaguaguaaacugcuuugaacagugccuagcacauugcaaguucuauuuaugaacuaguuauuauuaguuauaauuauuaaggcuuuaagucauaaguguagagaugcuugccugggaagaauauauagaauaauaagauugaggauuaaguaccaugaucccuagggaaugugcaccucaaaggguuuaaguagauguucaauaaauacuagcacucuuugcuacccuucccuuuucuuuacuagcaguacuugucuggcacagaaaaauugucacuauuuuccuguuagcccauuuuaaaaagaaauaugcuugaaaauaucuaguuuguuguauuuuuucuuuguagucuuuuaaauaauucucuuuacuuuuucgccuccaugcacacccacuguacuuuugucuguuguauucuuuccagccauccaacauauucuuuacaauggaugauguggucaagguuggagacuuuggguuagugacugcaauggaccaggaugaggaagagcagacgguucugaccccaaugccagcuuaugccagacacacaggacaaguagggaccaaacuguauaugagcccagagcaggugaguuuuucagaccuuuacuuacuagcacagcagcagauguaccugaugaaucucuucucauguuuucauuaaaauacccaguaaucuaaaacccaguaagucugaaaauuaugaaaacuggcaguaguguuccaguaguggaauagugacacagcuaagauguaguuucuacaaccugaauuggggcuggauuaagaaaaauacaacacauaaaaugcacucacccccugaacaagcaccugacagcaaccaggaauuuggaaagagacuuugaaugccacccucccaaacuuaacucguuugccuuguguagacuguguuggaacuguuuucagagccagcuagacccagagguacuauacugagcugcccuuuguggucacucauaggcaacuuccagcauguaccacaguaggaaauagaggcacacaggccggcagguguugccuugugggcugcuuggccuucacaggaaaagcacuguaaucagggcagggacuggaagagcugggggagcagggcauccuggaagcaucaggcgagcaugcucagccaccaccaggcaaaugaucuucacaagcuucucuaugcuuagagcagcgggucucggacguuuugggcucaguacauacuuacacuuguagaaauaacugagaacccaaaagguuuucuuaacaaaauuuuaucuaucgauauuuguuauauuagaaguuaaaagagaaauuuauaaaacuuuauuaaaucaacuaaauaacaaugaaaccuaucacaucuuaagauauuuuuaugaaaaauaaguauuuucuaaaacaaaaaaaaauuacaggcaccaauuccccugcaaaaaaaaaaaauuagagugacauuuguuuacauuuuugccagucucuuuaaagcuaacuuauaaaagugcuacauucuucuaucugcuuuuguguucaaucuguugcaguauguuauuuuggcugaaguacaugaggaaaucuggccucgcacagauauguaguuggaaaaaagagcaauauuucauuucaaguaauuguagauauuuugucuuugauaguauaucaaaacuuaguaaaugauaguuucuuagaagucauuuacacuguggaaucuaaaaccauucaugaauauuuuguacucugguacuuuuaacaucccuugguccauuuuguacuuugaauggaucuuuuuacccaugcuugacuuuacauugugcauuagucauuuggaaacuauugguucccuaaguuuggcaacuauuccaaaagucaucacaguucauuauguaauauaaaaagucacuuugguuaauacaaccaccaaucucaccagaaaaggcuuuauguacauauuaggaggcuaucaaauucccacugguagacugaaaucuuccaaaauuuuaauuuucacuuaaaagcucaacuuuuaacauuggcaacaaauacuguuaguuuuccuugaaaugccauucucacauuguucaucuuuuuuucucuuuaaaaaaaaaauguuguuuguuuuuuuuuuugagauggggucuugcuguguuacccagacuaguuuugaacuucuggccgcaagccauccuugaaccucagccucccaaagugcugggaucacaggcgugagcuaccaugcccggucucauuguucaucuuuaagaaagugucccucggccagucgcaguggcucacaccuauaaucccagcacuuugggaggccgaggcaggcagauuaccugaggccaggaguucgagaccagcauggccaacauggugaaaccccgucucuuguaaaaacacaaaaauuagcugggcauaguaacgcaugccuguagucccagcuacccaggaggcugaggcacaagaauugcuugaacuuaggaggcagagguugcagugagccgagauugcaccacugcacuucagccugggugacagagcaagacuccaucucgaaaaaaaaacucucugucaaguauccaagucucaauaacuguaguuugucuaccaauuauucuuucaagucaaaaugguguucuaugaaaagagcagcuagagcauauuguaacucaaauaauugcacaaaugcuaaugauacucacaagcuaaucuaugcuuacaucagcaggucucaacuucuuaaaauuaguuuguuuuuuaaauugacucauaauuguacauauuuaugggguacauacugucguuuuaauacauacacuauuuagugauuggaucaggguuauuagcauauccaagguaucaaacuuggagacaacuauuguacuuugguauggagcauaaauguuuuucugaauauuuuccauuuugucagauuauuaaaaagguguauauuuaaagguugagauuuaauaaauuaauaauuucuacugcuaaggacauuuuaagugaaauguuuuuugguuuugccugugagcacguggugcugaagaauguaauugcuacugguacagcuuggcacugcucgcuugauucaugcuuagguucugucagugcaaaugucaacacagugaaaaauuauaucuuaguauuauuaugaaaauagucuuggccuugcagaccuuuugaaaggguguuagggucccgaggaauccauggaccauacuucaagaaccacuggauuugacuaucuuugaaagauuauaucagagaccaguaauaggaacugccuuugaggagggcaaguuuguuuuacugucauagagcauccuuuugaaguguuugcauuguuuaccuuagucaaguguuucuuuuuugcaaugugaauuuuuauuuuguauuucgucuuugaaggagauugcagugagccaagauccugccacugcacuccagccugggcaacagagcaagacucugucucaaaaaaaagaaaaaagaaaucaagcauuuuuacauauuaagagucaaaaaaguaucuuaagugaaaaaaaacaaaaugcagaaauguguacaccuuuuguguaaaggaggaaaagauagauauacauuugcuuauguuuacauuaaaaaacucuggaaugauguguaagaaacaaauggcuaugggggcaguggcagaggggaaguaacugguggggcuaggccagugagggacagagugagagggaacuuuuacuguuagcucuuuuugagccaucugaauguguuaccuauuaaaaguuaauuugagaugagaaauauauaaaaauuggcaauagacaucaaacccaaugaacgauaugugccaaugguucuugugaauauugauaccaaaaugagaauaaaauccaaaauguauuccuaguaaaagacaaauaauuuuaaguaugcuuaucauuauaagcugaguuugucauuccuauauuaaauuaacaaagauuaggaaauggacgaugguaagaacauggaaaauaaagaugggaauagggauuuguacuugauguagcuaaguuuggcaaauagaauaauaaaacaauauuucuaccucuguaucacuuacagacgacaaacacaaacugcagcaaagggaaaggauauggaaauacaagugaugcuaaagccaaauauuaguuaugacaacaaauaaauagauguguuuaaauauccccaugaaagggaaacuucagguuggauuauaauuuaaaaaaaaaaagguuagaaagggaagcuagguaaaaaaauacuaagcuuuauauacaguugcuauuugaagauuuauugaugaauaaauuauaauuauauuuacuuucauuuugaacuucuaggccacaaagaaauaucauggauauuguaaaugccuuuuuaugauuauaauauauuaaaagaaggguauagugguguauaaauugauuuuuauaauuuugucuguuuuuauuuuugcuuuugcuucuguuuugcuggcuggaaauuuuauuauuuuuuugagacagggucuuugucacucaggcuggaguauagucaugugaucuuggcucacuguagccucugccuccugggcucaagugauccucccaccucagccuuccaaguagcugggauuacagguccacaccgccaugcucagauaauuuuuuuguuuuuuguggagaugaggugucacuauguugccaaggcuggucuugaacucuugggaucaagcaauccucccgccuuggccucccaaagugcuaggauuacaggcgugagccacugugccuggccaacuggaaauuuuaaaacccuccuaaauaacuaucaggucaauagaugauggguugauaagugcagcaaaccaccauggcacacguuuaccuguguaacagaccugcacguccuacacauguaccccagaacuuaaaaaaaaaaagaguuuuuaaaaauaacuaucaggucaauaaugaaguaaaaauacucauacaaaguauuaagaaaaugaugaaagaagcugggcacuguggcuugagccuauaaucucagcuacucaggagggugaggugagaggaucacuugaguccaggaguuccaggccagccugggcaaaauagaccccaucuuaaaagaaaauguaaaaaacuuuuuuuaaaaaugaaagaaaugaaaaauagugaaaucuauaggaaguuuucaaaguuccauuuggagauaaauuuauuuucaggccuucauuacauagcacauuacuguauaagagauuagaauucugcucaauagaaggcagggaggagccaagaagauggaaaacaaacauaagaauugauacuggugaaacaguaaaauagcaucaccaugguuguuucuaauaguuuaaaauaaagauaauccucucuagcauagauaccuacuuaaggggggaaaaucacaaauaaauuuagaaauuagaagagauacagaagagauuuuuauuuauaggagacuuucauauauagucaauugguugcaaccaaaaguauccaaacuggcuuacguagaaaaauaaauaaaauaaaucuauuggcccugguaauuaaaucauccugcucaaaugaucuggccaagggguggugaaaggaaaaauuaaaacuguaugaaauaucaaaauacuauaaauacauauuucuaucuauaggaaaaaagacuagaagagccauaaaauaucaacagucauugcuucugaguagugggacuucaaaugaauuuuaaucuauuuuggacuuuucuguaugauccaauuuuucuacauagucauacaacagaauugauauuaaaaacaguuuugguugggcaugguggcucaugccuguaaucccagcacuuugggacagguggauugcuugagcuucagaguucgagaccggccugggcaacauggcgaaaccccaucucuacaaaaaauacaaaaauuagcugggcauggugguguaugccuguggucccagcuacuugagagacugaaguagaaaggaucgcuugaggcugggagguggagguugcagugagccaaggucaugccaccgugcuccagccugggugacagagugaaaccccuuuaaaaaaaaaaaaaaaaaguuuuuuuggccaggcaugguggcugacaccuguaaucccagcacuuugggaagccaaagcaggcagaucaucugaggucaggaguucgagaccagccuggccaucauggugaaaccccgucucuacugaaaauauaaaaauuaccgggcaugauggcaggcaccuguaaucccagcuacuugggaggcugaggcaggagaauugcuugaacccaggagggggagguugcagugagccgacaucuugccauugcacuccagccugggcaacaagagugaaacuccgucucaaaaaaaaaaaaaaacaccuuuuuaauuguguuuuuaaaaauuuauuauuauuuaagaggcuggaaauaauacuuuuacauuuuaaauauugugaaaacaaauaaaaggaauucuaucuggaugcuuauuaaugaaggcucacgacuugggaagccucucucacccaguccuauuuaaaagagaugcuucucccuucacucccugccuggguccaucccauuacacugguuucuuuuuacagcauuuuuaacucuuugagguucuuuuuucuuucccugugaaauauaaacuaucaguauagggacuuagcuugucucucauucuacucuuaacaccugaaacaacaccuagaauguggcauaguuucauaaguguuugguggaugagugaaggugaaugcuagugaaaagaugaacaccagguagucccggccaccccauacacacuucugugcugacuguaguguggcuuguggcugcugugugugugugugugugugucuuggaaauggguugccauuugagaaaggaagagguugaugacaacugaagcuauauuucguauuguugaaaauacuagaaaauuaggauagcuguagaaauuuuauggcaauguauagugguuaaaauuugguaguuaaaaauggacagucuuaauuaucuucuuaauccucuuuaaacauagaaacugucacuuuauaaagugcuccuuaaaaagucacacaaaauauuugggcuguaugaauuguacaaucuuacccaagccuuagaagcuauacuaaaacauuguuuuaaaauuauuuauuauuagaacucucuuaauuuucucauccuugaaauaaaugagcaggacccaugguuacuuuguucuugguuguaauuacgaagaaacacagguuaaguucuagauuugcacacagcgauuaaacaauucaaaggauauauucuagguccuaauuccuuauuuuuuagauauuuuguaaauauaacuuuucaugcguucaugaggcuacauuucuuuuuuuaaauauguuuaaucacguuagaaacaauaaauaaauuuaguaacacauuauauaucuaucuguccucuagggaauacagaaaguauagggacauauaacaaaaaaguaaaaaucacuuaccaaaaauaucuguaagacauuaacagcaguuauuuccuuuucucucucuguguguguguauaucuauauacaccuuacuuuagaaaauaaaauuggaauucuacucuaacauuuuggauacaauauuaaaauauaaguauuucccauauuauuaaauauucuuagaaaagauuuccagcugcauaguauucaacauucauuugggacauuuuaauuacuuguaaauuuugcuauuaggaauaucacuuggguaacuaucccuguacccaaauacccaaaugucuguacacauuuccaucugcccuaggguggguaaaauuagauggcaucauuaagcaggaguaaacauuuauugccaaguugcuucuuauaaauuuguguuuauuuauauucuccaaauagugugugaggguguccuuuucaguuccccuauaagauuuguuuuugcacauuuuuuuuaacacuuccaaaaccccagggauaagaagugagacaggguucagauugcuacagucucuuggaagggaagagggugaugccacugauguggucacugaagcuuuccaucugcucuucuauaaguacagaggcaggcaggcugcgcagaaggccagggagacagaugccaaguacgguuuagaggggaaguugugaagggaucauaaacccuggcaacugcccugugaccaccucuacuucccaguuaagaaguacugguauggagcauuuccaaaguucccuucuuuggcaguuucucaaaugucauguuauaucucuaaagaaauuuucacaaauaaagggguucuucugagucaccaaaaggucaauuuuaauuuaaauaaugcuuucuuuagucgaguaguucuguuguaauucauuuguucauuuuaacaacuaaguauuuauugagggccuucucuauacuuagccccagugcuggacgauagcaacacaaaagaagcauuucccuuccuccaggacuugauaaucuaguugugaagaauaagaaauauacacaugaaaaauacaaccaagaaugcaaaguauccguaauuaagugcccuaaugaaggcuaacuacaguugauuagugguuuggaguaaugaagauuuucucauaaaaauggguuaggacuaagaugauuagaaaugaaagauuugcuuuagauagcguucccuuugaaaaaccucaccucagggguagucgagcagauuuugcuggcucccacaaacuuuuuuagcauggcaagucuccagguuuccgaggggccuguuuuacugaugcauaucucagagcuauaccugggcuuuccuucuguaaugcugaguaguuuaauuacucuugguguaguagugaagaaaagagacuugggagauuaacucuuugcuaacauuuuuacacauguacuugcauuuaaaccaagaagugacuaaguaaacuuugggauucaauaaugcuguaauaucaacuguacugucucuguguuaauuuuuaaauuuucuuuaugugggauuucagauucauggaaacagcuauucucauaaaguggacaucuuuucuuuaggccugauucuauuugaauugcuguauccauucagcacucagauggagagagucaggguaaguacccucccuacucaaaaaaaaaguuucaaacagaaaauaaucuaacauuuacaaaagaguuuuuuaaagacuuaguucuucuuaauaccagcagauugguuaacuaaaagugaaagaggugaugugaguaacacagagaggaguucuagacuauuugcuuccauuuaaagcucagucuucaaaaacuuguuugguuagauuguuuguucuuaguuuuugcuuaaauucaucauaauuuaacaauguuuugcacucaguaaguuuguuauaaguaaaaaucuaggggaaccacaagguaaugggggccacacacucauauauuuaaaagcuggcagauuaagcauaauuagguuucuuuccucucaaaauaaaccaugaccacagccuuuaaagcagauaguacugaaagucuuuuuuuuuucucaaggcaaggucuugcucugucgcucaggcuggagugcaguggugugaucacagcucgcugcagccucaaccuccugggcucaagccauccucccaucucagucuccccaguagcugggaccacaggcacgugccacuaugccuggcuaauuuuauuuuauucauuuuguagaaaugggcucugccuauguugucuaggcuggucucaaacuccugggcucaagugauccuccugccuuggccucccaaagugcugggauuauagggaugacugaaagucauuuuaaaguagcccucugggccgggugcaguggcucacgccuguaaucccagcaguuugggaggcugaggcagguggaucaugaggucaagagaucaagaucauccuggcuaacacgguaaaaccccaucucugcuaaaaauacaaaaaauuagccgggcaugguggcacgugccuguagucccagcuacucuggaggcugaggcaggagaauggugugaacccgggaggcggagcuugcauugagcagagaucgcgccacugcacuccagccugggugacagagugagacucugucucgaaaaaaaaaaaaaaaguagcccucuggccaggcaugguggcucacaccucuaaucccaacacuuugggaggcucaagcaggaagaucacuugaggccagaguucaacaccagccugggcaacauaguaagaccccaucucuacaaaaaauuuaaaaauuagcaaggcaugguagcacaugccuugagaggcuaaggcaggaagaucacuaugauugugccacugcacuccagccugggcgacacagcaagacccugucucugaaaauaaagugggccucugucacauucuucccuaucuuucauaaguagcuacccucaccucuucuaguuguugucccugguacuuaucuccauauuuucaaaguuuaggcucuugucacuauuucuuauuuuaucaguuuuagaucuuacuuauugaucucuggccaugguagaagaggauguaguucucacauagagcaaaaugacucauaucuucuaaccgaaaggaccuaccaaauguucuguacaaugaaugaaaaaaaaaaaaaaacagucaaaauaaccauuuucagaacaccagaaauaaaggcccuaaaagcuuccagaaaggaaaauaaaacaggucuaaccuaaguaaaggaucaagaaucagauggcaucaaaauuuauauaguuauaaaugccucagagaauacugucaagaaagugaaaagacaagguggacgugguagcacaugccuguagucccagcuacgugggaagcuugaggcaaaaggaauuccuugagaccaggaguucacggcuacaguaagcuaugauuaugccugcaaauagccugggcaccaugagacccuaucucuaaauaaauuaauuaaaugaaauagaaagugaaaaggcagcucacagaaugggagaaaauauuuguaaauccuauauccgaaaagugucuagaauucagaauacauaaagaacuauuacaacucaacaaaaagacaacucauuuuaaaaaggggcaaagcaauagaacuuucuccaaagaggauaaacaaauggccaauaagcaugugaaaagaugcucaacaucguugggcauuagggaaaugcaaaucaaaaccacaaugagauaccacuucagcaccaucuaggguaucuguaauaaaaaaauuaaaaaaaaaggaaaugucaaguguuggcuaggauguggagaaauuggaacccucauacguugcugguggaauguaaaauggugcagcugcuuuggaaaacagucuggcaguuccuuaaacaguuaaacauagaauuaccauagaauccaguaauucuacuccuagguauguacucaagggaaaugaaaacauagacaaaagcuuguauacaacuguucauaugagcauuauuucuaauauccaaaaguagaaaccaccaaaaugcucaucagcugaugaauggaaaaacaaagugugguauuuuauacaaugaaaaguauucaaccauuacaaggaaggaaauacuaacaugugccgcaacguagaugaaucuugaaaacaugcugagugaaaaaagccagacacaaaaguccacuuuuauaucauucaguuuuuaugaaauauucagaagaggcaacuccauagaaacaaagauuuccaauauuuucuuugugcuuuaauauggcccuuucucucucucucucuccccuuucucuuucucccucccuccacacauacauauauacacauauauguaaauguacauacacacacacacacacacacacacacacacacagucaucuugguauccacaggggauugguuccaggacucccuguggauaccaaaucugcagaugcucaagucccuuauauaaaaugguguaauauuuguauagaaccuacauauauucuguguauuuuaaaucuucuguaaauuacaguaccuaacauaauguaaauucuauguaaauaaguauuauacuguauugaugagggaauaaugacaagaaaaaaaucuguaucuguccaguacagaugcaaccaucuauuuuuaaauuuuuuaaauauuuucauucugugguugguugaauccuuggauguggaaucuguggauguggaagaccagcuguauauuuugaggauauuugauggaguguacaucugugcucaggaaacauauguaguuauuaaaucaggaaaagcuauugauaaauuuuccauuugauagauguacaaccucuuagucauuuuguuagaguaucaaaaaauauuuucauguuguaugucaaaauaaacuuaauaagugauacuuuuuuucuuuuuagaccuuaacugauguaagaaaucucaaauuuccaccauuauuuacucagaaauauccuugugagguauguguaauucucaucuuuuaucuucuuuagaaucaucuuuagaacguaagcgguccuuagcagucgacucaguuuccccuauuuuacagaugaggaagccaaaggucuagagaggaaagagaccugcucccaagagcccagaauuuguuaaaaccaaacacuggagcuggggccuggcuccuucagccuaauguccaguguuccacacuguagcaccugugaaauuuauauauugauaaaucuugaauuuccuuaaguaauuaaguugaagugaguuaguauguguucauuuucaaauuggaaaaagucaaaauuuaucuuucaguauuauaaugaaggguugcauuaaaaaauggacuuuauaacaauauauuaauaccuacauauacuuaagucuguuuuacuaaaaauugucaucauguauuuugcaaacuugaugaaucuauucccaggguggcucauaagaguacauguuacguucaaagagauuuuuaaaaaccaagaaaagguguugguugcugaucucugccauaauuuuuucuaauuaaaauuucuauugagauaauuguagauuuacaugcaauuauaagaugauuuuuaaaaaucauauuuauguuucagggaugugauuaaauaauccuuuauaauguguuagaaaaucaaauuacccaaaaauuguccauguuuuuuuggaaugaggguuggcaaacuagugcccacaggucaaauccagccugccaccuauuuuuauaauaaaguucuauuggaacacagccaugcccauuaauuuacaaauugucucuggaugcuuuugugcauugacggcagagcugaguaguuguaucagagacuugaaaacucgaauauggcucaaaagcuuaaaauauguacagaaauauuuugccagcacugauuuuaaaaacuguacagugaucaaaccuggccguuuuaucacaaaacaauuuuuauauuuucaguacgugaugguucaagacaugcucucuccaucccccauggaacgaccugaagcuauaaacaucauugaaaaugcuguauuugaggacuuggacuuuccaggaaaaacagugcucagacagaggucucgcuccuugaguucaucgggaacaaaacauucaagacaguccaacaacucccauagcccuuugccaagcaauuagccuuaaguugugcuagcaacccuaauaggugaugcagauaauagccuacuucuuagaauaugccuguccaaaauugcagacuugaaaaguuuguucuucgcucaauuuuuuuguggacuacuuuuuuuauaucaaauuuaagcuggauuugggggcauaaccuaauuugagccaacuccugaguuuugcuauacuuaaggaaagggcuaucuuuguucuuuguuagucucuugaaacuggcugcuggccaagcuuuauagcccucaccauuugccuaaggagguagcagcaaucccuaauauauauauauagugagaacuaaaauggauauauuuuuauaaugcagaagaaggaaagucccccugugugguaacuguauuguucuagaaauaugcuuucuagagauaugaugauuuugaaacugauuucuagaaaaagcugacuccauuuuugucccuggcggguaaauuaggaaucugcacuauuuuggaggacaaguagcacaaacuguauaacgguuuauguccguaguuuuauaguccuauuuguagcauucaauagcuuuauuccuuagaugguucuaggguggguuuacagcuuuuuguacuuuuaccuccaauaaagggaaaaugaagcuuuuuauguaaauugguugaaaggucuaguuuugggaggaaaaaagccguaguaagaaauggaucauauauauuacaacuaacuucuucaacuauggacuuuuuaagccuaaugaaaucuuaagugucuuauauguaauccuguagguugguacuucccccaaacugauuauagguaacaguuuaaucaucucacuugcuaacauguuuuuauuuuucacuguaaauauguuuauguuuuauuuauaaaaauucugaaaucaauccauuuggguuggugguguacagaacacacuuaaguguguuaacuugugacuucuuucaagucuaaaugauuuaauaaaacuuuuuuuaaauuaagu

SEQ ID NO: 14686 - RNA, 450 nt, Homo sapiens
auuugucaggggacauugucugcaggcacucagaauaguccagcauuuggcauagcgacguaggcuuuccuacaauacagcuucuaacaaaacuaggcuguccugaaccccugguaauagaauuguucaccuuuauaccaagaagguugggaaagcaccaaaaucugcaugugguguguacccaggccgacuucgagggguucgugcuguaagaccuaaaguucuuaugagauuguccaaaacaaagaaacaugucagcagggccuauggugguuccaugugugcuaaacguguucgugacagggucaagcgugcuuuccuuaucaaggagcagaaaaucguugugaaaguauugaaggcauaagcacagagucggaaagcuaaauaaauacgaaacuuuuuugaguaauaaaaaugaaaaaaaaggagaaaauuugccaagaagaaaga

SEQ ID NO: 14687 - RNA, 450 nt, Homo sapiens
ucuuucuucuuggcaaauuuucuccuuuuuuuucauuuuuauuacucaaaaaaguuucguauuuauuuagcuuuccgacucugugcuuaugccuucaauacuuucacaacgauuuucugcuccuugauaaggaaagcacgcuugacccugucacgaacacguuuagcacacauggaaccaccauaggcccugcugacauguuucuuuguuuuggacaaucucauaagaacuuuaggucuuacagcacgaaccccucgaagucggccuggguacacaccacaugcagauuuuggugcuuucccaaccuucuugguauaaaggugaacaauucuauuaccagggguucaggacagccuaguuuuguuagaagcuguauuguaggaaagccuacgucgcuaugccaaaugcuggacuauucugagugccugcagacaauguccccugacaaau

SEQ ID NO: 14688 - RNA, 5157 nt, Homo sapiens
uauucgaagggaagggagcccccuauaaaacagccuacaguggacagucuggucggcagagccgcaggucagucgugaagagggagcucuauugccaccaugaguuucuccggcaaguaccaacugcagagccaggaaaacuuugaagccuucaugaaggcaaucggugagugcuggacugaaaggcaaagcugugggucacaucagugagggucuagcucuaccagcaguggcuauuuaggguccaaauguugagauggggggagagauucaggcuauauacacaaacuagggggcauuuuacugacuucuggaguuauuugcagcaaguccucacugcacaaggccaccccauaggcaaguggaaagagcacugaacuaggguguggucuggauugauggccaugucauuggcacuucguugugugauccuauuccugcauuuauucauucuucaaacaaacagugauucaaggccaaccacacacugagcacugugcuggauagauaccagggagacagaugauaaaggcaauaaggcauuuucuuaucagggaagagaagagaagaaauaaagguaauaaggcauucccucagguguauggagcgcugacugugccaggcgacugugcugaccaugggauaugcaauaccccaucuauuccuugccaaaaaacuaagcuggguaccauuauuuucccacuuuacaguuaaugcaacugaagcccagaaagguuuaguaaucacaagcaaggucaugcaaguaggaaguguuuaaguuaggauuggaagcaggcacugguucucagagacccugcuuuaaccccugugccuccuagggucauguacaggaggauguggcucacagagagcauggggggauggcucaguggagguaaagagaaggcucaggcugagcuuuggaagacaggugucuagggaacugggggcagggagcaugcuccaggcagagggagcccuauaagcaaaggguguggcauggcaagggagggugccaagaaugagaagggugcugaagacagcaggggcagggagagaaggaccuucagugcugccagagaaggaucuucugcaggcaagccauaccaccucugugucucucaucucucccucaugcaacaggacccucugugcucacuguccacccacaaaauuuuugugaaccucaauuuguauaacagcauagacaaguucugaaacugguaaagcucuaucccagggcaagggauugcugguaugucuuccuccagagccuugacugcagagguggacacaggcuugccuggcacagugccgcuuuguguauguuggccuggcaugauuaucagcagcuccccuuucacuugcaggagggaccuagcuuggaagaucaacucucuggucaccagggguauggggaaugaaaugcucacacuccaagagcaaagucaucaaaggaggagggaaugaggaaggagagugagcaagaaccagggugcuuacaagaggaacgguucuucaggccagaagaguguccuuuuuauaaauugacuggcaagauagcagcaggccaggccaggucacugucccuuccuuucugaggccacagccgaugcugcugacaagcccccagugaguuucuguggccccuugggagacacagugcccuucucugucccuccaugucaugucguuucucucaccuaccuaccacggucaugaaacucccaccucugcccauaucuaaaccucagacgguuuccaccaggucugccggaagagcucauccagaaggggaaggauaucaagggggugucggaaaucgugcagaaugggaagcacuucaaguucaccaucaccgcuggguccaaagugauccaaaacgaauucacggugggggaggaaugugagcuggagacaaugacaggggagaaagucaagguaggagggcaucccuucugcugucagaacuuuccuuggaaccuggcccugggaccucauuccucaaggcucaaaccucacaauuccacccacagauaccaucucugaacccaccucccaugugggagaagcagagagacaaaggcagcucuuagggaagaaucuuauagagaagcugcucuccucuucccagggacugucugggggguguuccagccccuaaagucugagcucucccauauggaggauaugggagaaccaggcauacagcaggauucuaagucucagguucucccaggcccagugcuccuagcacuaagaguccucuaagcagggcccaggaguggggcaagugggaguuugugaaaaacccuuaacugagcccaaagucaacuggccuucacugaaccuagagcugguggugauagggagagacuucuugaaggaggugcuagcaauaccagaauaccagggccccagacaggugcucagacccugccuucagggguggucacaaagucucuggcuucagccaccccaucuguaaaauaagaacagucaaccucccuagacugaaggcagugcagggcagcaucacuucugcugggcacaacucauggugugcaaugacagcuggggugugggcugugugagugguuggcagaugguggcagggggauccuggcaaugggggugcccgucuccuccucccucugaaacacuccaugcucuagcagcccucuucucuccuccccguggacagcucuguucauugggcugggcguguuugcuuuuuaucucuucuggucacucuuuauuucugccucuccaauuagaacauuacaggucaggaugauuuuaggaggauaauauucuugaugugcucauggucaagggauuuaacuaugggccuuuuccaaauuuucuuuuuggaggcaaaauguuuaauguugcccagggucuuuggcucccugcuggguuccugucaucucuuccaggauguauaagggcuuggaaggaggccacaauaugaaaaguuaacgcucugggaagaauaauacauaccugguugggcggguggcucaugccuacaaucccagcacuuugggaggcugaagugaaaggacuguuugagccuaggaguucaagaccagccugggcaacauagcaagaccucaucucaauuaaaaaaaaaaaaaaaagaagaauacauaccaaagcaaaauauguauucucuacuggucaauauuugaauuuugccacuaccucccuccauuagcuugggagaauugagauuuuacuugauuugauuuuagcauuuguauuuggggccacuuagguguuccaugcucauuucuagaucacaugccaugaauuaaaguucugacaaaagaagucgugacauuuuauuuaguucuuaaaugcaccucacuucuauuuggagccagagaacuagaggcuugggaucauaggaaccagagcauuuugguuguuaugagcugagaccugugcaaaggaagcaacuucauuagcaaggcucuugccccccaccaccccuuccucacaggucaccucucuguucccugcagacagugguucaguuggaaggugacaauaaacuggugacaacuuucaaaaacaucaagucugugaccgaacucaacggcgacauaaucaccaauguaaguugguggugcucugagcguguggcucccagugcuugaggggagaggggaggugaagcauggggagcggcucacauacccuaaugccaccccuccacccuccaacccccaaacuucuuuccuguggucaguaucugccagcacuuacugaggauccaucaugucccaggcaguuuacacacauuaucacuaauccuuucugcucagcgcaaccaaccagccacagaggccuccaccugcccugcaugcccagggugcuucauaaaugccuuugcccauuuagcguuuauaaagagaaucccauucauggucauauuauggcagcuuacaagccuggcacaguccaguuaugcagucagccuuggugccuggcugccagccacauccuguacccuauuugggggugaauggugcaguguuucuccugcagguaugucccccugacucuucuuugcccccagaauaugcuuuagggagucacagacaacagaacacugccucagggcgcugucaucacucuauucaaauggaaaaauucuuaaacuagagagagugugagcaucaaccacccaaugugcaguuuccaccuccgccccagcacauucccaggagagcaggggagcaggagaugagcuauccugcaguaaguccuggccaacgcccuuugauagguuccaucucaccuaauccuccugucuccuucgagggaggcuggaugagggauucaauagacagguugaccuguccaagucaucagcuaauaaauguuaaauccagggcucaaacccaucaagcagcaacuauugcauugcugcugaaacugaggggcuccuuuucacccugaugacaugguaugucauuccagcagucuuauucaagagaacuggcagggguggaggaaacauccuuaaaaacucaaaagcugaugcauccacuguuuuuauaugcuucacagcuauaggaggacaauuaugcacuacccacugccuuccaggcugugugccuaguuguguccauguacauguauccuuggugcucaacauguauuuggugcauaguagguacucaaugaaauuuugagaaauuagauugggcugguuuggauggucuugcuauaacagucauugauguagaaaagaauucagucaaaggcaggaggacuuuccaggugaggaggagaagugacaaagacuuggcauaggauuuuggaaaacauugccaaccuuuccuccgguccuacaggaaaccagacgaauuuuugaauuguuucauaugccaacauauuuggugcuguuuuuuaagcuuaauuuuguuuuuuaugcuuaauuuuguuuuuuacaauacaacaucagaugaacacuucauaauuucuuuucuggcuuucagaccaugacauugggugacauugucuucaagagaaucagcaagagaauuuaaacaagucugcauuucauauuauuuuaguguguaaaauuaauguaauaaagugaacuuuguuuuaaaaaaaaaugucuucucaaugccuuuucau

SEQ ID NO: 14689 - RNA, 1546 nt, Homo sapiens
aagugcugagcaggaguggagagugaagagcaggaccucgugccuggguuugaaaaagugccugagacccaucuuagccgccccuaccugagcuuuagcagccuaggagcuauugcaccauaaaacacugcaaccugaggcugcauuaacagaagcaccacguccagguccagggagaauccagccucaccugcuuuuccuggccagcucaaagaaggacauugacaaaucagguuauguucaguuaccugugacaaccacagaauguaagaaauguuacaaaaaaaacaggaaaggaaagacgacucuggggaaggggcagugugaccuucuccuggcaucuggggugcggccgcagcagaaugaggugugguggguggaguuagaaaggcauagaugcaguguuaccggaaggagggccuugaguguaaguuguccagguccuuggcauuuugaacaaagaacugaacaaaacauacaaaguaauaaaggaauaaaagcagcaaaaggaagaauuuauugaagugagaaagcacuccacaugguaggaguggacccuaagcagauagcccaugggcccaauugcaaaguuuucuggguuuuaaguaccccuuuugagguaccuguuggcuaccccuuaucugggugaaggauuugguccauggcuaaugaaaggcugaggugaauugacgcccuaugcggaugaagggauggcccgugcuuggucuguggucaauccagggccgucucccuuuccaucugagaugcaguggaagggggaggguuguagggagaguagccuuugauccuugguuacucaguguggggagaugggguuuuuccuuuugguguauguuaauuggccuuagaugcccugcccccagacccagguguuuuccguuugcuccagcuuugagaagucagcacaaauuggccucagauucccugcccccagacguagguguuucuccuucauucagcacgaauuggccuuagaugcccugcccccagacccagguguuuuccauuugauccagcuuugagaagucagcacaaauuggccucagauucccugcccccggacauagauguuucuccuugauucagcacgaauuggccuuagauucccugcccccagacccuagacuccugccucagcaagagguguucaaaagaaacaaaagcucugcccaucagcucugaggacaagggacaggcugccuuccaaggcugaggggaggggugaaagaauuggggucagcuggaccagacuccucuaggguucguguuucaggugggccccucacccggcccaucacaaacaaauaagagauuaaggccugcagugcacauggucugcccuccuugaaggcucacacccagugcacagcggaaguaagaacaggccacaaggccucuugucccacugcaggcuuugaaauuugaccgucucccugcugcugucuuugcaauugcauguacuuguucacaaguucucaugggguugggcugggggcaggggugguuugcgcuccucugucaguuu

SEQ ID NO: 14690 - RNA, 54633 nt, Homo sapiens
ugucaauuaaaaauaaggugauaaaaauguaaauacaaaaaaaguguauuuauaaaaaauuagaauuacaaauaauauguguugucuuugacuaauaccccuaauucuagugugcacccccuaauaccaguaaccauuacuguaaguuuuaauaaccauauuuaacagaacauauauacuguuguuuuuguauguguauuuugaaauaguaccaaaugcaaauuucuuuuucauucauaauguauuuugguaacuauuuuuauuggaacaucuagcugcuuugacuccuuuacaaauccucuacaacuuuccaauauaugcauuacauuccauuuauuguuaauaauuuuauuuauuccuucuccaacuggaguacacuuagguuauuugcagauguuuuuucguucauauguguguggguguuuuucugugguacguaacuuauauuccuagguuuuuagaaaguuuaaaaacauuuuuuaaaaauuaugggugguauugaauauaaguguacacuuauaaucuucuuaguuuucuauguaauuuaaaaauacucuuaagaucacaaguguucaaugugacugcaugcucuauuuagcccuaaggugaauauacgauuuuucuuuuuuaaccugucauggugaauuuuaguaauuuucuaaucuugaaguaucuuugcauucauauaacacuaauuaaucauaucaauuaccuaaaaaaaaugcugcuggauuuaauuugcugguauuuuauaaaagaauuucccaucuauguuccuaaguauaauugaaccauaguuuuucuuucuuauacucgcccaguucagaauuugugaaacgguuuuauaacuuuuauaaaaugcauuggauaucuuuccaucuuuucuaagcucugaaauaaugaauucaacauagaaaguauauguuccuucagguucaauagaauuuuucccuugaguuguuuuucaaauuaauauuuaauuacauaaucuaaguucuccauaucuucccuuauauuuuacauuugaguugcauauuucugagauauuuaugucuucuacucugaaaacaaauugucaaauuuguaaaauuucucaucguucauagcgucaccuuaggauaggccauguuuuuagauucauaacaguucaggagaccauacugucuucauggacuuuaucuuuaauauaaaauccuuucucuuuugauacuuuuaauuguauuaauauugcuauacugcuuucauuuggcuaccauuugauuaaauauuuuagcccaguauuuucaagcuuccuguuuuguaagcauuugcuuauggucaauuuauagcuggauuguccuuuuauucccaacugucuuuuaaaacuugugagugaaauuaacccauuuacauuuauuguaaauacugauguuuggacuuuucacaugaaaaacauuuuuaccauauguucugguuucuuuugcuuaucucguucccauuucugccuucuuucagcuggauagguuuuuucuucucauuuagcagcccccuuccuuuaaauggucuacagauuauaaauccaauuuaauucuuguuacuaacuuuaaaaacuuaaaaucacauucagaauauguauauugaaaaucaacauccagaguugauuugcaucuauaaucccuuauauguuuccaaacauucucugauuauacguuuccacgcuuguaaaaugggaggcaugaguucuucuuaaggauuaaaugugauguaaugucaaacacuagccuuuaugaacauaucuucaauuucuucauuccauuucuuuuucauucaaucaaaauacuucagguccagagcacacaaucaccucuaaacuccuuuguccuucaaagucaccuucucuuucaucucuuccaucauucauuauggccuucaacuacuuuaaauuucuuuguaaguaucugaauaccuucucaaucccacuuuggagaaaaaaaaaucucauuauacauuguauuuaaaggucucuuuugcucuaaauuuaaugaacgucauuauccaguaacuccacgccuuucuucauuuauccuucaaaauggcggacuuuagacguuccacgaucaguaccacgugcgccugcgccucccgcagccauuucgcccagcagccuaagcucggcgaggcgccugcgcacgagccuccagagcacuaucgcuccucccucuagcugaguacgccugaaaccgcacguucucuucccugcccucccccgcuaacccugcaccgcccucacccuuuccugugagauucuuccgccaaguggaaggcucaucuucggucgacagccuacgcgguugaagaacaauccaguaggcacuuauagcucagggucucgccauucagucuuaucuaugcgccacagcaauuuuccuccgggccccaaaguugauaaccgauuucgcgggacuuuuuuuuugcauacugugaggcaacaaauggaaagaauaggccuauggcggagggaucacucgcuuauucucuguguacuuuaaccuaaugggggucgcccgggagucggaagggggaggggaaagggaggaggcagccaaggaauuguuuuuuucucuggccccgcccucgcccggggggccaauggugaugaucuguuucccccggagccucgcccagcuccuguguuucagccaaugagcggcggaagcggcuccgaggggggcggguccgggaggcugugcgugucuugugagagcucuugaaccaagucagcgcuggagucggcuaggcggcuggaaacggcggcugccgccggugacucagggaggcgggaggcgggguaagagcgccgcggccucggcugcggggagaggggagagaaaggugaaagcgccgagcgcgcggccccgucgcccguuggcagcggcgcaggcccgggagacgggcgcccgggguucggggccggggagcugggcgccggggcggggcggcggggcaagugcggaaucgcgggcucgcccacccucccccguggggccgcccggggcggggacccagccgcccgggaccggcucucugcaccaggggccuuuucuuuucggggcugggggcugagcacuuucaaauccacucgagccgcagauaauuuuucccucacucccucugcgguugcguuugagcuguuagaaaagccaaacuugggagagcgagggucacgcggcgcuggggcccggguguguggcgggggagggcggcggggggcgggagggcgcaggaggggggcucggugcggguccgcccggggccgcguccucgcgcggguucggcgcccuccgcccgcccucccugcugucuccgcccggcccccucccaccggccgcccccgucgcauuuuguuuuuguguuuuugcagggaggagcucuuccugcaggcguggaaaccauggugcucacgcucggagaaaguuggccgguauugguggggaggagguuucucagucuguccgcagccgacggcagcgauggcagccacgacagcugggacguggagcgcgucgccgaguggcccuggcucuccgggaccauucgagcuguuucccacaccgacguuaccaagaaggaucugaagguacaggcggcuccgggccucugccaccggacguuucgcaguuaccgugguaacgcgaccaucgguucccuccuuccguuuucugaaaacggagaccagaaaguuggcauaugaucugaaggugcaggaagcuagaucuugaaagucuuuggaaugguuguauagagccgaguuguguuuggcccacagcuccuggcugccuggcuuuaauaaugggcuuaggguuguucagacacgcuucauuaaugccggugcugugucccaccaggacugucucaucuuuacugcagaggaggaggaguauuuuuguuagcguuagguagggccuguaagugacguuuggagucauuaagaauugaagguuagugcuuggaaguacuuucagcugguuuuguuuguuuguuccuguuaauuuauucacucaacuuuuaaaaaaacuuucagacuuguuaaaaaugaagugaguguagagggaggagcuuaaguucuguuuggcguauuaggauggguguuuguccguauauggugggucagggcaggaguggguuccugguugucugugaugagccggugggugggugugggauaugaccauauauggagggaugggguggagcugucccauauauggcauauuggaggacuggcuuagaaauacugcacuuggacgcaugaggggagggagagaauugggaacaagugcggccagugauuuuuuuuuaaaucauuaugacacucagaaccuuuuucuguuagaucuuuucaaagacagaugaauucugauugugcucccuaauagaaguauugaugugaaaggauugucugggaacaagcagugaggaagccauuguaccaacaaagacuccuuugugcgaaaauaacugaaaaaagguuccuaacaaagacuccaaaguggugauaacuugaaggaagcuugucagaacagaagauauuuccacccugccuaguagauguguuucagaaucuucacuuggccaucaucuuugcuuuuucuuaaacuauguucaaauaaaggcagcaaguuuuagcauuggcaguugauuauauguugauuucugaaacacuguucauuugaacacuuucagggugacaguguaugcccaaacugguauuuaucugcaaagaguuguaggaaagggguaugcuguuaggcauguuuuaaagcuucaguguugugccuugucucuuguugaaaaggaggagugaccgaagagcauuuaaccauguggcaagcacuucacaacuaugaucucguuuaauccuuacagcaguucuuggggguagguacuaauauugcccccauuuuauggaugaaacuacugugccugagggacguuaagcaucuugccaaggacacauacguaggaauugacauagccuguauucugucaaacccaggaaguuuuacuccagaagcugcccucuuaaccaucaggccagugaucaagagcuaugccacagcagagcuccugucauaggcugugagguuugguuuuuuccugcauucggcucauucuccugccaaaucagguuuugauguuuauagagauaauauauuguggugcaagaauggccaaccuuuuugcuuugggcuuauaaccuuucuguaagcugggcuuuguguacuagauuucagucgugcuuguugugguuuauuucgccugccaaauaaaauuuucucuagugcauuuguuuuuaugugauuugaauggaaacaagauuuuauuuaaacuuuccagucuuuaguucuuuggcagauguugagagacuaggcguucccuucccuucuguagcagcaauugaggaccuguuggguuaggcaggcaaucuaggaggaacuucacauguauauauuuuuuaaaucuccucccuccgcccccauccuuugaggagguggugauaucuucauuuucagaaugaggaaauagauuuaggaaaaggaaucuuguccagauuugcauaauuagcugcggagggaggcugcgaauccagauugggcccagugucuucuccacugcacuuuggugccuaaccugaagacaacugggaauucaugucaaaaacaauuuuggcuagguuggauuuuugccuuacuuguacacaucacaacucaacccucauguaagaugccaaucuucugucucuuuucuagucaugauuuaucacugcauuccuuaguugaguagcagauguuaaguuugggggccauguugcauuaaaaaaaaccaggauuuuauuuuaccuugauuuuagaguuggggggucuuguugcccaggcuggucuggaacuccugggcucaaaacaccaaaaccaauuugugcuuggugagauggaggcaggaaccaaguaacuaagaccaugcuuacacuaggguuuaggggcauuaaguuuuuggggggugagauggggguggggcgaggggcugagaugaaugucaauaaauaacauucaaguaauauguaaccauucuucuauuauuaggacaaauacaagucugucuagacuggcuuguuuagauaguuauggaugauauuaaugaggccaaggcuuguuaacuuuguuucaccuagagagacuuuauaacaaaaccacuuacuuagaugacaaaaagagaauaugucuaguaguugguuacagagaaguuaaggugaagacauaauaacaguggauaacuaugauuaaaugguuacaucaggauuuagcaaagaaaaaauaaucauuaaauggauauuauguggcgauuacuucauuuaauccucacaaauauccuagaugguaaacuacauuuuuagugucaaaaacugaggcuuaaagaaguuaaauaacuugaguuugucuccagaccuuaaacacuaggcuuuaauauucagguagagcgagguuagagcauuuuauuuugcuagccucuauaucccuagcaccgagaacacugcuuggcauguagugugugcucagcuauuugaauggauaagugaaggaaucauaaaauuauuaccucuccuauggagaaacaguuuagaaagaaucuacugaugaggcaguagcauucucuucaucuggaauaacaacagaucuuaauuagauguggcuauaaagacugcuuuaaucuuauuuuuauccugcucuuucuacuugaguaugaaaugaguugcuuccuagcugauuuuguucacauaauuaugcguggugggaaugcccugcuuccuuaacuuguccuuuuuucuuugaagccuaccuuuuucuugagucuaaugcccugcuuccuuaacuuguccuuuuuucuuugaagccuaccuguuucuugcgucuaaugccccuucuuaguccuuacagguguccuuagcaggcaauuaguccuugccaucuguauguaccauuuccugcuauugucagcaauuuggugccuugacuaaugccuagccuuucauuuuugcacaccauugaaacuuuaauguuagugcaaucugcugccagucaagccauguaaaaugaaaaaacuucuagcacgguauaaaaacuguuuaccccuuuuaauugaaugcuggaccuugggaucuucgacaaacauuuaggcauaagaagacauaaguggaagcacaaggaauuaauuucuuuguggaguagugaauuaagugguauccugcauuguagugcaaggcauaaaauagacauguaauuaaaaauuugucuaaaaaccauaucauucugugcuccugcuuuuaaacuuggaaacauuuucauugguguuucugauggccuuuauaaucauauagucaggugagaugagaguaugguaagagugggagauuuugauauuaguuuauuagauacaauauuaauucauauaucagaaagauuuucuguuggggaaacauuggcuugaaaaaucugaaauaucgagcauuuggucaagguguuucauagguacuaauaagguacacauuugcaaaauacccauuaaaagaagagcagauuucacaauuauagguagugaaucauaguugacucuggccuuugaagccacacaguguaagucacaucucauugugggccaaaggagcaugggugaaauaacacaauuuagaauagaaacuagcugcaucugucagcuugcaugagcuuggucaagucacuuuaguucuuacugaauuuaaaugucuuuuuaggccaggcgcaguggcucaugucuguaaucccaauaauuugguaggccaagacggguggaucaucuggucaggaggucaggaguucaagaccaaccuggccaacauggugaaacccagucucuacuaaaaaugcaaaaauuagccagguguggguggcacucaccuguaaucccagcuacuugggagucugaggcacgagaaucaccugcaucugggaggcagaggaugcagugagcugagaucgcgccacuacacuccagcuugggcaacagauugagacucugucucaaaaaauaaaauaaguguuuuuuuguagaaauguccacagaagaagcuuuuuugggggaugucauuaaguguaaaaccucaaaccuuaaggcacaaaugaaagaugcuuuguuuuuucuggaaauggggucucacucugucacccaggcugaagugcaguggcacaaucauagcugacugcagccucaacuuccuuggcucaagcaauucucccaccucagccuccugaauaucuaggaccacaggugggcaccaccacuccugguuaauuuuuguauuuuuuguagagacgaaguuuccccacguugccuuggcugguuuagaacuccuggacucgagugauccuccugucuuggccucccaaagugccgggauuacaggugugagucaccaugccugacugacauauaugguuuugauaggaaacuuuugaacaauauugaagaaagcucacaacuuguugguuuucuuauauauuuuuuaaagucaucuuuuuccaaaccaaaauaaugugauuuuuggcuaauacagcauaauauuugaaagucauaaacuuaaauuguuuuuaaggagguaaacuuuuuuuuuuuuuuuucaaaucacucaaaaauugggauauggaaaggggcccugucugucuuuugguuuaggguuaucuuaagcuuuagauagugaucugguaagaacugugauguugcuuaaguuuugggaaaccacuuaagaucuuaauccuucuuaauucugcacuuuuuuuuuuuuuugcugaauagauauuagauaauuguguugaagauccucuuuccccugcuccuaacuuaauaagugauaccuugauaagauuugaauuaaccauggagguauuaaaacuaccuaguugucuugccagacacuuuacauacacugucuuuuaaaauaugccuaacuaugcaaugagaggugucacuuuuuucauuuugaaaaacauugagagaacuuagauuuucuaagugaggguucuuaaccuggggugcaaguuaguugguuuccuuuguaaucauaaguauuuuauuuuauacauguaaaaucauucuaagagagauucaguguagcugggaauucaaggucucugaaucuggaucuagaauuugugugugcucauuccucuuauaccacauugcugauaaauaagaaaacugucuaccuaaagcuugguuggguuugagguugaugugaauauggagcagaaagacuagccaauuuaggggagaugucagagcauauggauucuguggcuaggaaacagaaaggaagaugggcagucucugcccaccuuuaugaaagaccauuugguugauuacagugauagaaaacauauaaccagggagaaacguaugugggccuugccacguggguguucacauuuauucugauuuggaaaguauucaguaauaacugcaaaguuaaaagccuaaaauaccaagaagauauguaguuuccuagguaaagucgccugggagguuagggaugcauguuuuguuggcugagaaggguaggauagaucuuagauuucauuuauuuuuauccuguagacuggagaagguuugggauuggggcuaaugugggaauuuagugccuucuaagcaggugagagaaacaagauaggaacccaaugcagagggaaauuuauucauuaaucuaugcuaacaaguauuugaguaccaauuagauuccauauacuagugauauacaguuguaagcaaaagcagagacagacuuugaccuauuagaauuuaauugucaaucaguuaacaaauaaauaaugcaaaguguggauaagagcuaagacggaaaaguacaaaacuuugaguacaguuaguauggggaccucucuugggagagagaggcacuuugguaagggaagguuuguuugaggaaaggauauaugaauugugcucugauagaugaaguuaacuaguuaauaaacugaagguugaaaagggauguaugagugaugucuguaaaaugaugaacagauuugauagaugauagauguauuaacuaauuccuggaaaccaaaaugagagaccucuuuaguaagaggaggaauuuuaaaucaaauaaaaacagugauuuuuacacugaauaucgagggaguuuauugucauugguagaauacaaaaagcauugaagaggaccuagaguaaguuaagggguagcauauuuauaauagguuaaggaagcuggaguguuucaaugcuuuuauaugacuuugaguuuuaugguuuuguaaacaauuccuacucauagaucacucccagaagcccacuuuuagacugaauuuucuuaaugucuuuaaauauguauacagguuuuaagaguuguagccuuaggguuaaaaguauuaugcaggucagaagcagaaaacauuacaauuacuuggaaaacaauauuucaagguaguuuaacuuucauauaagaagcuagagauaguucugaaaaacuuuguggucauuuuguuaaucacucguuucuauguuauccaacaaguaguuuaagacuccaaauucugugguaaauuuccuagcuuauucaacugaaagggauauugaagaugugcuguauauuaggccuugugcuaaauuuacucauuccagaggaauucaaaaggaggugguggauuguggugauggggggucaucuuaagcccacuuauauugucaauagacaauuacagugcaguuuuauuaaguacaucuuuugaguuucaaauuuuugucuugcaauuccaaaagcucagaugucuaauuaauguauguaaacgccugauaaguagggguuguuugguuucugggcuucccagggguuuacuuuagggacacagacuggcccaaaaagccuugacuucugcaucccgaagugaguugggagccaaagccugguucaugugugauuauguauugugggcugugacaggaagugagggagcuggaagggggaaagcacauccagauaaaggauucaaauagaauaaugaagguauaguucagcuggggcauuuguaaugcuuauuuuaauaaauugaaucugcuucccccaccccccaauuuugucugucuagguguguguggaauuugauggggaaucuuggaggaaaagaagauggauagaagucuacagccuucuaaggagagcauuuuuaguagaacauaauuugguuuuagcugaacgaaagucaccugaaauuucugaacgaauuguacaguggccugcaauagugaguaaaacuugggcuuauugaacuccugagaagagggcauuuuauccauuguggguacaaaaggaauauguaaauguaaugccagaaagucagaaaagcucccaggaucuccugccagcccuuuuaagaacucugcacuucugagcgagucccuugacuuuguuggaccucguguucacuugacaaauagggauggagguaguagugggaaugucuaggucagaaggcaggaacuagcagucauaugcaaacauauagaucuguuugguuuggcccuugcaguacuuucaaaacauuugaauuaauugccuacuuuaaaaaauguggagaauacaucugaaaaucuagauuuccauugucucuuaaaaaaucuacaagauaauggcaacacuggagccuuauggcagcaaugggcuagagccaaauaguagcuguugccuugcucucuguaggguuuccagucuugaucuuaugaucuuuaagguucccucuggauuauuauauuuuuuggcuuuaaagauacuauaagucaguauaugauugugcuauauccacauuguaaaguguggugcaaagagaagagugagcgcugucuggagagggcacuuuagucuuuaugggacuugagcuggugcuucaaggagggaagguuggaucuggauaguuuggaaaggccgggagaaugguugaaggcugaucagauugugaucugauuuugcccaugagugaaaagagcugcuauggagauucuugagagaugaggguugugguuaaaguuuuauuuugcucuuuguauuuuuuuuuccagcuguuuagaacugguuaaaaacacaggccugucuccccagagaagugugcauacaaacaguuuuugcauaaauuuuugggacaccaugaaucugugaacccagucuugaauauuaauaacucccaaaugucuaucugguuuaaauuauuggguuugaauaaaaauuguauuaucuauggcugcauaaauaguuguuaugagauaacuugcaguaaauaaaaaaaauuaguggcuuuaucacuuucucuguguguggaaaauugccaguuccuauuuucagaauuaugcugacagcaguuaugaugcuaaaguguuuucuuuuguuuuagacguacaaaccucuguuggacaaagcugguuugggauccauaacuucuguucgcuuucugggagaucaacaaagaguauuucuuucuaaagaccuuuugaagccuauacagguaaaacauagaaacaguaguaaacauuagaaacagaaauacgaacuccuuuaacaugagaaguaaaguacaguugaaccuuaaauaguguggguauuauggaugccuacuccuugcacaguaaaacaucuacauauaacuuugauucccuccaaacucuacuaauagcuuacuguugaccauaagccuuauugauaaacaguugguuaacauauauuuuguauauauauuauguacuguauucuuacaauaaaauuagcuagauaaaagaaaauguuauuaaaaucauaagcagaauacauuuaguauucauuaaguggaaguagaucauuauaaaagguuuuuguccuugucuucauguugaguagacuuucggucuugcaaucucgggugacagagguggaaggaaaucuguuuauaauggggccugcacaguccacaacuguguuguucaguggccaacuguauauugauguugacugcucuaauuuaaauaccuaacaggaaagaacccaucccaucagcaguuagguguuagacaucauuccucaauguuagcuuuuagguuagugcuguccauuuacgguugaaaggacaaggguauuauaguugaugguguguguguauggaaacacuuaggugauaugaaaauaauauuuaaaaguagaccguuguuuauauacauauaugugcaugcauacauagacacucaugcauacauauauacaagcaauccucauuauuuguagauucuauguuugugaauuuaccuauuugcuaaaauauauuuguaaccccaaaucaauacuuguggugguucauggucauucaccaguacuugcagagcugcaaauaauuugaguugcaugaugcagguucccagcuccuagcuaagguuaaauaaggugauguuccaccuuguuucacuuaugcuguaaacaggugugcuuuuugcagucuauuuagugcugcauuuuugugcuuuuuuuuuuuuuuuggugauuucacuguuuaaaauggcccccaaaagcagugcugaagugccaugaugugucuuaagaacaaaauacauguguuagauaagcuucauucgucugaguuauagugcucuuggcugugaauucaagguuagugcauaagcaguauauauuaaauaagaugucuuucaacagaaacacauaaaacaagauuaugugucaauugguuguugaaaaugugaccagaggcuugaaggaaccuacaccuguauuuccccuaggagcaaugguucaguauuuguuaauaaaacauuuuuuugcaacuugauaaaacauaacuacugcaaaugaugagaauagacugcacacacgcauacaaacacacacauuauaauaauauucaucuuuuagauaucauuuauaaagcugaauaaucuucuuuaccgccuucuguuuugugacuucauaccugacuuguuucuuugggguauagaacuaugaaaccuauuugcuaaaaguaguuuggggucagugguuaucagguugccgagccuguaucgggaagcccaaagcacuggcuuuuccucuacuugagucucauccauacuuccauaucuggaaagugagugaaaacaggauucauaaucugaaccuuauuuuauaauguuuaaguaauggaacagaggaagaugcuuucacuuaguuaauuucagacacaaguucuuguguuauacccaucuugauauuuuuccugacuuaaaaggaagacugacuugcuugcagggaucaaauaacauacagggggguuguggauauuuugcuuuacugaguaauaaaaggaauuuuuuauucuuagugcuguuuucugaauuuacaucuuuccuguauuuaagguuuucaauuaagguagaacccuaguuuuguuucuugggauugagaaagaaacaucuaaauuaguaaguuuauauuuguucucgggaagaggggcuguggggcugugagccaucagugugaauguugucauuaauacgauauacaauuaacugggagaacuauaauguguggucuugacuuuuagugauguugaguuuucaaaguuuaguacuucagagaauuaucuuguagauauggguguucacaguaggcuguacgaaauuccacguugggggaugugauuaccccaguaggauacuugcucuagauaaugcacagagcaccugaaaaucauuuggcauguggaaaaauugggauugaaaguuaggguccgucuuuagauugaauuuuacucaguuaucuguugguaagaaaaagauaagguaucuggacaacuaucuugcacuuucguuaagcccuaaacucuccuaggcagccuaauauuuuucuacuuuauugaagcccuuugcggcucuuuccauugauacauacuuucaucuuguaguaggaauuggagaauauaauuaaauuuuuugaaauugcauaaacaauacaugcaugagaaaaaaacaaaaacuaacccauucugguaauuaauguugaucucuuauggagucccuagguuugucuaauguuacuuggcaaaagaaauacauuuuuccagcacagcuucucuaacagacuaguuauccuucccagugggaaaaauggaugacccauucuuggucauuauccauuucacaguggcagaaaagcauaaagcccugauauuggaagggcuucuguguugagcacuguuuuuucuuugcccugcuagaauucgguuuggcaaguuauuccuauugacaguuucuguauuacauuuaucauaacugggugugcacacaaagccagaagacuguggaauagugccaagaauggagcugcugccaagaauugaauguuucagaacuggcuuacucugacgccuuaggcuauucauucagauuuucuguuuguccccccaccucccuuuuuguaaaaaagaaugcauuuuguaauacuaguuagguuaaaugaaucugugugaaaugaguuguuaaaaacagcaguuucuuaccaggaagggagcugaagcuuggucagcuuuaaggggccuuagaaaauaggguuuuggccuagguaaccaggcugagaugugguucaaaauuuucccuaaaauugccaucaugggugcaugcuugcucauccccaggguggccacugggcacagccauggguuuacuaaugggaauauggaaaaaagggcugcccauuaucaguggacuuugguggaaagagauauguguaccucuggaguuaaucuuuacaaugugucaaaagguuuggagaacauugaucaaggaaacauuuuucugauugaugaauaaacuaacucucaguuauggucaucuaccccugcuaguagguuacacaguguauuauauaguacaugcaguguguuauauaaaauaaaaaaaaaacccagacaguaauugcaaugaaucgaccauauacaucugucucuugugugucauaucuguguuuuuugucccuuggauuuggauugugauuuccccauccccaguauuuaggauacagaguguuuuuuacuuggauugaccagcuguuuguuugcuuacuuuuuucccauugccaaaguuagucauuuuuaaaauuaugcuuugaguuccucuuaauauuucucaugcuucuagcuugggaugacuuuacuucagucugccuuauagcugugaucauuugauggucuaggacuuuuugagccaucugguuuacuggaauuggaaugauuugggcuaucacaugguuuguugacacuacuuuaacccauuugauuaaccaauugaaauagcccacuggaauuuaaauaacucuucuuauuaacuguuacccuuaacauguaaugaucuuucauuuuucaggauguaaacagucuucgacuuucucuuacggauaaucagauugucaguaaagaauuucaagcuuugauugugaagcauuuagaugaaagccaucuuuuaaaagguauaugcauuaucuaguggugauaguucacgaguugaccaaugauuagcuugugagaaacuaggguuuagccucucauucauuugcucauggaaauuucuuuuuucuuuuuuuuuuuuuuugagacagucuaguuccuaggcuggagugccaguggugcugucuuggcucacugcaaccucugccuuacaaguagcuaggacuacaggcacgcaccaccacacccggcuaguuuuuguauuuuuaguagagacaagauuucacuauuucaccauguuggccaggcuggugucaaacuccuggccuuaagugaucugccugccaagugugagccaucacgccgggccauuucuuacuuuuuuucuaaaauaaauuuuuaagaaauuuaaaauuuaaaauucaaaaaauguguguguugcuaaaaccucugaaauuuggaaaguucagggauuauaugaaacuaacaguaaaguagggccaggcacaguggcucaagccugugaucccagcacuuugggacauccaaagugggaggauugcuugagccuaggauaggaguucaagaccagcuugggcaacacagggagacgucgaucucuacaaaacauuuuuaaaaaaauuagcccggugugguggcacaugccuguaaucccagcuacucaggaggcugaggcaggaggaucacuugaacccaggaggucaaggcuacagugaucccugauuacacugcuacacuccagccugggugagagcaagacccugucucaaaaaaaaaaaaaaaaaaaagaaaagaaaaaagauauuuuuaaagcucagcuauauuuugauguggaauuugauauguuuggaauaucagccauauaaaauggauaaggcauuaauuugauacuccuuaccuucccauuuguguuacugaguuucuacaaucauacauuuuuuuucuguguuuuuuagauuaucagacauaguauuuuuguugggguuccugaauuugauuccucuaaaacuacacaggacagugagugaggucuugaugaauugucuaauacuacuuugguccgauacaaaauaaaaaguuuaaauuuucucauagcuuuucugaaaugucagucaucuuauguuuguagugauucuuuuaauguuuacuuuugcguuuuuuuaaaaaagacuuaggaaaagauuguccuggaugauguugcuauugggagauaaugcaaauugcucuaagauuuuuuuuuuuuuuuuuuuuuuaaggugacaaaaacuuaguugguucagaaguaaaaauuuauagcuuggacccaucuacucagugguuuucagcaaccguuauaaauggaaacccagcaucaaaaacucuucaagucaacugugaggagguaaagacaacaauaacucuuuguaagauaacucgacaaagcaugauaacuauacaaagcauuuaugauuuucuaggcacuaaauaccuuuauuauuuuauaggguagaaauaauuacaguuguuuuaaaaagaaauuauucauaagaagcuccuauuguuauguuaaugaaccugauuuucaguauguucuugagcauuuuuuauuuuccgguaucuuuguuucauuuauuuuuaagauuccagcacugaaaauuguugauccgucacugauucauguugaaguuguacacgauaaccuugugacaugugguaagauauguuauuaaaaucuuucuucuccuuccuccuuuccuccguucuucucacauuaagagaaacagggaagccaacuuaaccuauuuuuaaauauuuuagguaauucugcaagaauuggagcuguaaaacgcaagucuucugagaauaauggaacccugguuuccaaacaagcaaaaucuugcucugagguaaccuuuauuuaugucacuuguguaaagcuuuccuuaacuccaacauugcauggcuaguuuuuauuuuuuauuauuuauuuaauuauuuuuauuuuuuuagagauaggaucucacucugucacucagacuggagugcaguggugcaaccagagcuuacugcagccuugaacuccugccuccauaguagcugggacugcaggcaugugucaugcaugacaccuggcuaauuuuuguguuuuuuguagagacagggucuugguauguugaccagacuggucuugaauuccugggcucaagcgauccucccgccucagcuucccaaacugcugagauuacagucaugagugagcuacugccccuggcugcguggcaaauuuuuuuaguguuauauugcugucugcucuucuuugcuaguuccagaucuuggccauaauuucuacacugaagcagauggagauaauauaaguuuaugguucacuauuuuauguaaaaaaguuucauuuuuugguauuugcuggagauucucaauagauuugacaauuucaccauguggaaguguucuuaaagguaaauugaguugugugugucaaugccuggcaugaaaagagggaaggagccuuagaauucugaguaguuuggguguugaaauaggaccuucaccuucucaauaauaaggaauuuaauuggucauuuaugauuggguaaacaaauguauuucaaggaaagugauugguuugccauuacuaauuucuguccagaaaaguauaggcuuuugugaaugcuacuguggguucagguaccagauuuaauucuauucugaaauaguuaccauuuggaccgagacuauuucucuuuuaggugaauuaaaucauuaggaccuauuccaauacaaauaacuuucuggcaccuuaggaauccaaaugccuaaaugucacauggauaguuuccuguguuauaauuaucaaaaacuccuuuauaaugcucugccccaggcuggaguuuaaaauuuaaaaacugaccaaggccaggagaaauggcauggggagugggccaggaagccaaugaauaaaucuggguuucuugauuaagggcagacuggacuacagcaucgacuagaaccaaagcuagcacugugccacacaaacacuugagucuguguagcuaggaugguuaauuggcuuucuugaaucuuuccuguauacaggcaacaggaacuuugauacuucaccaaaagcuuuguaaaccagugucugaagccucuguccuccuuugaaggguauaggcuuugaccucuugaggcucagguuguuuaggaaagaaugaagaguuaaguauggaaauuagucuuacuaccuuucauuuuugccuuaaaguuuacaagguaauuucaaguacauccauccaagaaaccauaguuacuguauuaaguacucacugugugguggauacuugguccuggagauugaaagguaucuggaguuccugucucagauuccauaggauagugagggagacagacuuccagagggcucccacaagugcagggagagugcucuggucaggagcucugcaggugccucaagaagcagccugggcagagccucucagacagggaggacgugucuuguuuggugaagggcaaauguuucauuguggcaggggcacaggaggcauggaaaaagagaagcagggucagagauaggaaguuuggguuuuaugcugcagaugaagagggggugucugggguguucagggguuuuaaguucaggagauugacuuaagcucuguagaugauggaugagggaaggacaugagaauagaaaugagggcacugaugagguuaguuguauugcacaucauaaauaggcuugaggugaggcgguagcuaaggggguggagagcuauuuaggagacagcaguaguuggauuugguggaagacuagguguuaggacugaagaagcacaggaaucuagcuaaugaaguagguagaacaaauggaaugucugccucaaagaacaugacaguucuagcuuaggaagcccaagugacauggucaggcaauuauuuaugauacuauauagucucccaguauagaaaggggcugagcugcugaggaauaggggucccuggucuagaagggaacagauaguaaggcucuggguaauuaauguggccaggacuacacagaggaugucaagcucagagacaauauugucaaguaauccauaguauuagaagcugagagauaaacaggauauaauaauaauuucuuuaugucagguuuuaacguuagagaaauuguuggcagucuagaguuagaaguaguaaauaucaguuuggagaaguugguuguguguugccugucauggggaaugugucaguguaaauugggaguaugaugaagaggagagcugagcugugagacuugcugaggaagaaggguugggaauaggaaugacguauccuguuggaugguggagcgaucaaucuggggugcaagcagaacugaggucagugggaaccucccuugggggaaggugccuucagaauguugagugugucagcaaugagaaagguguuugagcaaguaaauuucuaaccuucaaggagguacuuguaaaaugugggcauauagacauauaugauaugauccugucuccuugauucaaauucuugcaaggccagaagcauuacuuuuuuaucuuucucagcauguugcccauacuaugugugcuauugagcugauuguugggcacauuagaagcuauuaaaaaaauaagccugcacuucagccuggagauaaguuucuuaacuucugcaucuaauaugauaaacuaaauuaaguguuuuaaaaauguacauugcagcucuugagcucuaugcuagucacgucauucuaaaggaagucgaagguggauuuuuaccuggguuucagaaguucuugaaaauauuuuuuugauugugaagcucaucucauuugaaaauuuuugguuaaccuagaaaaguauaguaaagaauagaaucaucacuuguaaucauacuucucagagacucucuguuuacauuuugaaauacuucaaauguaauguaaggaaauacuuuccuucugucucuucucccccuguauuuaucacagagaccugauuuuuuuuguuaguuuuuuaaaacuaaaaaccauacucuuguagccuccuugauucccuugcaauguauuauaacuauuauuccauaucgguaaaugucuuucguucugggugauucuuguagucagacaaguuuuggauacacuggccuggccuagauuucaggagggcuggagagauaaagggagcaguggggaaagaaaguuuuugaaaauguaugagugaaaggugaguacaguaaugcacucagcacgauucucacuguguuugcacuucccagauguguuggacuggcacuuuuaggguggucuuuagaagacaggcauuugggacuaguaggcaagacucuugacugucuugaugaauacuuuugguuaagauaaaccuguuugccagugauaccuggcuccuugaaggucuucucugccuagcagacuauuccucagaguuacgacguugccugguuaguugggaaagagucugcugaggaaugugagccggcaguguccuuuuuagaauucuaucauacacucaauuauauuaucuccgucugcuggcagggaggaacuauugccaugacugguauagaagaccuucagggaaaacucuucagguaagaagaaacuuugacccuuuguugagucagaggccagugcggaggugcacucgugaacauggguuugggaauuggaguccuguuccuguugagcuaaaccuuaggaaaguuguagaaggaaauacuugaguuucuuaaaggaaaagcacgcuaaguugugcuaauucuaacacacggugacagaauugagaaaauuuucgcaauguuuuucugcuuuaagacagcucaucucuaaaauugauuucagcgccaggcacuaugguaaaagcacagcccuguaaaguauacuucaugggaagaaagugcuaggaaguguuagagacugaauuucaaaccaaaggcuaacaccaaaauccaguacucuucaucacugugcuguugccacugcucuccaaaucuucuccuugguguggugaaucacccuuguaaaaauagcagauuucuccuuucuucccuccuucccucuguuccuccaucccuccuuccaacaaguauuuauugcauauuuaguguaugcuagacugaucuacaguggugaucaucacuuccugucacuucagguaacucauaagacuuauugauuuauagcuauuuagaaauguuacaugcuaacagcauucacuccuugguauguucauuccaccagucuuauuuauugagcauccacuguauguuugguuuuaugagguuauaacagugggcgcaacagcagggccucugcccauaaacagugugugucccauugugaggagacugacagugaauaagugaaagguacuuucauggugugauaagggcuaugaaagguauaaacagaaaaaugauaaagaguaagggacggcuuuugggaugcuacuucagaaagaguaaucagaaauucugagagugugacauauuaacagacuugagggugaacagagagaaccaaccagccacugaaaacgauguagccagagagauaacaaguacaaaggcccaggcaagaaagggcuuagaacacuaggagaugagaaaggaagcaaguguaguuggaguacugugagcaagcggggcagugaaagagauggggggaggaggagcaggagugguaaggagacuggaccacaugggauucuuguaggcaguggacugccgugaucuuauuugauuuauguuuuauagagauugcucugugguagaagagaucuuggguaggaugcagaggauucaacaagaauggaaggaagguugguuaggacauguguagcuuaggggaaagaugguaguaguagugacaugaaaagaaauggguagauucaauacauacuuugcaaauagaggcaagauuuauugguuuauugauuacauaugggaaauuagauggaggguuuuuuuuuuuaacuugagcggcuugauuuuauacagaguaaaaauuuaugcuuagguuuauaauccaaauuucuuaaguauguugcucuugggagagugaggaaagguauuagugcaucaauucuaaacauauucagaauaaggaaggugaccaauaugaggaaagauaauugguaaaauugagccuugaauaagcauuucaaaaugauuuagcauuaaacuuugggagacuaaccucagauuaacagggaauugcaaacuauuacaagcaaaagggacuuuaggaauaaacaaauuuccucauuuaaaggauuaggaaacucaaaaaacacccaaaaccaaccaucacaccuucuggagaacauuaagguacuauuuaaccaaaauugaguugacugaaauaguguaauauaugaucagauaauuuagugccuaaaaauaguugaaacuaugccaaaacuuugccagugauuaaauucuuauuuuucagauauaucuguauaugcuagcuagucuuuucaaggcugucaaguaaauuucugagaaaagcauucaugaguagaguacauauaaauauauucgaaauugucagguuuuaaaaaccugcuggccaggcacaguggcucaugccuguaaucccagcacuuuaggaggccaaggcaggcagauuacuugaggccaagaguuggacaccagccuuaacauagcaaaauccugucucuacuaaaaacacgaaaaacuagccgagcauggugguacaugccuguaaucccagcuacucgggaggcugagcccugagaauugcuagaacccuggaggcagagguugcaaugaaccaagauggcgcugcugcacucuagccugggugauaauagugagacugucucaaaaacaaaaaacaaaacagaaaaccuauuaguggaaguuguaaucaaacuuuagaaguuaaugacuagaagaugaagaaacuuuggagauucuucaaguuuagauuuggugguaaggcaagacgauugagaaagguauaugacuuaaaaauuuaagguauauaacuuaaaaauuuaagcacaugugaggagccuggugaaaugggugaauugguuucaccugguucagccuuagacuaguugucuugaguuucuccuuucuuuuuuauggugggaaguuuauuuuugugaaugguauaaacuguuaagaaguugauucaauacuuccuuuuuuugaagauuaaguuaccugaaaagggaacugggacaggugucccaacuuugcccacaggccugucauaacuugauauuuuuugcagcuugggaugacuucugugacuugaugagccacauaagagcaagaacuguccucaacuuuuauugcauugcaaaggcuuaucuggguaccaaauaggcaucccugccuacaagaguccuauguggucuggucuccugccaaacuaugcaguaagugcguggugggcacucaagucaugccaaagugaaugcaugugaagcugccaccauuuaaaacugucacuuaaaaguucaccucugcguugcauuaguaaaguaauugccaccugacuguuuuccuggcacagugguucagaggucugaaaaagauaagcuugugauccuuuguaggaagacauaaguuuugugaaaagcuggagugauuacuuacagucuuaaagcccugaauuguauaguuuaucacuuguuucacuuuccuguuucuuuuuauuuggcaaugguauuauguuuguuuaguauuaagcaaaugaucuuaaauuugguagcauuuuauuauuuccuaacuagggacuuccuuuuaauaucuguugguuugguaucuucuaggccucucccaguauguguccugugcagucuguaccuacaacaguuuuuaaggagauacugcuuggcuguacugcggcaacuccaccuaguaaggacccaagacagcaaaguacuccccaggcugccaacucuccaccuaaccuuggagcaaaaauuccucaagggugaguagugauuuguuaaagauguuuaauuauaauaauaaaaaauuauuuuagucauggcucauuguuuuuaucccugguuguccagggagguuuuucguuagaguuucugagaaaagauggauagaugcuuuugaaggugaaaaguauagaaggcacacagagcaacauagaaaaugguauagaagugaaagggggcaugagaaaagagacugucuugauacagugugaaggagcaauugaaauaguaccuuuguaaaacaggugucuucuuuuaaggaaaagggaacagauugguuguacauggaagacugaggucagugggagugugaagaagcagugagacaugguuacagugagagauucuccgcagccucgacaugaauugacccaaguauaguugagaaauuuggcaguagagaggacucuaagaauaauagaaaugaggaagcaauaucuguaggugguaacuguuacuaacuuguagaggaagaaaaugaguacgaaauguaaaguuucacuagaaaguuuaaaguagguacaagguugacagagcaaguaguuucaagggaaggaucucuucugggaaguggugguggccugcguaggcaggcaguugauacagccuuaagauguaggucagagagacugugguauagaaaaguagguuuggaaggugggagaguggcugagcacacugguucacugggaaaaaguagucagucugggauagagcuuggaggauggccauguggcagucagacaggaggaggagcagucuucaaaauagaaacggagggaacauuaggaaguucagugauauccaaggaaagauuuuucaucugaguguuuaaaugaaaaauucuucuccagggugaaguccuuugguagaggcaggaacaaacagguauaauagaaaaaaaggacuuugcauuuuucuggagaaagaacucuaggaugcuaagaaacaaaaguucuucaaggcuaucccuaguaagauguacagggaaaauaccaaaucguucugugaauaaccaaguaaucaaucagcuauucuauuugcucugugugcugaucacugaacaaacaagaaugaaauuauucucuguuagggcugguuacauguugcucauagcagaaaaggguuuugugcugcugccaguuuguuaguuuuuuuuuaguuuuugagguuuuuuagagacaggaucuugcucuguugcccaggagggagugcaguugcagugguacagucaaaguuuaaguuuacugcagcuuugaacuccugggcucaauugauccucuugccuuagccucccaaguagcugggacuacaggcgcgugccaccacaccaggcuaauuuuuaauuuuuuuguagagaugggggacuugcuauuuugcccagucuggucaugaacuccuggccucuagcaguccucucaucuuggccucccagaauccugggauuacaggugugagcccuugugccuugcccauuguucguuuuuaauuagauuuugugugaauaucuuugaagggauuucuaacauuuuuuauauacguauauauuuuagaauuuuuaucuugacacauugaccuuuacuagagguucaauuuuugacucuuggcaaguagcaagaauggaguuuuaucuuuaaaauucaaacauaaucuuuacuauagaagaaagaguuuuagcagagguuucucugaaauuuacacacaaaaaaaaaaaaaaaaaaagaagaaagaaaacuuucggaauugccccuacacagacuucugguuuugauacuuauaaaccagcuuaucugcugaguauauucuuugguuucauacaauauuuuguuuugagggaaagcuaagguucauugugcugugagaaguagaacuaacguaagaaguuaaagauuucugagaacgugcagacauaauuuaggguuguauuuuucugaguguuuaugauuuuugcagaaccauugacugaugacuuuuaacucuagcucacagaaaucuauccuaaauucuguaacauaugagaaauuuucuuuuuucuuucauacucguuaccuuagggaaccaaacaguuuguuuggggaagauaauggagagauaaaaagaggccuggaugcuagcuuucuauauuauauuuuucagaugucauaaacaaaguuuaccagaggaaauuucuuccugucuaaauacaaagucugaagcucugagaacaaaaccagaugucugcaaagcaggguugcucucaaaguccucucagauuggaacuggagacuugaaaauucugacugagccaaaaggcagcuguacucagccuaagacaaacacugaucaggaaaacagauuggagucuguuccacaagcauugacuggccuuccuaaggagugcuuaccuacaaaggcuucuucuaaggcagaauuggaaauugccaauccuccugaacugcagaagcaccuagaacaugcaccuuccccaucggauguuucaaaugcaccagaagugaaagcaggugucaauagugauagcccuaauaacuguucaggaaaaaagguagaaccuucagcuuuagcuugccgaucacagaauuuaaaggaaucuucaguaaaaguagauaaugaaagcuguuguucaagaagcaacaauaaaauccagaauggugaguguuucucaauaucuuuauugguagaagguaagaaaugguagauauauauaucucuuucuuguccuaugagaaacuaugugaaaaugacuuuguagaaauaguuuauacagucagaaaaguugaaagaagguauaauucccaaaucucagaaacgauuacuguuaauauuuugguguaccugguuucauguauauagaaauacagauaaacuguauuacacaaauggguucaugccaauaauuuuacccugugaauuaguguaggugucuauuaguauuuuaaagcaaggauuccauuauguucauuuaccauaggauuuaacugguuccuauuagguggguaauuaggugguucccaauucuuagguuaagaaaauuuugaaacaaaaucuaaaguaaucugguguuuacuuuauuucagcuugucacugaucuuucuguuacauccagguuggaguaggaagaggugaucugugacagguagcuaagauuugaaauuuuagaaaagaugcagaauuguaucauuucuggaaaaaggacuuggguuaaagauguuacggauagggcugaacuaccaggaagagucucuuugcuuaaggggagguccugcugcacccacaauuuaaaacuacucuucuuauggggaaauugguacguuguacuugaugcuacuuauaugaaguuugaggaugcauuauaauggugguaguuaucagaagcucuguuacuagaguuagaagaacaaaauguuuucagcaugucaaaagguuuagagcuauuagaauuuaaagaugccuuuugaucacuguuagcuaugugggaaauugauauggauuuuguuaauguuuuaggcugggcauaguagcuaacaccuguaauccuaauacuuugggagaccacugugggaggauugcuucagaccaggaguuugagaccagccugggcaacauagugagaccccaucuccacaaaaaauuuuuuuaaaaaucagccaggcaugguggggcacaccuguuauuccuagcuacuggagaagcugaggcagggggguugcuugaccccaggaguuggaggcugcggugaguuaugauuguaccacuguacucuagccugggcaacagagugagagcuuggcucaaaaaacaaacaaacgaaaacaaccuacgaaaacaauuuauuuauuuggaucaguaaaaaugaauauaucuacacuaucuuuuuaacugcaggccucugugaaauuagagggcaagauggcuggauuugacuugcgaaucuuuuuaguauagcauuggaagaauagaaagaacuuucuuugccuagcaauacuucuaaccuagcuucuucauugaggcuuaaguuaauauagcuguuaauuugcauaaaauuaauugcauaagauuauccuguucucagaaauuagguaacacucaaaagaaaguacauauucauaaccauauccuuguucuauuuguuguuuuugaaucaucagcucucacacacagcuaguuuuugaagcaaauuuaauauuaugugacgaaacaguaaagauucuagugcaauaagcacaugauagauacacaagugaguuacggaguccagcuuugucucauuuaauauguuauguagcuauuccccaucuaauggauuuuaaaagaagugaaaaacuuacauccuggaguagcacauccugcuaucuacugugacuuuuuuuuuuugguugaggugugagagugugaucagaagccuaccgggacuucugagcuguguccacuaguacugcauguuaguacagaaggcuuggaaaacuuuucugcuccuuucuuccacuuggggucuagaaaacaaaagcaaacuggagucaaacagcugccuuuuuuuccguucagauagauacguggcuccucggaagugggcguugcauuuuucucuugacuuggcuuugaauucagagaaucacugaugguagcaccuguugcucuccucaguaaagagcuagauuuagacaguucagcuuucuuguuucuagauauuuccucuugugagccaggauagaacagauaagauaaccuucuugccugugaucuguggaagccuggcucaacucaaaggaugucuuucaauaucugaguaauuaaaauuacauccuugaacuacuaaucucuuuauuuucucuccuuucuuacuuuaccuucucuuucacuauaacugaguaggaguguuuaagggaucaaggacuaacagcaucauguagaaauuuacauguggucuaguccugcuuuaaaagagagguaagauuagaucaccucuaagguaauuauugaagauguuuacuuuauuuaaaaccuucuuugguuugggaucuuccaauuuucuccaagacucaccucucccacccaucucucaacuaguuccccagaagcuguugguuuuugacuuucguuuguuugccuaaaaacccacuucccucuucucagcucucugggacccuaagaaaaggucuuuucuguuuucuaugaaauacuccuuaaggcucuugacauacaaauggauuccuuacuuuguuauuuucucugacacggugauugcucuuuccugauacaugucuaccuugucuuuagaaaccauguuaacauuucaaauucuccggccuauuacaaguuaaaacauaaaaucugcauuuacuuagaaugauaauccugucuguagccagugcucuuaauccugcuuggaccacaugugugaaagaaggggagacaugucaggagucaagugacaggcauuuagaagaugcucuaacuccauagacccaggggcuacguaggaaagugauucguuuauuguuauuuuuagaaugguuagcuuuugcauuguacuuuuaaaaacacaccuuaaaccagucuuuuuugaauuuggaaagugacagaauggacaucuacuaagucaggccucugcagaagugagccucgagaucgaguuugaauuaaaugucugauuugaaaacauccuaaaauguagaguugugaauagaaguauacauuaacuuugaauugugagucuggcuguuuaauuugggguuuuauguugccaaauggauugagcaaauaagaauuguuuuauaaagagaguaaaacuuucccaguuauucugauaguugucuucuguugagccauuuuuagaaauuacaauugaaccaggaauugagaagggaguucucuuuaagggaauauuggguuuuugaauagaauucagucauauaugaaugugauuuuuaaaaauuugagguccugucuccuuaaucuuuuguuuuccuagccccauccaggaagucgguuuugacagacccagcuaaacucaaaaagcugcaacagaguggcgaggccuucguacaggaugauucuugugugaacaucguggcacaguugccuaaaugccgagagugucgcuuggacagucuccgcaaggauaaggagcaacagaaggacucaccuguguuuugccgcuucuuucacuucaggaggugaggcauuuugggaaaaguucagauaaucugggcauacuuguuaugcuagaucaucuggcauacuuuuguuacucuuuuaucaacaguaaaucuagaaguaaaaaggugguagauguugcauuuauaaucucuagguuggagaaucuagaucuuauugcauguuacuuuucauucuuauuuuugauuuuuuuuaaaguaacaaagcuuaaaaauauaaacuucuauuucaaaaaguaacagucauuauagaaaaaugucgaagguucugaaaaaccacuacaaauaacuacuguuaacuuuucagugcacuguaugaucauaaaauguauaccuaguugguauaccuaguugguauauugcacacccuguuuugaaucuuacuuucccauuacauaguaggaaccucuugaucauaaccuuuuucuuuaaauacuuuugaauuucuguguaagagcacauuauaguaauguuugauaauuuauuucaccaauucccuuguugguauuaagauuauuuuguauuuuuugugacuggaaguaaugcagaaaugaucuucuuguccaugucccugauuauuugcuuugggaggauuacuagaaguggcauuucugggucagaagguguguguguuuuaaggcuuugauacaccuguucugccaaguuauccuacaggaaggucgcaccuguguccuugacaacugcaggguuugagcaugcucccauggucucuguaccauugccagcagggagaggcauaccuuuuuaaaaaaucuuuuccaauuuuauaggcaaaauuuucauauauauauauguguguguguguauguauaugugaauauauguguguauauauauguguauauauguguguauauauguauauauguguguauguguauauauguguauauguguauguguguauauauguauauauguguguguguauauguguauauauguauauauauguguguauauauauauauuuucaaaaucauuuucuuuaaauucuucuauccugagugaagaaaaaagcagcccuaucuuuuuuguucauauagaaaugaacaguguugguauaguugaacuugagauauaauucacuuucucagaaaucuagguacuuucagguuggacuaacucuaaucauaaacagaagaguugauuucaauuccuauucuccuccucccuuuucauuuuaucuaaguuaaaagauugcugaugagcugaauuaaaugcacagggaauuuagaucauuauaucugugcucguaacuuucagauucaggcuuauuuaacgaaguaagaguuuuuuagguacuaguuugccccauucaucccuuuguaaauugcaaaagcacgucauaaagcauguggguagcauuuagagcuguaauacuguuaacguauguuaacauaugcauauauuaauauauucugaauaacgccuggcccagaauaagcuguuaguagaggguaacucuguuucccuuccucucgagaauuuucuucuuaaacaguguguuacaaugcauauucauuuguauguguaugaauuuugaagacacugaaaugguuaugcuuuguacaggucuuuguguuucuauucacuugauuucauguuguuauggcuccucugcuaugaaaaauauaacuagauuggaugagagagugguuuaaguugcaaaggcauuuuagggaagggauaauuuuuuuuucuuucuuuuguucuuuguaauaugauuagagcuuuuuuuuuuaacccacuacauuuuuguaacagucuagaagucauugacuuuaugacuuagcuguuuuuuucauuuuugacuucuuuaaaggggaaaguaccuuugccuaaugcugcguaguagaagccaguguaguagaaaccagaagaaacucauaucuugguaaaagaauaucauaauuuaacuuuuuuccugauguuuagagugaagauugaggcugucauuagccuccucaucaaguuuguaucucauuaaacucuucugcaaauaaaauaggaguagggguagggucucagugguaaggcucagcugcuagguccuauugccauuaccucccacuuugaaaugcuuucaaauuuauuuuuuuguguuaugacuaucucuaauuugggccaucuuaaaaaauuaaaaacuuucaucucucauuuugacugcuugaaauaauuugcguguguuagguaacagugucuuguccuuccaguuuauucuacacucuuuuggacaaaugguuuuucuaaaacacaacuuugcaugugucucacaugaugacuuuugauagcugcccacugccuagcaaagucaagguccccaaugaaauacugaaggcuuucagcaguugaccccaacuuaccucugcaaguucuuccugauucuuaccuauuugaauaaacccuuuagucuaauuagucuauugccacccuguucaccucuaguuuucuugcuuuuauaugaaguacugucucuuggacauaccuucuuuaccuaauugucuaccuuuucuugccaaagcaagcucaauuacucucuuuauuaugaaguccuugucguauuggcccacaaaacucauagucagcagucagcacuuccuccucugcucuuauaagaauuaaugacuguuaggauaucuguuacaggcuacuucauuguguuuuauaucuauuucuuaugucuccuacuagaaauauuuguuuguauguauguaugcauguauguauuuacuuauuuauguuuagagacagaaucuugcucugcugcccaggcuggagugcauuggcacgaucauagcucacuguguaaccucaaacuccugugcucaagugauccucccaucucagcuucccagguagcuaggacuacaggcuugugcuaccaugccuggcuaauuagaaaaauuuuuuuuuguagagacagggucuuguuguguucucugggcuggucucaaacugaaucugucucagccucccaaagugcugugauuacagugagccauugugccuagacagaauacuguacuuuuaggcuggguauggugguucauguuuguaaucgaagcacuucaggagaccaaggugggaggaucgcuugagcccaggaguuugacagcagcuugggcaacagggcaaaacccugucucuacaaaaaauagaaaaagaaaauuagcugggcgugguggcacaugccugccuucccagccacuugagaggcuaaggugggaggauugcugaagucugggaguggggguugccaugagccguaaucauaccacuguacuccagccugggcauuggagugagagccugucucaaaaagaaaaagaaaaauuuuguguuucaaaaauuuaaaacuaauacauagcuuaugaaaagaacauucaaguguuauacaguauugaaggcagauaaugaacaaauguucugcccuuuguuccacuucuuagguucugaggcccauuuuaaugcuucccucuuuccagaagcuuggacgguaacgugcagcuggaauuuauauaggcaccaaguaccucacagaccaguguggucauugcuucagugacuaucuagggguuacccuucuuuagcugagcuuuuuucuugaagcaguaguuguauuuaaaucugaucagauuauuuaucaccuucuguuuguuaacgacuuaacuucuguaguaacuugugauuuuccuugcucuuaagugucaaguccagcaaguugaacaacuaucccuggaggcaguaugauuauauugguuugagugcaaaauauaccucucuccccuucuccucccuccucuuuccccugucuagcuugucuuuuggggaaaaaguguuuuuaaucuuccuacugacauugccaaauaaucauuggcugugauuagccauggagauuacagaaaacuaggaaggacuuuguugauuuaaauaguaauuacaaguuguggaugggcacgguggcucaugccuguagucccagcacuuugggaggcugaggcaggcguaucaccugaggucaggaguucaagaccagccuggccaacauagcgaaaccccauuucuacuaaaaauacaaaaauuaggcgggagugguggcaggcgccuguaaucccagcuacgggggaagcugaggcagggagaguugcuugaauuugggaggcagagguugcagugagccgagauggcaccacugcacuccagccugggugacagagcgagacuccaucccaaaaaaaaaaaaaaaguaauuacaaguuguaaauaaguuguguguguguguguguguguguguguguguguguguguguacauuacaucuuuuuuuccccugcuuccccuagguuacaauucaacaaacaugguguguugcggguagaaggcuucuuaacaccaaacaaguaugacaaugaagcaauuggcuugugguuaccuuuaaccaaaaacguuguggggauugauuuggacacagcaaaguacaucuuggccaacauuggagaccacuucugucaaauggugauuucugaaaaggaagcuaugucaacuauugagccacacaguaagagcaucucuuaggggguaggauuuucgagcccaauuugauuuuuguuccuaagugacaccuaaguccuaauugcuuggguuuuuuuucacccagaaguuuagauaacuuugguauaaugagguugcauuuuuccuuuugcaacagguuugaucagaguuagccaccuaucuuugggguuuauuuugggccaauuaacagaggaguggaacuccuuuuuuguuaggaaaggugaagugaggguggaauuugcacagccucaccagcagugcaggcacacuaaaaggggaugaggucucagauugguuuauuuuaaaacaaagguucuuaaucaugaauacauuucgaggaaaauaagaaugggaaggcugacucucagaccuaccgaguuagagucugcagggcugggucccagacuugagaaugagaacagguucagaauggaaaugauuguuagagucaagguuugaagggaauacuuggagguucuagaugugcaugugcuugugucuuccccucuuugggagcacuguuacacugaucuggcagccauuaagccacaggaaucaggguagguggcacauuagagccagaccuccuucaugacaucucaagcuaggauguuuggaggacggugcagcgucuuccuauccaugucccucuguggaaaugaguuauccagccagaagcaccauggggcaucugucuuguaagccucauauuuucuuccaucauuuuaucuuuaccagugguugaaguuaaaagugaagccuuucuauuccucuggugugucucuuuuuagacuuugcuuaaccaaguauguuugaauacaagcauccaugccagucuuaagaauuuugauuuauuaccagcaacuaacaaccuagcuuaagcacaaaaauaacuuauugaauauauguggauacugucucagaguccaaggaacaggacuaggucauucccagcucuaggaauccagagcugccugggagaaagggaauugcgagugccugggacaaccagagcuauucuuuagaauuacuucauucugcugggguaguggagacucuaagucaagagucuuauuauacuuuucccccuguagucuguuuaagacaagcaauauuaguuuuccauuuucaauagagauacaaaguuucuuuauuaaauauauuuaaguaaaaguaguagauugaaagaaaaauuccuaaguaacuggucuggcagugguacauacaugacugcaauguggaaacacuuuuuuggaauguauuaguggcuuugcuccugaaucagcagagcuguuuuaagcaagugauggcuuuuucuuugauaaagaugagucaucuaaaaaauguuuuuuucauauagaaaaaggcacaguuaucuuuuacagcauaauuaagaaacucuccuugaagauuuaaaugggauuaaccucuccuccuugccuuuuugauuauccuguugcucuuucuuuucucugugacaagcuggucagacuggagagagaaacucacugugagugauacugaaauaugccaccauacccagaagaguuuaccucugauccugagauuagggagcagaucucgacuauuacuacuuuuauucuguccuuucagugacaaauaaucauuaaacagguggcuaagagaucuaagaguacuuucugaugaaacagucuaauccagguguccaagaugaaguucauaaaaucucauuuguaagaugccuaaagcuauaugaauugugcccugugcaauacauuauaauguaauggcagaaguucauucagcaguuggauugauuuuguauaaacuaaagcuuggucauuuggguuguguucagucugaagaaggaaugaguuaaccccaaacuggauuaggaaaaagauguucuccauagaacaggagugcagcagcuuugauccaguguuguucaggagagagagagacugacugccaggagucuccuagucaggagaccuugggcuuuucugugacccacagaaauguccucccuuugcucauacuucugaaagcuugcugauaaccugguuugguucccugauuuggcacuccuccaucuaggggaaggguucaauggcccauccaguuuuggaaggccucucccuccaguuauuaggucuuggccacuggaacagaaaaugcugcuuuguggaauccccggucgugccuuaaucugcuggauguuugguuagugugaguuaguccugggugccugcaucauuccuggcacuggcuaaaucgaauuucugacugacuggugaagaaacugaucuuggaccauugugccugcacaaaguuaaugugcaacucccuccaggcccccugagaaccuuggaguuuuuaaugggcagucugaguggauguaggguaucugaauaaccugauacucagugcagauuacuggguuuguggaucugaguaaauuuuucuuuuuuccuuuggagaaagccuggaacaugcugccuuuaaauucugaaagggacucaugacucagagguuaagaaccacuguugugugauaaccugugucugagcuccaacuuguguaacuacugcugcacagucugaauagggauucugcuuggaguucauucuccuagagggaggugagacugugccugaauacauaaagugagaagaggcaugaaucugaaguacaaauucaaguuacuaggagugcugaggggauccaggaacacuucaugggguggaggacagcauuugcaaugaagccugaacaaaguuaauuugaagucuagucacagggaggaaugacaauaaccccuaccuuucguuuuugguuucagaagcccucuccuuccaaagacuaagugauuuacugauuuuugcaggacagguugcuuggaagcgagcugucaaagguguucgagaaaugugugaugugugcgacaccaccaucuucaaccugcacuggguguguccucgguguggguuuggaguauguguggacugcuaccggaugaagagaaagaauugccaacagggugagaaccgauuugauucuccuccagccccucuacacaguuaaaucaaguguuuuuguugauuuguguuuggcggguuucuugaagcauguggagacagagucuguaaagaacaguuacuacaaaucaguuauuugcaggugcugcuuacaagacuuucucuuggcuaaaaugugugaagagucagauacaugaaccagagaacuuaaugcccacacagaucauuccuggaaaagguauuucaugugcugcagugauuuucuuuccccuugucuugguuaacucaugggagcugguaguuuuguuuuccuuuauuacucguuaaguuuauuuuaguguguauuguaaguuguccagaaauauauuagauaauuccuccaacacuuuucgagucaaguuuugugggauaguuuuguaguagaaaagaaaaugcauuuuggggaaggccucuggagcaggaugaaaaggagggagugggaaaaguaauccuguggggaaugccagcuucugcucuguaauguugagguugaaaguuccuaauauccuuguucagauguuugccucugcccuuucuuuagcacucuaugauguuggagacauuguucauucuguaagagcgaaauggggaauaaaggcaaacugcccuuguucaaacaggcaauucaaacucuuuucaaagccagccucaaaggaagaccuaaaacagguauuuacugcuuauguuaaauucaacaucucuuguaauugucauuugucuguuuuucaaauaacccaaggauuucuaucagugcauuugaaaggaaccuggggauagcuaucaaguggaaagagagagagaaagaauucauacaguucaugugacaguucagagacccguucugacuuuucacauuacuuucguagacucuacuguggccucuuguaguagguuuuacauuuuuguuucuugaagaagcacaaaguucuaaaguagucuaccuaauaaguagcugucgaauuuguaaaggguuuaaaaaaauuuuuuguguauuuugcagaauuaaaauuauuaagauaagcuuuaacauuuuuaaaauuacuaaauauauuuugccuguguuuaugcagaguugaaggaaaugaugaaaugaaccuuuaguugcccaucacacaauguaaaaaauguuaauuuucucaguccucauaugucucuccuugguggcaucccucuccuccccaccaucacauguacgucuugcugucccuucucccccucguuccaguaaucaguaugccgcauuguguuuaauaaucagaaauuuacauuucuauaaagcuguggugucauaaggcaggaugggagagcagaagacuuguaauauuuggagucagaacugaauuugaguucuuuuccuuccacgugcuaguuguguuacuuuggcugaagugagcugguuucuaugugcuucagcuuccucaucaguaauauagaaauaagaagcaauauugaugauugggcaucacagaauuacaucacauguaaagagagggccuggaccacaacagggguuugaauauuuuuuuuccuccuucuuauguauguauaaacucacucuugccaguuuuuaaaauuauuuucuucuacagcagucaucuuagauuuaauuuauggguucuuuuaagagcucaucacauuuuuaaagcuaagucaaaauagcauuuucucuuucucugcaucccauuuccuucugaaaucaccgcuuuaccuuuccugccugcgucauuuauucguuuuuaaccauguuuucugugccuauccugaauucugggaugaguucauaggggagacaggcacaaacuggucauuuuaaaccagcaugguacauagaguaauagggauauguaccagcaggggcuggugaaagggugcgggggguaauaccuugcuguguuuaaguugcugacaucucuccuaccuuuuaguuauucucuacuagugcgggauuacugcagcuguggggauacccagggcuaacuauuaggugguuuuguucuggauauuuaucuuacuuguuggucggcuauuaggagagaagaaaagaaaaggaagcugucauucuucagcuuauguaaaaucguccuuuaaugcuuaacacagacuucuuuagcuggagaaaaaccgacucuuggugcagugcuccagcagaaucccucaguguuggagccagcagcuguggguggggaagcagccuccaagccagccggcagcaugaagccugccuguccagccagcacaucuccucuaaacuggcuggccgaccuaaccagcgggaaugucaacaaggaaaacaagggugaguguuuccugcuuuuguguuuguucuugaguauuuuaguccauucguggaaggacuugagagaacagugguuagaagucguguggaauggaaagugcuucucuggagucauccuggaaccugccacaaaugaaaguguuuuugaaaugcagcaccaaagaggagaaauuuugcugcauuaaaauuuagggacuuccaccuucuggcuguguuacagaagagaagaauugcaggccacuucuuucaugcaaagaucuggagcaaaauuuuaaugaaucaaauuugacacuguaaaugaaggaauauuugaauguuagacuacaucugaauuucuggaaaaaccuuuauauagcuuuaaaaaugugauaaggagcucuuaaaagaacucauaaauuaagucuaagaugacuguuguagaaaaaaauaauuugaaaagcuggcaagagcacagcuggugaguuuauacauaccuuagaaagaggaaaaggaauauucaaacuccuguugugguccaggcccucucuuuacaugugauguaauucugugaugcccaaucaucaauacugcucauuauuucuguauuacugaugaggaagcugaagcauauagaaaccagcucauuugagccgaaguaagacaauuagcaaguggccggaaaagaauucaaguuuuucaagguuuuuccagaaaugaagauacagucugacauucaaaaauguagaagaaucaugggacaagaugcaggaaaacauuaaguaaaauucaguaccuguuaaugauuuacaaaaaacuucuuaaauuaagaacauucuuaaucaagaguuuaaaccaaaaaacaagacuggagacaucauaaauagucguugaauuuuuuuaaaaauuuguuuugaguuuuuuugagacggaaucuugcucuguccagccaggcuggagugcaguggcaugaucuuggcucacugcaacacugcacucugccucccagguucaagccauuguccugccucagccuccuaaauagcuaggauuauagacgccugccaccacgcccugcuaacauuuguauuuuuaguagaagugggguuuugccauguuggccaagcuggucuuugagguuuuuguuuguuugguuuuguuuuuuuuuuuuuaaacaguuucuguguucaagaacaagacaaaggauaucuguuuucacucuuuauuaagcauuguacuggaaguccuggucagugcauucagggaaaaaaaauguguaaagagaaugcugccaauauuuguagacaguacaugcaaaaaauccaaaagaaucuacauuuacuaaacauuugucaggguugcuagauacaaaggucaauuuacaaaauuccauuguacuggauaguuauuguuuuuaacaucagugaggaaucgucuaaguaaaucauaucauucauacuuacucccuaaaguauuuuuuuuguuucaguaaauagaaagcaaguucuaaaguaauucugcuaguagaauacuaauaagggauuugccuuucagaauguuuuuucaucuggauguuuugguuuuauuuuagaaaaacaaccaacaaugccaauuuuaaagaaugaaaucaaaugccuuccaccccucccaccuuuaagcaaauccagcacaguccuccauacguuuaacagcacaauuuugacacccguaagcaacaacaauucugguuuccuccggaaucucuugaauucuucuacaggaaagguauguguuuguuuguugguauuccauguuuuaaaguugaagacagaacaggaagagaguagagaaguuggaacugaaaguagaaaggagacugaaucacauacuuaccuuuguggguucagaaggcugagucacuggaggauggguuuuaugggacuauaguucugagcugggccacuuucuccuguuaccucacuucuaugaguugucaaguggggacaggggacguaccuuuuugccuggggguccuggcuuggaaucuucuggauauguaaucuauacucauuaugggaauggaguuucuugaugguaagggaaugacauauuugagacuuuuguucuuucuccaauucagacagaaaauggacucaagaauacaccaaaaauccuugaugacaucuuugccucuuuggugcaaaauaagacgacuucugauuuaucuaagaggccucaaggacuaaccaucaagcccagcauucugggcuuugacacuccucacuauuggcuuugugauaaucgcuugcugugcuugcaagaccccaacaauaagagcaacuggaauguguuuagggagugcuggaaacaagggcagguaauguaggccucccauccuccugcccuauucagaacccccuucucaguuccuuuagcagacuucugacaaccccaccccaggcuuucccccuccuucaccuccuguuuuauucuuuauuguuucaggugaauauaaucaggucaggauguggccaugggucuuacuuuuuaaagcagaugguccuaagcuggacuuuuccagucagguuuuuguugcuuccuaccagucccuguuggguuuuugacgagggcauccaggcuuggugauuccuaugguaaacuucagcagaggaagugagggugugacuacaggcugaugggauuugggagaucagacaaaaugugcuacaaaaucaugcaccccucuuaccugaaugaaaagccugugcugaaggcaguucuaggugggcuagggccgcguggugucacauaguccccaggugccugcuucaaagggcaguguuguuggaucuuaagugccgguuaauaucuuuaggagaauuucuaggccugcuucugugcuuucuuguuuugguucuguuuucuggaucucuggcuucucuguuuggccagauagggucuuugcuaaaggaacacucugcucuuggacaagaauuugggagaauugccaaacagaaagaugugaguguuuaaccaaaaauaaauuuccaaaauguuuuucuccauccaguguacuaauaggauuugcucauuuaaucauauauagacaagaaacaaaaugaugggcugaauacaguuuaucggcaggcuuucuuucuugcuugucaauauuuuaauguuagacuauuucacauaaagguuagagcuucuggguugucuuagacggccaaaagauuuggcacccucacacagccaguaguagugaggggugucacaggccauauuccugcuuggcaauaacaggcucaaguacgguggggucagucacccuguuucacuggugacuggugucacuggacacuccuuccagcgcuugucuucuucacaguccgucuugcuguaaguaaugagaucuuacuaggagaggugauccuuucuccuagaugcuuacccauguaguuugagagcaaggguguguagcagaugaauggugaagguuggaggugcuuugggagcucagagaacuaagccgaaacugucacaucaccaucugagacggagcaccagcuccauggaaauauaccaauagcagugugaagagggacugccuucgggaguggggacagagcuggcagaguucagacuaaaguuuuccuucucuucauuuagccagugauggugucuggagugcaucauaaauugaacucugaacuuuggaaaccugaauccuucaggaaagaguuuggugagcaggaaguagaccuaguuaauuguaggaccaaugaaaucaucacaggagccacaguaggagacuucugggauggauuugaagauguuccaaguauguaugaaagaucuuuuaaggggguuggggaugugaaaggaggggacacaggaauggcaggagucugagacccaucaguggcagccgcagcauuuuccaggauuuuggaguuuaaaauuaacgucucuccuccccuuccuuguuacaauguuuaugcuuuuaaacacugaggcauuauuaccuguucuguuggucuuuguugucccuggacagaacaucagauagggucagucucucucucugagcagaauaaguaauuucuguugcaugcuggccucagaaaaauggguuuacuaaacaccugugacccuugaugguugacgugcauugcuguugguuaguugggaugcugcucacuucuucuggaacacuguagaggaggagcagauuggaucgaugacagcuguugaaauaccaccuacaugcagugggcaaaagggagcggcugaaucucccaagaaugaguagcagcuuaauaagcuucuaggaaagacaaggcccugacacagauccauuaguuggugaucuuuauuuugcugcaccuugcugccuccuggguacaaauggauuuuuuuacacugcagaaauaaaaugguggauaguugguaggaggggaaaauuaaggaaaaguaauauuuguauacuaaauuuaucagguuaugaaaauuuugcagagacauauuuuauuuguauuguugaggcauaaaaugcuaauuugucauuuauuuuggucuguuucugaauuauaaauaguaauaguucauucuguuuaccuuucagaucguuugaaaaaugaaaaagaaccaaugguguugaaacuuaaggacuggccaccaggagaagauuuuagagauaugaugccuuccagguaugauuaugaagguggggagagaugauucuguccuucacuugguaggauaaauucuuuuuugagguagugagaaaacaguuuucaagaaaauaacaaaaguucuguaauuauacugccacugauuuuucauuucuagucuguagucauuggaggcauguuuauuuuuagaugagaugaagaagugauuggcuuuuaggccuggcugacuaauggaacaccacagauuuuccaugguaggcccugcuagagaagaggcucacuuuuucuuacaaggcugauuuggaggcaguuguggaaucugaccugucagggucaggacaauguagucacagcacugaguuagacaagaagacaucuacuggguagaucuauuuuccugacugagcuugaaacuuugaaaagggugucacaacuaaucaaugauauaucucuaagaauaacuuuuugucuagaauuuauugcugagaucuuuugucugaacgguuacagcugauuuugacacauugguguguuguaggagagagagaagacaucuuuguaacugcuguacuucucaucuuaaauauuugauggcugucagucugcaugaucacagauggauuuguuccuuuugguguagaaggaacaaaacagguuacacaauaaugaauuagaaaagcaaucuaacuuugcaaauuccugguucuguuguucuagguuugaugaucugauggccaacauuccacugcccgaguacacaaggcgagauggcaaacugaauuuggccucuaggcugccaaacuacuuuguucggccagaucugggccccaagauguauaaugcuuaugguaaggaggagauggcuaacuuuaaaauggaaauaaaacaauucaaaauguuuggaaaauugauuuugugggagggagagguggaaaacacccauaauccuaaugcguaauacagccacagcuuucauuuuuacauauuuccuuucguucccuggccacauguuuguguguuucuuuucauaguugcaguuguagggcauaugcaauuuuguguuuuucccuuuacuguaccuaauuuuacauuguaaaaucuuuacauguuacuuaauagucuuuagaugacuuuuaauggugugugauacaucauugagagaauguacuuuuauuagugauuucaguguucggacauuuaggucaaucugcuggcauucuagcugucuuaacaucugcuacaauuaaaugcaguguucuguguuguugaguagaaguuaguuacuuaggauucaaaguacccuuugaguuggacuuuuauucuuuugacaugacucaauacucacugucuaacaaggaggaugccugggauaaagauugguuucuccauuuaccagagcuuucuuucaucaucauuauaacugagaucuucgucaguuuuacacauggccuuuaauuagggcuggauucgaguuggccauuuugaaggaaguauguauuguugaaugcaguucuaguuguuugaauauuucagugaauuuuauuuacucauuuuuacuauuuggccccuacuuuuccaguccuccuggaaauuacuuauuucuuccugccauaauuacuuccaugucauuuuccauuucuagccuuagaccugugggugucuuucucaaaaaggacaaggucuguuguugucuucgcuauguucuccaaagacuguugggggagggaagggaaggaggggcaaggacuccagccccacaauucuguuacgguugagucagcucagggaaccacuaggaguguaguuggggacuguugugacaggggaguguuuuugugugcaagcucccagcagucuccaugcccaagauaguucugccaggguagggguaccagagaaauugugugugggugagaagacccggugggcacaaggccucuugccuguuccucacuucucaggucucuguuggugaguccuccaugugcugugggucugcagugugcucucucgagguccugucccucgagccccucagagacugauuaaagcagcugcaugguugggaucuugggcaaacuuaaguauauaagagcauuuuuccaauaaauuguauaguuuauccaugcuuuauagaaauccugaagcuuuaaagguggguaucugagaaauuuucaaaagaauugcuugcgugguuuaacuagcuuggcagcgggucuuucccccuagacacuaauagauggcaguguuacucuauaaaagcuuuuccuaugacaaaaugguucccauccagaagcaagcauucagaaggaugaaaauaaugauguguucauuuucaaacaccuuauaucuuauuguaaacaucauuaaagaguggucuuuucaaagguugugugauugagcugugacucuuccaugagaguaagugcaaaggcucuuuggagagaucauauaauccagccucucuucaguuccugcaacaccccccauuuugcaaaugaggaccaggacuugcggacaguagaaggggcauugacuuguucaggaucuccaaggggcagcuaguggcaggucugaaacuaguacuuagaucuccugauuuccaagcuagagcccauuucccuacucuucccccacucuuaacuccccaucacccaacagccccuacuguuucagcuuuuuuucccccuuaaaaguccaugguguuuuguuucaggauguuuuguugucuagcacuccuuucccuuugaccauuauguuuuuacaauuuugguuucaucucaguuuaccaugguuuagagucugguuuuaucaauguacaguuacccaugacugggauccaguggacuuugggccaguggcugggcagcaguuauuuccuugcucguuuugcacuguggcacuggcuggaucagcaggcagccaguccugcugaggcuuugccuccuagucuccuuuccuuacuuuucuugccagcuccauccucuuccuauugcccuuagucuaaccaccaucuucaaguuuguguuuaucguuugcuuauauuuacaauuuuaacauauauauuuguauuccugcacaauauucuuucaguuuuuagccugcuuuugaacuucauauaaauagaaucagauuuuuuauauucauccaugcugucauauaucauccauguguucauuucauucauuuuauuucuauuacauuaauugcuuuuuucugaaauuuugcuuuuuacuauggaacuauuuuucaaauacagugaaaacuugagagucugguagugacuccauauaacucaucacccaguuauauaacagcuuuuaacuuuuugccauaaucguuucauugucuucucucuuuauguuuuuucaucauccucucaacuauccuaugauuucacccuaauaccaaacgcuuuaccuacucccaggacugauauuucagcaagcuggaaagaaaggaaaguacaacagggcucugggggcccuggucccaagcuggagugaagaaaugugcccucucaaaaguauagccccucuaaaaccaaagccccaggcaagccagagauaaagccuuccuccaaaacaguauuauggggcguuuucagaggcuggcagguuagaaaacagccgcugcuugcucacuacaagcugugcuucucccuacugcccagucuaagaagcagaguccugguguuacaauggguugcccaaagugacugcaggguaagcuucaggaugauuguugagcaaggugagcuuucuccugugagcaaggaauuagccacagacugaacacugugggggaccugucuuucuggcucacuccucaccccuccucuuuuacaguugagagaaccaaggaaugcguugggcaguauuccuucuuauacucaugauagccauuugacguuccagguuuaugugugugugugggugggugcuuucccuuggacuccccaucucgagugguccuugggcuuugucucuugccccagaacuccuaggcuguggcaacaaucaaagccugagcucacuugaucuagcagauguccuuuuggcaaaucccagcuucggaagccugcuuuaaccacuuccauuuccugcuguuuuuggcuucugaguauuccuucuuuucuugcuagcacaucgauugguuaaagaauuuuuuugcaauaauuugauccagaauuuuuauucucagcagaagagucaaucagggaccuaccaucccccagguagguaguggaaagacuguggcagccuuuguugucuuuuguaaaacuuaaggcacuuuguuuuugcaggauuaaucacuccugaagaucggaaauauggaacaacaaaucuucacuuagauguaucugaugcagcuaaugucauggucuaugugggaauucccaaaggacagugugagcaagaagaagguagggugcugagcauaaaaggagggcuuacucuuugagccagggcuuguggucugauaucugcuuucucuucuugcucuagaaguccuuaagaccauccaagauggagauucugacgaacucacaauaaagcgauuuauugaaggaaaagagaagccaggagcacuguggcacauauaugcugcaaaggacacggagaagauaagggaauuucuuaaaaaggugugcugcuuauggcaugugugaacagaggcauaaggaauagcaauauuauguuacuacauguggugaacugacuggcuuggcuaggggaauugucacaaccugaaaaguuaaaucuguaccugucagauugaauaggcugaaggugguugcuaaggaacaaggauucuaaaugauuaggguuacacuucuaaaaaaagcaggccuugucuuuuaugucuguguuuuguguuagagugcauuuagagauuuuuguucucugcuuucaaguuagaaguuaguucaucugaucaucucccagcauauaucuguuuuuauugccuugagaaucugagcacuucagacguucauguauccuuggcccugagugaccauguucugagugaguugcuaaguuugguuuuguccacugucauguagcaagugguccuacuuguuacuagcaaggguugcagggauuuggaagauucuagguuuccccuguaguuggcagguuuuuuuuucagcaagggcuauguguggaaauucuaggcaacuagaaagaugagucguguucaguuuuaaaauuguuuggcacugaggcugccgguugcaacucaggugucuuuggcugauauucuucagucauucaugagucuuggauaugaacauucguaaccuguuagcuggccccaaguaugucuuuaacaagcauuuguuugaaucaaaguguuucuggcuaaggaucauuuggcucuuccagaaaaccggcuuggucaccauauuguucuuuugauauugucacucugagucucugcuuuaccaguuacuggaucaaggauaaacaagucuaaucugcagcugucuuugggacuguuucguaagucagauuaaguaaaggcagguuucuaauaacuuuaaaacaaguucauuuauaaggauacugagccuacuuauguuuaaaaaucuagacuaaaauauuguuuaaauacaguauuuacaaacuuaugcagagccugucagucaugguuuaugggaacugacaucacauuuucuucgucauucuucuguugguucauucagcugaagucuuugauacuacuagucgucuucugccaaugggggcacuuaaguugaagaaggccugacauuuaugaacugccaacacuguuuagaggaaaaaaauggcuuauugggccuuagcauguuacugaguugcauaauauuuugaauguauucuagguaucagaagagcaaggucaagaaaacccagcagaccacgauccuauucaugaucaaagcugguauuuagaccgaucauuaagaaaacgucuucaucaagaguauggaguucaaggcugggcuauuguacaguuucuuggggaugugguguuuaucccggcaggagcuccacaucaggcaagaaucauuacuuuuucuuuaaucucuuuaugucaugaacuuuuggguuuguuacugauauauuacuugguguuuuucagguucauaacuuauauagcugcaucaaaguggcugaagauuuuguuucuccagagcauguuaaacacugcuucuggcuuacucaggaauuccgauaucugucacagacucauaccaaucacgaagauaaauuacagguaaaaauagcaccaauuccuagcauucuuuggcuauggcuauggcuucauggcccauucuucaccuuauaaagagagucagugaacuuggccauaucguacuuaguacacagugagucgaggaacuugcuuuauaucuaguacuacuaucuacuuaagugagggaggaacaagaggaaaucucaccuugguuugauuugauauuguuuagaaucuauaagggacuguccccacagagaaaggccuuaguacugaaaaugaauagaugugacuucugaucuuggcccagcugccugucggggucuugaacacagugcuuaaccuucagugcugcaguguucucaucacucuuagguagagcagaacugaaucucugagacucaaagaggucugagggggugguauuuucaaaaggauuucaguaaugaauuauguaacauaauuucauguuuggaaaauaagggaaaaaugauaaaagcuguaccuuggaacuugccucucccuguacucacugugaguaggucuacgugguaucaaaaccucuaaaagggggaaaaugaguucuugaaaucauggguuuaaaauguaugugaaauacuggucugaaggagcccagggaccuuuugcaauguugacauuucauacgaauauugaauuuuaaauucugagagaagguaauaaaauuaguaggaggaagcuuauucuuagugacagguuuuagauuuaaauguaaaaugcccauauuuucuccuacuauuuuuaggugaagaauguuaucuaccaugcagugaaagaugcaguugcuaugcugaaagccagugaauccaguuuuggcaaaccuuaaucucccugcacauuggaaaugaauuacaggcagcuguucaaacucuucaggcaggauuccuguggacuuugagauucauguuaccucaucuucuuuuuuaaacuguacccaacuugugaggguacucugucuaauguauauuucuaguguuuacagacaguaaauguguauauguaguaacuauuuacagaacaugcauccuuaaacugugacuucucaccuagugcagaacuuuuaccaggcuguaaaagcaaaaccucguaucagcucuggaacaauaccugcaguuauucuucagcuguuuggacaacuuagauuggguuuauaacuauuaggaaucacugcacaguuuauuuggguuguguuuugugucugaguccccucccucaucccuuaggguccagaagagcaauggaggaagugacagcuaauguugcaguucuuauuguauggcauaggacuggcauuauauagcagaaaucaacuacuguacaauuucuugggguuaaccaucuuuaguuaaauggaauuuuaauuuaaaugacgcuuugcuaauuuuaaguguuaagcauuuugcauuaaaauauucauauaauauuuuggcucaguuuauuggcauuauccucucauugugguuucaacacaacuuucuucaaaugcagguguaauggauugcuccaagaacucuucuuaaaagcaaagaaaucagaugcuauagugauuuucuuagugauuauuacaaagcuaacauggaaauuucugcucagccagguagaaacccugucacacuuugucaaggaaacaccaccaauuaauuaaauuuagaaacaggaauuaaccaagaaaccaaauagugccaggcuaaaugguucuaaaaagguaaguaaugaaacacuuuguuuuauggcccuucauaauguuaaguuuaugaaggaaaaugaaauuauaaguucuaggacaguacuaccuaaaauauucaucucugugaaggaaaaaaauucacaaagaagcgccuuucuuuagcccacugauucuccuaggccacucuuucauuuaauuucuuuaaaaaaaggaauuaaacauagaaaucagauaguacauagacaaagccuagaaccugaguuuuaauuu

SEQ ID NO: 14691 - RNA, 651 nt, Homo sapiens
ugcuuuaauucucuuuaagagucacagcuguccauuuuccacgugcggcugaagaauggauuucagagcgcucucccuccggcaguguucaccuaguaaccccuuccggauaaggaccugcagcccgggcgcgacccggaaagggaauccgcccuuuucgccuccuucgcgccaaucgccuggaguuggcguuuccgcagccgggacacagcccacccucuaagagccgcggagucggggacgguagaaggggccgcgcgugcgcaguggcguccgcugugcuuccggugcgccgggcgcggacgcgggcacgcacacacgcaagcacgccuccacuuaacucgcgccgccgcggcagcucgaguccaccagcagcgccguccgcuugaccgagaugcugcgggccugucaguuaucgggugugaccgccgccgcccaggugagcacuggggcucccggaggcgcgugaggaggcugaacuagaaccgucagcgaaaaacgggggagccuuggucgcugccuagccuccaggacaaaggcgagccucagggccacccucgucgggagaggcccgggcgggcagcuaggcagccaccagggaguucgccggacugggaugacuugagguuauugcagcagcgggguggggug

SEQ ID NO: 14692 - RNA, 651 nt, Homo sapiens
caccccaccccgcugcugcaauaaccucaagucaucccaguccggcgaacucccugguggcugccuagcugcccgcccgggccucucccgacgaggguggcccugaggcucgccuuuguccuggaggcuaggcagcgaccaaggcucccccguuuuucgcugacgguucuaguucagccuccucacgcgccuccgggagccccagugcucaccugggcggcggcggucacacccgauaacugacaggcccgcagcaucucggucaagcggacggcgcugcugguggacucgagcugccgcggcggcgcgaguuaaguggaggcgugcuugcgugugugcgugcccgcguccgcgcccggcgcaccggaagcacagcggacgccacugcgcacgcgcggccccuucuaccguccccgacuccgcggcucuuagagggugggcugugucccggcugcggaaacgccaacuccaggcgauuggcgcgaaggaggcgaaaagggcggauucccuuuccgggucgcgcccgggcugcagguccuuauccggaagggguuacuaggugaacacugccggagggagagcgcucugaaauccauucuucagccgcacguggaaaauggacagcugugacucuuaaagagaauuaaagca

SEQ ID NO: 14693 - RNA, 85253 nt, Homo sapiens
aagcgcacguugaaucgcguggugacuccgggcuugagguugaauuaagaauagucagguggugaguggaacgucucuuggggugucggaauucaaaacggaccuggaggauguugaucuccaagaacaugcccuggcggcggcugcagggcauuuccuucgggauguauucggcugaagagcucaaguaaggaguuggucggguagcgugcccagccuggaucuugaggucggcgcccuaaacuacgauucccagaagcgcuuuugcccagucuauccucuugaguccaggcuugucuggcgcuuguccugcugggagccguaguucugggaacguuccugggccggcguggacugccuggauaagaggccgguggugcugggggaaagaguuugcgcugagguaggggaauauaaggguggggaggguccuggucugcagcguuaucaucugccagucuccucguuaacuaacaagcauuuguggaauuaaccauaguguaccugacaugguuaauuaggcacguaguaaguuuccucuuguuuguaaaaugauuguccuucaagugucaguucaggcguuaacuucucuuugcuaggacccugcuauauucucggucugguuguuaaaucaagggaacucucuuuagucuucauuuugaucaagguagcauuugacauucuccaaugcacucucuugaaacuuuccuuucuuccagaaccuuauuugucuucaaguucuccuauuuuuaugacaaauacuucuaccucccucucuuccucuaucgaucuauaaccucacaaacauuuauugagcauccaguuuuuuccaggcaccaagcuaggcguuaaugacacauuggugagcaaggucuguaccucauuuuacuccuuaaauguugauguucuucaagauucuauucuaguaauguuuucuucaugguaaauauugucccuagacaaucucaccacuuucaugauuuauagucucaaauuuaaauccccaacgcaaauuuauuucccugauuuucagacccauuuguucagcugucuguacaucuuuaauugaauuucacacagagaucuuaaaugcauaucaaaaacucaacauggccuaaaugcauaucagaaacucaacauggccgggcacgguggcucacgccuguaaucccagcacuuugggaggccgaggccggcggaucacgaggucgggagaucgagaccaucccuggccaacauggugaaaccccgucucuacuaaaaauacaaaaauuagcugggcgugguggcgggcaccuguagucccaguuacucgggaggcugaggcaggagaaucgcuugaacccaggaggcggagguugcagugagccgagauugugccacugcacuccagccuggcgacagagcaauacucugucucaaaaaaaaaaaaaaaaaaacucaacacggcaucccucuucaaagggagggguuacuuaccccuccaaaaugguguacguagugcaaaauagucacuagaaacuggaaaauuauucuagaucucuccugacauauaacuuauuuauugggcucuuacuuugugucaccuacaugucuauuuguucuuagucuccuuuuucucccaauugcuacuguguugccucuggcccuuaucucauauuugaauugucuuuuccuuccacccuccccuuacaccucucaagugcaugcuccacacugcugucaaaauuauucuugcaaagugcaaauguagucaugcuacugucacccuuaaaacccuccaaauguucuccauuucccucagauaaaguauauuuucuuagcauagccugcaaagucucccaugaucagaccaaugcugauuuuagcuauaacaucaucccuucuucagcccuauuaaaccaccugcauauuccagaaaccgccaucauauuucaacaucugggccuuucuuuaagcuauucccucugcaugcaguguccuuucagccaaaaggagguacuucccucuguccccuacccaacauacacaccugaaagcucaguucaccucccuuguuuugugaggucauuuugcacaugauacaguugucugucauggugcuuuagugacuuuuugugcuuauguauauuugucuuccuccacuauccuugagcuucuuauaugugucacucuugucuuuuauccucaagucugaauaaauggaugaauaaacuccugagccacagcucugguaucauugguaacagugugcuagcccagaaauuccaauuauaucaucacugccauaaguggauacgauuucauccaaaagcagaaguguuuuaaguugccugaauuuuuaaaaagauaauuguggaguuuucaaacaaguuuagaguugagacauuucaauaauacugccaccuuuuauugugccagguucuaauagcuucccaucucacucagaguaaaaaccaagucuuuacaaauggccuggaggggucauuucagucuccuguuaccucucugaucucaccucuauucuggcuacccugaccuccuugcugcauccagagcaccacgggcacacauccaccucaggaccuuugcacucccugcuucuuccuccuguaaaacccucugcccaggugacuguauggccugcucccucaacuccuucagccuuugcccaaguuccuccuuagugggcuucuaggaccacuugccuacucugcucuucccuuucccugcauuauuuuucgucauagcccuuucugccgucuaacagacuauacauuuugugucuguucccguuccuccaauagaauguaaggccuguaagcauagcaguucuugucuguuuccuuagcacuuaacacugucuggcacacagugagcacucuggguauuuguugaguguaugaauagauggauagaggagcuagcugcucagugcuuggcacuuucaguccuuaacgacacccauucucaguucuuaacaacaccauuugugguggcaccuccaguaaaaaauucaggcccagagaacaaaaugucucucuaggaaguggcaaaggucaucuucaaaccuaagucuauugaucucaaacucuacugacugguggaauccuugcuaguugccccuacucuucaucccacuccuguaauggugggagggacuuucuccucuacaaagagagaggaacuuuguuugacacuguauuuucuguauguuaucuucuaaucaucccaauagagcugcugugaugcccagacuucaggugagaaaaaaauuagguaguuaucaaaggauacagucagcagagugaaagggcaacccauggaaugggggaaaauauuuguaaauuauauaucugaugagagauugauaucuagaacauaaaaagaacuccuacaacucaacaacaacacaaaauucaauuuuaaaauggacaaaggacuuaaacagacauuuuuccaaagaagacauacagauggccagugaguaugugaaaagauguugaacaucaccaauuuuagggaaaugcaaauaaaaagcuccucaaauccaguagggugcuacuaucagaaaaacagaaaguaguaaguguuggcaaggguguggagaaaguggaagcuuuuuguacaccauuagugugaauguaaaauggugcaaccacuauggaaaacaguaggguggauucucaaaaaacuaaagacaaaauuaccaugugauccagcaauucuacuucuggauguguauccaaggaauugaaaguagggucucaaagagauauuuguauaccuauguucauagcagcauuauucacaauagugaaaaaguggaaacuacccaagugucuaucaauggauggguugauacauaaaaugugguauauacaugcaaugggauauuguucagcccuaaaaaaggaaaaaaguucaacacauccuauaacauggaugaaccuugagggcacggugcuaagugaaauaagccagucacaaaaggacaaguacggugugauuccacuuaauauaagguaccuagaguagucagauuaaucaaaacagaaaguaaaaugaugguagcagaggagaugaagaauuacuguauaauggguacaggguuucaauuuuacaagaugaaaaaggguucugcagauggagaguggugaugguagcacaaugcaaauguacuuaauaccacugaacuguacuaauugaaacaguuaugaugaauuuauauauauuuuauuacaguuucaaaaauuaagauuaaagaacaaaagguaaguaauuuguucaauguuacccaguucaggguugcagguggacucuagauuugugggaagagaccacacgcacaacuuuugaguuagaucaaguuucucaugaaauuagcuuacuggcagcaaggugaccauauagacaagagccacagcagcagaucugccucccugucgccuuggcccuuagagugacacuggccaugcaacauagaaucuucuagagcugagcagcuuaguuccugauagacuaacauuguuuuacacucagaacaugucaccacucaugaaaacuugacacuauuuuugugcuuuauuaaagggaguguuuacaucauuaggggacucucguuucagccuucggauuuccucuaggcugucagauugggaugguuucuuugucuuuauuuucuaaaucagaaaggagaaaauuguaaaagcaaaguuagccuacuaaacauaguuguguccuaugggagcaccuuucaaaccaaacauaaaaugugaugaaaccuuuuuuaagguuugacuaaauguguuuaauguugucaaauuuacuauuucugcauacagggauuguugcaucacauucccuucauugaacugggugggcuuuggaguuaagucuauuccauauccugccucccccacauucuguuuguauuugugucaccuggauucaaucaccuaacuucccugagccuugguuucguccucugaaaaguacauguagugaugaguauuucagaggauuaagaucaggacuaaauaaugcggccaggcaugguggcuuacuccuguaaucccagcacuuugggaggcugaggcaggcggaucucuagagcucaggaguucaagaccagccuggguaacauggcuaaauccugucucuacaaaaaaauauuaaucgaaaaauuguuugggcauauugacacacaucuguggucccagcuacucgggaggcugaggugggaggaucacuggagcccaggaguuugaggcugcagugagucgagguugcaccacuacacucuagccugggcaacaggagugagaccuuguuaaaaaaaaaaaaaaaaagacagaauaaugcugccugugaagcagucaguguauaguagaugcuuaacuccuuuuuaugaacaguuuaccaguguacuuagugcaaguuuuguucuaaaucuguuuuuaagaaguuaccacucauucauuuagcacauauguauuuuaugacuuauucauuuagcacauauguauuuauuaacuauuggguaccaacucugcacuuaguguugggguacacuagugagaaagacagauugugcccuccagagcuaucaagcaggcauuaaauaaucacuuaacuauagguuugugcuggaaaggaaacaucagagagguugguaacuuuagcuuuccucuuggucuuuuuuauccccuuaggaaauuaaguguuaaauccauuacgaacccucgauaccuggacagccuggggaacccaucggcaaacggccuguacgauuuagcuuugggcccugcagauuccaaagaggugugcuccaccugcgugcaggacuucagcaacuguucugggcaccugggccacauugagcucccacucacaguguauaacccucuccucuucgauguaagugcugccuuaguugugugggucuccgggcugcuggugggauuugugagugcugccucucucccacaagaguggucuaaggagguuaagccccaggcacuccaaugaaagcauucuguagaaugagauuuugaaguuuugagccaaauacaauaacuucaacuuacccuguggcccuaaauaaaugaauaucaguuugauuccaguugaauagagccacagccugauuccguuugcguggagggucggggagaguucagauucauucccuacaccuuuuguugcaggggcuuugugcucuucagaaaucucaguggcaccugccugguaauagagagaacuucaguguucucagggucucccugagcccuucaggugucucuauaggcacuugugugguggcaggagaagcaaagccccagaaagcccaacagugaggucagaaugaagcuccuguuuagagucaugcugguacauuuucagcuuuuuauuucagcuaaccucaccuccaggauuuuuuuuuuuaagcuacacauauguugguauacauggacaugauuuuugucuguuaaucguguuaaagagaagugucuuuuuuuuuuuuuuuuaagacagugucucauuccgucucccaggcuggagugcaguggcacgaucuuggcucacuguaaccucugccuccuggauucaagugauucuugugccucagccucccuaguagcugggauuacaggcacgcaccaccaugcccagcuaauuuuuguauuuuuacaaaaauuacgggagacagguucaucauguuggccaggcuggucucaaacuccuggccucaaguaacuggccucaagugaucugcccaccuuggccucccaaaaugcugggauuacgggcaugagccaccgcaccuggcugagaagucucuuaauuaaaucuuggaauaaaauaaagauauuuuucuaccucagguuguacgcccaaaguaaauuucaaaucuaaauggauuaaaauaaaaccuuaaaagaaaauagaggguaauauuuaucugguucuuaagauaacaaaggccuuucuaagcauguaggcugaaguagaguuuuuaaaggaauagacugacuacauaaagaaacuugugaguauaccgaaaaucaccauggcuacugugucucuuucuaauauccuguuuguuuuuauucccucucuucagaagcuguaccugcugcuucggggcucuuguuuaaacugccacaugcugacuuguccccgggccgugauucaccucuuacucugccagcugaggguucuggaagucggggcccuacaagcagucuacgagcuugagagaauucugaacaggguagguggguagugguggucacagaaaucagaaaaggcaaagugguguggggaacaagagaugcuuguauguuguccuaguuaccaugccgauagucaucagaacguuugaucuuuauaucuuauaacuggauaccaauagcugagugugaaaacaggaagcuauaagaauaauaaaagaaauguucauagaaacaauagugaaauaccauuuaauccauuuaugagcuuuugcugauuuucuggaccaaggauucaaucaagguuuauucaaucaaaagacauugcuuuugauuguuacaucucuuugaucugucuuaaaguagaacauuguaauguagaaaauucuuuuucaugauaccaacuuuuuuggagacucaaagccaguugucuuauaggauuucuuacauuuuagauuguccgauuauuucuuguaauuagauucacauuuuggcaagaauacaaccuacaugauacaggguacuuuguauugcaucauuuuaggaggcauaugucagguuguucaccuauugguaaugcuuacuuuguuuacuucuuguauuugguuuuuuuggucuuuuuuuguauuaacacauaauauuuacacauauuuuaugggguacauagugauggugugauacagacaguguauagugaucagaucaggauaauuagcauaucaguucucucaaacauuuaucauuucuuuguguugcgaacaugcaauauucuccuucuagcuguuugaaacuauauuauuguuagcuauggucauccuauaaugguguagaacacuagaauuuauuccuccugucuaauuguaauuuuaucuccuuuaacaaaucucuuccuguuccccuccuuucccuacccuacucagccucuaguauucucuauucuacuuuuacuucuaugagaucaacuuuauuuuuggcuuccacauaugaguaggaacuugcaguguuuaacuuucuguuccuggcuuauuucacguaauguccuccaguuccaucuauguuguugcaaaugacaggauuucaugcuuuauuauggccaaauaguauuccauuauguauauauaccacauuugcuuuaucccuuuaucuauuguuggacaucuagguugguuccauaucuuggcuauugugaauagugcugcaauaaccaugggggugcagguaucucuuugauauaccaauuucuuuuccuuuggauaaaugccuaauagugggaugcuggaucauauggaaguuguauuuguaguuauuugaggaaccuucauauguuucccguaguggcuauacuaguuuacauucccaccaacaguguauaagaguucccuuuucuccacauccucaccagcauuugcuuuuuuuuuuuuuuuuuuuuuuuuuuuugucuuuuggggauagccauccuaaugggaugagaugaaaccuuauugugguuuugauuuguguuuuuguguuuucucaaugacuagugauguugaacauuuuuucauauauuuguuggccauuuguauguguuuugagaaauguuuguucagaucauuugcccauuuuuuaaucgaauuguuugggauuuuugcuguugagauguuugaguuccuuacauauucuggauauuaagccucugucccuaagaugaauaguuugcaaauauuuucuccuauuccguagguugucuuuucacucuguugacugacuacuuuguugugcagaagcuuaguuugauaaaaucucauuuguuuauuuuggcuuuuguugccugugcuuugaggucugauucauaaaauauuuuuccagaccuuauauuuaggucauugaucaauuuugaguugacuuuuguagaggggagcaguggagaucuaguuucauucuucugcauauggauaucuaguuuucccagcaucauuuauuaaaggcacuguccuuuuccccaguguauguucuuggcaccuuuugcaaaaaucaguuggcuguagauaugcagauuaauuuuuggguucccuguuuucauuggccuuuguuucuguuuucaugccaguauccuacuguuuugguuacuacagcuuuguaguauauuuugaauucugguagugugaugccuccagcuuuguucuuuuuacucaagauugcuuuggccauucagggucuuuuaugguucuauacaaauguuacaauuuuuuuuuuucuguuucugcaaagaaugucauugguauuuugauagggauuguacugaaucuguaaauugcuuuggguaguguaguaauuuuaacaauauuaauuauucugaucuauaaguaugggauguuuuuccauuuguauccucuccaguuucuuucgucacuguuuugcaguuuuccaagagucuuucacauccuugguuaaauuuauuccuagguauuuuuuugguagcuauuauaaacgggauugccuucuugauuucuuuuucagcuaauucauuguuuguguauaaaagugcuacugauuuuuuuuauccugcaacuuuacugaguuuguuuaugaguucuaagagguuuuugguagagucuagguuuuucuauauaugagauuaugucggcugggugcaguggcucacaccuguaaucccagcacuuugggaggccgaggcagguggaucacaaggucaggagaucgagaccauccuagcuaacacgaagaaaccccaucucuacuaaaaauacaaaaaaauuagcugggggugguggcaggcgccuguagucccagcuacuccggaggcugaggcaggagaauggcgugaacccaggaggcagagcuugcagugagccaagaucgcgccacugcacuccagccuggguaacagagcaagacuccaucucaaaaaaaaaaaaaaagaaaagaauauguaaucuguaaacagggacauuuuuacauccuucuuuucaguuuggaugccuuuucuuucucuugccuaauuucucuggcugguuacuuuuggauaaaguggggaugaccagaucucuauuguaaagagauacuuuuucauaguuaauauuuacauuagaauuucuggugcuauuaaaaauaccuuauuuaaaauuucauuuuguuuguugauauguaaaaauguuauugauuauuuuugaagcaacguggcaaaauugucucaucaauucugacaguuuaucuguagauauuuuuagauuuucaauacaauccuaucugcaaauacuggccuuuuuguuccuuuccaagccuuguauguuuucuuuugauggcuaggaucuacauuacuguguugaagugguaguggguaucuuugucuuauuucuugucacauagaaaaguuguuccccuuuccucuucuccucccucuucuuggaugcuucagucccgaagacauuaggugggcagagcaagcugggauuccccaaagagacauggccuaguauguggugucugagccacagcagagugagcaaagcuucgugggaagggugucccugcacagggacucagccagagcagagugagaggggaucccugcacaugugggcagcccugugcggaauaccagagcucgaauaggguaaggaggauguucauuuggagauaaaggcacagcuuagagugugagagcccaaaucaggugagagggugccugugcagggugacccagcaugggauguaugagcccaaauaugauaaggagggguccacaaggagggugggcucauguggagcuugagcccaauuugggugagggcuccacaccgaggaggggaugacaguggcaguggugggagagugguuacauacggggagagagagagauguugaugaauaaguacuuaauugaucgaauacauacuuaaggauaaugggggccagguuuuaacuaucagagaagagaguuacaaauauaugaaagagagaagacagaauuaauccuguauuguuaaaauggaauuaaaaguucggguguaaaguguguguacacauguauuuuccccuggcccugucccugaaagggcucagaggagugauagcaccuagcacccccuucuuguuuucuaaauaccauucuccacuaaaaaagcuucuuggagaaauagcugaucuagagcugggacagagaaaguacaagaccagccuggaaugucacaugccagaaaggaaguaugugcucaaagaacgauuggacauguccaaagggcacaaaagccugugugaagggcccacacuggccaaaucuaggacaguuugagcaucauaauaaaugaugauacuaagugauuauaacccauugaauaaaguaggaauccaugaaccuacuuuuauguugauauaaaugaaagaaugaauugagugacugaaaguuuaacaggcuacuaacgcacuuucaaaguacccucccucccauacacacacauagucuuuuuuaauuacaaaggucagagagagagaauaacuuuaccauggaaaagacuucuugccuggcagucaccccuuuauucaagugaucaaagugaagcauaccugaugggaccaguugaaagaacacaacaucgcuucuggauauuccugccaaagauguguuagccgaaucugaucaugaggaaacaucagacaugcccgcaaucgagggauauucuauaaaacuugccuuuaaucuucaaaacugcuaaugacuaaaguuaaagacuaaggaacuauucuaaacaaaggagacuaaaaaguguaacagauggcucuaaacuggauacuuuugcuguaaaggacauuaguauuauuuugagacagagucuggcccuguuauccaaguuagaguacaguggcacuaucucggcucucugcaaccucugccuccgggguucaagcgaucucccaccucagccucacgaguagcuggaacuacaggcaugcaccaccacacccggcuaauuuuuguauuuuuuuagucaagaugggguuuugcuguuuuggccgggcuggccuugaacuccugaccucaagcgauccaccuggcucagccucccagagugcugggauuacaggcaugagccaucacucccagccuguaaaggauauuauuaaaggaguuggcaaaauuugaauguuguuugaggauuagaagguaauaauuuaucagugcuaaguuaccauuuuuugaugaucguaucacggucauauuugugaguguccauguuuauagaaaauguucaccaaaguauuugggguuguugguauaucagaucagcaguguacugucaaaugguucaagaaagauagauuucuggaaauacuuggaauuuuucuauaaauuugagauuguuucaaaauauaaauaaauuauacccuuaaaauagggaacccuuucgacauuucacuauuaaguaugguguuuacugagcuuuuaaucggauuaaggaagcuccuuuguauuccuauuuugcugugguggcuaaauauuacauuuuaucaaauaccuuuucaauauauacugaaauuuucagauaauuuggcuccuuuuaaaccagcuaacauggugaaugacuccauuccuuuccuaauguuaaauuaaccugggauuccugggauaaacccaaauuguuuaugauauauuaccuuuuuaauauguuguuggauuugauuucuuaauauuuuacuugggauuuuugccucuguaaucaugagugagauugguuuacauuuccuuucuccuauugucuuuuuggguuuugguaucuagauuaugucagccucauaaaauaaguaacauaauucuuucuuuuuuuuugagagagagucucacucuguugcccaagcuggagugcagcagcacaaucuuggcucgcugcagccuccaccucccggguucaagugauucuggugccucagcuucccaaguagcugggauuauaggcauaugcuaccacgcccagcuaauuuuuguauuuuuaguagagacaggguuucaccauguuggccaggcuggucuugaaauccuggccucaagugauccacccaccuuggccucccaaagugcugggauuacaggcaugagccacugugcccagccgaguuagauaauucucucuuuaaaacgcccuggaggagauuggagacauaguaugccagcagggcagugucacacauuucucuucagcagguguccucacagggacuaguugucuuuggcuccccacaugacagacgacugcucaaacgcaaaggaacgagaucacaucagcggcuaugggagccccccuggccuagaggccccaucucccagaaaggaaucaauaucguuucuaacaguuccaugggcugugcuuccagggaccguaggauaugcccagcuaggacccagggaagcucagagcuguagucuuuccaguccagauguagccuaaccaauuggggucauuuuuaccaucaguaguguugccuaauaacacaacugacauuuccacuuuuauuuauuuauuuuuauuuauuuauuuuuugagacagagucuugcucuguuacccaggcuggagugcaguggcacagucuuggcucacugcaaccucugccucccaggcuaaagcgauucuccugccucggccuccuugaguagcugggacuacaggcaaacgccaccaugcccagcuaauuuuuuguauuuuuaguagagauggggugucaccauguuggccaggcuggucuuggacuccugaccucaggugaucugccugccuuggccucacaaagugcugggauuacaggugugagccaccgugcccggccuauuucuacuuuuauugcauuuaugagggaacagagcuaaaaaguuaacucauggucaaauuuguccgaaagacagauugagagagagaaagaaaggauuuucuuaaaccagcgcucacaguaaguuacauguuucuaggaauuuccccauuucauuuaaaguuucagauuuauuggcauaaaauuauucauggugccuacuauuauaccuuaaacuuuuuuuuguaaaauauauacagaaaugcauuaauuauauguacaguccaauacaaaguaacuaucacccuuacaguccaguucaaugucagcauauuguuuauguccccaaaaacccucccuccuuucccuguccccuuguguauuuauuuuugacaguuugucugucauugaccuuuaaaaauucuuuguuggggcuggacacaguggauaaugccuguaauccuagcacuuugggaggcugaggugggaggauugcuugggcccaggaguuaaagagcagccugggcaacauaacaagaugcuaucucuaguuuucuaauaauuauaaaaauaaauguaaaaauaaaaauuauuuaugggaauaauuugagggcuaggaugacgcugccuucuccagagaagauucucauugcuucugcugugugcauggcacugaugccaacuugggacugucauuauccagguucaacgcuuaaagcucccuggauggccugagugauuguacaagggcugguaguuccugagaguauaguccuuuguguuccggcuuacuauguuuauguguuggggggugaagaaugauggcuuccuguuagauuucuaaccuuauacuaaaaaagcuuuagguuuuuaaauuuguucuuuuuaaaggcaggaucucacuguguggcuuaggcaagcaguggaguagugcaguggcaauucacagguacgaucauagcgcacugcagccucaaacaccugggcucaagcgagccccugccucagcaucuggaguagcugggacuacagaggcaccacugugcccagcuuagguuaagacuuucauuucuguuuccuacaucauuugagaguuugugaauaaaaaguucaaaauugcugcauuggaaaaugcacucaaggccagggcuccuggggagcaucauaggcauauucccuggggcacaugaguauaccaagugauguccugcuucagcacagcaccaaagcccugcaucagcgcauguggcugcaugcucuuucaucuugcuagauuccuaguuccccuuuaguuugcucugguuauuuauuccucacuguccugucggcucuucagaacauuaagguuuuaaaaauauuuuaaccuaucuuggcucuuugcagucuuagguuuggucuggggaaucuagcccaccauuauuggacguaggauguucucauuugauuuuuuuuuuuuuuuuuuuuuugagauggugucuggcucuguacccaggcuggagugcaguggugcaaucuuggcucacugcaacauuccccucccagcgaucuccucacaucauccuaccaaguagcugggaccacaaguggaugccaccacaccuggcuaaguuuuuguacuuuugguagagacaggauuucaccauguugcucaggcuggucucaaacuccugagcucuagugauccgccugccucugccucccaaagugcugggauuacaggugugagccaccacgccugaccuuguuugauuuuuuucaacagcgaugcugucucacucuuuugaaagugcaacacaguagccauaguuucuuuuucucccuucaaaugaaucuuuuccacccuuggagagguuggucccaguugugcugcucaucagagguguacauuacugugauaauggaguuuuccucuuuguuuuccaguuucuggaagaaaaucccgaucccucugccucugaaauucgggaggaauuagaacaauacacaacugaaauugugcagaacaaccuccuggggucccagggcgcacaugugaguuaacacugucuuucucccaugcuguuuugggcaucauuuuaucacuuucccucuguguuguccuuugcauauacuucuggcuucccaaaguagaccugaguuugcaucugagcucugucucuugugagaccugcaaccucacaaauuacacaacugucccugaguguccacuaucuaaucucuaaugccugccugcaggaccaaugagaggauuaugugacauaugauuucgguauagcauccagcaagccucuucuuaaaaaauggcagcaggucuuuuuuuccuucuccaacacuucucucuaacccacugcuaccuuauucuccccuucauauacugccuaaguauuaauuuguucaacgaaugaaugaauggguagauaauucaccugugauacuagucuuggaaucugcuucacuucaugccuugguuucacaccagagaugcugauuuaauuggucugggguaggguccaaguggaguuacaaaagcucccagaugauucccaucugcugccaggugcagagccacucauguggcuggacuguggaugugccuuccuuagaacccugagguccuucugaggcaggccagcugcauccagagggcuuccuuuuacaagugaaaguaacuagcacuuauugaguacuggcuguauuucaagcccccacugcauucaugauucuuugucuuaguaagagcuuacugaggugguuacuauucuuauucccauauuauaauugagaaacugaaggcuuaaagaagucacucaguaauugucagagcucaaguguauuaggguucuauggaagauuuuguuuaagaaaguggugguggggguguuuccgcugguuaaaaauaaaaggugaaaaccauaaaguaaauauauuggauucucuucaaaauggcacuccaagguucucugacuuuuuuuaaaaaaacagguaaagaacgugugugagagcaagagcaagcucauugcucucuucuggaaggcacauaugaaugcuaagcgcuguccccacugcaaguaaguaucagggcccuugcgccaggugagacgucucugggcagucacucauugcuauuauuaaauaucuuacuggguuuuuucucucuucaaucacaacuguccuccugcacaggaccgggcgauccguuguccgaaaggaacacaacagcaaguugacuaucacguuuccagccauggugcacaggacagcuggccagaaggacucugagccccugggugagcaggcugggucuggagaggagcuccaugugaggccagcagauguguccuaaacccugggaauaccugguucuccucaccacguguuucucugcugcauuugggaggggccagcagaggcacagugugcaggccucucaggccugaggggacccuggcaagcgcccagcucaggccucucacaugggagagcugaugggaggggcuguuuuaugaggcagugccccacaggcgccucuugccuuagguggucguuuuucugaaagguuuuucaggaagaaauuaagaaauuuaccugacaaauauuuugaaacauuuuacuguaaaacaaguguggaucuauuuuggaauaaaauguaggcgaauaauuuuuaagaaaaacugcaagaauucagcaaaacaugagcgccuccugcaggcuacuccuggcuguccacccagauccccccagguagaauucuuuccucagcucugcccuacccaagcucugcuugggaaaaauuuugagauaacuuaauacucccacuuuuuaauuuuuauagucauaggcuuauuuaaaaauguuuuuugguuuuuauucugaaguggucagaagauuaaauagaguauuccaagagaagcacugagagcgguaccugcuguguaauaugugcuauguaaauguuaacuguucauuucuuauuaugucaucaguguuccaggguagaaaaugcauaaccuggcugggcacgguagcucacaccuguaaucccaguacuuugggaggcugaggcaggcagaucacuugaggucuggaguucaagaccggccuggccaacguggugaaaccccaucucugcuaaaaacacaaaaauuagccaggcgugguggcgggcaccuguaaucucagcuacucaggaggcuagggcaggagaaucgcuugaacccaggaggcgcacucugcagugagcugagaucgugccaccgcacuccagucugggugacagagcaagacuccgucucagaaaaagaaagaaaaagcacaaccugcaauugucacuuggcucugccacuuuuucugaguggcagauagaaggcuguuuugaggcguuuccauuucuaacucuauauaauggcauuccuaaagccucuugccuagaauugaggaaguuacaugcauggcaguccauagcagauacuguuacuaaaccuuucaccaggguuugagaauaugggauaagcauggaaauaagauccccuccuggagaugcaugauguauguuuuacauugaacacucuggcauggccuggacuaaaugaaaaaccuguuuaauauuuuuuuaaaauguuauaguuuaggauaauuuuuagacuuaauagaagaguaguaaacauaguacagagaauuccuuaauacuguuuacuucauuugcccuacuguauaacauaguagauuaccauggugcauuugucaaaacugaguuuaacauuggugcaacacuauuaucuaaacuacagacuuuuuaaauuuugcugguuuuccaguaauuuccuuuuuaugcuccaggauccaacccaggauaccacacugcauuuagaaagccuuuuuaauuuuguuucaugguugguaguuaacacuguaagaguggauuuuccuacacuuaaccauuaaauugcccucaaaacaauuuucuuguauuaccaguugggaauugcuucuguagcccuuaggaugccuuauaaaauguucauagauugagaacaaagauggucagaauucuuucuagaagauaguuuucguggggcaaauguccggcagguaaguagccuuucaaugccuucaccaaacccauucuucuaaagucaucuuucauugcagccacgcaaauaugauggugcaaccaaaagucugugcauuagaaacaaguagaccauagucuucuacagcuccaggcuuggguauucaguauuuagcacacauuuauuuguugggugcucagcauuaugccaaggaccauguuugugaugagcacaaugccaggacacagaccagaccauguggucucugcucucugaaggggcugcaagugacacagaucaguaacccuggggagcaggugauguggaggaaagugagcagccucagcgugggucugaccauguuccugguaucagagggaaucaaaaagugagggcuaggcugggagugguggcucacgccuguaauccgagcacuucgggaggccgagucaggcggaucaucugaagucaggaggcaggcagaucaucugaggucaggaguucaagaccagccugaccaacauggugaaacccugucucuacuaaaaaaaaaaaaaauuagccgggugugguggcgcacgccuguaaucccagcuacucaggaggcugagacaggagaaucgcuugaacccaggaggcggagguugcagugagccgagauugugccauugcacuccagccugggcaacaagagcgaaaccccaucucaaagaaaaaaaaaaaagugagggcugugccugaguaguccccauggacuggugaucccacaaggagcgcugucagcuugugaaaugccacacgugcugcuccagugcgcucccugugcuccaugugccccccugagccccacaaggcacauuaacauuuaaaaugagaauucauauagccaagacacuuccagccauugugaucccagguuauuugaccucugaaucccuuuuuccuauggcaccucuuacagcugaaagaaagacacauucaagaugcucugaaaucccagcuaggcagaaggcauuguugcaagcugcagaaguucuuguuaggaggggaugcagcgcaugugaggagaugggcuuccacagcucucuucugacuuuaagauccugugauugaagaacagccucugccuucacggugacuaaacugcagugggggcauugcugggacaggagcugaggagauucgaccgaucuucuucagcauuuccaaccuauuuaguagaagagaaaguucagacacucauuuucagaaaugcccacaaaaugcagguuaauggggucuguuuucucccacugaacauauguagcuuucuaaugcugugguuaucccugaaggucaaggccauucuucauugcauacccaugcuuccuucaguugcguuaacucauugaaauauucugcuuuuaucgacaucaaaacuuuaaacaugcagacuccuugacuuagcaguucugcuuugaugacuuuauccuaaggaauuagaauacucacaguguuguuugaauaguguauaacuggacaugggccgggcacgguggcuuacacuuguaaucccagcgcuuugggaggcugaggcgggcggauugcaagaucaguagauccagaccauccuggcuaacacggugaaaccccgucucuacuaaaaauacaaaaaauuagcugggcguggugguggaugccuguagucccagcuacucgggaggcugaggcaggagaauggcgugaacccaggaggcagagcuugcagugagcgaagaucgugccacugcacuccagccuggucgacagagcaagucucugucucagaaaaaaagaaaauacuggacaugacuuaaauaccuauuaacagagacuacuuaaauuauggugcauuuguuaauuguucuccaaguuagggauuucucuaaaaacuuaugaugacauauccucugcagauuuuaaagaaacuagcuggagaauuggagguggaaugaagcuaguuuuuaaaaauggaggaggcugagguaggagaaucgcaugaaccugggaggcggagguugcagugagcugagaucgugccgcugcacuccagccugggugacgagcaagacuccgucuugaaaaaaaaaaaaaaaaaaaggaaaaggcaagagugguguuuuuaaguguagacuaucuuaggcuauuuuauauuugagccguauacucuuaacuuagaauuugcugugagcuagacacccugucaaguguuaggaacacagacaaggcauagugccuguccugauaugugaauaaaaaaggaacauugaguaaugcuuaguuucaguggauguauccagaaaagcuuuuugggguuuuuguuuuguuuuguuuuguguuuuuuuuuuugagacagggucucacuuugucauccaggcuggagugcagcgauacgaucucggcucccuacagccucugccucucagguucaagcgauucuccugucucagccucccuaguagcugggauuacagucauguccaguauuuucuuuuuuucugagacggagucucgcucuguugcccaggcuggagugcaguggcacaaucuccgcucacugcaagcuccgccuccuggguucacgccauucuccugccucagccucccgaguaggugggacuacaggcguccaccaccaugcccggcuaauuuuuguauuuuucauagggacacgguuucccuguguuggccaggcuggucucaaacuccucaggugaucugccugccuuggccucccaaagugcccagaaaguuuugaaccugaaagacacacuacuuacuugucuuagguaaucaucuuaaaugccuggucccuaccuccugaauggcagucccaagccucguuuucucauguaaccuggguauugcugguagauggcaucccagagugaucuugcuuagugugagaaaccaagcccaaucuauuccucacacaccaguaugauauuuguaaaaagaagucaguauauauuuaccuauaaaaauacuuauuuauccauaauucaacuuauaugaacuuuucugguaaaaaacagguagauaaagauauuuauuauaauguuacuuauaauagcaaaauauggaaaucaauccagauguccaauuaugagaauaugguuaagugaauuaggaaucauccuuaauggaauaucacauagccaugaaaaauggugaucaggcaaaagcuacauagcaacaugcagacaugcugaugagaugauacuaaaagggcaaaguagugugcaaaauaaauccacacugaagauuacaguuguguaaaauacguguauagacaaaaaggccuggaaaacaauauauaaaagugauaggaguuguuaaugugaugggauuauggguaauguuuucuuuuacuuugcuuuuuuuuuuuuuuagguuuuauacaauagccauaugguuuuuauuacuauagaaaugagauuaagggccagagggaauccaggccugauaauaugcuacccuugagauugauuuuuguggucaaguugcaggcuuggggauaaagaauugauaaaucccauugcagaaagaguaccuguuucugauuuauugcacuuugauucuccuccuuggcuccaggaauugaggaagcucagauaggaaaacgaggauacuuaacacccaccagugcccgcgaacaccuuucugcccuguggaagaaugaaggugcuguaucaggcuaaagaaauagccuugaucuucucuaggcuuuuauuuccuggacucauuaacccugccuuauuacuucuuuuaaguuguagugauuguagcuuccuccuggaacugauccagagguuuggggcagucuucagggcacauugacauugagucauagagcaggagaggucauacccagcaccaaaaacuugacaauuaucgcagcugagccugguuaugaaaugacaacugcaggugggccucacuuaauacagguuggcauauuuuuagaagguucaguguaacuuauuuuaaaugcccguaaguaaaaugcuuuguccuucugugaaucaaagaaugaacucugucuuauuuaaauugggacuuuacuauaagggaaauccuucuuuccuuuugaguguauaacaaaaccuacgcaguauauucaagcccuugugagaguauguuguggaacgcugacuauaaccucuguguaauaagcgcuuacaaaugaacauguuguuaaagagguaucagaaaaaaaaaaaagcacuggaguuaguaugauugcuucuguggcaggcccuaguacauuuuaaucuuuuucucuaggcauuuuuuaaaguaaccagaaaccugaaauaaagcuuugauccacagaagauccuuucuuggcaguaacuguuaggggugggaggaggcuaacuuaaaaaaaaauuuuuuuauucaacauauuuuuuaugaagaucaaaguaaugaugugugugcugucuguguuuuaauaguccaggagggugauuaaaaacaagugaaguuucuuccccauccuugcccaucucagucccugguuuaagagcuauugucccuguaguacccauuuuuaugcuaucauauccccugcauacaaacugucauguacacaggggcuauuuuuuguuuuuauaaagaaaaaugaggccaggcacguuggcucaugccuccaaucacagcaauaugggaggcugaggcagguggaucaauugagcccaggaguucgagaccagccugggcaaccaagcaaaaccucaucucuuaaaaaaaaaaauacaaaaauuagcuggacaugauagcacgcaccuguagucccaacuacuuggaaggcugagguggcaggauugccuaagccugggagaucaaggcugcagugagucaugaucgcaccacugcacagcagccugggcgacaggagugagaccuuuucucaaaaaagaaaacugugaccuuaacucuacauauuaucuuguauucuguuuuuuccucacucaguaauauuuuuaugguuguccucccaugcccuuagugauagauuuaaauggucuucuugguuuauuucuuuccaacgcaggauucuuucugaacuaccuuuuuucgggaauggaugaugaugguauggaauccagauucaaucccaguguguucuuucuagauuucuugguggugccgcccucaagguaauacccuuuaauuaacuuauuucaccugaaaaaaagcguacuaaggaacugaaaugugaccucuaggagaggugaaagggccaagggcacugagagacaaagcugcaguuccgcuccaggugcagguggugggagggcuugcuuuccuucccguuuguugugaacgcaauaggaauguugguuguuuuuguuuguuuguuuugaaguggagucuugcacugucucccaggcuggagugcaguggcaugaccuugacuuacugcaaccucugccuccuggguucaagugauucuccuaccucagccuccugaguagcugggauuacaggcacgcaccaccacacccaaauaauuuuuguauuuuacauagagaugggguuucaccauguuggccaggcuggucucgaacuccugaccuccagugauccaccugccauggcuucccaaaguacugggauuacaggcuuaagccaccacacccagccggaauguugguuaggaagguugguuguuuugagcaugguggggugugcucccuacaguaggcaugggugagaggcugaagaacaugacccuuuccucacacuaaacauucauuuauuccguaugucccccugcagguaucgcccagucagucgccuaggagaccagauguuuacuaauggccagacggugaacuugcaggcugucaugaaggauguaguucugauucgaaaacuucuggcauugauggcccaagaacagaaguugccagaggaaguggccacacccacuacagaugaggucagggcugcucuguugcugaugugaugagcacacaugcuuagugcuaacucugugagcuguggauguagacacugggucugggagaugcuuccugggauguucugugcagcuggcagcagccuuagugugagcucugggcuuagggggcaccuaggaacauuagggggacacacaugggucugagcauggaaagguguggguucuggucuagcuucuacaccgaacgaccaugccaggugacccuaguugagucacuuccuuauacuagugucugcuauaaagugcaugugauuuguggugagauuucacaccuaggcuguuccgggcuaccagcucucgcagcucuagaaagaauagccuacuucccucaggcuuuaagagugucccuuuugggucacaguacuagagcucauguugccagcucuauuuuggacacguuaaugucuccagcauuggggucaggaaggcaguauugcagaguggaaauuccucucagaauaggacaguuucaacuaacauuuccugagccccaucugugugccggguuaauuaguagguguucaguggguacaaaggugaauugggcacccaggaagcuugcugaggucaucaagauccuucccagcucuaaaguacucucuggaugcaaauaggcagccuuggguagacaguccggguucucagacuccagccgcugcgacagucccgcugucugccaggcccaucacaagguggcgccacugucucuuggacacuuauggugcagguuacacuuggggcuuucugugguuuugcuuguuuccugaucggcccgcauuggugugcuuuuaaaaacuccuuaguguaaaagacaucagccaugugcaugccuuagugcaguuuccaagaaaagaccaugggauaacuguacccagugaccaggguugaugucccuuaaaaaucgggcagccuggccaggcaugauagcucaagccuguaaucccagcacuuugggaggcugaggcaggagguucacuugagcccaggaguuuuagaccaggugggcaacauggcgaaacccugucucuaccaaaaauacaaaaaauagcugggcauggugguucaugccuauggugccagcuacucagggggcugaggugggaggaucacuggagccagggaagucgaggcugcagagagcugugaucgcaccacugcccuccagccuggguaacagaguuagaccccaucucaauaauuaaaaaaaaaagaaaaauuggucguccccuuugucaaacaaaugcuucgccucugaggggcaaauagcauccucugauuccuaugucccacugcccucuuuccuugugauugacaggauguguuuuuucuccccccuuacucucuguguuccauccucauggcagcccuugccagucaccgucuaggcauuggggauacuccagugagacaaguucucacucauuucacaaucacuggucuugagccagguaaugccaugagcagugaguugggcuaacagggcccggucaucaugcaggugaucguaucucccucugggacuccagccagaaggggacccugaguguuuuauguagaauacaucuauuuucccuagagcuaaagaagauuccuguguuccucagguuugaugacaagcccacuucaucacuacuggguuuucauaacauucucguuuacugaaucuucacccacccucacccucccaccucaagacacugacagguuucuucucuuaucugcccacacuggaagacgugggaccaucugucuccuugugucauacccagucgauugggccaguagguggccagacaguaucaauagguggugcucuaagccagcugaaggcuucuguguauuucuguccccuggguagggagugggagagaggaggagacagggcuaggggcaaaaauauuaaaaaaggauugguuaaauauuccaaugagacuuggcaaucagccacuaacuugauauagcucagcuggagacccacaucuuaguugaugacauagaauaucguauggcaaaccuaguuccuuuuaagaaauuguuccaccugcauguuuguaauugguuuggaucaaguuuuucaaagccauaaauaaaacugaaacugcaugugagaauugguuaucuggcaagauaacagaacuucauaagaaauguacugaugugggaaggacuucuuaguuuucuuuaggaauugcauauuaagggauuucagcaaaaaugccuuaagaaagaagcaugcuuauaaauuuugaguucaucuuacuacuagaaagagacaggcugguaaauauauaauagugcugauaugucuuauugacauguacuuacaagauugauuuauuagcauguuugucucugaucugucagguucagaggagauaaacuccagagugcauaguugucagauccaggguaagaaagaaaaauuaaaucaagccaggccuuuuggagcuuuuuuccaucaucccuguuuucuugguuucaucuuccaggaaaaagacucuuugauugcuauugaccgauccuuuuugaguacacuuccaggccagucccucauagacaaacuuuacaacauuuggauucgccuucagagccacgucaauauuguguuugauagcgagauggacaaacuaaugauggacaaguacccaggcauuaggcaggugagcaaaaaacuggauucccauugcuagcuacagaagauaaauaauaaacauuguguauugaaacaagaaacuaauaagccuacuggaauucuuguugaauguuuuuuaugaccuuuuuucuccauaaagauccuggagaagaaagaaggccuguuccgaaaacacaugaugggaaagcgaguggacuacgcugcgcgcucagucaucugcccagacauguacaucaacaccaacgaaauuggaauucccauggugugugugugugugugugugugugugugugugugugugugugugugcgcgcgcgcgugcagggcucauuugcuccccguggguggcagaugagaaugccgcagaggacuggggacaggaugugcagcagauuauucuggcuugggcggaacuagcuucugccucuuccuggacagcccacaaggaggugacuggaagcugcaugauggcauugcugucacuccuugcuaggcuuacagacaccuccuaccaacaagucagcaccagggagcugacugcaggguguuccacauccccgccggcauagcuuccuccugcccacuucagccuagucuuuugaccuuccucaccaaauugaauacaugacaggggagaggaagagggcauggggcauaucaguuaucaguccuguguacuuuccaggcaucagaaauguguaccccagguuacugggaagaggaaagggagugagucccggagagaggcgugugcauguugcccagguccuguuucgcuucucagggucagcagcuugcuguucaccuguuagugcucuccccccgacccccuccgggagcuagcuucgucuucucacauccuuagcacuucaugcuguggugcucagcagcagcagccuuuaaucggcuuccuccuuaaugggccggccucuaugucaguaaugugaaggugguuuaauuucccuccguggagagccucauuuccuugcacgccacccccuccaccccucucuggggacuggugaugagcagcgcugaaguguucuuucugaucauccuguguccccauggccucaucucuuuguggcacacuuggguuuccuggacaaaggcgugaugugucaggagacagcagucugagaaggcccaguccuguacccacugccucuugggaaccauaguccuugcauucaaaggcuggaucauguggugaggaccagcuuugcaaaguccaguggugacauucccaaaucugaggucccgaggagacauguagcaacuuuugguugcccucucuggacagggcaggggccacccuuguuggccuugacuucauagugccuacaguguccccagcucugugagagaccuuuugugcugccuuuucuaucuucuaggugcuggguucucuuucuuagaucuggguuuguuugguaguggcuugucccuggaggagagaccccgaagucacuucucugcccaccugcagacugcugcaagucucagggccaugguggccuggggcguagguauuccucacaggauagcugggaagauuagaguggauagaacugccucuggccccuuggaucacacacuucccauagagcacuguugacaggugccacaggagcaaggagcuggagaccagcagugaagcacagacuaaugugcucccauauaaagcaguguccagggguggagacagacaguaaauagauagacaaguauauguaugcucuguugaacggugaugggugguaagugcaucagcaacaguagagcaggcucaggcugaggaacgcagaggcugggguagccccaggagccuucugagaaaguguugcugcgcgggaccuguacaaagcuagacaaguuccuuuauguaggacaucucagagccucugguguauuuguguacauuuggaagcauuagagguuuauaauauucaguagcucaaaaacucauuuaacagggaacuuguuuuacuuggagcguaucccaggcccagcuuuaaacacagcacacugcauuuucuuagguaucagaggaaugcgucaguuucaucucaaguaccaccuugauuguaauggcugccagaacuguggaguugagauauuccgaugccaugucugggcucagggacagcaccaugaugcauuagugaugucugccaggguagaugagggaugucaggguauuugaggacaggcauuugccaccugucucaaggaagugccccaugccaccuuugggaacuuugaauuuauuggcagauaagaaaaugaaguuuuagacugggugaaaaaauuggcugggcgcgguggcucacgccuguaaucccagcacuuugggaggccgaggcgggcagaucagcugagguugggaguuugcuaccagccugaccagcauggagaaacccugucucuacuaaaaauacaaaauuagccaggugugguagugugugccuguaaucccaguuacucgggaggcugaggcaggagaauugcuugaacccaggaggcggagauuguggugagccgagaucgcgccauugcacuccagccugggcaacaagagcgaaacuccaucucaaagaaaaaaaaauuauauaaacugcugcgcuuaaauuauucuccucagacuaacugguagaaaaggaggccuagucucuauaccauuaagggaguagcagaagacaggcaggauguuacuuugcucacuggaagaccuucuuggccaagucaaacagcuccuccacaucuugggugaaaagacagccuguugagacagauuugggguccaucagaccuuuuuuuaucccugcccugaauuucuaccuccauuccucauuuccagguguuugccacaaaacugaccuacccacagccaguuaccccauggaauguucaggaacuuaggcaagcggucaucaacggcccuaaugugcacccaggagccuccauggucaucaaugaggacggcagccgcacagcccugagcgcuguggacaugacccagcgagaggccguggccaagcagcuucugaccccagccacgggggcaccuaagccccaggggacaaaaauugugaguaagggcagcuuuggucagggacccauccggcuccuguucggauucuggugauugguggccaucagguguggcuccggugcgcacugacacaggagcccaucccuaggaggaagcuccccgacacguggguggcuuuuuagauucaccuuguagucuccgggcagaagaauggcugcccuuaaacaggacuacucaaagggcaguccccagaccagcaucagcagcagcccuggagcuugugagcaaugcacauccccccaccucuacugaauuugaaucucugagaauagaguucagaaucuuucuuuaccgugcuuuccaggggguucuucugcaugcugauguuugagagccacucuuaggaagggagugcucugugccagugauaaccaacaaauaacagguuauaacuaauguuuccauuuugggcaauugcuaaugcuagcccauagugcugugguagggaauccugaggcucuaucagguuccacuggaaggagcacaugaucgauuaacaauguugcugagugcaugaaaucagcaggugacagcucuguggcucugucacauaauagccauuccugcugggaggggaguagcagaugaccccuaacuaggcaacaguggcagcaguuguuggagggaaauggauucgacuuggauguaacccacaagugacuaccggagucaauaggugacugccuggauuuuccucacccaccugcacagagggccucuccuugcccucugcccacccauacccauggcugaccugcccuucuuuaacacugaguucaccucugcaaaguugcaucagccuugaaggaacuuuggaggaaccgagaggaaaaggaaaugcuccuggccuugcggcggugcccaucacugcucaucacaggccuucuugcuuccucucguucucaccgccguccugaggggcagcaguaauacacugccuguauuacuguauucuccuuuggugacagggcacaugcaaacauagaucaagucaccucuuuuguucuucucuagugcacgaaguaagguuuguauucagguucguagaaucggucugccuuuccuaagugccugguguuucgcuaggcacugugugagcaaugcaaaaagaagcaagguguguuucacuucacuuacauuuaacucaggucaaacaugugaaacagacucacaauaggaaaggaugagaaagagacuaggagaaggggugagggaugaggcaguacugaugcccccugcaugcuagcacuuugcagucccugcagacggauccucgccacccuggaguugacagcauggugggggaaccacuaggaaguaagcauauaaauguauugcuguugcggaggggugugguagacaccauagggaacagcagugacagacagugacuuuaagcacauaauguccaagaagaaacaaguuugaggggaaugugcagggcaagugggcagggagaguuuggggucaucaggaggcaacugugagccaggugcuggggccagccucagggcuaaagaggggacugaaggcagcgaauucuugcugcucucucaggccuuagcaagcccucauuccucuggggucagauaguaaauauuucugugguccugggccaugcaggcucugcuguagcugcucagcucugccaccuaauaccaaagcagccacagguaguacacaaacaaauaggcauggcuguguuccaaucaaacuuuauuuacagaagcagguggccagccugaggacuguagucugcuacccaccaaaaccugucauuuuuuuuuuuuuuauuuuauuuuuuuuugagacaaggucucgcucugucucccaggcuaaagugcagugguauaaucacagcuugcuucagccuccaccuccugggcucaggugauccuucugacucagccucccgaguagcugggaccacagguguggcuaguuuguguauuuucuguagacaugggguuucaccauguugccaaggaugguuuccaacuccuaggcccaagagaucugcccuccucagccucccgaaguucugggauuacaggcaugagccacugcuccuggccuguaauuuuugaagacuuugguuaauguguugcauaugggucagggcaaggcugaaggggcugugugagguugaugggaaggaaacacugaggucucguccggggaggaaccacaggcuaggugaggaggggaaaggccaaaaggacccauuuccucuaugaaguaugaaagcucugccccauccccugggccuuguaaauaaaagaggaaauggcccggagagccaaggcucauugcccugcucagcagccugccagaagcaggccuuuggcuccgagccugccucugaaaauucugacccuggggcacuggggcacgcuaauuuucacugcaguauuuauuuagagacaagagaaaggaagggccuuggguuuggguuggcaaggggaauacccugugcuccagggcuucuguuuggauuggccggugccuaccagacuggccuguguaccuucccagcuguggcgaguuugcuuacgcuggaggaugucucaaauuugcaagacucaaauccuaggcccagccuggcuuauugggcuugggccacaggucuaggcaguuucucccuugagaggcuaaagcaagaagaccucagcuuguaugacgcagucagacagcagccagugcccugggcagaugcucaugggaacccucagaguuuaggucuccuuggaaacaugggacuuggcaauggggaggggaagguuugaauuccuucgggagcaaaaagacggacuccaugcuagguacuuuuaagauugcuuuguagcacuugaggguuuugcucccugcuucucugagcuagagagagaaaacuuuuaaccucacugaacaggaaucggggagagaguuuuggggaguaucucuuaauuacuucuagccucucucuuuaaugaacuuucuaaugcaguuucauaaaugugggcaacauaagaagaaacuagacuuccaauaauuuguuguuuucuccugccugcuaucuguugugauuuagaggagauuugggguggcagagauuucaccaagucuucauaauuccuuuguacuacuuagaggagcccuucaggaugcaugggguggcaguuaccuucauacauuugucuuuuaaggugucacuuuauguucaguguuuaggaggcccaguaguuaauauaauuaaagauaagggugguaagugucuuaauaggcgguacaggaaagucagcuuugugagagagaugucugucagaaggacaugaccagccagauauuuauaaggggggaaaaguaugagcagugguuaucuuagagggguacaauuacuugugauuuuuaaauucuuaucuuuaaauuguauuuucuguuuucccucuagcaaugagcauagcacuuguucaauauuucuuucuuuaaaaauaagugaagaccuuuuuuaaaauuuacagaagcaucacauacucauuauaggaagaacgaugcuaagauguaggaaaguagcugaguguggugacucaugccuguaauuccagcacuuugggaggccaaggcgggaagaucguuugaggcuagaagguugaagcugcagugagccaugauuguaccacuauacuccagccuggcaacagagagagacccugucucagaaaaauaguacagccuagugaggauccaaccaccccuuucccauagacacacacacacacacacacacacacacacacaugcacacggagagagagagaagcuggguugguuuuuaaauuguuuuuuuuuuucaucaugucacaugccaccuggguuuuuuuuuucuuugcuguaauacauuauugcuaucacuuuaggccuuguauacauuuaccuuauccuuguucaucacugcauaauauuccauaguguggauacacuauugccccuucuauggggcagucagguuauuucuaguuuuugccgcuguaaaugcugcuacacaaacauacauacucaucuaaccuugugugggugcuuuuuuuuuucuugaagagccaacagaaaauguguuuuaaguguuuuaauugcuauuuucaaacucuguucccaaaagacuaugacaauuuacagcucuuaauuuuugaagugcaauaaaguguucucugagggcauugaacuaacuaagaacccuuuucuggcucugcuauaugaagcugggcaaacuuuuugugaaauguagaauuucuguuuagaauaauguacucacaugugaucacggcgggggggggauucgaaagucugccaaugccuuucaaacccagugguuuuaugguuaugucuucauuuuguuaugguuauaucuucaggaguuguauccauuucuuucuuuggauuaguuuucagaguaauccagaaaccugggacggcuaugcaucucugaagaagacaaagaccuguggucuuauuuguuccuuauacuucugagccuagagccaggaucaggguuguaaagggccaggaccagaagggccuaggacguauuucucagagauuuccaggguuuugcuccagaugaaaaauuccccuugcauuuaguuaacuagaacgugagacaaaagccacaccuuggucaagcugaggugagcacuuggaaagagccguggugauacugacguuugcacugaucacccaccuguccacucuguucccaggugugccggcaugugaagaauggggacauucugcuacugaaccgacagcccacacugcacagacccuccauccaggcccaccgugcccgcauccugccugaagagaaagugcugcggcuccacuaugccaacugcaaggccuauaaugccgacuuugauggagacgagaugaaugcccauuucccccagagugagcugggccgggccgaggccuacguccuggccugcacugaucagcaguaccuuguucccaagguaggucuggccuugaggcuguuccguggucaucgucagcaugacuuagcacuuuuaaguugggcccugccagccccuggggucauugggcagcuccaggacaggggcgccuggaauggaggguccugguuucucccagguggggcuuuuagcccaucuaguggcuuagaggcugggaaauguuucuguuuugcugcguuguaaaauguaaaucaggacagaaauugugauagccaucccagaaagccaaccuuaauaacugugugauaggucuuguguucagcacuuaaauuuggauucugcaacuuaguagcccccggcuagcauuagcaucccaacacuguaaugguucucaugguccacugaugacuuugauccuuuguucugacaaacaugaguuuuaagaagcagccuaaccccaagggcccagaagagaucccgcagcagcccgugaaggcaucuucuguccccuuugaauccuuuccuucuuucuccaaguucacuccucaagggcaaccccuuguggucacagcuguccagagggacacgagggaaggauagaacuuccucccccgucuccuuagcagcugacucuuggccaggaguggcaggggccugaguuagcaugugcucaugggagggacagagcggggaaagaggcaggcugcaggaaagaagacagaguguguuccagugccuccuucacccucaccacccacccaaaggucugaguccuccuaaauuauaagccauuugcgccacaaugauucauaguuauacaucauucauuuggauugugguggaguaugaagaauaaucguaacgucaaaccaaggcucccauuucccaaguacuuuuucagugccauacacugugcagagagcacuuuagaggcuccucauuucacccuccccacaguccuuggagguaggugcuauucauguccacauuuuacacuugaaggauucguguaacuuguccaaggacacucagcugagaagcagcaggaaggacaaggaguuccuggaucuuccuaggguuugugcuaccacagagauggagaccucugugcacagggagugccaggggcugcucagagaugccuagugucaaucagcauccucugcuccuuggagcuucucuauucccaucagccgucugccacgaaggaaucaggcagguggccaggagcccggcaucccggacccuuuucccaccagaugcaccacuguggcuucacaagggucccgguuguuugaguuggccuuucccuucucugcccaccuuuguuggcuguggauuagcaaagggacuaaauguaggaagaaguggugaagggccuacccagauuacuuggaaauuaaaaaaaauacauuugcuaauuugaaaaguggcuuuuuauguuuucauuuaaauaauaauguggcucuguggugguggcaguaaaagcugccauuuauuaagugggucacaggccuuaggcacugcuguaagcaguuugcagacauucccuuccuuaugagguuggugugauuuucagacaaggaaacaccaagugaguaauaugucagccagcaaugaggccaagacuugaacccagcagcuuuggacgacacccgccccccccccccgcccaugugcuuggcugugcguguucuuagccccacucgacagccaaggcugggacuaagggaaggcaggugacaggaaguggcugccagaacugugugggucucugacucuauagcagccgagucauauuucaccagaggggacacuaccggggagcagcagaugguuuuuugcuggcagagugaccugaggcauuagcuauguggggaguugaggugcucugaaguccucagaccagugaccuugaaugugcugugcuugauuuugauugaauacggugcaaagccauaggagacuucaugcuuacauuguguccugcagugggcugacauauaaauccaaguggaccucaucacaugcuaauaugccuaugaguuuuagguugggcguacacuuaagggaggcaggagaacacagguaaauaaacuuaaugucaauaaauuaauuuauugaaaaaagcuuaugggagauggcuugaagauucacuguacuuucauucacuuucuuuugucggagguaaagagcuuuugauucuugauaaauuuuauuuaguccuugguguaaaugccaagaaguggaauccuuauauuugcuaaugguuauaaaaaugcaacaugucuuuauuggcagaguccuaaaaggacaagagcugauuugguuaaacuaggaaaaccaguauuuugagguaauuuuucuuagcauaucuuuauuucccuuaguuuccauauuucuuuauuuauaauucaauuucuucucuauuaccagguuaucuuccuuaaguaaccauaauacugaauuaaaguacauuuugucguugguuuuauguacuuaguagaguuuuguggcgucuuuuuacuuaaaauaggaguugaauggaacucauuucuuuuccaugaaaacaguuaaacuuuucauuuauguguuacuuuuuggacuaauuuuuuuuccuucuguuuauuuauugagggcccauacuuuguggaaaguuuuuaagcaaggcuucagauauguuuccugacuucuacuuagucagcuagaaaauucaaguuacagggauacccuauucacaaagcauccuaaccagagacauuaauuguaaugucauuuugcuauuaaggagaauaguaaagcugacaauugucugggguuuugauucagagguguucuuucugauccuaagcaggaguuaggaaauuuagaauuauaaguagaccuuuaguaauugcuuuaaucagcauucugccauagaauuugugaugauugcauugaaaaugauuuagccaucaaaguaauugucuagucauggaaaaaucuggacagagagaggaaaaggcacugaauagaucacagaaccuguaauuauguucuuuaaggaaaaaaacaaaaggaaaaaucaguaucugccccccaaagacugugagaugagucaaaugcauaauacugguuuggguuuuucccccaagcaaaauaagaccaucuaggcaacaagagguagaguauaauuuuuuuauguacauuauuaagugaaagccuucauaagaggggcugugugcuccaucugaucuugccuuaggucugugccaccuuuccagcccaucuguaaucguuaucuuugaguuuacauagagcccaucacuguaguguuuagaccauuugacaaggauccuuuuuuagccuuugaguuaguacauaugguuaaauuucuggugcuucucccagacugcauuugugaguucccuuagccuuaguuauaaaacaugaccauacuguuggcuaguauuuaacaaauaaucaaaugauuaauaaucuuuauauccaaggcacagguuuuucucaaauuccuauaaacauugaaaaguuuacaaaaucuacaucuuaaagaacgucagugagcauagcuauuuuuacuucagcgugcguuauguugccgugaacacagacccgacagauaagguucaggagacuggggaucagaauggcugugaaagugucaaaugaaauuaaugcacucaccaaaucucaggcuuuucauaaaagccuuucuuuuuggcaucugguagauaacagccuuuauuaagggcccaccaugaacccugugcuguguugugaagagauaacuaauaauggcuauucucccuucugcagucaugcacaucaggcccacucacagcucucuugaggaaccugugccggaaccccuuccucccaacacuggccagcucaccccucaggccucaacugugaaacugcccuucggagaggcuauuucugaccaucccccucaccucaagucuauauuaugacccacccuguuauuuuccucuuuggcauuuaaaacacuuugugauauuguauuuauccaaucauuuguuuacugucuaguucuucuucaucauaaaggaccaugucuguuugguccccuggaguagggaaaagccuacccagugccuaggcauucaggaggcuccugauaaauauuuguugagugcaugacugauuuacagaagagccaggccagaaacgugugaaaaauacuaaagcauaaaaccaaaguauaaaaacaagaacacagcugacagcagccagaccaaauuuaggcauaaaugccaaaaauaugcuggaguaacuagaaccagaugggauuaaacagagaaggccgggggaacgggaugaguuugaagcagucuugauauaggauagugggcaaauggcaaacguagaagccagugcuaaacccuggucaugugcuuugggaagcaguuggcucccaagcaagaacauagugaggaugugggcaagacaagacagggauauaagaagggcucuugauagaaaguggcuuccaggcaggcgauuagggauuagaguuugacuuaagauuuauuuucauucuucuuguguugucuguuuuggcuuauaggauggccaaccauuggcgggacugauccaggaucacaugguuucaggggcaagcaugacuacucgggguugcuuuuucacccgggagcacuauauggagcugguguaccgaggacucacggacaaaguggggcgcgugaagcuccuuucuccuuccauccugaagcccuuuccgcuguggacaggaaaacagguaauugggagagaacagccaguguauguaacaaaaggaaauaggccacucauguaaaagguuuuauucucagaagaguccagaccagagacagagaaauggcuaagccagcaauagucugacuuucuuuccccuuuguuugggguuccugagucuggguggcuucaagggagugucuagcaagaguagacugcauaguagccuggugcaguggcucacaccuguaaucccaacacuuuaggagacugaggcgggcagaucaccugaggucuggaguuugagaccagccuggcuaacauggugaaacccuaucucuacuaaaaguacaaaauuagcugggcgugggauuagugccuguaaucucagcuaccgggaggcugaggcaagagaaucgccucagccugaggcaagagaaucgcuugaacccaggagguggagguuguagugagucaggaucagccacugcacuccugccugggcaacagagugagacuccgucuccacaaaaaaaaaaaaaguagacugcauaguuucuguccuuugcuucuaacuuaaauuugguguccucauaauacaaauauggugguaauaggcaguggugcugguggaguaauaguaauauuuguugggaaguuccauauguuugcugagugcuuuagacacauuaucugauuuaauacucacgacuaaucugcaaugcagacaccauuauuaucuccauuuaggagaugauaaauuacaugcccaagacuacaggagacagaucaaacccaggacuuuucaaccccagaagcaucauaccauacuuccucucaaaguaaccaaauuacaugauauguggcgaccaaauaaugaaaaacaguaaaauauguucuucugcuguugccugaguauccaaguucagccuuaaggaucaacuucuaauuggcuaugugaucuuagcccugugugucucaguuccucaucauuuccugggacaguagaaauuaacuugcuaagcuaaguucugauucuaaacaugguuuuucucuuugaaaccagacuaacccacaaacaaauucuugcauaguguagucacucuugcccuuuucaccuguuggcaaaaaaaaagcccguaccaaccuuuagagacacacuaaaaaaucucacccgugacagaagcaaaaccuggaccuauuuccuaauuuuauuugguacagaggauuuuaaaaggauucaagauguggccucugggcauaauggaauuuggaaaucagcaaccaagauauuuggaaaagcccucaauauuuguacuucuaaauaacguacuucuuaaauagcucaugggucaaaagaaucuaaagggaaauuagaaagcauucugaaguagaugaaaugaaaacacaacaaaauuugugggaugccacugaagcagaacuuaagggggaaauuuauacauaaaaugccuagguugaaaagaagaaaaagggucccaaaucaaugacuucagcuucaaguucaugaucucuaaggucucuuccugcucuccaguucuuagucuguggaccuggaacuugauuuuccuuuuuaagccaaccuugcauuccuggauaaaccuuccuuggucgugagguauuauccuuuuuauauauuauugaauucaauuugcuaauauuuugucuagaauuuuuuuacuucuguguuugugauagauauuggucuguaguuuuauuuucuuauaauauguuuguuugguuuugguaucaggguaauccuggccucacagaaugagguguuaggagguauuuccucugguuuucuguaagaguuuguguaguacaguauucauauuauuuauuccuuaaauguguuguagaauucaccagugaaggcaucugggccuagaguuucuuuguggcaagguuuucuuucuuuuuuuuuuuuuuuuuuuuuuuuuuugagauggaguuuugcucuugcugcccaggcuggaaugcaauggugugauccuggcucaccgcaaccuccaccucccagauucaagcaauucuccugccucagccucccaaguagcugggauuacaagcaugcgccaccaugcccggcuaauuuuguauuuuuaguagagaugggguuucuccauguuggucaggcugggcucgaacucccaaccucaggugauccaccaaccuuggccucccaaagugcugggacuacaggccugagccaccgcgcccaaccugugggaagauuuucaauuaaaauuucuauuucuuuaguagacauagagcuauuuuugguuaucuacuucuugaaugagcuuuaauuguuuguguuuuucagggaauuuguccauuucaucuaaguuacugaauuuauaggcacaaaguuguucauaaugcuccuuuguugaccuuuucuaucuguauugccuguaguggugucacuucucucauuccugacauugauaauuugugucuucucuuuuuuccugaucaguuugccuagagguuuaucaguuuuauucucaaaaaaaagucuuugguuuuauugacuuuauuuuucuguuuucuguuucguugauuugaacuuuaucacucccuuucuucuguuuacuuugguuuaauuugcucuuuuuuuuuuccuaguucuuuaaguucuuuaagucaauuugagaccccuuuucuucuuucaauguaggcauuuuauguauaaauuucccccuuaaguucugcuuaaguagcaucccacaaauuaauauguuguguuuucauuucaucuacuucagaauacuuucuaauuucccuuuugauuuuuuuuuucaauccaugaguuauuuagaaguauguuguucaguuauuuagaaguacaaauauugagggcuuuuccaaauaucucgauuguugauuuccgguuuaauuucauugugccuagagacugcaccuuggauccuuuucaaauccuuuguaccaaauaaaauugggaaauaggcccagguuuugcuucugucaugggugaaguuuuucauuguaucucuaaagguugguacaggcuuuuuuauuuugcaaauaggugaaaagggcaagagugacuacacuacacaagaauuuguucaugguucagccuggugcuacagagaaaaaccauguuuagaaucagaagauaaggaacuuagcuuaggaaguuuauuucuacugcccugggaaaugaagucuuagaguguuucuccaggucauuucauacagccucuugauugauuuucuauuuacaaaccgaaggucucucauuauuuguucaaagagcaugcaaagaaagagauuugccugucauugcaaaucucgaguuuauaacucagugcacauucacaaagugaauacaucuuugcaaacucucacccagaucagaaaguagcauaucaccagcacccccagaagaccccuccacggccccucccaguuucuaccccucgucaaagguaauuacuaacuugacuuccaacacuauaaacaaguuuugucuuuccuugaaguuuauuuaaaugaaaucuaucuuuguguguuacccauguuauuguauauaguagcaguuuauuuuuuauugcuuuauaauguucuauuaugugaauaugccaucauguauuuauccauuuuucuauugauacacauuugaguugucuucacuuaccuucauuugacuguuacaaauggggcuacugugaacacuugucguguguaucuuuuguugaacacauauauacauuucaguggguaacuauugaggcauggaauuacuaggucauaagauauguguuuaacuuuaauagauaguuuccuaaaguuuuccaaaaugcuuguaauaauacacacuucuaccaggauggagugcaguugugccaucuuggcucacugcaaccucugccucccagguucaagucauucucuugccucagccucucgaguagcugggauuacagaugugcuccaccacaccuagcaaauuuuuguauuuuuaguagagacagcguuuuuccauguuagacaggcuggucucaaacuccugaccuuaggugaucuacccaccucagccucccaaagugcugggauuacaagcaugagccaccucgcccagcuguuguuguuguuuucuuuuucugguuuauuuguuuaauuuuagcuguucaggugaguauguagugguaucuuacuguuuuaauuaucauguccuuaaugacaagagagguugagcaccucuucauaugcuuauuggccauuuggauaucaucuuuugugaugugccuuuucaaaucuuuugccuauuucuaugucauuuucuuauugacagaugagagguuuuuaaacuauaauuugguauaaguccauuagcagauauauacauugcaaauaccuucuacuugguggcuagccuuuucaccuaauacuguuuucuaaugaucagaaguuucuaauuuauagccaaucuuggcuuuuugugacuaguccuguaggagcucuuugccugcccugaggucuuguagguauuccccucuguuaucgucuaguagcuauauuguuuuaccuuucacacuugggucugcuaucugccuagggaugauuuuuguggaugugcaugaagugagguaggggucaagagucauauuuucccauauggauuuccuagccagugaaugcaacaucauuuguugaaaaguccacugcucuacugcuaguacuccugugucacaaaccaaguaguaauauaugaguggguauguuucuggacccuguuuguuuccauugcaccaacagcacacugucuuaauuacuguggguuuauacuaaaucuugacuucugauaguaaaagucuacagcuuuguucuucaagacugccuugauaggcuuuaauuacaucucaauauaccuuuaaaaaaaaaagacugucaacuauuuugggguguuuguauuuccauauaaauuuuaaagucagcuuguaaacuuucacacugugcacacaaauaccugcuagaauuuuucauugggauugcauugccucuguaggucacuuuagggagaaucaacguauuuacacuauugagucaucuaaauuaugaacauaguauguccuucaauuauguaaaagccuuauacaucuuuucauuagauucacuccuggauacugcuaugguagaugauacugucuauuaaauuuucuaauuguuuaugauuggugucuagaaauacaauuaauuuuguauauuguccuuauauucgacaagcuuuaugaauucaguuauuagaucucuguccuucaaguucuuuuaaacuauaaaaguaaacaaguuuauugauaaagauaaaaggaaaaacucccucccuccccaaccccacucuccauauacacacauacucucauagaaaauaaauaagaaugaggccaggcaugguggauuaugccuauuaucccagcacuuugggaggccaagguggguggaucacaugaggcuagaaguuugacaccagccuggccaauauggcaaaaccccgucucuacuaaaaauauaaaaauuagccaggggugguaguguacauuuguaaucccagcuacucagaaggcugaggcacgaaaaucacuugaacgugggaggcagagguugcauugagcugagauugcaccacugcacuccagccugggcgacagaacgagacucuguuucaaaaaaaauaaaagaaauaauaaaaucauaucauaccuucccugggacuguucaggagaaccaugaaccacaauuaaaucugacauucaaccaccugauaaaucugauauuuacaaccaccuguuugaccaugacauccugguaccugaagcaugcauuuuccugauggccaggcacauggaccucagauuuggcuggucuuuaagauggcuuacucugaacgagccaccaaguccuccaaagggaacuccauuauaucagacagucugcuuuuucauugggaccacacuaacacacucuaaauauggcaagaaguucauuuaaauguuuucauaggcuaugcugacaaauguuuuuguaauugucuugugacugauuucauucacuggauguacugggggcucauucugugucuguacauguagaucugccucguucuuuuuaaccccuccuguguuguauucagugauauggguauaccacagaugacuuaacugucccucuauuaguggauguuccgauuauuaccugguuuuuacuauucuaaacagugcuguggugaacacccauuucuguauauguuaguguacuuucauugacuuaucuuuuauuauuauuauuauuauuauuguagagcugguguuucacuguguugcacuggcuggucucgaaccccuggccucaagugauccuccagcuucagccucccaaagugcugagauuacaggcaugauccaccaugccuggccaaguauaucuguuagauaaauucuuaaaguacaauugcugggucaaaggauauagacauuucaauacauuuuuuuaaauccauuuuauuuuuaagacuuuuuuuaagguuaauacaggcuuaguauaaauaauaauucccauagauauugcugcccuucuugguuuaagaaaacauugcagauuuuuucucccuagcauaguuuaugaccagaaaguaaauuauacauuucuagaauguuagugcaagaggagacuucaguuccucuugucuggguccuuuauguuuuuuuuuuuuucauuaagauauaauucauauucaacauaaaauuuaccauuuuaugagguaggaggauugcuugaggcuaggaauucaagaccagccuggcaacacagugagacccccaucucuauuuaaaaaaaaaaaaaaaaaaaaaaggcugggugagguggcucacaccuguaaucccagcacuuugggaggccaaggcggccggaucacgacaucaggaguuugagaccagccugaccaaccuggugaaacccugucucuacuaaaaauacaaaaauuauccaggcaugguggcacaugccuguaaucccagcuacucaggagguugaggcaaaagaaucacuugaacccaggagguggagcuugcagugagccaagaucgugccauugcacuccagccugggcgacagagcgagacuccaucucaauaaaugaauagaguagaguagaguagagagaguagaguagaguagcugggcaugguggcacacaccuauagcccuagcuacuugggaggcugaguaugaggcugcagugagcuaugauugugccacagcacucuagccuaggugacagagcaagacccugucucucuuuuuuuuuuaaaggaccauuucaaaguguauaaguagguuuuuaguguauucacuauguugugcaaccaucaccacacuguaaugccagaacauuuccaucacuccaaaaagaugacauguaccuaauagguacagcagucagucccaauuccuccuuccuucucauccccugacaacuacuuuuuaccuguaugaauuagccuguuuuggacauuucauauaaguuguaucaaacaauauguagccuuuuaugacuuauuucuuuuacuuaauguuuuccaguuccauccauuuuuuaguauguaauaguacuuuauuccucuuuauggaugaauaacauuccauuguuuccucuguauccauuugucaguugauaaauggauaauuuggauuguuuccauuuuuuggauacuacaaauaaaccugcaaugaacauuuguguaccaguuuuuguaugaacguguguuuucaguuuuccuggguauauaccuagaaguagaauugcugcaucauauaguaauucuauauucaacuuuucugaggaacuugcaaacuauuuuucaaaucagguguguuauuuacauuuccacuaacaauguaugaaggucucaguuacuccacauuuucaccaacacuuauuuuuuguucuuuuuuuuccuuuauagauucuucuaauucuaguucuauuucuacuacugcugccauuacuuccuccacugaagucuugacccucugaaagucauacuuaaggguuggaaucaacuuguuccaaacuccuguuaauacugauguuccucccaugaaucacaaauuuuuuaaugacaucuagaauggugaaucauuuccagaagguuuuccauuuacuuugcccauaugcaucagaagaaucacuaucuauggcagcuacagccuuaaugaaauguauuucuuaaauaauaaggcuugaaagucaaaauaacuccuuuauccgugggcugcagaauggauauuguguuagcagacaugaaaacagcauuaauuuccuugcauaucuucagagcucuugggugaccagaugcauugucaaugaacaguaguaauauuuugaaggaaccuuuuuuucagagcaguaggucucaacagguacuugaaauagucagcaaaacaugcuguaaacagaugugcagucacccacgcuuuguuccacuuauaggcacaggcagagucgauuuagcauaauucuuaagggcccuaggauuuuucacaaugguaaauguucacugguuucaacuuaaagucaccagcugcauuagccccuaacaggagagccagacuguccuuugaagcugugaagccagacuucucgcuagcugugaaaguccuauauguggcaucuucuuccaauagaaggcucuuuuaucuacauugcaaaucuauuguuuagugcggcaaccuucaucagugaucuuagcuagaucuucucgcuuagcacuaccuucuuuuuuuuuuuuucuuuuugagauggaguaucgcucugucacccaggcuggaguguaguggcgcaaucucggcucacugcaaccuccaauucccugguuaaagcaauucuccugccucagccucccgaguagcugggauaacaggcacccgccaccaugcccagcuaauuuuuguauuuuuaguagagacgggauuucaccauguuggccagguuggucucaaacucccgaccuuaagugauccgccugccuuggccucucaaagugcugggauuacaggugugagccaccacaccuggccggaacuuuuucuuaauuucauuuucagauuguucauugcuaauauagagaaagagaauuaauuuuuauauguugaccuuguauccuucagcuuugaauaagucauuuacaagcucuaauaauuuguuuuguuggcacuuaaggguuuucucucuauaauaucaugucaucugcaaaugugguuguacuucuuucucucuaaucuggaugucuuuuauuuauuuucuugccuaacugcccuggcuagaaccucuaguacauuguugaauagaaauggcaagcguagacauccuugucuugguccugacuuuaggcagaaggcauccagucuucuaucauugagcauguuaguaguagguuuuucauaggugccucccuuuauuagguuggugacagucuguuccuagucuguugaguauuuuuauccugaaaggguguuggaguuuaucaaaugcucuucugccccauugauuuuacagaugaaguggcaggucauauuucccugcccuuggauggguguguuucuguuaccuuucacaccaaguuccagucuugacuaugccuagccuggggguccccacugugcauguggcaccuugguugaggugcagcuugaaguaggcaccccaggacgugucacucuccugccuuugcucccucaccccacucaccgcacagugcuggccuucuauggaguugaggcauggagagugugggucauaaccuuucuggucaucuucugcugagaaaacagaauauuuucugcucucuuuaauaaugcuguuguccauuguccccugcuccuggugcacgugggugaaaaggcagcugcucuuauaacugcccugucccauugcccacucucuuuuuuuucuugagacagaguuccacucucucacccaggcuggagugcagugaugugaucuuggcuaacugcaaucucugccuucuggauucaagcgguuaucgugccucagccuccugaguagcuggaaguauaggugcacgccaccaugcccggcuaaauuuuguauuuuuaguagagaugggguuucaccauguuggccaggauggucucgaucucuugaccucaugauccacccgucucagccucccaaagugaugggauuacaggcgugagccaccgcgcccucguugcacacaucuaaagacacuacuuuguggggccugcugcaggcacacuaagcgcuguugauggcaguuagucucccagcccuggagccugucacaccugccggucugccccugcccugcuucaucucugggaaugugugcaccugcauucggcccuucuguagccaacucugguuaucuccagauaaagcugucucccuuugagcucucugcagagcagccgcuugagaaagcgcuucucuuggcuuccuguuagcagugcuuguuggguggaugaccccucugagggauccaacuggggccagggaaagauuccuuggcuuuucaguagcuauaauuaauuccagucauaguaaagaaauaucugaguauguggcauaaaaugaaaacaauuuacuuuuuccucuccuuccuuuggucuauuuaggaauuuaauucaagucuaggggauuauucacuuuaagaacuauuuuagggaguaaaaaucccagugaaguucuuuuuuguuuucauuccucauugguuuaaauaaaaccugaaaucaccuuguccuauggagguggaccugucuguuuuucuugccauaccugagaucaucagaaauggcauugcaagggcaggagguccuaaaagggaaguucuuaacucuucuuuuugccaucaguuuguccucauuuugccaucacuuuucuuuuugccaucaguuuguccucuuuuucuuugcagguugugucaacgcugcucauaaauauaaucccagaggaccacaucccacugaacuuaucuggaaaggcgaaaaucacugggaaagccugggugaaggaaacuccucgauccguuccuggcuuuaacccugacucgaugugcgagucccagguauggcuguccagcuguguggaguggagacuucuagugccgggguuagacagauugguuuaaaauggagacagaaauggaggcacauucacagaagcagguacugugccucagaagagaaggcguugugccugaguuguugucagcuuuuguuucggaaggguucaggguugaucuccagcauuugacccucaguauaaaacucacaagcaguuuaggaaagcuucuccugcaaaaaggcugaaauugauuaugcaaagcuuggcaaugcagaguccuguuuuccugcaagacugcugaguggcuucagauaaucaaacugguauaaggcuccacacccauaacucugagccuuaggaaccaggccacaaaaggacaggcccagggcagagagagcuguccacacugaagauuuccaaggccucugcauguucccaguggagaagucuuuccaggcccccagugcacaacgcguuaucacagagucuuaauggacaguccauucaccccgaaacugccagguuucuuuuccuuuauagaccauaugcuucaugggugcuacauuacgcagcuagaaaugcuuuucuguucauuagcuucuaaugcuuuaacccagcuuugagaaaguacacauucaggccuuagaggauguuaggaagauuuuguuguuacucccaggguucaagggaggaaguaccuaggccagaggcacaguuacgagguugaagcucgccacuucaggaagaccuuguaacuagaagcucccauguccggucacaggucuuugucaaggauacuugaccucaagucagcguggguggguguggggaguaggggauauaaaacacauggagagagagugugaguguguguguaugucucugugguauagucccugaagggaagaaaaaaaacugcuggucuguauaugcuugccucuguuauauuaaaaaauaauaauaauauauauagagagaaaauacuaguuucacauaugcccuacuuuuuuccaugaaggauucuaggcgggucacaguagagggacuugcacaacgagggucacacauggaguagagggugggugacucccacaggaggcaucacccgcagcccggcauugguggccuugcccucugcaggugaucaucagggaaggggagcugcucugcggagugcuggacaaggcgcacuaugggagcuccgccuacggccugguccacugcugcuaugagaucuauggaggcgagaccagcggcaagguucuaaccugccuggcccgccucuucaccgccuaccugcagcucuacagaggcuucaccuuggguaagugccgggcucgcugcccuggggcagugacccgucagcgcagccgccuggccaucucccaggcccaggacagagagagccguccacacugaagauuuccaaggcuucuguguguucccaguggagaagucuuuccagguccccagugcaccacgcuuuauuacagggucuuaacagauaguccauucacccccaaaacugccagguuucuuuuccuuuguagaccauaugcuucaugugugcuacauuacacagcuagaaauucuuuucuguguccucucgggaaggagcugggaaguaaccaggcuccuccuacaaaggcgcccucacuuggccaccccucuccuccacagccagugcuuauucccguucacagugcagaauggcacccucgugcccauuuccauucuguuucuuuccuaaccccucccuuuacagguuucuguccucggacugauuucucauacucuuacaaccccauucccugcuacacaagugcccuuucagaauucucagggcccaucccacuccacagagggguuucccuuuugucagaacugcccacugccggcugggugcaguggaucacaccuguaaucccagcacuuugggaggccaagguggguggaucacuugagcccaggaguucgagaccagccuggccaacauggagaaaccccgucucuacuaaaaauacaaaaauuagccaggugucguggcaagcaccuguaaucccagcuacucaggaggcugaggcgggagaauugcuugaacccaggaggcagagguugcagugagccgagauugugccauugcacuccagccugggugauggagccaaagaacugcccacgccuucccacugcgguggggccaucagcgcucuuggaaacacuaugcugggcaaaccugucggggugauccuaagacacgaagaggaacuaccuuguuugcaccccagaaaugagugcacgcuguuuuaggaaaauggcuuugauaaagaggcuucaccuugggugagugcugggcucacugcccuggggcuccccugaagcagucaccuggccccuuuuagugugggcuugagaucagaucuguccaaaggcucagccccuggccaggcuuauggaggacacugcaccuccauguacacagagcaggguccagcccuuccacgcuguucgcguuagggggacgcgagaugcugcgugucaggcaugcaccgcagugugcauaggcguugucugguucaugguggaaguaaggcuccuuugcuucacagacccacucgugugcagacagagugggagucucagcguagggccuguggaccugcagcugcugcagcuggaguuuguucauuggcccacacuggggccugcauuauacauuuuauucuauuuuaauuguaucauauauuuaaucauggaaagguuaaaaaaaaaaaagcauacaugaagauaauuuaaaaucacccagcaugcauuugucagagauaaccacuaauaguaauuugauguuuguuuuucuagacuuuucuaguacaaauacauuuggaaaaagugggauccuacgcuacauacucuacuucccuuacccacccacccaccaaauguccaaauguauuuauaaauguccuuugggaucagcuaauacaagucuacauccucaugucugguaauuacagauuauuccauucuuauggauauauuguaguuuauuuaaccaguuccuauaauuaaacauuuaggcugcguccagauuuucacauuauugcugggaugagcauccuugaacaaacaucuuggcuuauaugucccauuauuuuaccaggauaaggauuauaaguuaagucuguuuggcagcugaaacucaccuucccccaucuuaauuccacuaagagaccugagccacuucugggcucaagguccaaggucacccacuuccaguugggaaccagacuagaguaccuuccaggauaaccaaagaaagugaagcaugaugacuacaccucaugaaauguauauuucaguuucaaauggugaccuagaauaagcacaaggauuucugcuaacuagaaaaaaucagagcgcuuuugaaacgaaaauagaggaagaucccacacccagcucaugaugaggaacaaacuuaacaaaggugccaggcuuuagcucugcuuagugcaugguacaaagagcaguuggucccuugagugugaagaugauccagaggcucagggcugcagaaggaagcagggccaagcugggaguggggcuacaagggggaacaggcgagagauugacuucacuccagcccgucucagcuagcgggguccauaaagggcacagcuaguuggccuguagcugaacccaugggaaugcccacuuucacgguguggccugcuuacagaggaacuguuucuuuccccuucuguucacacauguucuuagaagcccuccaggaccuugcguugggaauuccaaauauuucagccccaucuuuugaacaguacaccugcuguuuucuuucccacucagaucuuggcugagggacucuugaguccaguagcacuuacaguugcagaaaagaacuaguuuuggccaggugcaguggcucacuccugcaaucccagcacuuugggaggccgaggcagguggaucaugaggucaagagaucgagaccauccuggccaacguggugaaacccugucuguacuaaaaauacaaaaauuagcugggugugguggcgugcaccuguagucccagcuacuggagaggcugaggcaggagaaucacuugaaccugggaggcagcgguugcagugagccgagaucacaccacugcacuccagccugggcaacagagcaagacucagucucaaaaaacaaaaacaaaaaaaaaaacacuaguuugaucaagaguugauguggaaagaccuacugcugcccaggaugaggaauuccucaacccuuugagccagaagggcaggcuucacugaagugacccaggcugucauccuccugaagcaaugcugagggaccugugguggugguccuugucacccaggcucgggugugucugugugugugccuacacagguauacucagcuauauaggguggccccugugacaugugacuucugggaccccagacugagauguucucucucucuuuuucccugagcuuaucuuuucauccaaaaccucuucuucaccuucagccuauucauccaacacaugucuauggaguggagauaguauagcugguggcuaagaacaugaauuugggacccaggccuggguuuacuuucuacccauacgaccaugggaaaguagcccaauuuugagccugaguuuugucauuuguaaaauggggauuauaagguuugggcucugguaagcaccuaagagaugguggcaaucuguuaauaaugauguuaauaucaucuuccuuacucagguauuuccugcaucuguggcacuggacucugugcucuggccuuacugaguuuagucuggugggagaaaucaggccugaggucgccuacaagcuugucuguuucacuucacaggcguggaagacauuuuggugaagccaaaggcagaugucaagaggcaacguaucauugaagaauccacccacugcgggccccagguaaggagggacuucgaggccguggccugcccuagaggggugaagugugugcugagucaaaacccacacucucgucguuuggccucagccuccgcuguguuucuguucucauucuaggcugucagggcugcauuaaaccugccagaagccgcaucauaugaugagguccgaggaaaauggcaggaugcccaucugggcaaggaccagagggauuuuaacaugauugaucugaaguucaaggaggaagugaaccauuacagcaaugagauuaacaagguuagcccagcauugcaugcauuuauccccaccacuaugaaugcugauuuuuaaaaaaauuacauuuugauucucaccugggcccuacagagcaccuuggcuguugaacagcugacuaggugagaugcgaggugggauggguagaacucguuguuuugaagggcccagggcuuuguucccugccccaguuagggucuauacaggccucagaauagugccaagagagaaugcuuugugcuguuuuucuuuauaaauguuuuuauuuuggggugacugcauuaaaggggcugaauggggccaccaggggugaauaagcagggugagggacccggaucgcccuggcugcucaugcagcggagccaggagugaaggcucagguuccaguccuggcucugccuugaacuugcugugugaccuugggcaagugagauaaccagucccugccuugguuuccucaccuggaaguggggcugugaggggcaccaccucacagggcugcagagaggcuucaggagcuacuaguacacaaugccaagccaguuccugggcaguugagaaaggagaggggaaaucucugcaugagcugaaaccacagccugcuuuucucugccuuucugccccagagccaggguucuccauccugcugcuuggaggagcuggccuggcccucacccugccuccugggcccuggggcccagccugaggaguggggaggaggaggcaaugccaacacucaucaaaagucaaaguucgucuguagugcucucuugccuggcuuuuagcaucccuuaggcugcugagaagaccgacuucucauggggacagguuccauccuugagggguuuuguugacaggagcuuuccuagcaccucccugagaaccaggaagcucagcuucuagggcugacuggggaugcuaggaguagggaaguugucuucagaugcaucucagaaugguuucuugucccuccaguugcccucuucccaccaccuccgcccacccaggcucugccucuccuguguugggccaagucuguggaauuccaggcacaggcuagaagccccagacucagagcccccuucucagcaucuccccaggaucccccugaaggggcaugcuugguucugcuggcucuugagccaagacagagcuuccuacauggggcuuggguggcauguucguaaaugugacaugaugcggauguugguauucacgcugggagaggacccaggccaggcucugcugggcgaaucaagggcaucaccuuaaauuuuauucuucuccagcuucuuuuuagaaucacgaacuggaucugccagccccucuacuucuccuuuuccuucucccuuuuugcugcucuuuggccaaugaaugaaaccucggggauccuggcagaggaaguccagcgagugcagggcagggagcaccuguuugaccucucagggguuccagggaaggauuaaugcugaaugaggcuuucucuuaccucgagugggauuugguacuuaggucugaauaaauauucuggcuguauugcuucugcuuccuggauuuacauccugauucugggauuuuuaaagaaggugaagucacugaccacugugcugauuuaaucugcaggcaugcaugccuuuuggccuacacagacaguucccagagaacagccugcagaugauggugcagucgggagccaaagguucaacugugaacacgaugcagguaugugcagaggcggguuggcagcuuuacaggugucagcaaaggcaggugggggauagcaggaggugguuucaguuuguucccuauaaaacaugacaaguaaaaagaggaaagcguguagaaaucacuacaggagcuaaccacuguuaacaugccaauguuaaaggcagauguaguuaugaauaugcagaugggauauguauaacguagauauauauuacaaauuuacaaacuguacuauuacauauauucacguuauauagauaaauuauguauacucacacaauuuuuacguaauuuugcaugauuguuucuuucuuucuuucguuuuuuuucgagaugaagucuugcucugucaccgggcuggagugcaguggcgcaaucuuggcucacugcaaccucugccucccagguuccagagauucuccugccucucgggauuacaggcaugcgccaccaugccuggcuaauuuuuguauuuuuaguagagacgggguuucaccauguuggccaggaugcuuucaaucucuugaccucgugaucugcccaccucgaccucccaaagugcugggauuacaggcaugagccaccgcaccuggccgaucuuuucauaauauuaaauuauaaacauaaacauuguccuagagauuucuuaaccuuaaaccuuggugaccuugagagggucuaaaggcccaccccauugucuguugagugugacaacagaaaggccgaaagccguuaggaaauccccugacuacaucgaaaccuagauauacugcucuccuccaacacgccaagaguauuaacaggcagcuuucuaagcaaauagcucaauagcuugaguucccauuuuguuguuguuguuguuguguuuuguuuuguuuuguuuuuaauugaaaauaagacagagucucccuguauugcccaggguggucucaaacuucugggcucaagggauccuccugccucagccccgcaaagugcuaagauuguagaugugagccaccacacccggcccugaguucccuuuuggcucuagaaugugaggaucgcaauaaauggcuguuuccugcaggccucucuuuccccaucaggacccuccaguccuuuacagguauaacaugagaugguucugagacauggcucuuuuuauagagagcacccauuuucaacugaccccaaaugugaaaauccagaucagucaaccaaaggaagguauuuuuuuuuucuuaaaaugaaggcuuccugguuuguuuagaaauguagguuagccuucaagaacucgguuuccaugcagcuuuucuucaaggucagauuauacuuucccugcugggacaaagcacuguuaaacacacauguggaucuucaguuuccuguggauuuccuguccuccagaucucgugccugcugggccagauugaacuggaaggucggagacccccgcugauggcgucuggcaagucacugcccugcuuugagccuuaugaguucacccccagggcugguggcuuugucacuggcagguuccucaccggcaucaaaccuccuguauguauuuugguuuuuccauuuagcuuuuucccucauuucuaggcuuaauuguaggugaacuaugacugcccuacaggguagggcagaagacacugggggcuauuguagcugucgaggucaaaaaguccuaggagaucagggaagggaguggccugucuggucaggaaaggcugcuggagguguuggccugagcccuucaggaagcgcacuguccucacugucaccuuugggaccugggucccauucucugcaggaguucuucuuccacugcauggcaggacgagagggccugguggacacugcugugaaaaccagccgcucaggcuaucuccaaagguaaaauguaucugccgugccccuugagguagagugccagggcccuuccugccaucaucuuucacauuauaucagcagcucauuuaagauuccuuggaugaaaaaacuuuuggaaaguuuccaugaauggccugagacagaaagcagcaaacacuguuccccuucgcaggaucgguagagcaugagcucagaggcuuauaccaagggcucuguguucugagggucugccauucccugggggaagcuauggcugugggagaaggucuugggcaguggcaagcuuaucuugcuuccuagaaggcucagcugccaagacaguagugacuaacauugagcucuguccccacagcuugggguggagggacagugacugcugggaagcccacuguuaggguggcaggaggggaaaccuaggcagaguguccggagagguaagcaaaggggcuaggaccagggcagagagcagaagaaguugagauaaaacugaggagaaaggccgccaguggagggauucacaucagcaugugguucccaauaccccuuaguguccuuggcaaucccugggcugaccaaguuugagaauccuugacagcuccccugcuucgcccgucuuuugguucuaaggacacuggucucuggggagcucugcauugugggagaguguaggggcagacagucaucucagcagcuggggcuagaugggagcccaggucuagggguggcagccaagcugcucaguaacauggcugcagccuccuccuccuagaaaaccaucaggaaaugcagccccuggcugggggacacuggagcaagcccagaccccggggcauuggaucuagccuguucugaagucuuguuugccugcagaacaggagccccccuuucccuccccuccacugcccccaacccucaucagaggcugcccuggggaggugaugggccggcggggacugagccgaugguguccuuacaggugcaucaucaagcaccuagaggggcuggucgugcaguaugaucucacgguccgugacagugacggcaguguggugcaguuccuguauggggaggauggccuggacauccccaagacacaguuccugcagcccaagcaguuccccuuccuggccagcaacuacgagguagugugcuagaucccggagccugggggccgagcaguaggccucccccaccgagguuagagaacuggaaugcgcugagcuuugcaacccaguccaaguggccauuggaaaguagagugggaaggguuuauaagacaccggucagugcccugaaacacuugacaauuucaaagccugugaacuuucaucacuugagguggcuggagggcacgagcaccucuggaauaauaccuacucuuuggggccauuugccgugugcugggcccucagcuaaagcacacuaucaauacuauccguuuuccuccucacugcaacccagggaaguaggcauuacucugccgauuuugcagcugaggcaacugaguaucaaagcauaaguaaacagucggugaguggcagagccagcauuugaacaugggcccgucagacacaaacucaugauuuucauuguauaccuuaaugcccuuguagugaccaucacuguugacugggcagucaccccauuugcagauagggaaacugaaaccgaugugaccugucuaaggucaucaagcugaugguagaauugaggguugugcucuggugcugaguccuuuccauccugguuccuaucccugagcuuggccaucacucuuccccucuuccuuucuucccagaaacucccuugugcuccuggaggggcucugagugugcugcuuucuuuccugugucucccucugcucccaagaccauugguucccaaaucugguuugcacaaagugagggcccugauuaacaauggaugcucagccucucugagaguggugcucggccccaucaugagggcuccacaccagccaccuggguccccugaauuugugcuccauggcccucuugucacgcccucaucucuuugaucucaugugugugauuuguuuguuuguuuuuuuguuuguuuguuuaggugauaaugaaaucacagcaucuccaugaaguuuuauccagagcagaucccaaaaaagcucuccaccacuucagagcuaucaaaaaauggcaaagcaagcaccccaacacccugcugagaagaggcgccuucuugaguuauucccagaaaauucaggaagcugugaaagcccugaaacuugagagugaaaaccgcaauggccgcagcccugggacucaggaggugaugcagggaggugguguccuuaauguccagcacguccaggcuuagucagugggugagggaugaggggcuguuuuccuaagagaagguagaaucaugaacuccagcuuuguucaccgucagucagaacagaauggcucucaaaugggaauguaagguggggacucuuaacaaggguguaggcaggguuuggggggacuaacuggggccugugacuucgggguuccccgcgaucccaggugugaaggaauggggagcagucaugagaaacggagaggacgacuaugugcuagggccacuggacagagcccuggguagagacccacuagagggggguugaggauaaauaccaggauccccuuccuccugccuuucccucugcugcuggugccucccaucagccaagcacaccugggagcuggaagcaggggaucucuuugaagcagucacuuugggacagccuugagggcacagagcgugugaaagagccuggauccagaaauaaccauggauccagcacagugacugcauccuagcuggccugagacagucguggcuuugccucuuguccuagccuaaucauaacagucuccuguuucacucuaaaagaagcccaguuugcucaguaaauuacaugcuugcccucccugggcuugaaugggccaggaugaagagcugcuaggcuuauagucaagcagggugcccuaggacagguugaagucucuccccauuuuaaauggggagaugguuucucauugcaaucagguuucuuucugucucccuuuauucucauuggaagccaaugcuuuugaucccucuuaugcuacuggguaucccucccacauagcugagacccauccuucuguucagaugcugaggaugugguaugaguuggaugaggaaagccgaaggaaauaccagaagaaggcggccgcuuguccugaccccagucugucugucuggcguccugacaucuacuuugcaucagugucagaaacauuugaaacaaagguugaugacuacagucaagagugggcagcucaaacagagaagaguuaugagaaaucagagcuuucucucgacagguauugacagugauuuguugcacaacaugugcaggagaaucugccuccuagccccugccuccuagccccugcccuacucacuccggaagagggcugccuccuggguuugagacuucagcuagagggagggcaguaagacagccaggggcaacgcacaagccccaagggcccaggagugaacaagugcaagggaggcaggaguggacacccccaucugggccaagauagggauaguggucugcugggaggcuugcaggaaagucugcucucuuggguuuggugugguggguggggcugacugagagucagggaaucuggucacuguucaccugcugccaaccgugugacccagggcaggucauucaugcccagggacaccaggucuuaacuucucaugaggccuuggauccgauuacuccaguaauccuuugagcuuuggguucccauuugaaggccucagcuuggacuaggacagacacacacacacacacacacacagacacuguagcucagcgcgcgcgcgcacacacacacacaccuuugagcuuuggguucccauuugaaggccucagcuuggacuaggacagacacacacacacacacacagacacuguagaucagcacacacacacacacacacacagacacuguagcucagcacacacacacacacacacagacacuguagcucagcgcgcacacacacacacacacacacacacacacacacacacacacaguguagcucagcgcuccuaguggcuguucuuaacagggucaggcuucauaggaaaaaugguuaguaaauuacagaaucgugcggcaugaauacuucugauguggucugcagccauuugcacuaacuaaaaauauaaacacucucaucacccccauccccauaauggccuagugaaccucuuucuaauuuuuauagcaggagguuuaaacugucuccaaauugucauaauugagaagaaagaauggauaaaggaaaaagugaauaaugaacccagaaauucuccugcuuagggggcuugugguaacagucccagaguggauaugugacauucugggggcaaacaugaggaguccaagcaugaaugucuagagcuucagccacccagcugggaucugugcuguguaauuugaggacaucucagggucacuggugggaauuugaagauuagagggaucuuuugccuaggaaaaacgaguccagaaagagguagagguuucaguuuucugguuucgggcagcauugacagucuguggugucugcuccugaccccugccacaacccccacccugaccccccaccaccgucucuagguugaggaccuugcugcagcugaaguggcagcgcucacugugugagccgggcgaggcugugggccugcuggcugcccagagcaucggagagcccuccacccagaugacccucaacaccuuccacuuugcaggcagaggcgagaugaacgucacccugggcauuccaagguguggggcacaagggagcacaggguggggucuguccuagccucuccuggagaaggggccauuuaaugagagggggugagugagugugugugaaugagagagugugucugugugagagagggacagggucucauuaaaguggggaucaggguuagaauuuccagagcccagcugguuucuuuggugcccaggccugguaggaucuccauuuauuccucugccaacuccugcauccacguuccuggggaugccugugagacugcacacugcugggggaaggacucaggaacguacauuguuaacaagccccacacaaggugccugguugcccaacuccaggggagccauucacauagaacgugcccccacguggcccugggcccuggcccuucagguaaauauaugugcuggacaaggggaaugaguguggggucagacccaucugcauucagucccuggcccugccuuuuucuagcagaaagacucuggacagguaccucacuuuccaaaccucaggggguccuucuguggaaggccagaggcugggacccacuauacauccaggcagugagggcuggcugagcucagcaggagcacugugggugcuaguugccuucccugcaucgcuuguucauucaguaagcgucagcaggcaccuguuguuugcaaggcacaggugauaggaaacaagaaucagacaaagcccugagcacaaggagugggcccuccagggaggaaacugacaggggagucccuuacuguugcacacgaggccagagcugggauucucugaucuagcauauuaucccugugagauccccaggccucucucagauuccaaaagaacucugacaucauuaggagaagcugcacccaaacagaaggucugguugccacucaugauuggaugugcccuuauucugugacagguugcgggagauucucaugguggccagcgccaacaucaagacacccaugaugagcgugcccgugcucaacaccaagaaagcccugaagagagugaaaagccugaagaagcaacucaccagggugugcuugggggagguaacgucucuccuucccagguugcagacggggugaaggcauguuccuauauccuccccaugugugaagaacaggcuuugcuuacugcucugacccuaggcucagauucccaccaaugagagauaagcugucucugccaggugcugagcagagauggaucaggaagcuuuuaagagagucauuaguuccacagcauccuccugugccugaaaaauaaaccauuuccugaguuugccuacccgcucugcugaggccacuccuaggagguucaggccacucucuggaggugacugcaggcugugggccccccagcagauccacaccaguauagcucaccaggguuucuuugggguuuggccuguggucucagcugcuaucucuguaaacccuugggucucguaacccacucacauugcgcagucaccuaggaccugaacaagucaaguucucucuguccgucugguuccagguguugcagaaaauugacguccaggaguccuucuguauggaagaaaaacagaacaaauuccagguguaccagcugcgguuucaguuccugccacaugcauauuaccagcaggagaagugccugagacccgaggacauccugcgcuucauggaaacaaggucagggcucaggcugugauugucauugaccuugacccagagaaugcgcuugaacuggggcaggaagcaccuagccacaaggcuccuagagauugagugccuuugcccaaaugagcccuucaagggaaguguuuaggaagcagagggccuugcagccugaucuggaaaccugaccacagucuggcuuguggguaugacuuucuuagccacacgucacucccugagcccauuucuucucuuggguugacgucaggauuguugucuucuggggcuugcaggcauuaagacauggaaaugugggugugguaaagagaagggagcaccaucaaagcggugcuucuguggugucggagcagcacaugcuguuaauguuugcuaggguguuacugcaggcaguauaaugugguuccugaugcauuuagauucugugaauaaugaacaaugugcggguggcacgcugcuguuagaucuccauucuauaaccaggauugccuccagagaaauucgaguuccugucccgaguuccuguccaguagggaaaaggaacuuuugucucaaguucaaguuacuguuagauauuugaaaagcagaggccacaaugcugaguuccggggagcaggaggaugggcuuuuuggggacuggggcaagacuggaagagcccacgaagcauuuuugacucaccagcuaacccuagacggugaagugugaacacaaaaaggcugcauagcccagcaggugacaggccagugaagcaggcuuggaggcccccggcagacugaagaguguggaaccugucucaaggggcaccuguuacuaugcaggaauggaggcccggggggccacaucuuuugauuuaaaaagaaagaaaacaagcuucccacccccuacguuuuuuucuuucuugggucacuuguuuacuugccuuugcuuuuauauaauugaggucuccugacuuuuaaacaucagcaacuaauucauguguuuuuaaaagcccaguaaggcccagaugguucucaucuguugcaggaucuggccacaggccacugaccacugccucuaaucuagaccaguucuuggucuucugggagcugcucagauagagaagcaaugacagagcagaagcagaaagcucccugcacucagccaucccacaaacacauacugagccaugcccauucgucgcugagucacgggggcaggcgugggcaacacaguacgacuuuucugcccucagcccucugcccucucaccuuauggggccuggccucgagccagcccucugugcagguggcauuugggauggugggucuugggguggaggagcuuggaugugaacucaguccuuuggacgggggucacuggccaggugcuuccugccccaguucacgagcccugggugaaguuguuguuggcugggccucaggagcaccugcguuggugccagccugggcugagaacauuccuucugucgagugguccucugugcuaucugggcacugggcagaguggcaggggagugcugugugcacccgccugccagcuccuuaauuaacagcgaggaacauaacuaccaagugcagggggcguuugugcuggccuggcagugguuuucugggaaaugggaauucagauuucauggccucuagagaauaacuaaggguggacggaguuagauguuuugccccaguucuguucacaggaggcccaggccagcccagcagguaggucggcaugaggcuggcgccagcccaugcugggguucuuuuuacuuauauuaccucauggaauugaaaauaggaaaucacuuuuuaagacuucuuccugaugagggacagcccuggcuuguucccagccgugaaguacuuuuucaacuccucccuguguuuugcuugugaacuugaaaaucugugauaaauaaagccaugcgcaguagcuuuugguggagguggccucaaggacucagcagaauggggcugagggguuaggcagagcuaaaagauggggcaguggaugagcugggugcggucuggacucccuuugucaggccccaggcagcagagcagcuguguucaggccucuggccgcccacaggaaaugggaggaagugugagugcacuuucaaaagagcagccaacccccaagaagcuuuuucuccuuccuuucucccaucccucccccuuccuuccucucugccacccucuuuuucuuucucuuugcccccacccucccuucucccagcuguggagucaugagacccuugacagagccuggagaaaaacagcacgagacagaugguucccuagguagagauauacaagcguagaaggccccccagaucucugcacuggcacccaucacaugggcuguuuguguaaauugucuggcagguggcaggggagaugaaguggaaagagcacugagcuaggaguuaggggcuguaaguuuuggccuccgguccccagccaugaaaagacccagcugacagucuguaauuguagcuucugugaaucugacuuuccaaacagcaggugguggagcuguugccaggcgcguucagaaaccgccaggggucaugugcucuguuuguaauuauuuacgugggacgggaggcuucucugccccugccccuccuguucccuuucuguugcuacauucaggugagcugcacaaccuugagaaggcagucacugugggccguuaguuccccugcucuuggcaaaaccauagaagggcaaauugcaccuccaggaaaacuggcacacuggucacaugccuaccacuuacucaccagccauucauucugccuucucaccuccuucccuccuacguucuccacaaguccuggucaccaaaagaggcagggaaggcagaaggcauccccaacugggggaaucagggagggcuucuuggaggaguuacagcugcugaggccuggccuugaaggaugaguacagcuucaguagguagauauuggccagggaaguuacuggcagagugagccgcucaagcaaaggcccaaagggugcacaggguggagggagcagaugggcaguuagaguugaggccagaugugaaaugcugggggcaaaagcaucagagccgugacauugccacaaguugagacaggcuggggcgcccagcugagggaagcagcccuguguguggcagcagcugagccccgcacccccacuccgccucauuccaucuccucugcucugcacaguagccucgggugcagagugagagugaucccauguugcagaugagaucaaggcccuccucuccagucuguggcaggucaggacuuuaaccugaaccuguccuuacagaaacaucucucccacccccucuuuccagugggauuguaucuuucuaaagucaagcccggccuucucucaucuggcuauccuguuccuguccccagugccugguaaacaagcucuucucuggauuaauggaugagggggcuuuuuuuucugccaagggcaaaccacguacaccuuuaaaaaguuaaaaaauaauauuggggucugggugcaguggcuuacccuuguaauuccagcacuuugggaggccaaggcagguggaucaccugaggucaggaguccacaaucagccuggccaacauggugaaaccccguuucuacuaaaaauagaaaaauuagucgggcaugguggugcaugccuguaaucccagcuacucagaaggcugaggcaugagaaucguuugaauccgggaggcggagguugcagugagccgaggucgcaccacugcacuccagccugggggauagagagacuccaucucgggacgguggggggaacuaauaauaauaauauuagggaagaugaguggcauucuuuuguuuuuaaugagcaaaauaguauacauuugaccugccuacuuuuucaaaugaagacucuaagcuccuugagggccuggagucugucuuuucguccuugcuuugccaccagggcuggcacaugcugggcacaguauaggcgcucagagaaagugggacggcuggcuggaugugugagggacccgauucucacagucacaagcagcccuuuuuggugugcuauucuggccuguuggaaaagacaggcaggggguuacaugaggaaagaagugguauggaggggacaggguggauccuaagaggcccuaaaaauagauggcucuggaggaaguggcagggggccagguucugagcuucagguugguucuuuuaaauuggugugguucuaacuuguugacacgauucauugccacaagcuaaguuaucucugcccuucgaaauuuugaugagcccuuccgaaguccucguucuuucgucacauugccggggcucccacaccaagggaguucucuggccagagcaacaccaccuucuggagaugcugcagguugugggcaggggaagguccuaguccugggugggguuccccucuccuacaguagauucugccuuccuuguuagaggacgaccacagcggcaccuacaacuguccuucaccaagcacgcacucugccaggcgcugugagaggaaucagacauaggguuguuucucaucauuagcaaacaagauugcagaauacguaguaauucccauauuuucuagacaauggggcuuaaagcugaggaagcugccuguccuacucauaccccgggaguggcagugcaccuauugagaccaggccuguuggacuguggaaccgguguuccugauacgccagagacgguuccaaaacagcggguagggacaagugaguggcuaggagaggcugggccuccaucucgugcacugauccccugugggaaucccucagcguccuaucccccaaaugaggguagggcuggacaugcugguacugcacagggcuuuuuggcuuucuucuuguuuuagauucuuuaaacuucugauggaauccaucaaaaagaagaauaauaaagcaucagcuuucaggaacguaaacacucgaagagcuacacagcgggaucuggacaacgcuggggaguuggggaggagucgggugagugaguccccgggggucacuagaguugcacagggacagcccccagacugggcaggcucugugccuauucucugugcuccuccagccccauccuggugcuggcccaucuccuaccuaucucagcuuuuaccugcuguucugagagcccagaagcagcauucacuucuuggccugaugggccaggcaagcgaggcugccaggcagcaugguguagccagccccggggcaggccuccgcaucauagcucugcucuccaagagcccgcuguaaguggucuucauccugaggagggacucgaggucauggcgugcgcugagccuuugaaaguucuuuuuccgguuuccuuuggcucugccuucgacuugcccaggcaagaugaacugaggcccaccagggcacuggcagggaccagagagguaucuggaagcagagaaguugggcugcagugacaaaaaggggaagagggaaaaaaccaguaggagcaaaauaguccaggaauaaauaaucagauaucugccaggagacccaggagcaggccagaccugaggguggugugggagcaggucccugggugccaucugagccagcagccagccugcuuggguuggggaugauguggacugggacuacccccaaccagcucuguggucucaguugugucacccuucucugggucugucuucucaccccuaaaaugaggggcuggccuacaccagggaaaaugcuaggucucuccugcuccgugaguucaccugcuagcucacucaagcacaagcggguguggacuaucuuuagaaugcugccuggucuugauucuuaauucacccagaaggagaguauaaaaaacuaggagccaaguucaggaggagaaaggaagagauacucaguauucuacaagauaacccuuccuucucauccccaccugcaacuggguuugaucaaaaauauuuggaacaauauuugacaccaucuucuucuaagaaagcaaguccuggcacuuuuuuuuuuaauuuuugggaaugaaacuuugcaaguaaguggugcauguaaagaugaagacugaagggaaggaggccuggguucugggacuggacagaguagaugccaguagacggguuggguuggguggcaguggauggagggugguggcuggaugggagaagggguuagaaggguggggcauggauggauggauggguugguggguggauggauggauucacugagcacuagauauuggaguuaaucuuuuucuuccuugcccacaaaccacagggagagcaggagggugaugaggaagaggaggggcacauuguggaugcugaagcugaggagggggacgccgaugccucugaugccaaacgcaaggagaagcaggaggaggaggugagagacccuguguggggugaaggagcuguggucccagcccccuucccuguuaaccuggagggauuaucucccggcacccaggccacaccucugugucaugaacccacaaggaacccugaagcagcaccugccugcccagcauaccucucucuugagaagaugggguucauagggugggaauuuggcacagguccacuccagggcugccuuuuagauguggccaucccuggacuuaaaucggacucaaggauccagacaggcuucuggcaagaaaaagucaggcugccucugguuuuuacaaugaaaauauaccucucucuccucccacaaaccagucuccugcugucauaauggccgagggaacuuaccggugagcagguacaccagugagggcugagugagggugagcuccaccucugugaggggcucagggggacagagagguggcauucucaaggcaaaaggaagaagaaagaccaaccaggccggagcagaggagccgggaguguggagcagguggggccuagguagcccaggccagccaaggcuuugcaggggucuuuguuccacaggcagaguccagguagaugguggguccccaagugacacagccugugcucccuuuucugccagguugauuaugagagugaggaagaggaggagagggagggcgaggagaacgacgaugaagacaugcaggaggaacgaaauccccacagggaaggugcucgaaagacccaagagcaagaugaagaggugggcuuaggcacugaggaggacccgucccuucccgcccuccugacgcagccccggaaacccacccacagccaggagccccaggggcccgaggccauggagcgccggguccaggcugugcgugagauccacccguucauagaugacuaccaguacgacaccgaggagagccuguggugccaggucaguguggccgugcaggccagggcuugggugguugguccagcuggccaaaucccucuguggaaggggccugcugagcuccccugcacagcugggcagggggcagccaacauuccccauggucucccacucagagcacagccaggccuccuguuuggggccugcgagagucauuuguucuuuuuaaucccagaucccuuuaggaaucuggugauggcuauaaacccucugccccgaaaaagggcccacacgugucauuuucaaaccccuaguaagccaguucuccccgaucuuucaagacacacaagacugaucuaccaggcccuuuagguacuuucaaauacaccaccuccuuuaaucuucaguacaacagauauguuaccauggaccacacguguuguagagacacuguucgugcccucaggcagggacacuucaguuccccacacacacagccccugccaccaucuuuuuagggauuucaugguucccuuaaagccuggaugaucuggaugccuagacaugugcacacacuuacgcuuugucuuuccuuugauccaguucagugguucccaagugaugggguaauaacaagaaccacugaugggauugcacgcgugaaacaacguguacccugccuuguggucuuuaaggacauuaagagcagugcagaguggaugugaaucucaauguugucaccgacagcugugaaaacaaccccacuguuucccccugaaucugggggacuggagauggcugaccuguacacaguucagccaucuccaauguucagacuaccugcuggcuugcccagcaggaccacuuucccccagccagggaguuccugaaaagguuuugaaggagucucgccucaguccucuuuguggggacuggaguagcugucacccuacccagcucucccuccuuuugcaggugacagugaagcucccucugaugaagaucaacuuugacaugagcucccugguaguaucuuuggcccauggugccgucaucuaugcgaccaagggcaucacucggugccuccugaaugaaacaaccaacaauaagaacgagaaggagcuugugcuaaacacagaaggaaucaaccucccagagcuauucaaguaugcagagguaagacaggcugucugcuggccugggacaaagcauuaguccucaccccacguugucucaagacccagccacugggaggcucgcucuacgcgauuuacucuggcccuuccugagccauuugugcuuccaggccacauuccccaaaccaagugugcguguccucgucugccucccggggauucuggggcacguuagccucauucagguccccaguaaagcacccugcugaacuuauccaacccagagucgcccggguuaauuugaguagaguuuuuuccuugaaauuaagacccucgggccgggcguggugguucacaccuguaaucccagcacuuugggaggccaaggcaggcggaucacgaggucaggagaucaagaccauccuggcuaacacggugaaaccccuucucuacuaaaaaauacaaaaaaaaaauagccgggcauggugacgggugccuguagucccagcuacuugggaggcugaggcaggagaauggcgauaacccaggaggcggagcuugcaguaaaccaagauugcgccgcugcacuccagccugggggacagagugagacuccaucucaaaaaaaaaaaaaaagaaagaaauuaagacccucccgaaguagaguugugagaaaucauugcugcaucaccugccuagaugcuguuugcuuuaucugguaaagggggucccagggguagaggugcccuggcauuccugucccaccugcucaccagcucaucuguccuuugagcugugucuccaaguacucccacuucaccaacucucccagaacuuucuggguuucccccacagaacacugaggaacuggggcccucuagccuaaccccccaacaagucuaugcuaagcuggcaaagcucccccugccacguacacuucugcccccaccaaugaccacccugcaaagucuccugcuccccugaacccuuuuaccaaacacuucccagaggaugagcaaggaggauuggcaccugccaagagugcagggugagaggcuccuccaagacagcucagccgcaccuuggccccuugguaaggcccagcacaugccugugcggcugacuggcccccacuccaugcacccuggagggguguguaaugugucgcugcuaggggaacuuuccuugcuuccuaagggaagccuuaauccuaguaaacaggucucaguuuaaaaauaagaagaaaaaauccuuuucuucccauugaaucuaaagcguguccaaaguggacacgcuggauucuuguaaugacgauacagaccuugggccccggccagcgagccgucagcagcucugccuagccauuuccuucugcuaauccugggccaccucuugaccacuuugucaucagcuguaccgagcugccagacacaaggagagagagagcggccagggggagauacgcaggcagaagggagcagaaggccaggcccucuaaauaaaucccuuccuuccucucuccagguccuggaucugcgccgccucuacuccaacgacauccacgccauagccaacacguauggcauugaggccgcgcugcgggugaucgagaaggagaucaaggauguguuugccguguaugguaaggggagcuugcagauaacaccccgaggucugggcaccagccaggacaccagaaggcucggcaggagggucaggaccgugucgguccagcaccgagucaguccagcacuaaggcaggcacugcagcaugcgugcagugagugcaccuguaggagacugcagaucugugaagaggugacgucucccaucacugagaccgcuucaguggugucucaucugcuggugccuuagagaaagcuccugauugauaacuuggccccauccugccuuugggguuucaguucccaagugaaaacagugcgguuagauccucauuuccugugcugcuggaaggaagcgggaagcaggaugcaggggucagggaaagaugccccagaccacggggaaggguuaaguagcgugagcagguggcggagcugaaggggagccccagagucuaacucccaagccaugugcugauguggaggcagcuuggcuugugucugcugacugcucccguggucacugcuuaaucccuccuaauuuuaccucccguuugacaggcaucgcggucgacccucgccaucucucccugguugcugauuauaugugcuucgaggguguuuacaagccacugaaucgcuuugggauccggucaaacucuuccccgcuacagcagaugacauuugaaaccagcuuccaguuucugaagcaagccaccaugcuggguuagugcgugggcaggagcccuggccuccccucuacugacgacucugggcacacgggcucacccaugggcaucuuuccaugguuccuugcacaccagugggaucuugggaucugaggggagcgggggcggcuggagggggcugaacagcagacacgacagcugccucuacgcuuugaaggaacaggaagagggccuuccccucucaagugcuagaggggggcugccucgugaucccaucagcuucagagacucaggacccaccugagucccgagacuucaguguucagccccauaaucaccucaugacauucccaacuucuaccucaacacccugacacauguuuuugugucucugucaggaucccacgaugagcugaggucuccuucugccugccuuguggucgggaaggucgucaggggcgggacaggccuguucgagcucaagcagccucugagauagcagcuaccccggcaccaucugcccagcuccaaggacccuuggugagggcguggcccagccugccuucugcaugagaggaccaggagacuggaauccagggcaguuccaagugacaguacagagcacagcagcgaccuugggccugaaagcagugggccucugagcugggccagcuucaccuggaaagugacagaguugcucauccuugccccucccugucucuggauuuuuaucaagguuuaccaagucuucugagucccccugagauggcuggggccucaccugugcugcaggaggccucuguggcauaaccccuaaggagaaguccugauucacgauucacugagaagaccaaggggaagccaugcuuugcugcuggggaccccaggcaccuccagaguagggaagcgggguucuuuugcugugaguggccagggacaacagacaagauuccugggggcucccgaugagcaggaacguggagccugcugcccaaggccugcuccuuccggcugcuccagccccugggggcagaguccacaaagaguccccaucaagacuucuucccugagucaaguacagcguagcauaguccuccacccacccaaccucucugccuggccaggguccuggcccugccacuguguggcgagguguccuucuagaccacaucagccccaaggcugggagcagucgcuccagggccgcagcaguucacucccacacauagaacccaggucacugcuggggcgauugaacagguugccuggcuuuucucugcugucaguuugguguggaggccuauguucugccccauacaccccacaggcccugcuuaugggaaggaacacaggccuccagcccagaggacugugccgcccuguucuuggccguccacguuuccucucccucuagcaccagcaauacauuucccuggcauggacagaaaagacagagaggacuuauacaaaggcuuuguaaaaccagaggcuagcuucuaucuuugucuacuguuauuucagcucagggcggguaauuaacaucauuggaacuagcuauuaggaaagaaaaaaaacuugguuuuuuuuacaacaauuuuuucccuugguuugcaguuucugcauuuggauuugagaacccagggcggggauuuucuuggcacagucaggucuugggucccucuuccugugcuuucuugucugaggccuuagggggaagagcucagccucugcagccuccuccaccucugccccuggccugccucugcugugaccuccuuccagagcuagcugcuggcccuguggccaggagaagcagaggggagaagccuuuaugcagaagcugugcuagccuuggucugggguggggaggcugcugcugugaccuuagggguaggguuggggaucaagggaggcuuugucaagggagagugaccauguugcucccuacauccaugcaauaggacccagccugcaccuccuaggccuacacuggggaaagccugacagaaaucaguaccuccuaacggggucugccagguucaccaaggcaugggcacagaggaauaugacaguuuugaggcaggcaggaagggcccagccugcaggguaagacauucauucuuugaguuaaaggccauauucacuugaugauuucuacacacacuagaauugugagaguguccuugaaggagaucacaaaguaaccuggugacuguggcacaggguccguggauuccaucucucccaggcacugagggcgcagaggcgaaggagcaagcccugcauauuggcagggcugugaccaucgcacuuagaucagacccccgaccuguguugggaugugagggaugcccuccugccccacccauccacaugguuccugggcagcucuguuuuauuccugugucuuuccugauggaugaguauuaagacagcaugucugguuuuuaaacagacauuugggagcuugcacauccugaugagcagggacucacugugguggccuuagggaauuacacgcucacuuuggugguucucuaugcucggaagccucugagaguggccuuggcagcuuaagauggcagaggcuuuggagucuucuuaggacuguaagugcccauugaggaugcauuugaguuuuggaaaguaggcccaagucaaaucugauggauggauucaagaacauggacuaaucugcguugucauuuuuaaucaaaauguaauggagauugaucaucuggugggguucacaaacuuuucaugagagcugugaguucuuuuuuugagaugcacuuuugcacuuguuacccaggcugagugcaauggcgcaaucucggcuccacugcaaccuccaucucccgaguucaagcgauucuccugccucagccucccgaguagcugagauuacaggcaugcgccaccacgccuggcuaauuuuuguauuuuuaguagagaugggguuucaccauguuggccaggcuagucucgaacuccuaaucucaggugauccgccugccucagccucccaaagugcuggguuuacaggcgugagcuacugugccggccagagcuaugaguucuuucagaauccucagaugccauuagcuagccacuguuuggacauccuucucaccuugcccuuuggggugauauccauaccuacuugcuugcuucuaacaguuuuuuuauuuguuuuguagagacggguuuugguuuauugcucaggcugguuucaaacuccuaggcucaagcgguccucccacuguggccucccaaagugcuggguggugugagccaccgugccuggccaguuaauuuuuuuuagugucucuuuuuuggguucucaccagaaacacuaucagcauucccacagauauuccugugagucuuugaaacauuuucuauccugcauugaguaagaauaaaaccgaggaaggggugaagcaccuugucucauccccagucuggaacuugaaccuucuuuucucuucacuuugcccuacccccaaauaauauguacaaaugucuguauccauugagcacuaacucccuauuccuuccaccuccccagccccuggcaaccacuguucuacguucugucucuacgaauuugacuucucuaggucccucauacaaguggaaaaguacagcaugucuuuuugugaccggcuuauuucacuuagcauaauguccucaagguucauccaugcuguagcaugugucagaauugccuucuugcuugaggcugcugauaccuccucauguguauauaccguauuuuguuuaaucacucaucuguugguggacacuuggguugccuccaccucuuggcuguugcaaauaacgcugugaacauggauauacagauaucugaggccaggccaggcguucacaccuguaaucccaauacguugggaggccgaggcgggcagaucaucugaggucaggauucgagaccacccuggccaacauggcaaaaccccaucucuacuaaaaauacaaaaauuagcugggugugguggugcgcgccuauaaucccagcuacucgggaggcugaggcaggagaaucuugaacucaggagguggagguugcagugagccgagauugcgccacugcacuccagccugggugacagagugagauuccgucucaaaaaaaaaaaaaaacaaaaacucagacccugcuuuccuuugaauauauacuagaaguggaauugcuggaucauaugguaauucuuuaauuuuucugggggaacugcugucccauuuuccacagcagcuacaccauuuuauguucccaccaacgguguacaacaauuucaauuucuccacauccuuguucuuguuaauaguagccacccuaauguguaugaggugccaucucgugguuuggugugggcuguguuucaaucagauguugggacccuuaaguguucugcaccuggggagaguuaggaaccacuuaaggagugucuguugcuugccaaucuuaaaauuuuuaguuugcaccugaaucaggggcugucagaguccagacugcucuugaaauagaaaagacuggucguuaaaggcugguucguugagucuuucaucguugagugauaccaccucugcagauggcucaguggggcagccccguaccacagccugcccuugagguuguguaguuuagauaggucacagaguugcugggccuaccgcaggucuccugacccuggugcaguuuuacuucaauuacaaccaccaaaauagcuacagucaaaaauuccaaaguuccuacaccaucaaccuccaccccacuuccguccaaaguccacuuagaggcucucaguuuuggaccuuagaaacacuuagggagcuuuuuaaaaagaucgauucuguauuuuuaguagagaugggguuucacccagcuacucaggaggcugaggcaggagaaucacuugaaccggggaguuggagguugcagugagccgagauuaugucacuccagccugggcaacagagugagacuccgucuuaggaaaaaaaaaaagauugauucuggccgggcacaguggcucacgcuuacagucccagcacuuuaagagacucaggcaggaggaucacuugagcuuaggaguuugagacuagccugggcaacccagugagaccccguaucuacaaaaauuagccagguguugugacaugugccuguggucccagcuacucaagaggcugaggugagaggagcaagugagcccaggaguucaaggcugcaaugagcugugaucgcaccacugcacuccagcucgggugacaagagugagaccccgucugaaaaaaagauugaucccaaggccuugcccagauucugauuuuauuggccuggaguguggccuaggcauuagaaaaucuucaagagagucuaaggugcagcggaauugagagccacggacagaaaaagcccuaaauuguggaaaugcacagccaccgucaccaccuaucgguacgaugacaucucaaggagucacuggcccuagguuucugcaguaggaucuuaagaucugaucucugcccucaagugagugcacgugcaguaaagcugucaucgugccaugacagaugucugcaaggacuuuacagugggguccaaaggaugccaccaucagcuccaccuggggcucaacaaagccugaaagaagaaagggaugaugcuuccagcagaaaccuggaggccugcagcucugccagcccagcacagcaagcgaggccauuuguccagcaggggcagaaggagggaacucagccagccagcguuuccuacaagcagcuccaugagagguuuccacuuaaaaugcuaaaucauaauuauuuaaucagauucguuccuuaaguucuuuaagcagcaucgcuguccuaccacgaguggucaucaaggagcaggguuuaacucaacucugaguuacccggcaggguaccuggguaacugccuggguugagguacccagcaggcuucaugugcaugugcacacugcccccugauaggaccugguuuauucacaggcucaggugucacugcagcuccccagugacuaucuucgcgcaaguuggacucaauggccugggagguuugucccagccgacagauaccugaccaugcccauccucaccauucccucccccaugcugcauccauccaaccuugaucuccacugugucccaggcacccuaagaugcacaagcuaugugggcccugcccucacagaacuuguagucuucugccccaaacaagccaguucaccgucuucaugaucaggccaaagguugagguacccagcaggcuucauaugcacaugcacacuguccccuauaggaccaugccuugcccagcuggcugcacucuagagggugcuuuguaggaaggacagaguggagaggacaguggggagguacuuggguguucaacagccagaagggagggaaacugaaaaagaaucaggaguccagccauccccuccccaccuccugcccccacuuccacccuggcugcuggcccuuugcccuugaauaugggugauauagguguggcuauucaguuccagucacagugcugccucuaugucuuuugcaagcuggggucuuccuuacucagaaggccuggaggcccugccagaugcugccuuccggacuggcugcccgcugcaguguuuucacgggagccaagccagccccgggccuguagccucccaugugacaaaguuucagacaccacaguccucagcuggaccacaguaaacacuugccuuccccaacccaugauucuugcuuggaaacaugaaccugauguuccacgugcguucagccaaucaaaccucaagaaugugauugagcagugaggcugcguuuugggcaagacacugagcucugaaauaagacuuuucuuggaaucucaagcccucaacuuacagugggacccuaagaaaugcacuucaguuuccuuuuauguaaaauggugguaaaauuaauuguguucauuaaauugcacacaacuauacauguuuaccuauacacuaagugguucucaacuuggggcaauuugccccccaggggacauucagcagugucugcggacauuuuuuguugcuacuggagggaggugcuacuggcaucuagggaguggaggcuagagaugcugcuaaacuacaguccacaggacagucuccacagcaaagaauuguccagccccaaauaucaauaaugccgagguugaggaaacccugccacauacacauagaugcggguuaacauu

SEQ ID NO: 14694 - RNA, 2488 nt, Homo sapiens
caggaaaauauacgguuaggaaagccccagucuucuuuuuuuugagacgaagucucacucugucgcccaggcuggagugcaguggugcaaucucggcucacugcaacuuccgcucccagguucaagcgauucuccugccucagccucccgaguagcugggauuacaggcaagugccaccacauccagcuaauuuucauauuuuuaguagagaugggguuuuaccauguuggccaggcuggucucaaacuccugaccucaggugauccacccaccuuggccucccaaagugcugggauuacaggcgugagccacugcacccagcugccccaaucuucuuauggguccaguguaagugguuuuuuuuuuuuuuuuuuugagacggagucuugcucuguugcccaggcuggagugcaguggcuaaaucucggcucaccgcaaccucugccucccagguucaagcaauucuccuuccucagccucccaaguagcugggauuacagccgccugccaucaugccuggcuaauuuuuguauuuuuaguagagaugggguuucaccauguuguccagguuaauuucgaacuccuggccucaagggauccgcccaccucggccucccaaacugcuaggaucacaggcaugaaucaccgcgcccggaccaguguaagcauuuggugugcugccaaucaaggacuuauuuaccuuugcaucccugcucugaggccagcacaauccugucacacaguagguacacaaugcacauuugucuagcaaaaaguacuggaaagcagaaggguggauagagcucugccuggguucaaauccaggcucugccauuuacuagcugagaucuugggcaaguuguuuaaccucucugugccuguuuccugacugugaaacagacagaagcuuucuuaugagguuguauaaagacucaaugaauuaauauacguaagaucuaaaagcacuuucacuaaugccuaacaaagguaguggcacacaccuauaaucccagcacuuugggaggccgaugcgggcagaucaccugagcucaggaguucgagaucagccuggacaacguggagaaaccccuucucucucucucuuuuuuuuuuuuuuuugagaccgagucuugcuguguugcccaggcuggagugcaguggcgcgaucucggcucacugcaagcuccgccucccggguucacgccauucuccugccucagccucccgaguagcugggacuacaggcgcccaccaccacgcccggcuaauuuuuuguauuuuuaguagagacggggguuucaccauguuagccaggauggucucgaucuccugaccucgugauccgcccgccucggccucccaaagugcugggauuacaggcgagagccaccgcgcccagccggggaaaccccuucucuacaagaaauaccaaaauuaaccggugugguggcacacgccuguggucccagguacucgggaggcuaaggcugcaguaagcccagaucgcaccauugcacuccagccugggcgacagagaccuagucucaaaaauaaaauaaaaacauuuuaaaaaaaguaauaaugcuuaacaaaaauugaccgucauauauuaaccagugugaucucuagguagcagagaagcuggggaaaggccauuuacuggguucauuccgcaauuaugugcuggucgcucaucgcugugccagacuuucucuuugcuagguagcggagcaccuuacuaaaauacagcacgguggggcaaaccggcagauaaacuucuugcuggcuccccgauacucugacagcgaugcuuaacugggggcuuaugagucgucccaguucuuggugagaaucauucagcggagauuugggagcgcugagguggagguuccggaaagagacgagaugagcugaaccuuaggaguaagaagugguuuuucccuauagagaaggggagugcguugcaggaagagcgcgcgggcuggaggcaggcggggcgggcggccucaccucggugucgcggcagguacaccugcaggucuggcuugcggggccgcgucggcgcgggcgugugccgccuccucaccuucuccuuggccgccugcuucaccuucuugucauagucgucccugcggggagccgagcgggagucagggacugucgggccgggccaggccaggccaggagugguggcggcggcggcgcagggcggggcgguaccgagcgaucugguuccgucggauauggugcacgaagccgugguucauguccagccgccccccaggcuugcagcagugccccggccggggaugcggccccgccuccaucaggagccggggacgcagagucgccgccgccucgacggccccaacaacagccacccgcccacagagcuccgcgccgccccuugcucagcuuccggccccgcauccugacuuccggucugggaggccccggccuggccaagcgaugcagcgcacggaguuu

SEQ ID NO: 14695 - RNA, 6907 nt, Homo sapiens
aaacuccgugcgcugcaucgcuuggccaggccggggccucccagaccggaagucaggaugcggggccggaagcugagcaaggggcggcgcggagcucugugggcggguggcuguuguuggggccgucgaggcggcggcgacucugcguccccggcuccugauggaggcggggccgcauccccggccggggcacugcugcaagccuggggggcggcuggacaugaaccacggcuucgugcaccauauccgacggaaccagaucgcucgguaccgccccgcccugcgccgccgccgccaccacuccuggccuggccuggcccggcccgacagucccugacucccgcucggcuccccgcagggacgacuaugacaagaaggugaagcaggcggccaaggagaaggugaggaggcggcacacgcccgcgccgacgcggccccgcaagccagaccugcagguguaccugccgcgacaccgaggugaggccgcccgccccgccugccuccagcccgcgcgcucuuccugcaacgcacuccccuucucuauagggaaaaaccacuucuuacuccuaagguucagcucaucucgucucuuuccggaaccuccaccucagcgcucccaaaucuccgcugaaugauucucaccaagaacugggacgacucauaagcccccaguuaagcaucgcugucagaguaucggggagccagcaagaaguuuaucugccgguuugccccaccgugcuguauuuuaguaaggugcuccgcuaccuagcaaagagaaagucuggcacagcgaugagcgaccagcacauaauugcggaaugaacccaguaaauggccuuuccccagcuucucugcuaccuagagaucacacugguuaauauaugacggucaauuuuuguuaagcauuauuacuuuuuuuaaaauguuuuuauuuuauuuuugagacuaggucucugucgcccaggcuggagugcaauggugcgaucugggcuuacugcagccuuagccucccgaguaccugggaccacaggcgugugccaccacaccgguuaauuuugguauuucuuguagagaagggguuuccccggcugggcgcgguggcucucgccuguaaucccagcacuuugggaggccgaggcgggcggaucacgaggucaggagaucgagaccauccuggcuaacauggugaaacccccgucucuacuaaaaauacaaaaaauuagccgggcgugguggugggcgccuguagucccagcuacucgggaggcugaggcaggagaauggcgugaacccgggaggcggagcuugcagugagccgagaucgcgccacugcacuccagccugggcaacacagcaagacucggucucaaaaaaaaaaaaaaaagagagagagagaagggguuucuccacguuguccaggcugaucucgaacuccugagcucaggugaucugcccgcaucggccucccaaagugcugggauuauaggugugugccacuaccuuuguuaggcauuagugaaagugcuuuuagaucuuacguauauuaauucauugagucuuuauacaaccucauaagaaagcuucugucuguuucacagucaggaaacaggcacagagagguuaaacaacuugcccaagaucucagcuaguaaauggcagagccuggauuugaacccaggcagagcucuauccacccuucugcuuuccaguacuuuuugcuagacaaaugugcauuguguaccuacugugugacaggauugugcuggccucagagcagggaugcaaagguaaauaaguccuugauuggcagcacaccaaaugcuuacacugguccgggcgcggugauucaugccugugauccuagcaguuugggaggccgaggugggcggaucccuugaggccaggaguucgaaauuaaccuggacaacauggugaaaccccaucucuacuaaaaauacaaaaauuagccaggcaugauggcaggcggcuguaaucccagcuacuugggaggcugaggaaggagaauugcuugaaccugggaggcagagguugcggugagccgagauuuagccacugcacuccagccugggcaacagagcaagacuccgucucaaaaaaaaaaaaaaaaaaaccacuuacacuggacccauaagaagauuggggcagcugggugcaguggcucacgccuguaaucccagcacuuugggaggccaagguggguggaucaccugaggucaggaguuugagaccagccuggccaacaugguaaaaccccaucucuacuaaaaauaugaaaauuagcuggaugugguggcacuugccuguaaucccagcuacucgggaggcugaggcaggagaaucgcuugaaccugggagcggaaguugcagugagccgagauugcaccacugcacuccagccugggcgacagagugagacuucgucucaaaaaaaagaagacuggggcuuuccuaaccguauauuuuccugcagcaucucuauggacagggccuucagcagcacccccccucuucuuucuuacugugguucauccuuccagaugucucugcccacccacgcaacccagacuaugaagaguccggugaaagcagcaguaguggaggcucugagcuggagccuucuggccaucagcucuucugcuuagaauacgaggcagacaguggagaggucacaucaguuaucgucuaucagguacgccugguggaaacagcugcagccugaagguccugggccaugguaguaaucauugucagacccugagcccuguuuuccucaggacccccaaugggaagcgucugcuccacaugugagucuaggccugccgggcagugcuuuugagcacaacucacucccaucucacagugauucucaguaggggaacagggagggcucuuggcccccaguggagaaucacuauuacaggagacacauaggaaaugacaggugcuggcaaaaagccuugagcuaaauggaguucugugagaguguuuagggacagggcaggucaccuuucuggaagaggccaggcccugagccuucugacucuuccuccacguagggugaugacccaggaaaggugagugagaaggugucggcacacacgccucuggauccacccaugcgagaagcccucaaguugcguauccaggaggagauugcaaagcgccagagccaacacugaccauguugaaggcguucucuccaggcuggauucacugcacucggaagaauucugcccagggaauuuaguguggggguaccaggaccaguuugucugaucuugagacccccagagcugcugcauccauaggguguugcaggacuacaccuggccugccuugcagucauucuuucuuauauguugacccauuugcccagccugauauucuggaauucuuuuuuuuuuuuuuuuuuuuuuuuuuuugaggauuuuguguggcuaauguguucuagaagcagagacuccagggagaaccagaauuuaugaagccucgugcaacauggugcuuucucaccgaggucauaugccuggcugcugcuguuccacucagcuccaugagccacguuuguuauuuuauguuucuucugugcuuuugcucauuuccacccauguguuuauagaccuuuuuucagcccuuuuucuuuguuccuuucccucaucuuuuugccucagguagaauccaucaguuuuccucccccuccaaaugacuguguaccuccagcugcucaggacuuuggaggugggggcggggccuggggaucuacccuucuaaaaaacucuccaaguaauucugauaccaauaaagugggagaccuccauuuuugaggccuauuugcaagcaugucucccucccuuuccauggcuuuuucguuucucgcauguuccacugcuuugcacugucuagacaggaaaccuaggaagauguuggugcuaaacugaaaagauuucuuacagcaaaaccugccucggccagggcuacagaauuccaacuuucaacuugauuccuagccgugaacagacuguccucugcucagacuaaaagggaauuauaaacaagugggaacuuacucuccaguugugacuuaacaguucugaacauaccuacaaagggaaagucaauauuagcaauaauugccugauugacagcacgccagagggaaugaaaugaggccuucucuccuaccucccaggaguauguaacucagauccuuagcauaaagauccccaggaauaccacugcucuaacccggugaacauuuuuucuaaugcaggguuaggcuuacgucugaauuccacaagacauccucccccuccaguacggaaguuccaaggcacuuguuuuccagcauaucagccuaaccucagugccuugaaauauggcuuuaagccuuugagaacugagauuuccugaaaccauaggcccuugccccagggguuucuccacauccggguguuaagacaccugauggcacuguugguuuguccccuauaccccagaaaaucuauccugcaagguagcuacuucaaucuugucauuaaaaugugucaagucacagcucgcaaugccaaaggaaugcuggggcaguaagugagguggauaagugagaagggccugguggugaaagcggccagggaccagaaugcuccagaccuacagagcuggucaagguuaagugccuuaaacuuaccaauccugggcucaguucuccuuugaaaggagaaagucuuuguccucuacuuaggcagcugggcuagaagugccuuuugacuucuaauguuaacuacccuccaaagccuccugggucaagaaggcucucccaaacuccaccccuguucuuccuggucagagaaccagucagucauucuagucuucuaguccuuaaacugaucugaugacuuggaacauaggauuucacugcaagucuggcuuuuuagucuggaaauacauuugaggucuguuuucgcacagcuggaucaccuguuuccugguuuuauuacacaauucagaaggcuagaagaggaguuugggggcuuggcaccugaaaauuuagaccgcauucuuauuaaguaaaggaagagguagggaggccgaggcgggcggaucaugaaaucaggagauccagaccguccuggcuaacacagaaaccccgucucuacuaaaaauacaaaaaauuagcugggcauggugacaugugccuguaguccaucccagcuacucgggaggccgaggcaagagaaucaccuaaaccuggaaggcggagguugcagugagccgagaucacaccacugcacuucaggcugggcagcagagcgagacuccaucucaaaaaaaaaaaaaaaaggaagagguaaaaggcaaggcagcauuuaauaaguaccuguuguauccuuuuaaguguuuguugugguaauccucacaaagaccgggacugauggaaacuccuugcuauuaaacuuuuuuucuugaggaauuuugcuuuucaagugcauauacacuauuaauauuuuuuacccaagagagcauucuaagcuaauuuaugcagugugacuguauuaagcauuaagcuuccuucagagcuggccuaucggagaugcuacugcccucucuacagaugugucugaaaugccugcccaaggauggcccuuagccaguuaacagcuuuauagcccauccucauugcuuacugccaccccucagcugggguccaaggcaguacuauucaguuuauucaccagaccugccuccagacaucuacuucuuucaaaaauuaguguuuuccaucaaggagcauguuccagagcauuucccagagaugucccaaagaacacuguccggugcuguggcguacaguggcaacagcauuagacuaaguggaacaucccagcaggcugcuuuagaauccgcucauuugacuagauacgauguaauuggcugucuuuaaaaaacgcgcacacacacacaaucugauaggcauaucucaugcccauucaauauggaauguucuucgcuugcugaauuuaagccuguauuuuaagguuuugugguuccucggccacaaugggugaugucacugauagaacgaagcugaguuuccaaggguuuggggcugugcaagaguaaacacuagagcuugaguuguuauccagcuggcaagcacggaagucuuugaagaauguaauguaaaaagggaaaagaauguaaagcuuuuuguaccaaaugagaguuggagcccagccaacaaaugcuuuucccuguguaaaagucucucuggaagggacauuccaucuccauggugcacucugaggggcacugucaacuagagauuggccccauccaggugggaggaaccccuuugggauggugaguauccaaucugcugugcauuugacaggaucucugaauggcuagguaauggaucccaagcaggcucacaaauuuaaaugagggcuuugugugcagaaagaggaauaaguacagauuauuuuccuaccacuagauuuuuggggagagucaccauggaauguugacaauuacuuaaaauauuuuaagcucccuugcugaauuccuguccugucccugaggaaucagauggucauacagccauaggcacccacccgaaauuucccuaggaguuggaguaaugcuagaauugaagaccuucugaguaaagggcuucucugccuucucagaggcaggagaauuugcacugguuguguuaaauguauaaaaagcuauauguucaccaguuuacucauuuccaauguguagaugaauaaaauguaguguacaaauuauuugaaaaucccagaaggaagguacuuuucaaauacaguauuuuuuuuaacaaauaaacuuacgauuuuuacagcacuguuuuugccaagag

SEQ ID NO: 14696 - RNA, 6907 nt, Homo sapiens
cucuuggcaaaaacagugcuguaaaaaucguaaguuuauuuguuaaaaaaaauacuguauuugaaaaguaccuuccuucugggauuuucaaauaauuuguacacuacauuuuauucaucuacacauuggaaaugaguaaacuggugaacauauagcuuuuuauacauuuaacacaaccagugcaaauucuccugccucugagaaggcagagaagcccuuuacucagaaggucuucaauucuagcauuacuccaacuccuagggaaauuucgggugggugccuauggcuguaugaccaucugauuccucagggacaggacaggaauucagcaagggagcuuaaaauauuuuaaguaauugucaacauuccauggugacucuccccaaaaaucuagugguaggaaaauaaucuguacuuauuccucuuucugcacacaaagcccucauuuaaauuugugagccugcuugggauccauuaccuagccauucagagauccugucaaaugcacagcagauuggauacucaccaucccaaagggguuccucccaccuggauggggccaaucucuaguugacagugccccucagagugcaccauggagauggaaugucccuuccagagagacuuuuacacagggaaaagcauuuguuggcugggcuccaacucucauuugguacaaaaagcuuuacauucuuuucccuuuuuacauuacauucuucaaagacuuccgugcuugccagcuggauaacaacucaagcucuaguguuuacucuugcacagccccaaacccuuggaaacucagcuucguucuaucagugacaucacccauuguggccgaggaaccacaaaaccuuaaaauacaggcuuaaauucagcaagcgaagaacauuccauauugaaugggcaugagauaugccuaucagauugugugugugugcgcguuuuuuaaagacagccaauuacaucguaucuagucaaaugagcggauucuaaagcagccugcugggauguuccacuuagucuaaugcuguugccacuguacgccacagcaccggacaguguucuuugggacaucucugggaaaugcucuggaacaugcuccuugauggaaaacacuaauuuuugaaagaaguagaugucuggaggcaggucuggugaauaaacugaauaguacugccuuggaccccagcugagggguggcaguaagcaaugaggaugggcuauaaagcuguuaacuggcuaagggccauccuugggcaggcauuucagacacaucuguagagagggcaguagcaucuccgauaggccagcucugaaggaagcuuaaugcuuaauacagucacacugcauaaauuagcuuagaaugcucucuuggguaaaaaauauuaauaguguauaugcacuugaaaagcaaaauuccucaagaaaaaaaguuuaauagcaaggaguuuccaucagucccggucuuugugaggauuaccacaacaaacacuuaaaaggauacaacagguacuuauuaaaugcugccuugccuuuuaccucuuccuuuuuuuuuuuuuuuugagauggagucucgcucugcugcccagccugaagugcaguggugugaucucggcucacugcaaccuccgccuuccagguuuaggugauucucuugccucggccucccgaguagcugggauggacuacaggcacaugucaccaugcccagcuaauuuuuuguauuuuuaguagagacgggguuucuguguuagccaggacggucuggaucuccugauuucaugauccgcccgccucggccucccuaccucuuccuuuacuuaauaagaaugcggucuaaauuuucaggugccaagcccccaaacuccucuucuagccuucugaauuguguaauaaaaccaggaaacaggugauccagcugugcgaaaacagaccucaaauguauuuccagacuaaaaagccagacuugcagugaaauccuauguuccaagucaucagaucaguuuaaggacuagaagacuagaaugacugacugguucucugaccaggaagaacagggguggaguuugggagagccuucuugacccaggaggcuuuggaggguaguuaacauuagaagucaaaaggcacuucuagcccagcugccuaaguagaggacaaagacuuucuccuuucaaaggagaacugagcccaggauugguaaguuuaaggcacuuaaccuugaccagcucuguaggucuggagcauucuggucccuggccgcuuucaccaccaggcccuucucacuuauccaccucacuuacugccccagcauuccuuuggcauugcgagcugugacuugacacauuuuaaugacaagauugaaguagcuaccuugcaggauagauuuucugggguauaggggacaaaccaacagugccaucaggugucuuaacacccggauguggagaaaccccuggggcaagggccuaugguuucaggaaaucucaguucucaaaggcuuaaagccauauuucaaggcacugagguuaggcugauaugcuggaaaacaagugccuuggaacuuccguacuggagggggaggaugucuuguggaauucagacguaagccuaacccugcauuagaaaaaauguucaccggguuagagcagugguauuccuggggaucuuuaugcuaaggaucugaguuacauacuccugggagguaggagagaaggccucauuucauucccucuggcgugcugucaaucaggcaauuauugcuaauauugacuuucccuuuguagguauguucagaacuguuaagucacaacuggagaguaaguucccacuuguuuauaauucccuuuuagucugagcagaggacagucuguucacggcuaggaaucaaguugaaaguuggaauucuguagcccuggccgaggcagguuuugcuguaagaaaucuuuucaguuuagcaccaacaucuuccuagguuuccugucuagacagugcaaagcaguggaacaugcgagaaacgaaaaagccauggaaagggagggagacaugcuugcaaauaggccucaaaaauggaggucucccacuuuauugguaucagaauuacuuggagaguuuuuuagaaggguagauccccaggccccgcccccaccuccaaaguccugagcagcuggagguacacagucauuuggagggggaggaaaacugauggauucuaccugaggcaaaaagaugagggaaaggaacaaagaaaaagggcugaaaaaaggucuauaaacacauggguggaaaugagcaaaagcacagaagaaacauaaaauaacaaacguggcucauggagcugaguggaacagcagcagccaggcauaugaccucggugagaaagcaccauguugcacgaggcuucauaaauucugguucucccuggagucucugcuucuagaacacauuagccacacaaaauccucaaaaaaaaaaaaaaaaaaaaaaaaaaaagaauuccagaauaucaggcugggcaaaugggucaacauauaagaaagaaugacugcaaggcaggccagguguaguccugcaacacccuauggaugcagcagcucugggggucucaagaucagacaaacugguccugguacccccacacuaaauucccugggcagaauucuuccgagugcagugaauccagccuggagagaacgccuucaacauggucaguguuggcucuggcgcuuugcaaucuccuccuggauacgcaacuugagggcuucucgcauggguggauccagaggcgugugugccgacaccuucucacucaccuuuccugggucaucacccuacguggaggaagagucagaaggcucagggccuggccucuuccagaaaggugaccugcccugucccuaaacacucucacagaacuccauuuagcucaaggcuuuuugccagcaccugucauuuccuaugugucuccuguaauagugauucuccacugggggccaagagcccucccuguuccccuacugagaaucacugugagaugggagugaguugugcucaaaagcacugcccggcaggccuagacucacauguggagcagacgcuucccauuggggguccugaggaaaacagggcucagggucugacaaugauuacuaccauggcccaggaccuucaggcugcagcuguuuccaccaggcguaccugauagacgauaacugaugugaccucuccacugucugccucguauucuaagcagaagagcugauggccagaaggcuccagcucagagccuccacuacugcugcuuucaccggacucuucauagucuggguugcgugggugggcagagacaucuggaaggaugaaccacaguaagaaagaagagggggggugcugcugaaggcccuguccauagagaugcugcaggaaaauauacgguuaggaaagccccagucuucuuuuuuuugagacgaagucucacucugucgcccaggcuggagugcaguggugcaaucucggcucacugcaacuuccgcucccagguucaagcgauucuccugccucagccucccgaguagcugggauuacaggcaagugccaccacauccagcuaauuuucauauuuuuaguagagaugggguuuuaccauguuggccaggcuggucucaaacuccugaccucaggugauccacccaccuuggccucccaaagugcugggauuacaggcgugagccacugcacccagcugccccaaucuucuuauggguccaguguaagugguuuuuuuuuuuuuuuuuuugagacggagucuugcucuguugcccaggcuggagugcaguggcuaaaucucggcucaccgcaaccucugccucccagguucaagcaauucuccuuccucagccucccaaguagcugggauuacagccgccugccaucaugccuggcuaauuuuuguauuuuuaguagagaugggguuucaccauguuguccagguuaauuucgaacuccuggccucaagggauccgcccaccucggccucccaaacugcuaggaucacaggcaugaaucaccgcgcccggaccaguguaagcauuuggugugcugccaaucaaggacuuauuuaccuuugcaucccugcucugaggccagcacaauccugucacacaguagguacacaaugcacauuugucuagcaaaaaguacuggaaagcagaaggguggauagagcucugccuggguucaaauccaggcucugccauuuacuagcugagaucuugggcaaguuguuuaaccucucugugccuguuuccugacugugaaacagacagaagcuuucuuaugagguuguauaaagacucaaugaauuaauauacguaagaucuaaaagcacuuucacuaaugccuaacaaagguaguggcacacaccuauaaucccagcacuuugggaggccgaugcgggcagaucaccugagcucaggaguucgagaucagccuggacaacguggagaaaccccuucucucucucucuuuuuuuuuuuuuuuugagaccgagucuugcuguguugcccaggcuggagugcaguggcgcgaucucggcucacugcaagcuccgccucccggguucacgccauucuccugccucagccucccgaguagcugggacuacaggcgcccaccaccacgcccggcuaauuuuuuguauuuuuaguagagacggggguuucaccauguuagccaggauggucucgaucuccugaccucgugauccgcccgccucggccucccaaagugcugggauuacaggcgagagccaccgcgcccagccggggaaaccccuucucuacaagaaauaccaaaauuaaccggugugguggcacacgccuguggucccagguacucgggaggcuaaggcugcaguaagcccagaucgcaccauugcacuccagccugggcgacagagaccuagucucaaaaauaaaauaaaaacauuuuaaaaaaaguaauaaugcuuaacaaaaauugaccgucauauauuaaccagugugaucucuagguagcagagaagcuggggaaaggccauuuacuggguucauuccgcaauuaugugcuggucgcucaucgcugugccagacuuucucuuugcuagguagcggagcaccuuacuaaaauacagcacgguggggcaaaccggcagauaaacuucuugcuggcuccccgauacucugacagcgaugcuuaacugggggcuuaugagucgucccaguucuuggugagaaucauucagcggagauuugggagcgcugagguggagguuccggaaagagacgagaugagcugaaccuuaggaguaagaagugguuuuucccuauagagaaggggagugcguugcaggaagagcgcgcgggcuggaggcaggcggggcgggcggccucaccucggugucgcggcagguacaccugcaggucuggcuugcggggccgcgucggcgcgggcgugugccgccuccucaccuucuccuuggccgccugcuucaccuucuugucauagucgucccugcggggagccgagcgggagucagggacugucgggccgggccaggccaggccaggagugguggcggcggcggcgcagggcggggcgguaccgagcgaucugguuccgucggauauggugcacgaagccgugguucauguccagccgccccccaggcuugcagcagugccccggccggggaugcggccccgccuccaucaggagccggggacgcagagucgccgccgccucgacggccccaacaacagccacccgcccacagagcuccgcgccgccccuugcucagcuuccggccccgcauccugacuuccggucugggaggccccggccuggccaagcgaugcagcgcacggaguuu

SEQ ID NO: 14697 - RNA, 4624 nt, Homo sapiens
uacuuuaaguuuaagcucuuguuugggaagccacugggaggacagugaagaaugcccgccuaccuggggaaaccugaguuagguguggcuggagcgacucgagaugcgaggugggcgggggcaggcugaaaguuggagcaagcaggaagugaacugagggccacccugggaggaagccgacuaggcgaauucacuuacugaccggccugggcugcucugagacauggugagccaacugggaacuaggaaagggcugguuuaaagaggagccagagggggcuugggacuggggguuggcugugucgggggaggagaguugguggcaaaguuagagggcugggccagugcugcuauggccucucuucuuugacaacuuggcugcaaauagcucugagcuguccuggcagguguuucuacuccuucucccucccuccccugaccucugugcugguggggagcugggcuuccgugccagcgccgaugggggcuccgaauuccaggcaaagaguuguugugccuuccuccuccagggagcccgaggcggguguugugacaccacaccaggcagcgccugggcaguucccaguucagauuccagcccagcggcagaagcucuccucuccggccuuucacuuuauccccacacagaaacacaaaggauuuguguguccacugaguccuuuggguguccuuucuccauuaacauggagaagagaacuaaagguuuauaagagaaccagaaguugguucucugugauaauguaguucugacccaugccacuggccuauuuuuggaggucaagcggggaggagcuaaauacuauuuuucucuccuuguucaaaaaccuugucaugaagccuccgagaugagacaucagccagggaggacuaguccuccauuucccccaacacccaggcggguauuuuuauuuaauaucugcauaagcaggcgguugcuuggugccugcacgugucgcccagugguggggaaagcagaaguguguggcucaacggcuccaggcgccuucugggauacuugguugccuguuguucugggucacagcaauggcauugcggccagggccgugcuccggcagcuggcuuagagggacagauggguggggcugggugaggguguucugcuggccagcacagacacuuucaaccagggucccaagaaaucaggaaagggggguggcucugggaauuguaaauaguggcgggcucugcucuggaagggaacauugugagaugcuggcccugcuguauucuacggcccucucuagggagcaaggaagcaguggggagggauuuagugaugugcugcuuuuccuugucaggggcccuaauaaccccaaaagaaguuugaucuagucuguucagcaucacaucucaccuucuggggcuuacaaaugcauuuauuuuugauuacagaaguaauacaugaaaacauucucuuuguaaacauuucaagcauuuuacaaaaagcuuaagucugccugaggccuuacccuccccagaucucugagcccaagucuccaguucccccaccacuuggucuaauuaaccccguguugccgcacaggaggaagccagugaagguggaggaaaugaucgugugcggaaccugcaaagugagguggagggaguuaagaauauuaugacccagaauguggagcggauccuggcccggggggaaaacuuggaacaucuccgcaacaagacagaggaucuggaagccacagugagacagggagcccacugggggcuggaggaaaacagggagggagggaauuucuuuuugguggggcaaaauggacaggagggccagaaguuugacauuucuguugccuuucaccugguuugggagcugaugugagcugagucuccacuucugaaucugcucugcuccacagauuguuauggaucccagggaauggaucccaugacuggggcuugagguggcagcucgcccauagaggcauguucugagaccgaaagcucagucagcccaugcauucucaggcuucucucccgggaaacuuguuuucccuuugaagccugcccaugacaaucaucugggucugaccuucccagggcagaaauauuggcucugaggaaacccccgcuguggccucuagccuucucuaggagcuguuagacaaggggugggaaauugcuggcgucuugcugaguaggcuuuaaaaagaagggggaaagagcagugaaaugcuuugaucccaggguccccugcuagaugaaggcuaaaauaauaucucccacacaucuugcuagaccucauucuucucucucuccagccaggggcugaggccagcuguuucagggaggaaguaacuccaaaguugagcaaagucuggagccucaaguucuguguucagcggggaggcuggcucuggcuuucugaguccugugugaacucuuggcucuuggguauugcucccuugucucccuggggcucauugccuguuucuguagcuuaauuguagcuuaauuuggggagcauggccccgggaauuuuuuuuuuuuuuuuagacagagccucacucuguugcccagguuagagugagugcaaucuuggcucacugcaaacuucaccuccuggguucaaacgauucucgugccucagccuccugaguagcugggauuacagugugcacccccacaccuggcuaauuuuuuguauuuuuaguagagacgaaguuuugccuuguuggccaggguggucuugaccuccugaccucaggugauccaccugccuuggccucucaaagugcugggauuacagacuugagccaccaugucuggacaagccccaggaaauuuagugucuauaacuugaauugcugggcauggggaagaguggguggaggaggaggaguucccuuacuuccaacccucuauccuguccuggucccuccuccagccucagcagucccgauggggcaaggaguccuggagcugcgagaugugcccaccuggagccugcaccccucagucccagggucugcccucccaagggcagauuuugcugccaguguuguacccuuggguguaagcaggugucgaggaccccucagugugcagggguaagaagagaaaggggaccccuagucauaucuagguggagaccuccuaggauccugagaauucuaaauuucaacccggccuuccagauuuuuaggaagguacauuugucaagguaggcagauacagcauuuuuuuuuuuuuuuuuuuuuuuuugagauggagucuugcuuuguuacccaggcuggagugcaauggcgcaaucucggcucacugcaaccuccgccucccagguucaagugauucuccugccuuagccuccuaaguagcugggauuacaggcgucugccaccacacccggcuaauuuucuuguauuuuuaguagagaggggguuucacaauguuggcuaggcuggucgcgaacuacugaccucaggugauccaccaaccucggccucccaaagugcugggauuacaggcgugaaccaccgcacccggccagagcaucuuuuauuuagcaguuuguuaccucagcuuacagugucaguauuaagauguauggcuugagcugaacgugguggcaugugccuguagucccagcacuagggaggcugaggugggaggauugcuugagcccuggagauggaagcugcagugagcugagauugugccacugcacuccagccugggugacacagccagacacugucucaaaaaacaaacaaacaaggccaggcgugguggcuuacgccuguaaucccagcacuuugggaggccaaggcgaguggaucaccugaggucaggaguucaagaccagccuggccaacauggugaaaccuccucucuacuaaaaauacaaaaguuagcugggcgugguggugggcaccuguaaucccagcuacucaguaggcugaggcaggagaaucaauugaacccaggagguggaggcagcagugagccaagaucgagccacugccugagugacagagcgagacuccaucucaaaaaaaaaaaaaaaguauggccugugggcugcacuuguacucuuauaaucuuguuccagugggaggagccacugggucacucacucugccuuuuccccaacagucugagcacuucaagacgacaucgcagaagguggcucgaaaauucugguggaagaacgugaagaugauuguccuuaucugcgugauuguuuuuaucaucauccucuucauugugcucuuugccacuggugccuucucuuaaguaacagggaaccucucccaccugcccuucucuucagggacaacccuccauaaaugugugccaagagggucuccuuuccugucuuccucuacagagaaugcugcucgguccuccuaccccucuucccgaggcccugcugccauguuguaugccccagaagguaccuuggucccccggaaggagagaaaaaagagagauggacuguggcugcauuucuuggguccuuagagugggcuggagagaccuagagggcccagcauguggcugggaaacuguugguggccaguggguaauaaagaccuuucaguaucccuauaugugugaggcacuu

SEQ ID NO: 14698 - RNA, 13669 nt, Homo sapiens
ccguccuucccuggagcagcuggcccaggaggugacuuaugcaaacuugagacccuuugaggcaguuggagaacugaaucccucaaacacggauucuucacauucuaauccuccugagucaaauccugauccuguccacucagaguucugaagggggccagauguugggugcagauguagaagcagccagucacagacccauucuaugcaauggacauuuauuugaaaaaaauucucaaaaguuuuuuuuuuuuuuuugggggggcgggguucuaaagcuguuuuuaacuccgagauuacaacuuagaggaaccaaggaaauaaagcaaauaagauuuaacaacccaagauuaagaggccaggaagagguuagacgcaaugugaaacuguccuccuaggauaagguuuaaaguggcuuuuugggggcugggugccguggcucacgccuguaaucccagcauuuugggaggcugaggugggcagaucacuugaggccaggaguucgagaccagccuggccaacauggcaaaaccccuucucuacuaaaaauacaaaaauuagccagacgugguggugggugccuguaauccaacuacccaggaggcugaggcaugagaaucgcuugggcccaggagguggagguugcagugagccgagaucgagccacugcacuccugggcaacagagcaagacuucgucucaaaauaaauaaauaaaguggcucuuggggaaaagcaauuuaauguaccacgaugaauagcuaacuguucccaaguguuugcuaugugcaacacaccgcgugagcaguguuaccugcauuauuacauuaggcugagagguaaaauaauuugcccgaagacauacagcuagugacgaauggacugaugguuugaacuuaacgucuauuugacuuaagguccugcacccugccacuuguaauuuucagaaucacugauaaucugaaauaaugcagcuuaaaacauguuuucuuaauuaaaaguauaauuggaugguggucagguuguaaaugcacacaaaguaauuuaucuucauugcaauuuugguuccuucuuuguuccuauuaucuauauacacccaguguuucacuagcaguuaugagagcagucagaauagcagcaucaaaguuaaauaaggaaaucuagaugauugcuagauuuucucuaaaaauaagcuuaguauuugguauuauucuagccuuuggugagcagaaggggagguaaaguaagaauuaacuaaauuuaguaagggauuagggaaugcuuagacauuuuguagguugggguauacaaggguaacucaggaagcuccucaguucagugaaaauucaaaggguuggcacugagcuaggaagcgagaaugcaggguuaugaaaaaggaucccugcuuugggagcucauggacuuguagcagagaccgguaguaaauuggcagucucaguaacuucuguaaaugauugcaucucuuugcaggcuucucuucccauacucucccccacuccuccuuggacaguguuccggggguucuuuccuaagcaacugcuuuuucaguauacauacuucagaugauugugucuacuccaggauuuccaacgaugcuagguuucuuuccugugcccuagacguauaggucuaaguuccaccuggauaucccacagggcuaucaagcucaguucauccuaaacagaacuuacauucauccccaacucagacuuccuuauucuuuauuauugaauggcagcucuguaccuuagccaagcuguuaucucuaggucaucagccuugacucuuccuuuuuccuugcauuucuuaaaauugccaagucccaucaauuuuaccuccuggauaccucuugaaucuauuuuuuuuuaaagacaggguuucacucuaucacccaggcuggaguucaguggcacaaucuuggcuuacugcagccaccaccuccuggguuuaaacgauucuuccacuucagccucccauguagcugggacuacaggugcccaccaccacgcccaacuaauuuuuguauuuuuaguagagacaugguuucccacauuggccaggcuggucucaaacucaugaccuuaaguauccaccugccuuggccucccaaagggcugggauuacaggugugagccaccgugcccagccaaaucuguuuucauuacuaccuauaucuguauuuucaaccuuuguauuagcaucuaguuagggauagaccaggacagggccgacauguuaguugucaagcagauugccacccucccccaccacugaggaggccaaauggaguuugguggaaaaucucuaauucauucaagguauuauaugggcaagcaauggcuguggcacaggguccccugauuacuuuguaagaaugggugggagggaugcugauuuucaauccuuuugcagaucuucucucauaguaacacaauagaagauacuuugccacuauguuguuugccaaacucacuguaccuacuugacugguaacaaaagucccaagaguuacuugggagaagacacuugaaaaaguauuuuucuaaauaugggcaaggaugcugcccuuccccaaacuguuaguauaccaccucucugaccaauuuucccaaggaagauauugggguagggugagguguaaagaaaaaguggucauguaaauacugguaauaaaagcuguucagugggguagaguuggguugcaacuguagccauucuaaaaaugggcuaucaauguccuuuuagccaaaagacuuuaguauacauccuccucauucuacccucaggauuuggaucuuugccccugauggguauccauccccuuugaaacuuuagaaaggcagguuauauacagaauguucaaccuaaagacauuuccuuaagucauacuuucaugcuuucuaaacuauaaucacccuuaucauccccugcuguuaugcuuucccucugcucccuguggccuaauguuccuccaccaccuuauuaaccuucaggauacuuuuccccuaggcugggcaggacaacacuauccccuugguccacaagcucccucaagguuggggaaucuuuguuuacuuagcaaauacugaacauaaccuuaaagcgguuacuuuugaaaacuucucaugcuauucuaccaacuuggaggcaccuauccaugcucauuccccuaauguagccaauaugguuaucugcaauguauuggcaucuaaaaacucccuuaugaaacugccagacuuguucuggaacauuucaauuacaugcaaaauucagguucucaaguuggaacaagucuaauugacacaccugcauagguuuuaaccuugcccucccccuacuucccaacagauuuccaaguuuuuugagaaggaaccuugcucuggcccaggcuggagugcaauggcgccaucucggcucacugcaaccucugccuccuggguucaagugauucuccagccuccugaguagcugggauuacaagcaccugccaccacacccagcuuuuuuguauuuuugguagagacgggguuucaguuugccaggcugguaucaaaccgugaccucaggugauccacccgcauuagccucccaaagugcugggauuacagguguaagcuaccauacccagauuuccacggcuuuuuuuuuaagucucacucuguuacccuggccggagugugguggcacgauuucagcucacugcaagcuccaccucccggguucacgccauucuccugccucggccuccugaguagcugggacuacaggugccuggcuaacuuuuuuauauuuuuaguagagacaggguuucacuguguuagccaggauggucucgugaucugcaugccuuggccucccaaagugcuaggauuauaggcucacgccuauauuacuauauaguggccuauauuacaggccacuccgccuggccuccaaauuuccaaguuuuuaagucuccaugcaaacaggcauaagcaagcacuccuuggcucuacauuugcaggacaagcuggaccaccauucagauguugguagaaauguaauccaaguggcuauucucuaugcauguagcuccuagguucaagagcaguguggucugcggauuuucuacacaaccugccauaaaugaaauuuaagccuuuggaaauuuauagcauuuucagcuaauuugcauuauuuaucucugcaagauauugacuagaaaucacguuucagaacuucucagaugaaaacaucauacaacccuuaaaacuaagcucauaauuuaaaaauguaugcagauuaauaggcuuaaauugccaggacuuuagauagacauuaccacuuccagguuaauacuuuuagcgguuuuuaugccuucaaugguuugaagcccucaaccuuaguugaaaacuuaaaaauggcauugaauggcugcugcaauaaggacacaugaauuuuggcuuaaguggacuaggaggacuaaaucuugcuuaggcuuuuaaaaaaugcccacccacugggucuagggauugagguuauuuuccugaauuauggcuaauuauggauuacaauucaagguuaaagauacacauauaguauucucagguuauucauaugauagcauuuuuuaagagccaaagucucagucacccaggcuggagugcaguggcuugauaaugguucgcuacagccuccaacuucuauguuaaagugauccuccuaccucagccuuucaaaguguugggauuauaggcacguaccuauggccccaaagcacuuuaacaaaugaguaacagacacaguuaagguagaaccuagcauuuuauuuagaucuucauuaaacuguuggaauugagaaccagacauacguaauaaaccuccaaaaauagauccugaaaggcacuuucugcuuagggcaagcagucauggaauaagcauguaaacaagcuggcuucucuguaccacaccagccaagucagcuuucuccauggccagccgcaccagcucugcccucccuucuguuaacaccagccagacccccuguaggucuaacccaagguuuuucuguaggacaccuuggccuaccugggaaugcuggaaacauguuguuaaaggaaucaugguguugagagaaaaaaaaaaaaucuuuuaaaagcugccaucugaggugauggcuucucuguacuuacgccauaccccagaauacaauaaauaagcaauuagaaaacguucaaguaugaagggauuuccuccuccccgccaaaagcacugcucucugaaggaagcugguuucucuguagcuacaccagcuguucagaaagcucauuggaccugguuuugaaaauaaaacaaaguuaaaacccugggaggaguuauugugcaguguggaguacucaggcuuucuuauaaagaaaaaaaaaaguuaucugguaccaaagugugcaaccuacagacccucagguacugcccugugacuucucuguaugacaucacaaggcugccaagugccuguuuuucuagaacuaggaguuggugagguuuggcuagugcugaaaccaugcauaggauugguuuacuaaauuaaaaccuuauuacguacguccuccaaaagacagcugaaaguggagagauuuugauuuggugcuguuagagguggcaauuaagagcauaagcaccagggagaugguuuaaugguaacugccuuuuuugaugucaggcuggagcuccaacugggaacuugcguuacaugcaagauugauuggauagggaacacucccugacaaagagcuacauaauuagaaauggaucaaguuacagggaggauaaggggaaggcuucacauucauaauagagcucaagacauuacaaauucaugcugacagggcuguggcauugccagacagaggcuauaaguggaacuacaaguacuuuacgugcacaucacaaggacauuuucagcaucugguggggaaagucaaugcaauuaugacuuuggagcguugggugauagggcacaaagguucaauuucaaagcauuauuuacuacaguguuguuucuaggcaguuacauggaucaccuaugcucacuaaauucauuauaauggugaacaaaacaccuagggacagaauagcaagcccaacuuacagucccccacaaaagcuaaaauucaugucauugacuagagugacugcaacuggucaggagcugaaagaggacaggaaaauuuaggaaggagggcccuuucccucagagcuugaaggcuucucuguagccuacgccaacaagucuggggaaaaaaggcuaacacuuucaauauuuaagcuuuuugggcacuucccaugggaagcugucccuaccaaaguggccauaggcugcaguccucugauaaauuggcuucuucagauccagaucccuggaauauacaaguccguaacuuaauauguagcauuaaauuaaaauaaagcaaaacaaucagcaagacucauuuucaagagcucuggcaaaugaguucucugggauaugcuaggaaaaaaauuuguggcaaaaguguuacuucccugguguccaaacuccuugcacaguccuuauuaguaacuauaguuguuuuuccgucccuggcucaacaaauacgaaaacuugucauuauucugagaaauuucaauugucaaaaagcucaccugagaucacacaauacuuaccaaggucccgccgcccacacccuaccaugguuuuuacauugcaacaaaccuugagcaacccacuuuaucucuauuuucuuaacacccuuaaguagaagagcacaaagcucaaauaucaaaucuggaacauucucuagagugguuagccuaagccauggagcaccguaauuuuaaauuucucaaauaacuaagucuucacuaaggcagcaguucaaaacuguuccaggaauuaaaauauauucccauuugaggagucuuccuucacaccuucaccuccucagccuuaaguauauacacacacacccaacacccucaauacuugacuagcaacaggcuuuaccaucuuuaccugacaaugaccccagggcggagaucgaaauucuucuucacaaucucuaauagcucucucucacucuucugagagguaccauaauggaaaauggagauagauaauggaugagaaacuccaauagcauaagagaccuaaaaggauucaaaugucguaagaaucagugauugcaaagacccauauacuuguauaauacguugguauaaaacaaguaguuaaguagauuacuacuaaauacccucccacuuacaugacuuuuaaucguucguuauauaaagaguguauaccugaacaagaacccuccggcacagaccuccuuuaacaagggauuuugccacccaacgagcagcauaagcagcugaacggucgaccuugguauaauccuuuccugaaaaggcaccuccuccaugagcaccccaaccgccauaaguguccacaaugauuuugcguccagucaaaccagcaucacccugaaauuacaggauuuaaguuacuuuacgccuagugcuuuccaaguggauuagguugccuauucugaauucauucagcaaauauccuccgaugauucacauguagguuucagaaagccugaaaaaaauguaguagccaaaauuuuaaguaaccaucaaaaauccagaaaaaugcaacaaaaugacauuaccugaggcccaccaauaacaaaucugccacuuggcuguaggugguagauuguauccucaucaagguauuucgcaggcacaacugcuuugaugacuuucuccuuuagggcaucccucauuucaucaagacaaaccucuucaucaugcugaacagauauaacaauuguguggacucugaugggaagcacagcaccucgauccugcauauacugcacaguaaccuugaaggcaacacaggucaucagaacaucacaccaaacaauaacuuuguauuuguuucucuaccugaaguuacaauauaggaaaacaaaugcuauuuuuuccaguuagcuauuaucaaaauuauggaucuucugugcugauguaauaaaugagacaaccaagcuuuaugaucaucacuuacuugaguuuuagaaucagggcguaaccaaggcaaagugccauuacggcguaguucugccaguuuggcauuuagcuugugugccaagacaaugguuaaaggcauacacuccucaguuucaucaguggcauagccaaacauuaagcccuaaagaaagaaaagucaccaaugugaucaagcuccagaauuuaauguuagaagagauuaaaacagccucuacaccaagauaccuggucuccagcaccaaugucuucuucauuucugucaagaugaacaccuugagcaauaucuggugacuguugcuccaaggcuaccagcacguuacaagucuuguagucaaaaccuauaagcaaaaaacacaacaucuuguuuacguccuagaaauaccugcuguuuacagcaauuaucuggaauucuaaacacugcugaagaaaucaaauauaccuaaaccaucggaccuuuuagagaaugaacagaauagggcuuaguguauaguaagauacaacuggaguuuaggauuagcaggaacauucuaggaguuucuucaaaccucacagcuguuaccuagaaaaaaaugagcaaaaucauuaaaacacaccuuuggaagaaucaucauauccaauguguuuaacagcuucacgaaccacuuucugguagucaacagcagcucuggauguaauuuccccagcaagaaggaucauuccaguuuuagcaacaguuucuaauaaaaagagacauucaacucaaacaucacuucuauaaaaauaauuuuuaugcuaucuuuccaccaguugauaagcacauucugaaccuaccacaagcuacuuuggcaucaggauccugcugaaggugggcaucaaggacagcaucacugauuuggucacaaaucuuaucuggaaaagagaaauuccuggcucaguuucuuuaacuuuaaacaaaguauguauguauguaugcaagcucccucccuguuacuaucuguaaaaucuuuggagauuuuaaaaaacaugcuuaauacaucuuaauucauuguguuugcacuuuccuccuaaaauucaaaguuugcauuauaaaucuaaucaccagaaaggugaacuguuaguccuauauccuuuaaagaacagaauuugcccuauaucauauucacuuccacaacuguaccaaaccccucugcaccugggagucugguagaacugaggccacagguaggccaguuucccuaaucuuaaggaacaccaauuauaaugagcaacaagauaauucgauuaaacaauuaaaugaaaagcauuuucugacuaaaauggcaauuaucugauuuugcuguuaggaguugcgcaggaaacaaaagcucaacaguguagaagaugcucaaacguauuccgaauccaugucucccugcuuugucaucuauuguuaggagggagaacaaauaucucccuaauucaaguucguuuuucugaauuuucuauaaccgccuaaaacagaauccaaacauaauguggaagccagacugcaggcucugaacuucggucuacuacuaacugguguaacagcuaaccuucagcacucaucaagauccuggguuuguccucucauaccacuaaguuacuugugggauuucaucaugggcacaguaaacugaccagacccuaaagccaccagauagauaacuacugcggucauccuaagggcagaaacagccaaaagagccaaauaaucaucuuuacuagccgauaugcucaggcugagauuuucaguuccuggaaauauagcuuuacuccuccuucacgugccaauugauccccauaauggcgguugagcggacaaagccucaaguaaaacccugcaccgaagacuuuaaaugcgaacccaaagcaauggcagcuccuaauucaugcuucccauccuuuucacaagggguccaaauaaggacugccuucuuggacaugagcuauauuuagucagaggccgucaccuuggaggcaaggccauauccgccgaagggcaugugcguauucuccaguguguagucaagaccuaaccacugaggcaguggagccagacgacgucccaaggcauaggccccccaccccucaaacugagggccaggacagccggggaggcucacggcucccccucgcccagauaccacaugcggcaaacacguggucgccgcugcaaugcggggcgcgcgcucccgagggccggacgcgagcacgcggggcgggucgcccacuccagguuugucagacggcagggccgggagggguuaacagugcccucccuucccggccagaacucacuagcgaccacagcccccgcccuucacguuuucuggaaccuuccgcaugccuaggcgcgcgaccgaaugaaaagggaggggggaagggaaggguggagaggggagggggaagaggagcggcggccacgcgccaggcccuggcggcgccacgaggaaagcgcgcggucgccgcucuuccaucacccggcggacgaggacgacccgcgcgggccccaccaccggccggccgcagccagccggaccuuggcgcugccuucugccccgccccacgcuucgcuucaggccguccccucaccuggguggccuuccccgaccgacucugaggugaaaaggaaugugcccuccucgaugaacgccucguggaagccguugagcuguccguucauguuggugucggugugcggaaguggccuuacgaaggagcagcggcgaggcggcagcggcugcgaaaugcgcaagcugcggacagcguucuacucguagcaggcgggcggcgcggagcgaacgaagcagcgggcggugcggcccgguauuuauagagcagcgcccgcgcgcgcccggcucgggccccgccccucggcgccgcgcgccaaugcaccacuugcgcgggggucgggggaggaagggcagcucgccccgcggaguccgggcugaaccacacugcgcggccgcgggaggugccguggcaauccggcccuccagagaccguucagcuaucuugagccgcuagagcuaggagaaaaaugcagacgcgaggagacgugggggauugcucuuccuuguuugaugugggagaaaaagcgacuggggcuugcuggacccgcuccccugugcggugacauggcaccucccuuccgaccguuggccgggauagcuuucccggaggucgcgucccccagcggaggcggcgggaaucgcggagguuuugugcugcggcuggggucuuucuggccgucccgccucuagaugccggguggcagggagccgguggcggucggccaugugaagguggccaucuuggccggccagcgagggcuccucacggccuuccuucggcgucccugcccggcucguugccggccccgggauaucugaggggcgcaggcccaccuucuagucguuuccuggugaauggcucugcugaagauggccggaaagcagauuaaugaaggugcugccaucgauuuaaacaaucgcccuccugcccgcuccccugcgcuaaaguuucugagggauccucacccuucgugguucguggacuuaaaaguggaggcagcgcuccagccuuucccuccagagagaaaggaggccgcucccaaguccguccuugccccguggccuuccuguuccuuugaagggggggggaaucgauguuucaauccucuguucaggagaauauggaacgaacauuucuuuuuuggugggugggggcuauucguucccuugaaugugcuuaagcagaucucuugacggcguggaaugggcuguuucaugaagcuuucacuuuaaaauguccaccugcguuugucccaguuuugcccaauaaaggaauuacagggaaaaagagcgaaacaaaacuugagccagcaaggaguauggagucccguuuggagggagcccgccuugggggcgggggucucugcagccuguucuggggcugggccucggugcaggucuggucgggcugguggccugguggcccugagcggagcgcgugacaagaacgccggguuuaaugagguucucagggaacggccugcuccuagcaugggauguacuuuacgcuggggaggugaaggagaccccuaguaacagucuccagcugccuacugcuggcggcaguagaacaaggugcauucccaagaacaauccucuccgucggugcaggaggaaaggugggauuugcuaaaggcucagugggaaacaaaggaagcacuugggcugugcugggggcauccacaaagaagauaaagggcuccuccccagacucagugaccacauccacggucgcucaaagcaggcagcaagaaaagguucgaccacaaaagagacaauaggugaugauauuuuuauucguugcuuuuuacuuuucaagcuaacccuucaugggaaaguaacuguauaagacuauuaaauuuuuuuguuauuuuuuaaaggagaaugccaauuuauuaacuuacaauguguaauaaaauugucaacuggaacaaaaugcguguguaggcuggucagugcauuaucucccagcagaaaaaucuauaugggaagccagaauauaacuagaagguuauuuuauuagggagucagaacaaggagcguaaagucaaugauuggcucauuaaauccugauaccccugugcuaccaacuccacaguggggcuaggccugccaaggagaugagauuuagcuguacauaguugcuuaccuacuucucucacuugugaauaguguguagguguaauacaguaagaguagggguuuggagucacgaccucucuaugcaucaguauccucguucuguaaaauuggaauauuaauaguacaucauaggauuguuucaaggauucaaauagugcaaguagagucuuuagcacaguaucuaguacauaauuuguuuuaauguaagcuguaaaaaaauuaacuauauuugcugugaauuacuuuucaguggcuuucaauugcugucgggauacggacuaaaaucucuacauacucaaggccccagugugauuuggcugcuacuucugcaaccuuaccuugugccacacucuccuuucuguguucuacuuggauuuuuuaguuaguagcaguuaauuuuauuaauuucauaguaucaaaacaaaggaggacacauuuucauuuauuuuauauuauucguauugucccuuccucccuuccacaaauauuuaugagcacaucugugagucagacccaggagcaaaugcuauaacaauccuggucucugcccacucggcgcucuaaauguggggagaugccuggcuaacuccuuauccuucucacuccagcucagcuaccacuuccuggaugaagccuucaucuacacagauuugucacaggggccuguguuuuauuucauggcacuaagugcaguuucaaauuauagauuuggugauuauuugaugaaugucuccaauucccaguuaggcuuguaagcuccaugauaaugagaaggugggcuguuuugcucaagcuuuguuacugaaugccuggcacacacaaggugcuuagaaauguuca

SEQ ID NO: 14699 - RNA, 1657 nt, Homo sapiens
agguuugucagacggcagggccgggagggguuaacagugcccucccuucccggccagaacucacuagcgaccacagcccccgcccuucacguuuucuggaaccuuccgcaugccuaggcgcgcgaccgaaugaaaagggaggggggaagggaaggguggagaggggagggggaagaggagcggcggccacgcgccaggcccuggcggcgccacgaggaaagcgcgcggucgccgcucuuccaucacccggcggacgaggacgacccgcgcgggccccaccaccggccggccgcagccagccggaccuuggcgcugccuucugccccgccccacgcuucgcuucaggccguccccucaccuggguggccuuccccgaccgacucugaggugaaaaggaaugugcccuccucgaugaacgccucguggaagccguugagcuguccguucauguuggugucggugugcggaaguggccuuacgaaggagcagcggcgaggcggcagcggcugcgaaaugcgcaagcugcggacagcguucuacucguagcaggcgggcggcgcggagcgaacgaagcagcgggcggugcggcccgguauuuauagagcagcgcccgcgcgcgcccggcucgggccccgccccucggcgccgcgcgccaaugcaccacuugcgcgggggucgggggaggaagggcagcucgccccgcggaguccgggcugaaccacacugcgcggccgcgggaggugccguggcaauccggcccuccagagaccguucagcuaucuugagccgcuagagcuaggagaaaaaugcagacgcgaggagacgugggggauugcucuuccuuguuugaugugggagaaaaagcgacuggggcuugcuggacccgcuccccugugcggugacauggcaccucccuuccgaccguuggccgggauagcuuucccggaggucgcgucccccagcggaggcggcgggaaucgcggagguuuugugcugcggcuggggucuuucuggccgucccgccucuagaugccggguggcagggagccgguggcggucggccaugugaagguggccaucuuggccggccagcgagggcuccucacggccuuccuucggcgucccugcccggcucguugccggccccgggauaucugaggggcgcaggcccaccuucuagucguuuccuggugaauggcucugcugaagauggccggaaagcagauuaaugaaggugcugccaucgauuuaaacaaucgcccuccugcccgcuccccugcgcuaaaguuucugagggauccucacccuucgugguucguggacuuaaaaguggaggcagcgcuccagccuuucccuccagagagaaaggaggccgcucccaaguccguccuugccccguggccuuccuguuccuuugaagggggggggaaucgauguuucaauccucuguucaggagaauauggaacgaacauuucuuuuuuggugggugggggcuauucguucccuugaaugugcuuaagcagaucucuugacggcguggaaugggcuguuucaugaagcuuucacuuuaaaauguccaccugcguuugucccaguuuugcccaauaaaggaauuacagggaaaaagagcgaaacaaaacuugagccagcaaggag

SEQ ID NO: 14700 - RNA, 12568 nt, Homo sapiens
aauggaaucaauaaauuuauuaauguuacauuaacacgaacuacaaagagaccuuucguaugucugauaccaaagacauaacugaaaagucauuuuuccaaaccuugagcuugcauucaccuaccugucuaacccucacaugugcuaauuaacugcaaaugccauuucugggcuucacacacauuccguggcuuucccuuuucugaugugacuucccucccuuaccccacaccucccugcacuguccccugcugugcccuuggcuggaaugcccugcagccugcuucagcccagcaaaguauucaucuuaccaguccaugcccugacuccugaugucacccuucccugcaucacccuucccuguguauuugguggauaaggcuugauugaggcucagguacugagucccugcuggcacauugagaaccagcugccaccccgaugauaaggaagacagacccgggacuuccauaugaauuggauaugaucaucugacaugcacccuacuaacugauggauccugcuguuaccccaaagcuccagaaccacacuggccagacacaggcauuuccuguccccugaagagccacugaacccagcacaaaagagaucuagagcucuccaaaccuauggaauggcaaccaaaaccacgcccagguuuugaguuaagccucauuagucucccuuuucccuugacaguguagaacugugcagcguagcacuaaaugaaugagagcagaagccucaggacagaacugaacccaccagguugagcugacaacacugccagggguucuauccacagauggaauauucgcuuugaucacugaguuaggaggcaugggugagggaugcagagcgccgcucgucaugagacaucaagcuauccaagucaauauccuauuaguagggauggcauguuauaaaaggcguaaagaucucaccugccccagcuggaagcagugauuccauugccccagauucggaauugugauuuaaacuaggccucucuucaggcaucagaaccaaauuagagugcuuuauacgugcaaggaacuaaugcagaaagacauuauggguaagucaagggagaugccccagccauugggcaaauuccucugacuccucccugauggaacuaauucuuuuucuucugugcccggauccuagaaucaagauucuuaaggucugaguacaaguuccgcuucaggauggcgcugcugcacagcagggcaccuugcagggccccgaccaguccacaggugaagauauccuggccuaggaggcaagagcagaggccccugagcgugcacccaggcaggcccaggggaggguggggccuuggugcucuucccuccacaugagggccacccagagcuggcuccaaucagacaggggccacagccugcccaggcagcccugcucaggggaugggaggcugcaggggacagcagggccugagggcaggaacagaggacguugggcgacaggggcccagggucucagguccugacaacauggggcagugaguauaccugucagauagagguuggggauggggcucugggcccucaaggaggccaucacacaagggugcaggcggcccaggucauggucagccccguagcaggcaccucggggagcagccagauagaacugguuggugaguggggauccugcagucacacucuccaccugagggcagaaaggguggggcaggcaugugagauccuggcuccccucccucuuccacucuuucccauucacugacugcagggaugggugcccuguccuucccuggggcucaugucuuggggccugauuccccugucucaaggaaagggcagaaacagcaccgugagguucgucaccaccccaaauacuuuacccccuaccuuccccuccagcugugggaacaguuucaggaccacugacauagaggcuuccacaaaggaguuuuugaaggucucauagucacugccccgcuuucccuucagcuccgccugccacuccucaaaccacucguaggcaguggguaugagcaugaucaugguggaccggccuggggaucagagcugauauuacuacugcccggccucucccuccacccccucacccgggacgugcagccccaccugggaaucgguccucccaggucggaucuuuggcugaugggaaagcgaagaagagaagagggauguguuccgcagccucuucccugggcauggagacguagcgcuccauccugcaugugacaagaguguggugggaucuccagguuuuuguccucaaaaccccagaaccacugcaaggacugcuuaucccuagggacuccccacaggggugaagcugagccacagccuuggcgugacaaacuuccaggagcaaauuagaaauugccuacuuccucccauuccauaaccucugcucauucucugagucaagcagggaggcacgggccacacacauacacacacacgugcaccuuacgccugguccauguccgugucauaguaaacauaguaguugguggacggcagaugcaggucuuccuuggugccucgcaggcagaugaaaacagaggucaugccuaagccgggccgcaccguccccaguugcugcuucacaccugccagggggagugguuggugccuguguggaccauggccggagacggccacuccuugcucccaggagagccuuggggugccagcucuggcaccugccugaggcaugccgggccccuggccacucugcuuccuucauuuaacuaaauauuuuugaggccuucagaucguguucaggaggaaaauucauagacaagggaaaauuguaaccagacagugagaggggggcgggagggacagaugacuguagcagggcugccuggccaggacagugucaguucccagagguccugggacaggggagaagggaggucagggucacagagagaaagguaggaaguagcaaaggcagagucugccugugcaccaagcccgaccucccugcucugccccugggccaucucugccucaccccuucagcuccugagagucugagagaggggaggccgagcaggcugcaggcucagccacgcagggugaaggaaggagaggcuggcgcuggugaaaucacccuaugcccuggagacaaucacaacugccuuaccacccaguccccaugcggaaagccaggaccucgcuuuaccccccagcccgcucugcuguccccuuccccggcuccucagggagcagcucccgggcccacccucuggggucagggcuccuuccccugcucucuagcuccugcaccagucaagguuuccgccauaccauauccggagcuacuccaugcucuccagcucccgccccauccugaguccuucaucugggccccucucucucaccccugcuggguuacugguccccucuucccagcggccucccuuccucagauccaguuacaugaagguggcgggaccucuuagcugcguuggcucggcggcucugcucccugugggcugccugcucuccugcuucucuuccugaggccucuucucuggaagcccccucagcccagaagggugggaggagcggagcuuucaaaucagaccagcuacucugcucagcccugccccuuucagcugaguggccucaggacuguaauuaaucuguaugggccucaguuuccccaacauuaaaugcuaggguuaggaugauguuagagguagcguucucaccuuguugcuuaaggacaaucagagggccggccaagaagaggagaagcaugacccacacggagcagguuggcuccagaaggggacacauuggggaaccugcaagaggggcagugcagacccgccuuuuaccuggcaggcagcgggcguuccccggcaguagguguucauagguguugaacaguccugcguuggagaccacgauggggcaauagauguucaccagcucaugccccuucuucacacugacaccugcaggcacaagagcuuggcugagggucugugagcucugggaugaagagaaaggcccacggcccccauggaucucucucugccugugcccauuucucagaccuuggaguccagcuaccuagacucaggcagggcaggccccugggaaaaugcacagugagugaguaucuucaggugcuuucacacuauccuacaacugcuugggcuuacuuucccuagcucuguacccaccuguguguguguauguuuguauguacucuguguuugagccaaaucccagacaaagcucaagggcuaaagaccuuccacuggaaauccaggcccuuuucucugcugccagaguuguuuccaaauacucuuuaauacccuccaaucggggcuaggcacagugguucaugccuguacucccagcgcuuugggagucugagguaagaggacugauugcuuguguacaggaguucaagacuagccugggcaacauagugagacccugucucuauagaacaaaaaaauuuaaauuaagcuguauggaguugugcacaccuguaguccuaucuccucagccagaggaauggguucagcccaggaguuaaaugcuacaguaagcuaugaugacacuacugcacucuagccugggcaaaagagugagaccguguaucuaaaaaaaaugaaugaaugaaugaaugaauaaaauaaaaauaaaacccugcaaugaugccucauccuggauaagagaaccuccaaaaucuuacagcagccugugcaauguggucccuucuguguguccagcuccauccgucucuggucacucucacuaaacucccacuaaacuauuaggcagaaccaauaucaaacagcugagagucaaccauuucuuaccuacaaaaauggcaguuucuuauuguucgaccuaauacuucuggaugccugaaaacacccagcucuuucauaucuccacaccuuugcacaugcugcuucccauuccuggaauauucuccaaccucaucugcuugcuagcuucaucucacccuuuauuacucagcuccaacaccugugccuccaggaggcuuccccuguuccaccgugcugucuguuauccccauccuuagcacacgccuccagauggcaaguaaaugaaugcuuuuucuuuuuuaagaugaagccucgcuccguugcccaggcuggagugcagugguucaaucucagcucacugcaaccuccgccucccagguucaagcaauucuccuauccuggccuccaaguagcuaggauuacaggcucccagcaccgugccuggcuaauuuugguauuuuuaguaaagacaggguuucacuauacuggccaggcuggucucgaacuccugaccuugugauccacccaccucggccucccaaagugcugggauuacaggcgugagccacugcgccuggcccuggcuaauuuuuguauuuuuaguaaagacaggguuucacuauguuggccaggcuggucucgaacucccaaccucaggugaucugccugccuuggccacccaaagugcugggauuacaggcaugagccacugcgcccggccucuuuuaucucuaucuuuuauuaccuagcacuugaaaaacaaacaaauauaucuggauuguauuuaacucaacugauaccuugcuuccuggaccccuuucagcugaaaggagaacuuguucauggacaucagagaaaaccuugcccaaccaacagccaccucucucuuaccacccgguaacuuaucagucucuccuacuaauggauucucucagaucacugauggccuuuucuccuucauuuuucauuuugcacugggccccccacuuaucaccuccuugaaagguuccucugauaaaugcaugucuacauuagcccaguuuuucccaggccucuuuuugucugcuucccuggcuucuuuaagcacccauuagucauagauggccuauucuguuuaacagaguccuucuugcacagacccucuauuccaagaguucauuuauacugggauucugagucccuaugcggguuacagcaucaaccugagccaggguaauaacguucugggccccacuuuacagauagaggcagggaaccuugcuggccuccauacuauccuguggaauccaagguuacucauucauucuauuggccacugaacagcauuuauugagccucuaauaugugcuaagauuuauagauacaaagauaaaagacagucucuacacucaagaagauagucggcuggucuccgugccugacgccuguaaucccagcacuuugggaggccaaggugggcggaucacaagaucaggagauugagaccauccuggcuaacacauggugaaaccccaucucuacuaaaaauacaaaaaauuagcugggcgugguggcgggcaccuguagucucagcuacucgggaggcugaggcgggagaauggcaugaaccaggaggcggagcuugcagugagccgagaucacaccacuggacuccagccugggcaacagagcgagacuccaacucaaaaaaaaaaaaaaaaaaaaagaagacagucauagauuacuggguaaauaauuuuaucuauuaaauaaauaaauaaauacuguucuuuggggaccaugcaauccuuuauuuuucuuuucuuuuccuuucuuuuuuuuugagauggcgucucgcucugucgcccaggccggagugcgguggcgugaucucagcucacugcaaccucuaccuccuggguucaagcaauucuuccgccucagccucccaaguagcugggacuauaggugcgugccaccaugcccagcuaauuuuuguauuuuuaguagagacgggguuucaccguauuggccaggcuggucucgaacuccugaccuugugagcugcccgccucggccucccaaagugcugggauuacagacgugagccaccaugcccggccauauuuuuguuuuuuuuuuuuuaaagagacaggguuuaaccauguugcccaggcugaucucaaauuccugagcucaagugauccucccaucucagccucccaaagugcugggguuacaggcuuggaccacuaugcccggccaauccuuuaucuuuccugcuuccuuuuuauuucuggacuaaucacuaucccuggacccugcucuggggcagauucucaccuuuagccuccaugaggaggucaguucuccuacuccuucuggucucagggagaccccaggucucgcccacaccaacccagggacccagaagggcagggcggggcagggcucucaccacaggcuuucccagcugaguccagcaacacacucugcacaguggccuuugugaggacagcgcccccagcccgcugaaucacagggaugguguggaaggcaauuucacuggaacccccucggggauaaaagccuccuuucauguagugguugaccagcagggcgugcauggaaaaggcacugugguugggggugacaccugcagaagcaaggaaggguggugagcuggcaagagaaggcaccagcaccauucagaaaggaacguggaauucugugagauaacacacagcccagucuauccgaggaaccacauguuccucaggguccaaggcagccagaggagccuuuccaucuagacaugggguaccuuagagaucuuggcgccaguaggaauacccccccugcaaacugccaugcugccaagaccaaggaggauaguguugcuugaauugaaaaaucauccaaggcauggaugaacagaauuuugaccaaggaguccagcagguggccagacuucucauccacaagcuccagagggccugggguuuacacugcuccauaucagucagccaggcagggucgagaagaaagauugagagaugagagggcagccguuccuccuccagaagcugcccagagcccaggcccaguacccaccguaaguggggaagauguagcugaguacugccuggagcucagaggaggcccccagcugcugcaggaccucagccaggcucuggguggaugcuugaaggaauggagagaaacgagucagcagcccacaccugucgaggagcugaaccacgggcaaugggaggaauuucaacaggauggcaugaggggcuccacuggauaccaccugggggagugaaugaggacagcaggccucaccucuagaaccgcuuugacagaacugcuauccccauagccuggaccagcccaagaauccagcaacacuuaccccugacugaacuuugcugaauuugaauauuuuuaaaaaaucuauacucugugaauuuuucccauccuacacucggaugaguccuuuuuuugcuuuuaauuuuccugcucaaauuccuuuucaaaaaucccaaucuggucucggaugcaguaaaaaggaguagugaucugaugucauggaagccagccuagucagggaggagagcagggcauccccagaggccagggugacagcagcagccguggagccaaggcuccagagagagagagacagagaacuggauggacuuggguggaggcugagcuaagaacagaugugacucuuccucccuuccugccucccgcacugcacucuccacccccagugccuccacuaauaauaaagaaacccagccuuaucgagaacaaacucuggguccucagcauguccauguuaccuuaaccagcuuuauauacuugucaaugauagcuuccuccuguggaaacuucuccuugaggcccugaauguaggcuuucucuccacuguacaugggguacuccuuucggccauugggcccuuccaguaccaugaugucaaaaggagaggacaggggagcccaguccagcugcccuucagugaucugguccaagauaaaacggccaaugcugcccucuuccauacgcccaauguaauggauuccuguugggagauggaaaaacaagguaguaaagggauauggggauugagcccuggaaagguggcugaggaagugagguggaagaguuuaucuggccuggccaaguucacgcccagagugagcugcucacucugucuguagggaggugucacagcagaaaccgccagaucgcugcccgauucaacucccaguagcuaugcugucacauaagaaaacugcccagaggcugggcacgguggcucacacccauaaucccaacacuuugggaggcagagggagguggaucacuugaggucaggaguucgagaccagccuggacaacauggagaaaccccaucucuacuaaaauacaaaaaaauuagcggggugugguggcccacuuggugggauuacugaguguaaucccagccacucgggagacugaggcaugagaaucacgaacucaggaggcagagguuacaguaagcugggaucacaccacugcgcuccagccugggugaugaagugagacucugucugaaacaaacaaagaaaaaaaguacccagagagaagauggcacuuccaaaacaacagaaaugcucaguaucaccccacaagggcugcuccaagccucuucaacauacagccaugcucccaacccuuuuccacacaagccuuaccugugucaaauucaaggccauucuuuccaaagguaugacagcagcccccugccuugguauguuguuccagcaccaggacucgcuugccagcuuuagcuagaauugcagcugcagccaggcccccaaagccacugccaauuaccaccacauccagcuucuccggcacuugguuggcugaaaaagcuacagcagaagggccaaaggguggguuucucaggcaggggcagggaaauagcaaagauagggaaaccaaagaagacuucucuagcuuguacagugcaagaaaccucuagagugguuuggcacagaacucuugacuaacauguuucaaacauuuuaccugggaauacucagaaccagccaggcagauuugggguuuugcuuauuuguuuuuugagacaaggucucacuauggcccaggaugaagugcagugaugugaucacagcucacugcagccuugaacuccuggccucaagcaauccuccugccucugguucccgaguagcugggacuacaggugcaugccaccaugccgggccauuuuauuuuuauuuuuauuuuuauguguuuaauuauuuuuuaagacggagucucacucugucacccaggcuggagugcaguggcgcaaucuccgcuuacugcaagcuccgccuccuggguucacaucauucuccugcuucagccucccgaguagcugggacuacaggugcccaccaccacgcccggcuaauuuuuuuuuuuaauauuuuuuaguagagaugggguuucaccauguuagccaggauggucucgaucuccugaccucgugauccgccugccucggccucccaaagugcugggauuacaugcaugagccaccgcgccccgccuauuuuauguuuuauagagccaaagucuugcuauguugcccaggcugaucuugaacuccuggccucaagugauccacccaccucggccucccaaauugcugggauuacaggcaugagccaacacaccagcccacaagccggguuucuuuggaagaugcagggucugcaagcaauaguggaauagcugggucuuaugguggcucuuccagguccugaugaaaaggcuugggcaggacagaacugcucagaggcugcagcucugagaaaucacagcaccagccccucccauagggaaggucugggggcagugcugagggaggcagcaccuucucagaagacaaaacuggauagcaaguggugcuauauggguacuuccgacacaagaucuguucuuuaacaaucacuggcaaagaacugagaucugggauguuucaagauacaagagaacuuggcaaacugcuuauuuuuuuaauguuuuuagagagaucaauaguaaaaaaaaauuucacauguaaguauauaagauaaauacaugaaacaagugucacaaugcaauacuuaguggaacuauguauaaugcacucugauauuuucuauucuacugcauucuaaaauacuaguuguggccaggcgugauggcucacgccuguaaucccaacacuuugggaggccgaggugggcggaucgcuugaggccaggaguucgagagccuugacaacauggugaaacccugucucuacuaaaaauacaaaaauuagcugggcaugcccacuacucgggaggcugaggcaggauaaucacuugaacccaggaggcggaaguugcggugagcggagaucgcgccacugcacucuagcauggacaauagagcgagacucuguuucaauaaauaaauaaauaaugccaguugcaacucacuaaauugauuucauagcccacuaauagaucacaauccgguuugaaaagcaguuaagcuagucaucucauuuuuagaccagcccagguaggugcuaaugguuaugcagcaaauuagugacagaguccaagcuaaaacucaguucucagaaguccagaugauuaguccuuccacuuagaacaguacugucuccgauuguguagcaagauaugacacggagaauucuaaaauuuacaagugagagggacuccguagaucaaacaggugauccauuauuuuuuaaagcagcagaacucuuuaaacucuagaagcaaccacaaaauauguuuuaaagaugagaguggagagcaggcucugagccugaggcgccuuguugaaccucugccaauguuucagaacuaggguucaauccuuacgauuugggaccaugcaaagccuguuaaaucaccggacgggcaaaacgcaauuuccuacgcauuucugugcugcucccccacaccccugagcucgcaugggaggguaggugaaaaaguuaagguccuggaaccaaguggaggaaugagucacggggauuaucaguuccacgagccacggggauuacaaguggcagggcgggugccaacaccuugcaaaccaaggacaaugaccacacccuugggacuacuauucccggggccuacuagggcaaaggcuaucgacaguguugcacacuaaagcggggcuccuccacgugcaaggaagcccuccuaguacuuuacauauggggaaacuaaggcccacgucugguagcggcugccuuggcaaaaugagaacccaaaucugugagaaagccucgagugcagccccggaccccagggucccuccugcuaccuuguuugagaaccuucuuccuggccuccuugucaguuaccaggggcgcugggggccguuugacaucuucggagaaaggauucggggagcugccagagaauagucccaaguaaacuuugcagaggacggccagcagcagcacagccaggagcagcaccagcggaagccacaucacgccggcgucgggucggguaaaugggacagcuccgacugcgcucagccucuaggacuguggcuccgcccgggcuaguucgcucuccagucaggaggcggaggcagcuuugagcacugauuaaccagccagccagcgaagagccaacucucaggugaugauug

SEQ ID NO: 14701 - RNA, 8528 nt, Homo sapiens
auuugagucacauccauauggcauggagaaagaaaaccucucugccagaaggaacugaacucuggaaguccuaaggaaggucaccaugaucagcagauaggaaagcauugccaagggcugucccucaagagcuuaguuuucuuagggagaccagaaagacaucagauccugacugcccuguuuugcucaaguucugaaaugaguggcaugaugaagagcugguggagcugagggaaagagucaaccauguggggugggguagugaggaagguguaugaggaaacaaacugggcccugacgaaacaggcggauuggggaaggagaaagaaggaagggagagaaaccuaaccaaagaaacaugggaagcuggaaagucgagggcacagccggaauaaaggcacagaugggcaccccacaggaggggccuuggccagguugggaugcagagaaaaacaggcaggagggugucaaucuauagcauccugaaccccaaaaggucuguaacuggauucucuaagccuugagaaguucacaccaaagcuucagaccagggaaaauauuuuggaaagaucagucuuuccaagagugagcuccuuuccaagaagcuggacaggaaacccaauaaauguggaucugaaaaaacaaaauccaagagagaagcaaaaugggcugggggugugcaauaagagaagcaaggaaaauggaaagacuguagcugaggaucuuuuauuaaaaaaaaauggaugggacuuuggugaugagagagaaaaagggcaaaagucugcaguuaggaauuuaggugaccgaagacuguccuagacaguugggagggacaggcugauggacagaagagagaaauuccuuucaaugacaaccaagcugaacuauucgauaccagcagaacuggguucuuuagggauuaagccaagacaaagacuugggaaucacucacuccgaggaugaagaauggguuaauggcugaggagacagucaaaggaauagagaggccuggcuuugagggccucuucaccaccagcacaagauaaggcaaaggaccauuugucagagacaccaagaaaggggaauuuccauuuggauggucaauaguguccaguucugccaaggacaagacuaagcuuugagaaaaagccauggauuuggugauuggauaacugguaaccuuuagaaaaguuuaguugacagacagagaccgaagugaguuaguaaaagucaugaagagaaugaauggcaacuuaagggaagcaacauacuggagaaguugagcagcgggaugaauaacaaauaggacagaugggaacagaaaaaucugggugcauacgaagguggauggaaaggagcugguacagaugggcacaaccagaaaacaugaggaggggaaaggaagggaaaaggaaggcaggcagggagagagacgugaaauagccacagucuuaggggaugcuagagaagccuagaagauuccucagguuggugcaaaguauuauaagacuaacgcaucaguacagagaaugacccaagaaggguaggaguucauuccuuaccuucauaaaguaggcuauccgccaagaaugaaaaugucaacucaaagcuaugggcuguuuuaagcaagguggaagauaauauaagaagcaugguccuuucuucagacuuacugccuugacagcacagaauucaucuuauuucccucaucucccaaguuauuuguauuucccugagaucagcucagaaacaacucucuuuaggcucucuacaaugcgguagagcaugauuagaaaagauaaaccuucaaacaauaguguuguccaagacacuacccucacuuaucccaggggaacccacggaauuucuucauuuguauuaacuccugacauggcauggaagaagaauuuuuaucaaauacccuuggcaucuuauaucagauuaaaggaccauuaaauacacugagguaaaauuggcagagaguauaguuucuauuaauaaaucuaagucuauuuugucuguuuuaggcaacaaaggcaaaauggacuuugugggaaauguaucucauaaaagcccuuuggaaaaacugcagaccaaaaccaaaacccuccuucauguuuucucgcaugaaacauaaacuugcccuauuucaaaaaguuccuacugaguaugauugugugaaagaucacacuacuucaaaucauauuuauuuuaaaaaucugugaugggacaguggccucacugccaggaagcccaaguucuguuuuaugcucgguacaacuaaguggaaguugauucacuuugucucaagcuacauaaaauaaucagaaaaucaagaagaucucaugcuagacagguuagacuugcacccaaaaaagcaucuuuuuuuuuaaccugcuguuuugguuugcugcugaagucuuugaagagaauuauguauucaaaguagcucuuugcccauuggcauuuccccaucuucuaugucuucuguagggcacaucccccccaaaguaagaggccuuaguagaaaagcacuuccaccugcaguuuuccccuaggucugcagagagaaacagugcagagugcaaugccacagucaaggaccaacuuuccuacagagcccgggccccagggaggguggucagcagcgcagccugcccaggcugggaucucccuuuggucauagccguguuuccauauaccccuccacucacccucagaggaggaacggauggaagccaccagcauaaauaaagggaacacagaagaacaaugucaccaaagugcaggugcaaagcccaaagcagcccccuaccucugccagcccagacccgccacuaaauucuagaggagggugucucucaggucacaguacuuuuuucuucauuucuuuugauuuagaaacaaaucagcagggaggacaagguucucaaggacaaaaaaaucaaagcugaaacgagagcagcacaauccauuggugacguucaucuuuuuccagaggaauauaccauucuguuaggacuuaggggaaaaaagaucuuuuaggaggugcagggaaaacauucagaauuaagacauacugacccaccaccacagaaacagcaauuaauuaaaauagcacacaaaaugauuuuuaaaguuugaaaugaaaccuaacacuagaaagauauacacuugauggagagagaggaauccuggcuucugcuucauacuguucuguacuguugugaauuauuuacauguguuuuuuguugguggugguuuucuucuuuuuugagacggagucuugcucuguugcccaggcuggagugcaguggcaugaucuuggcucacugcaaccucugccuccgaaguucaagcgauucucccaccucggcuuccucaguaguagcugggauuaccaugcccagcuaauuuuuguauuuuuaguagagaugguauuucaccauguuggccagacugaucuagaacuccugaccucaggugaucugccucccaaacuguugggauuacaggcgugaaccacuaugcccagccacauguguauuuuuuuaaaaaucauaagccaugugugguggcucacgccuguaaucccagcacucugggaggcugagguggguggaucauuugaggucagcaguucaagaccagccuggccaaaagggugaaaccccaucucuacuaaaaaucuaaaaauuagcugggcgugguggugggcgccuguaaucccaccuacucgggaggcugaagagggagaacugcuugaacccgggugguggagguugcagugagccaagauugugccacugcacuccagccuggacgacacagcaagacuccgucucaaaaacaaacaaacaaaaaucauaaaagggggaaaacccuuaaagucaauuaucugaaaaggcaguaguccagagcuaaauuguaaagcuagccuacuggacuaguuagcaaagauauucugagcucaguggcucguucuguagcuaauauugaguugugcaagagaaucguguucccugcaggaagucugggaacaauucauaguugggccaccaaugguucuuugccaauguccuggcuguugcuaugcugaaagcagaaggaagggugcaugcugguagcaacgcagugagaguacagucuuccugcuuagacagguugucuuuagagagacccuugcuuagcucugcugccaugggguggaaggagggcuuaucugucugacagaggaauggauuggcuguacucaggaacuccagccuacggugcuuaagccaggcugauguggggaguuggaggccuaugugcuuccaggcucguguuuccagggagcacagucuagcacuuuaccacacaaaguguggauccaguggcauuugguuucaccugggaacuuccuaagaauguagacacaggccaggcacgguggcuuaugccuguaaucucagcacuuugggaggucgaggcgggcggaucaccugagguugggaguucgagaccagccugaccaacauggagaaacccaucucuacuaaaaauacaaaauuagcuggacguggugguggcgccuguaauccuagcuacucgggaggcugaggcagaagaaucgcuugaacccaggcagcagagguuguagugagccgagauugcaccauuguacuccagccugggcaacaagagcaaaacuccaucuccaaaaaaaaaaaaaagaauguagaaauauaggcuccaccccacaucuaaugaaucagauaaugcuuuuuaucaaaauuccccaaggugauucaaaugccuauuaaaguuuauggagcgcuggcagaaugcagaaagcucaggacugggagacuagggaguugcuaucagguccugaguuugccacuaacuugcaguagaaacuuagcggaaaaaaaaaaaaaagaguguuucugcgugggccuauuuccucaucugugaagggagguagcugcuguagaguauuccaaggucucugcuagcucuaacgucacagauauguguaucuagauguuucuaguuuguugucuaaaaagggcgaaugcaacagcaacagcaaccgcauccccagaaucagccacugcugcuucauggcaaaugcaagcccacuacuggguccaucugacguugccuaucccuccuaucccucccauggaccuggcuccuccuuccuuaccuucugguccaaacguugguagucacuggccuuuggccgccgggugacuuuagaucuuuuuccuuccaggacaaaagcaaugaucugaggaaaggaaaaagaaaaugauuaacagguggcucuguaaugacauaguucagucucugaacucagaggcagucaccugguagcauauuuguuaaugacccugacuguagaaagagcaguacacucacagaggucuauuuaaacuauaaccauuuuaagaaagacagagccuaauuacaucagaauccuuuguauugcuuaauaggaaauaacaaauagaaggcugucugagcucuagcgugugggaggaagucuguuugauuuauucaaagguacacagucaaagaucuaucaacuccuuccuagagauaucuaggauauaggacauuccuuuaaaaaaagucauaaucagaauuuccuaucuacaaauguacuuuuucaccccacgaugcuacaucaacuacauucuuuaucaaucucauuucaugacuaagguuacccugcauaauggacacuuggacauagaauaagaaauacacuuuuuuuuuuucuuagaggcaaggucucacucugucacccgggcuggagugcaauggcgugaucauggcucacugaagccucgaccucccacagucaagccauccucccacuucagccuccugaguagcugggaccacacacguccaccaccacaucuggcuaauuuuuuuauuauauguagagacgaggucuugcuauguuggccaggcuggucucggacuccugggcucaagcgauccuccugccucggccucccaaagugcugggauuagaggcaggagccacugcaccgggccaggaaugcacauuuuuacuaaaggucuuccccuuuauucuuuauagccauaggccuuauggccagaauuggacucuccaauuuuaagcagguuacagaaacuagcuucuaaauguugggggcucaauaugaaaugcaaucauuuugucauuagagugguugcuaauaaacagaccaaacccugaugaaaaaguaacagguguacgugucugugcaauuucugggcuuucuucuaauuauuauuaauugcagaagucccugggcucuuugguccugguaucgaagacgcaguaauugaaaccauucuuugugccacugcugauggaagagagaauguugggaaaggaagcuagaaaugacauaucgucucaagaagggaaauaggauggaagguacgugcuuuaacugucaaguacucagguccucugaggcugugaaggaccuaagugcaaaguuaugggaggagauuccaagucaggucagauccuaauaauguccuaacuuggcuccuaaugcaguagcagaggacacucagaguaaacaggugacaggaugaaaacacgauuaacaaaacaagaguaaagaggccuaauagggccugaggaaaaaacugaaguuuguuuuaaaguccccagugcucacgggcaucuagugacgggauacccacccacacccaagcuuccagggugcuggaaaccccacuccccuccggaaggccgcugucgacuuaccuuccgcuuguugugaugagcgauauagaggacagccacaagaauggcugcagucaccagauaugcaaagaaguggcugcucuccgcgcugccauuuccagaaccguucggauaaaggucauccuucucgcuacccguggaauccgaaagugucccuucacgguucucacuggaggcagaaccggacaucuuuucuuucucuucuuugggcggugagcccuccucggguccuguaucaucaucuucagccucuuugggcuccacauccucaguaggcucugaagacuuaacuuccuccugcgggggagaaaugaggucaguuuccuccccagauucgguuuugaaagcaugaggagaaagcuucccuuugucagcaagcugguuugugucagccuuggggagcuccuuguuaucagaaggguuggagaugggcuuggaauggucuuuccgggaaggcugcucuggaaccaccuuguuagggcugucuuuugaggucugcuccuccgcacccgacuugcugggcccgucuauugggcccugcuccucugcaccggacuuguuagagccgucuuuuggagucugcuucuccgcacccgacuuguuagggacgucuuuuggggucugauccuccgcacccgacuugcuggagccgucuuuuggggucuggccguccgcacccgacuuauuagggacaucuuuuguggucugcgccuccgaaccugacuugcuagggcugucuuuuugggucuuugccuccgcacccgaccuguuggggcugucuucuggggucugcgccuccgcacccgauuugccagugcugucuuuuggagucugcagcuccggaugcgacuuacuagugcugucuuuuguggucugcgccuccgaacccgacuugcuagugcugccuuuuugggucuuugccuccgcacccgacuuguuggagcugucuuuuugggucuuugccuccgcacccgacuuguugggggugucuucuggggucugcgccuccgcacucgacuugcuagggcugucuuuuggagucugcggcuccggaugcgacuugguagagccuccaggccguuggcucaagcugggguggguggagacguuuccugcagaaggccguacuccagcuucuucuugcuugacgcuuucgguggccaagagcggcacggcuccugaaauagaaaaacgaguuagcaccggagaagggcaggcgggaagaaggaacuccucagaacuggaagagaucgggagcagcgggggaauggggauugggggguggggcgggagacgauggcgagcggagaggugggucggguagggaagaagcgagccuagaggugaccugcccaggugagaaugggggaucugggggcaagagugggaugcgggauggagggucuuacccgccgcugcgacguucaggaggaccaaggcaaccacgaaccgcauccugcucggauagcgcuuccgcccucuaaugcucucgcgagauccgcgcgcggggccccucuccagucccgccccugcugcgcgcgucucucagucucccgcugccgccaagacgaagggcgggauuuagggggcagcugcugaugucggcgcucgccuucggcugcuucgcuuacugucgccgagugggaggcgagccucuucuuccugguuucucgucuccaccacagccacaacagucuggccccccguuuuucguccccuccgccucguacuuccgagaccu

SEQ ID NO: 14702 - RNA, 7467 nt, Homo sapiens
agauaggaaagcauugccaagggcugucccucaagagcuuaguuuucuuagggagaccagaaagacaucagauccugacugcccuguuuugcucaaguucugaaaugaguggcaugaugaagagcugguggagcugagggaaagagucaaccauguggggugggguagugaggaagguguaugaggaaacaaacugggcccugacgaaacaggcggauuggggaaggagaaagaaggaagggagagaaaccuaaccaaagaaacaugggaagcuggaaagucgagggcacagccggaauaaaggcacagaugggcaccccacaggaggggccuuggccagguugggaugcagagaaaaacaggcaggagggugucaaucuauagcauccugaaccccaaaaggucuguaacuggauucucuaagccuugagaaguucacaccaaagcuucagaccagggaaaauauuuuggaaagaucagucuuuccaagagugagcuccuuuccaagaagcuggacaggaaacccaauaaauguggaucugaaaaaacaaaauccaagagagaagcaaaaugggcugggggugugcaauaagagaagcaaggaaaauggaaagacuguagcugaggaucuuuuauuaaaaaaaaauggaugggacuuuggugaugagagagaaaaagggcaaaagucugcaguuaggaauuuaggugaccgaagacuguccuagacaguugggagggacaggcugauggacagaagagagaaauuccuuucaaugacaaccaagcugaacuauucgauaccagcagaacuggguucuuuagggauuaagccaagacaaagacuugggaaucacucacuccgaggaugaagaauggguuaauggcugaggagacagucaaaggaauagagaggccuggcuuugagggccucuucaccaccagcacaagauaaggcaaaggaccauuugucagagacaccaagaaaggggaauuuccauuuggauggucaauaguguccaguucugccaaggacaagacuaagcuuugagaaaaagccauggauuuggugauuggauaacugguaaccuuuagaaaaguuuaguugacagacagagaccgaagugaguuaguaaaagucaugaagagaaugaauggcaacuuaagggaagcaacauacuggagaaguugagcagcgggaugaauaacaaauaggacagaugggaacagaaaaaucugggugcauacgaagguggauggaaaggagcugguacagaugggcacaaccagaaaacaugaggaggggaaaggaagggaaaaggaaggcaggcagggagagagacgugaaauagccacagucuuaggggaugcuagagaagccuagaagauuccucagguuggugcaaaguauuauaagacuaacgcaucaguacagagaaugacccaagaaggguaggaguucauuccuuaccuucauaaaguaggcuauccgccaagaaugaaaaugucaacucaaagcuaugggcuguuuuaagcaagguggaagauaauauaagaagcaugguccuuucuucagacuuacugccuugacagcacagaauucaucuuauuucccucaucucccaaguuauuuguauuucccugagaucagcucagaaacaacucucuuuaggcucucuacaaugcgguagagcaugauuagaaaagauaaaccuucaaacaauaguguuguccaagacacuacccucacuuaucccaggggaacccacggaauuucuucauuuguauuaacuccugacauggcauggaagaagaauuuuuaucaaauacccuuggcaucuuauaucagauuaaaggaccauuaaauacacugagguaaaauuggcagagaguauaguuucuauuaauaaaucuaagucuauuuugucuguuuuaggcaacaaaggcaaaauggacuuugugggaaauguaucucauaaaagcccuuuggaaaaacugcagaccaaaaccaaaacccuccuucauguuuucucgcaugaaacauaaacuugcccuauuucaaaaaguuccuacugaguaugauugugugaaagaucacacuacuucaaaucauauuuauuuuaaaaaucugugaugggacaguggccucacugccaggaagcccaaguucuguuuuaugcucgguacaacuaaguggaaguugauucacuuugucucaagcuacauaaaauaaucagaaaaucaagaagaucucaugcuagacagguuagacuugcacccaaaaaagcaucuuuuuuuuuaaccugcuguuuugguuugcugcugaagucuuugaagagaauuauguauucaaaguagcucuuugcccauuggcauuuccccaucuucuaugucuucuguagggcacaucccccccaaaguaagaggccuuaguagaaaagcacuuccaccugcaguuuuccccuaggucugcagagagaaacagugcagagugcaaugccacagucaaggaccaacuuuccuacagagcccgggccccagggaggguggucagcagcgcagccugcccaggcugggaucucccuuuggucauagccguguuuccauauaccccuccacucacccucagaggaggaacggauggaagccaccagcauaaauaaagggaacacagaagaacaaugucaccaaagugcaggugcaaagcccaaagcagcccccuaccucugccagcccagacccgccacuaaauucuagaggagggugucucucaggucacaguacuuuuuucuucauuucuuuugauuuagaaacaaaucagcagggaggacaagguucucaaggacaaaaaaaucaaagcugaaacgagagcagcacaauccauuggugacguucaucuuuuuccagaggaauauaccauucuguuaggacuuaggggaaaaaagaucuuuuaggaggugcagggaaaacauucagaauuaagacauacugacccaccaccacagaaacagcaauuaauuaaaauagcacacaaaaugauuuuuaaaguuugaaaugaaaccuaacacuagaaagauauacacuugauggagagagaggaauccuggcuucugcuucauacuguucuguacuguugugaauuauuuacauguguuuuuuguugguggugguuuucuucuuuuuugagacggagucuugcucuguugcccaggcuggagugcaguggcaugaucuuggcucacugcaaccucugccuccgaaguucaagcgauucucccaccucggcuuccucaguaguagcugggauuaccaugcccagcuaauuuuuguauuuuuaguagagaugguauuucaccauguuggccagacugaucuagaacuccugaccucaggugaucugccucccaaacuguugggauuacaggcgugaaccacuaugcccagccacauguguauuuuuuuaaaaaucauaagccaugugugguggcucacgccuguaaucccagcacucugggaggcugagguggguggaucauuugaggucagcaguucaagaccagccuggccaaaagggugaaaccccaucucuacuaaaaaucuaaaaauuagcugggcgugguggugggcgccuguaaucccaccuacucgggaggcugaagagggagaacugcuugaacccgggugguggagguugcagugagccaagauugugccacugcacuccagccuggacgacacagcaagacuccgucucaaaaacaaacaaacaaaaaucauaaaagggggaaaacccuuaaagucaauuaucugaaaaggcaguaguccagagcuaaauuguaaagcuagccuacuggacuaguuagcaaagauauucugagcucaguggcucguucuguagcuaauauugaguugugcaagagaaucguguucccugcaggaagucugggaacaauucauaguugggccaccaaugguucuuugccaauguccuggcuguugcuaugcugaaagcagaaggaagggugcaugcugguagcaacgcagugagaguacagucuuccugcuuagacagguugucuuuagagagacccuugcuuagcucugcugccaugggguggaaggagggcuuaucugucugacagaggaauggauuggcuguacucaggaacuccagccuacggugcuuaagccaggcugauguggggaguuggaggccuaugugcuuccaggcucguguuuccagggagcacagucuagcacuuuaccacacaaaguguggauccaguggcauuugguuucaccugggaacuuccuaagaauguagacacaggccaggcacgguggcuuaugccuguaaucucagcacuuugggaggucgaggcgggcggaucaccugagguugggaguucgagaccagccugaccaacauggagaaacccaucucuacuaaaaauacaaaauuagcuggacguggugguggcgccuguaauccuagcuacucgggaggcugaggcagaagaaucgcuugaacccaggcagcagagguuguagugagccgagauugcaccauuguacuccagccugggcaacaagagcaaaacuccaucuccaaaaaaaaaaaaaagaauguagaaauauaggcuccaccccacaucuaaugaaucagauaaugcuuuuuaucaaaauuccccaaggugauucaaaugccuauuaaaguuuauggagcgcuggcagaaugcagaaagcucaggacugggagacuagggaguugcuaucagguccugaguuugccacuaacuugcaguagaaacuuagcggaaaaaaaaaaaaaagaguguuucugcgugggccuauuuccucaucugugaagggagguagcugcuguagaguauuccaaggucucugcuagcucuaacgucacagauauguguaucuagauguuucuaguuuguugucuaaaaagggcgaaugcaacagcaacagcaaccgcauccccagaaucagccacugcugcuucauggcaaaugcaagcccacuacuggguccaucugacguugccuaucccuccuaucccucccauggaccuggcuccuccuuccuuaccuucugguccaaacguugguagucacuggccuuuggccgccgggugacuuuagaucuuuuuccuuccaggacaaaagcaaugaucugaggaaaggaaaaagaaaaugauuaacagguggcucuguaaugacauaguucagucucugaacucagaggcagucaccugguagcauauuuguuaaugacccugacuguagaaagagcaguacacucacagaggucuauuuaaacuauaaccauuuuaagaaagacagagccuaauuacaucagaauccuuuguauugcuuaauaggaaauaacaaauagaaggcugucugagcucuagcgugugggaggaagucuguuugauuuauucaaagguacacagucaaagaucuaucaacuccuuccuagagauaucuaggauauaggacauuccuuuaaaaaaagucauaaucagaauuuccuaucuacaaauguacuuuuucaccccacgaugcuacaucaacuacauucuuuaucaaucucauuucaugacuaagguuacccugcauaauggacacuuggacauagaauaagaaauacacuuuuuuuuuuucuuagaggcaaggucucacucugucacccgggcuggagugcaauggcgugaucauggcucacugaagccucgaccucccacagucaagccauccucccacuucagccuccugaguagcugggaccacacacguccaccaccacaucuggcuaauuuuuuuauuauauguagagacgaggucuugcuauguuggccaggcuggucucggacuccugggcucaagcgauccuccugccucggccucccaaagugcugggauuagaggcaggagccacugcaccgggccaggaaugcacauuuuuacuaaaggucuuccccuuuauucuuuauagccauaggccuuauggccagaauuggacucuccaauuuuaagcagguuacagaaacuagcuucuaaauguugggggcucaauaugaaaugcaaucauuuugucauuagagugguugcuaauaaacagaccaaacccugaugaaaaaguaacagguguacgugucugugcaauuucugggcuuucuucuaauuauuauuaauugcagaagucccugggcucuuugguccugguaucgaagacgcaguaauugaaaccauucuuugugccacugcugauggaagagagaauguugggaaaggaagcuagaaaugacauaucgucucaagaagggaaauaggauggaagguacgugcuuuaacugucaaguacucagguccucugaggcugugaaggaccuaagugcaaaguuaugggaggagauuccaagucaggucagauccuaauaauguccuaacuuggcuccuaaugcaguagcagaggacacucagaguaaacaggugacaggaugaaaacacgauuaacaaaacaagaguaaagaggccuaauagggccugaggaaaaaacugaaguuuguuuuaaaguccccagugcucacgggcaucuagugacgggauacccacccacacccaagcuuccagggugcuggaaaccccacuccccuccggaaggccgcugucgacuuaccuuccgcuuguugugaugagcgauauagaggacagccacaagaauggcugcagucaccagauaugcaaagaaguggcugcucuccgcgcugccauuuccagaaccguucggauaaaggucauccuucucgcuacccguggaauccgaaagugucccuucacgguucucacuggaggcagaaccggacaucuuuucuuucucuucuuugggcggugagcccuccucggguccuguaucaucaucuucagccucuuugggcuccacauccucaguaggcucugaagacuuaacuuccuccugcgggggagaaaugaggucaguuuccuccccagauucgguuuugaaagcaugaggagaaagcuucccuuugucagcaagcugguuugugucagccuuggggagcuccuuguuaucagaaggguuggagaugggcuuggaauggucuuuccgggaaggcugcucuggaaccaccuuguuagggcugucuuuugaggucugcuccuccgcacccgacuugcugggcccgucuauugggcccugcuccucugcaccggacuuguuagagccgucuuuuggagucugcuucuccgcacccgacuuguuagggacgucuuuuggggucugauccuccgcacccgacuugcuggagccgucuuuuggggucuggccguccgcacccgacuuauuagggacaucuuuuguggucugcgccuccgaaccugacuugcuagggcugucuuuuugggucuuugccuccgcacccgaccuguuggg

SEQ ID NO: 14703 - RNA, 9484 nt, Homo sapiens
aaacaccugagcuagaaagagcuggcuugcagcgcuugccugaaggauuuaggucugagguggcucucaggggcucuuuggaugcaucuggauucagcuuccuggccaugcacacccaugcccacgcuuguguguuuugucccuguugggguuauccacagaggggugugcggugguucccuacauuccuaguccucgguuuggguauaugcugugaacauccugccccugggggcagcugaggagaguaaugagcaggaacuuuuauugggacagaagccugcaaggagaaccuuccuucuaggaggccacuaucuacuuaccgccuucccucccgguucauuuucuggacaaugaugccaccuagugggaaacgguaagaacucacacagcauuucgacaacuauacauagaucuucaaauaaaaauuucccuacuuuguauuagguuggugcaaaaguaauugugguuuugccauuaaaaguauggccaaaaccacaauuacuuuugcaccaaccuaauacuuaauucuguuacccauugaguccuguuugcugguuucuccccaggccaaauacagcacaugagcaaucaggauuugcuaauacuaucaccaguuuuuaagacagcuauaaaugauguaaauaaauguaaauuuaaaacugaugcagaggcugggcgugguggcucacaccuguaaucccagcacuuugggaggcugaggcagggggaucgccugaugucaggaguucaaaaccagccuggccaacauggugaaaccccaucucuacuaaaaauacaaaaaaauuagccggacaugguggugggugccuguaaucccagcuacuugggagguugaggcaggagaaucgcuugaacccaggaggcagagguugcagugaaccgagaucacaccacuugcacuccagccugggugacagagcaagacucugucucaaaauagaauaaaauuuuauuuugagccacugagcccggcacaguggcucacaccuguaaucccagcauuuuaggagaccaagguggauggauugcuugagcgcaggaguucgagaacagccugggcaacauggugaaaccgcgucucuacaaaauauuagcgagguguggcagugcgcaucuguagucccagcuacuugggaggcugaggugggaggauugcuugagccugggagguagaggcugcagugaaccgagauugcaccacugcacuccagccugggcaacagagcgagaccuugucucaaacacacacacacacacacacacacacacacacacacacacacacugaugcccagaaaggcuuaaugaaaggagauaugccaaaaugaccauagcgacaggguuaggauggugcaguuauguugucuaaaugcuuugugauacaauuaugauauaguuugcauuucuuucuuagaaaguuuguguuauucauaguauauuuuuuuaaguaguagaucauggugaaaguaaaguuggaaaauauggaaagagagacaauaaagacaaaguuacccauaguuucaccacucaaauauaacuuguuuacauuuuuggugugcuucuauuuagccuuuuuuuaaauuacagaguuuauguauuuuuuaauugugauuauguauuuucacgcugguaauaauucuauuggauuuauuuuacuaaaagucacccuuuagacaaagcuguuuccagaaacuaucauuaagaugcauuggcuuccuggaaaucugaucuuacaauaauuuuuaauauuuuuguguuguauguucauguauauggagauaucuucaaaaacgaguaauuggacaggugaaaacaguaagaagacaguacuuuuuaaauucaugaugcaacauccagugagcccaccagccaccagcagggcccagcugugugcuggcgccaccugguggucaugguuauaaacgguuuaauucuccgccucuccucucugcuuggcacacugaaaaggaacaaggcuguggugagcucaaggauacccaggaaaucuauggauuggaguuugcauuaugaguaccaaauaggcaccacaugaaaggaaagaaaggucucauggaaucuacgaaaugaaaaauucaaagaggaauauagccauuuggaguuguagcccuuggguuaccuccaaaucaucuuuuuuacaaaucucuuuuuuuuuuuuuugaaauggaaucuugcucugucacccaggcuggagugcaguggcacgaucucggcucacugcagccucugccuccuggguuccagcaauucuccugccucagccuccuggguagcugggacuauaggcacacgccaccaugcccggcuaauuuuuguauuuuuaguagagacaggguuucaccaugucggccaggcuagucucgaacuccugacuucagguguucugcccgccuuggccucccaaaaugcugggauuacaggcaugagucaucgugcccggccacaaaucucuuuuaaaaagaaaucucuucuccacuuguaacucacuuaucuuauuaucaaaaaacauaauuucuguccuuucucugugacagauaaguuuuacguuuugagaagguucugggagagacagguuguacaagagaaaacauucuuguuuauuagagccauaaacagcugauaugaaucccagcucugccacuuacuaaccgugucccaggcuaagucauguaaucuuucugggcuguucccucaucucuggaauggggguaaucacagcuucuuuucuagguuauaaggaguagaaauuaugccuggugcuguguuuguaaugcaggguucagugaccuguagauguuuuuaaaauaaaaagccuuauggauaagucagauuagguuuaaacaauuaaaaaguuaauucuguuuaccaauuguagaacgcacagguuuuucccauguuaacaucucugaagaugugucuguggcgugccagcguuuuucucaauagcuuuauaaaauaauggugcuccuuccauuuggugguguuuuacacagaaugugguagugaggucagcagaguaaaguguuacagagagaaguguuucaagugcuuuaggguugugucuguaaagccugaauaugagacuugguaguaugaggucuaaugggggcaacucucccccugcccuguucccagucccagacuugaaccugagagcaacuguuucuaugaaguuuauuugaaaaauguguguuaaaccuuuucagggccgggcgcagugguucacaccuguaaucccagcaccuugggaggccgaggcggguggaucaccugaggucaggaguucaagaccagccuggcccacauggugaaacccuaucuguacuaaaaauacaaaaaaauuagccaggcgugauggcagacgccuguaaucccagcuacuccagaggcugagacaggagaauugcuggaauccgggaggcagaggcugcagugagccgagaucaugcuacugcacuccagccugggugacagagcaagacuccaucucaaaaaacaaaacaaaacaaaaaaaaaaccuuuuuagauucaaugagaugacacagcgcagaucaucccucagcagccuguaguguuugagaugacacagcgcagaucauuccccagaagccuguacuguuucccacacacagugcacgugaggggagcgauggagggugggugugaucccuucucaaguccugcugcucugcuguguccacugcugucaucucucagggacuguuuugaggacugaaugggauguugccuggaaaauaccuggcacuuacuugauuccauaaauaacagcuggucauacucuccaucuccuuggcaaccauuccuggucuuuuuugucucuuucagucuaauaaaguuccugucguucagcacccgcaucacaugcauccgcugacuccccucaucaccuacagcaaugaccacuucucccccggcuccccucccacccaccucuccccagagaucgauccaaagacagguaagucgucugccacucaggcagugcugcugcagggcaggcgggcuucucuuuugugggaacauaacagcccuugaaucaggcugaccuggguucaaaucauggcucuuugucucaggagucuuuggaccuugucugcuaacuuuagccuugucauuuuuuuuuucaucugugccuccccuguaccuucuccaccauagggucacgauaaggcccacaggaauuaaaugcaguaaagcacagggccuggcuccauaggcagugugugggguggcucugcccaagucuagcccagcugugggccgugcuucccuacaccaagacauguuugcccuaaacugaacauuuuuaaauagauucaucagucuaagcagacacagaagugcaaccguaaagcagugaggccaaacuggcuuuuauuuauuuauuuauuuaagacagucuugcugugucgcccaagcuggagugcaguagugugaucucagcucacugcagccuugaccucccgggcucaagcaguccuccucccucagccucccgaguugcugggaccacaggcgcaugccaccaugcccuugcccagcuaauuuuuguauuuuuaguagagauggguuucugccauguugcccaggcuggucucaaacuccuggacucaagcagucaacucaccuaagugccgggauuaccggugugccaccaugcccaaccugaacuggcuuuuuuuucuuuuuuuuuuuuuuaacuugcccaccagaccuguccauuccagggagccacugucuuuauagcauucacacagaguugccaggggaaggcaaagcauuuuuggagccccucuuuggagaaauaacagucacuacaaguuacagauaaugaggaagacacauguggaggaggaauccaaaguuuauuucuccaugaaugaggcgggcuuucuagagacuugguucaccagugacucuugucauuggucuuguggguccugucccucucuuccaggacgcuggcuucuguaucacagccagcuggaagauacucuucacagagauagaauccgugcagcuagagagggggugcauuaguccugccuccccugaauauguccuugacugacuggugagagcugcuagggaguugacagagggcaaggacaaugacacaagcaccugcuaggcuccagagcaccagggacauagggcaggaugcucccauuugauguucguuaaggugcucuggcagggcgagggaacagucugacauaucucucuuuggaagcaggaaucccccggcccccucacccauccgagcugucaccguauuacccacucucucccggagcugucggacaaaucccccacccccucggcuggcucgucccacaguaaggaacccacagccucucuucccccugcucccuccuugcgcugagcucugccucugugcccugcgcgcccugcacaguggagcccccucagaggcaagcccaggacuaggccucccugcccccgcccaggcagcgugcucccagcauuaccuucccgcuuccuucccauauuucucaucccuucuucccaagugccucucuuccucugcccugagcuuucccaauaugcugaccagauuuccucccccucacaggcaaggccagcccauguacucccuuccucccgguggcuuccggcacccuuaccccgcccucgccaugaacgccucgauguccaggugagucccggggcuggggcuguccgcauguuugucuuagcaaccacgccauuucugaccacgaaacagcuuuuucuugccaguuaaugagcaggcacagggcucacccuccccccaccucucuuugaucaagcaucuucucacgucccgcgcuccccacccccaggucagaauggagaccacaggaucacuguccccaucucuccaacagaaggauugcaaagcccuagcacucugccuccugccaugggcucuggcacugaagcauuuugaggacagaugcuccccgacuuaggauggagccgcguccugauaaacccgucguacauugaaaacacaacuuuccccuuagaauauuugcaacauaugaugguuuuauccagacauaaccccaucuaggucaaggagaguacugaauuaauaucguuuuugcaccaucguaaagucaaaauauccuaagucacggacugucuguauaucacacugaagcuagggacugggagaagaugaauuuuuccugaaaugaugucaggagaggagacggugaaaggggauuucugucucagggaccagcucuaccugacaguggaaccucugaggacagaggaaagcugcccacagccuaagcccuucuuuuccccaguaugcccgggccucugacccuccuccccuuuuguguguuucaucccaccugcuuccagcaccagaugggcagccuggguguugguggggagaaggaagagccauuaagcaucucccaaaccugguuuucuagaagacgacaaauagccuucuaguccugagacucugccccacggacaugccugugcccuuaaggcagagagccaccguguccucugcuggguggcagguauccagccugaaccccucuguugccauuuguuucuauccggugcacagccuggucuccagucgguucucuccucacaugguggcuccugcccacccuggccugcccaccucagggaucccccacccugccaucgucucccccaucgucaagcaggaaccggcaccccccagccugagcccugcagugagcguguaaguaagcggcagccuggauucaggugggagggugcaggcuguggggagggguggccacacucugagcagcaaaugucauguacucuucucucuuggugucacucagcaggcaucacagccuccccagccaggcccucccucuuccucgggacuuacucccucugaccuucugggucccuguccuuucagggacauggugcaucuucucucuuauuaaggaaaguuuuacugucaggucucagaggcugaaagagaaccugagaaagcuuuuaacaccccaccguaagauauaugaaaaggugaggcccagaaaggagacaguguuuucuuaaggacuuguggugggcugguggccgagcugagaugagcaccaggguccuuaccuugcccguguaccauaaagauggcaggaagccaaagucagugcucccuggagaucccaagagaacccccucccaacuugguucugcccagagugccccacacuguguccugucaccgccgccagcaccugccagcuccagugagagcucaucucagcaaccccaccaugcucuguuccucugucaggaaauuggagaguagauuuucaaagaaucuggcguggagaucguucaaaggugggaaacuacgggaggaagguacucagguguugagugcagccauggggccacuugaauuagcauccaggcagcccgcgccccuccccagagacaaucagcgguguuucagugacagguggggauugaugaguugugugacaccugacaugcuaaccuacaaccacgugccuucccaggaaaucaccagucaccgugaaaaaggaggaggaaaagaagccccacgugaagaagccucugaaugccuucauguuguauaugaaggagaugagggccaaggugguggcugagugcacccugaaggaaagugcagccauuaaccagauccuuggaagaaagguaagaccugcccucucccuccaggccagggaggcagcgucccugcauugauggcuccguguggucucugacccucucucccccaguggcacaaccugucucgagaagaacaggccaaguacuacgagcuggcccggaaggagcggcagcuucacucgcagcucuacccaaccuggucagcccgggacaacuauguaagugcacacucugggcagaggacgcucagaccccaggaacagccucugcaagaggaggaagggugaaggaaagcaacugcauuuauuuuuauuuauuuuauuuucuuuuauuuuuugagacagaggcucacccugucacccaggcuggagugcaugcaguggcgcgaucucggcucacugcaagcuccgccuccccgguucacaccauucuccugucucagccucccgaguagcugggacuacaggcaccugccaccacacccggcuaauuuuuuguauuuuuaguagagacgggguuucacuguguuaaccaggauggucucgagcuccugaccucgugauccgcccaccucggccucccaaagcgcugggauuacaggcgugagccaccgcgcccggccagcgacugcauuuauagaggacucuuaagaucagggagaagcccauacuucucuagaaauaaggaagguguuuuaauucucaggaggucaacaaguccugaggacggacuucaguugaugcauuucccuuugaacuggacucugcccucgauuucauaacacagggcacgggguuagcugugguaggaagaguugucuccagccacuccuaacccagggcucaaagaccagugugugagccucagggggcgugucucuaagcucccggaaaccaagccaauuuucgcaugcguguucuucuuugcuuuuuuucugguaagaggacccacaguugcaucaaacuuucaaagggaccugggaccccucagaaaagaucuagaagcacuguucuagggagagaaacagaaaaacagagucugaagggcaguggagggaggaggccuuccaagaaggccuggacacccgaccuggaggggaaacgcguuuguaggggaggaagggcucccucugccuccucacgggcucccacggcugugaucugaauuaucucuccacacucucccugagggaucgagagcaguaaagggcaacguccugucuucucucugaucugggagccccugagaagccagcauucuucucucccagcuuaccucuuccuuuggcuguauuuuccaggguaagaaaaagaagaggaagagagaaaagcagcugucccagacacagucacagcagcaaguccaggaggcagagggugcgucucggggcacuggccucuucuccugcuuuuccuuuugucacagccacaccugcccaugcugucucuagcucccugaugggucagggcuucugccucgguauucgcgggcggguauuauuaccccuuucucgagguggccacuuaagaggcucugagaugugaaggcauuuucccaggcacucugcuucagugguggugguaggauuugaucccaggacuuugucacuucaaagccuagacaaucuaauuccauugaaaagugaaucauccuaccugaggguuaauggaaugagguugaaauugucuuugaaauacccuuaggaaggcagcacaugagccccugacaucccaccugu

SEQ ID NO: 14704 - RNA, 3949 nt, Homo sapiens
caguggugguuaugguguuaauggcagugauggugguggcaguggugguagugguuggguacguagccaucuguaucagccacagcauccuccacaugcuaucacauacaucuuagauaacuuugccccaacccucaaaaucugcagugguuuccaacugucuacaggaaaaaccacacccuacuuaccuucuaggguaauuuugaagugcuuuuguuuucaaugaaccuuuaccuuucccauugcugaacaugcugugguaucacuauaccuugcuccuccuucuauugagaaagcccugcucucauucucacuucucuaggucuucuuucaaaugauuccucuuccgugaagcagcaccaugucccagaguuaaccacuccuuugucuacuuucccagaggguuuuacuuaaaucucucuuuagcauuuauuuuauucugccuuuuguguaguuaguuggcacaugucuucuguagccuccacaggccuaguacaaugaugggcacugaguucuuaaaaaaaagcguguugaauuaagcggaacaggaacacagcuucugaauuucucagaaaucagcaacccaauauccaaaaucuuuuagcuggcugagaccuauaguugucaucuggguaauauaggcuuccuaccaauagcuucaauuguagguuaacuguacuuccccuuauuucaguaggauuucauccugaacugggcucagggagggaaaugaaaguauuugccuucccugaacuuccacaaguucaccaugcuugggcccugucaauguguacauagaauagaauagaaccaacaagacagugggggaggagggcugguagcagcuuggcuuuagcauagccaaguuggagcaggcgaggccauaugauacuucaguuacaauucagugagcacuuaugagugucuacuaagugcugacuacugugagagucaccaauaucaauuaauaagaaucuuucagccgggcaugguggcucacgccuguaaucccagcacuuugagaggcugagacggguggaucaccagaggucaggaguucaagaccagccuggcuaacauggcgaaaccccgucucuacuaaaaauacaaaauuagccgggcgugguggugcaugccuguaaucccagcuacucaggaggcugaggcaggagaacucgggaggcggagguguggaaguuguggugagcugagauugcaccauugcacuccagccugggcaacaagagcgaaacuccauuucaaaaaaaaaaaaaaaaaaaaaaacaacaaccaaaaaguuagccaggcgugguggcucaugccuguaaucccagcuacuggggaggcugaggcaggaaaaucgcuuguacccgggaggcggaggcagugagccgagaucgcaccauugcaguccagucugggagacaagagcgaaacuccgucucaaaaaaaaaaaaaaaaaaaaagucucucuauuuacucuaaugggggaggugauguauguguccagguaccaggagggaggugcagauaggaguucagagagaaugccuuugggcaugagucucccugccaagccuagguguccugacucuggucugcuguggcuaucucacucaccagauuuuaaauuccucguggacagggaccguaucuuauucgaauuaacugucuucacccagugcccagccucuuggggccgggcaaaaaugugggacgaaucucuaagcaguguccuauccaccuuccuuaaagaaaacuccaccccugucuuuauaagccuguuucuucugcuucugaauggccugcagccccagguucccaacugucaggcccccuugggcugguccuauuccuucccuguggguuugaggugucaucccuuggagcuuggccgccagcgccagcgccagcccacccuuccucccucccaccacauccccacccuuccugcugagcacugggugguagcagaucagucuagcacuuccucuaauggcuaauguuuuugugggagguucugaacuaggguuaaaagacaaaagcucuuccccccuccccucccccaguucuaguguugguucuucuaguucugacguucccguugcuguaucccuagaucccgccuuuguuuuaagcucccgaagaaaggcuuccggagacuuugugaccucacccaauuuccaacauuccagauugucuuuucuuucuuuaaaaucaguguucccuucugagucagcuaggaggaggccagagggaaacaguggggcuuucgaagcuuaucaaaagcaaaccuugcucuuuugaaaaagcauuuuccaacgcaaccuggggacaaagugggguuaaauuuuacacagauugcuuacgagcaagaguuaaguggcuaacaagucaugaaaucuuacggagaagcagguaaagccaaaauuaaaaacucccuccgagucagcccauucugcgacccaccuccuccccuuugcggcaggaacucuacuccaucgaggggcuuugcugcaguggcacugcccacgcauacucaacuaaaagacucagaccacgccagccaugccacgagguguguuuuauuuucauuauucauacaaauaauuuucuauaauaucccggggcaaaccggagaauuuggcaguccgauugggggggggucccuucagagacccacaggccgguggcaucggcgcggagugcccagguucacagugcagcuuguggcucguguccaucuugcagguggcucuuccuccacaucacgacuggggucucgaagaggacggggguaggaaauccuccaggaucuuaggaaauuucacuccgcuucuccugcucaauggcuguggagagcgggaagcgggcgcuggaggggagcugcaacccccacccgcaaccgaggugcuucccggugugggcgaggcacccacgagguguggggauuuagaaggaagcuuggggcuggggagaaacaaggcgcuuugugaaacugaaagaguggccggggccgcccacaccggggacaacggcggggugggggguggaggaguggguuugcaaggaagagcagggugaggggcugggcuggggcgcgggagaccgaggcacacucacucucuuuggucggcaggguguucuucuccugcgucuccguuuucuucagcuuggccuuaucgaagcuggcgauuucccccaugucugguuugucugccauuuucuuaaaacaauccuagugggcaaaccaaggcgcuugaccugggccugggggccagcguccccuuccgcgcuccccgccgacgccucucgacguggcacucgcgccaaggcgugccgagcagccccaaggccgaggaucugggcgcgucccgcaccccucuucucggucccagggcguggucgccggccccugcguccgguccgagaagggcgccugucgcgguugcggcgcgcccgcccggugcaccggauccgaccacacccugggugggccccccgccccggcgccgcacucaccgugcagucucguuccgagcccgagauccuggugcucccacucgcguugcugcagcaagaaacaaaagagcggcgcccgccccuagccuuauauacgccgcgccccgccccgccccucacccgccgcagcaggggcggugcuggcacccgaggggcgggagcagcgcgggcugcuccucgcccugccgcgccccccgcugggcuaccagcccggcugggcgcggcuucucccgcgccgggcacccccagcucgcagugugcccagcgugggggcuguagucgccgccagagugggcgccaggcccccggcuuugcuuuugcggcuacauuucccccuuuccgggaaucugcugcucaccccgcagaaaggauaugggaccggcgugggagggugugugguuuugugcgugugcagauaugaugugua

SEQ ID NO: 14705 - RNA, 36026 nt, Homo sapiens
acauugcccacaaugccacgcgcuggccagucucgcgugggguuuucccucagcugcuguuauaauuaauguuaaucaaacccacauuucuaggaaggagccgaguuauuaucugccucuccgauaggaugccucuuugucuucaccugccauucccgcuguuucgugaagaauccucuguaaagggaaauuuguucaggcgacugcuguggccacccucugccuccuccggccucugccccugggagguccccgggggccugggagugucauuggcguaugaccgcaacccuugccgcugccgcugacaucgcuaccauggucuccggcagcagcggccucgccgccgcccgucuccugucgcgcagcuuccuccgugaguccagccaguacugucuuccuggcgcccgcggguuauuggccccgccggacccaaccuccuggcccaggccgcggcugggcccucagggcuggaccucggcgggggccugggagccgcuugggauuccggcuucgagucggggaccccuacgguggaaggagcuuugcuggauacguggggcggggggcaugacuuaggccgcuggcagauggagauauuggguggcugagccaggauucggguccgggagcccugcaaauuugggagcuugcucucggccccgcggugacaaaugacaggauggggguggcgucuagacuggccuuauuuggaguuggggaugaagagguccaaggugaacuugguggggaagguaagggucuggguugagagguagaggaagagugucucaguaggaaguugggggaugaggcugucccuaguacggaaagguccugcacuucgaauucccccucugcaggauuguaugucagggaaagaugguuucugcacacggaguggggucggcauagccgcauagacuacuagaagcuuaugguuggcugggaccuaaaccagcuuauuugcagugucuccaccaggcgauuuguggacacauccguucccgaaaacuuaguacccaagguugcuagucuuugagacacgcugacuauggaaaauucuugccauauucaaagucucugugcuugucagguagguuauaguagaaagaaacuuuggaaucagccacaucaggguuugaagucuggcuagucccuuuucagucuguguaauaacccuggacacuuaaucuguuuuucaguguuuccaaucacaugaaaauauuaacacauuuuaaggggccugaagcaccaucacuuguaagguggaccauuauuuuguuuaccacuaacaaugaagaacgauugcuuauuaaaacugugacacaccagugguugucacauguauccugguuuuuuaaaaagugaaaaaaaaugugcauuuuagcaaugaugauguacaggaugaucuggguucacugcagaauaaguggagcaauuuauauaaagcaucucguauguaacaaacacucaaaguuaguuuucuuuuuccgcuuugcucuuaauucugcuuguacugaauauuuuaugagacuuaauuccuuucuugagaagauuacauucugaaaguguacauugaugagugugcacucaauagcuaacacuuaguugccaaucacuugaggacaaaggucuggcuagauaacguuagcaaguaugaaaugguuuguuugguaaagcuuucuggagauucuugagaguguuguaggcagaaggacaaaaagaauucauuauacccaguaaucacucaggucaauaaaguuugagcaccaagaaugaaguauauuggauaugguuuuaaaccagcuuaauuugaauagauaguggguuagaauguagaagaucagaugugcagcacagccacuguggugggaaacccuaggaagaaguugcccaccugugucuuucgcuucuguggucuugcuagucugagguucugaaagauccuagccucagguaggucugcugucuagaaaaaucuagagaauaaaggaagagugucuaaaagaucuaguuccuuacuccacccuuagcaguccucucaauccucuucccacagaacuggaaguguguucuuccuagacucccaggaucauuuggcccuagagugaccaucugguuuaguuuuguuacuggagugggcuugaauuauucaagucaugugauuaacuuguuauuacgggucugagauuuaaaccaagauguauucuauauuaagagggguuacagacaacaaugcuuaauguguaaacaccucuaaauucacaaaacucuaacuccucuuucccaugccacauuuccgagcccauuuucacucccacuagaaaaauagcagcuacaacaucaccuugcaaacuuuuuuuuuaaaaagggaccagaaauuauuuagucugugaagcuaauagagcuacagauguuagggaauuuuguucccucuguuaaguuucaacuuaugguacauuacuugcugaaggucauaguguugcaauauugauuagaguuaacagccacagaaaaaacucaagugaacacugguagaugccuuccggagcccuguuuuauagcuuaugaaaaaaggaaaaguggccuggcacgguggcucaugccuguaaucccagcacuuugggaggcugaggcggguagaucacaaggucaggaguucaagaccagccuggccaagauggugaaaccccgucucuacuaaaaauacaaaaauuagccaggugugguggcaggcgccuguaaucccagcuacucaggaggcuaaggcaggagaauugcuugaacccgggagguggagcuugcagugagcugagaucgugccacuguacuccagccugggcaacagagugagacucugucucagaaaaagagaaaaaaggaaaaggauccaguugaaguggagagagaaaauacaaugaaaaaugaggaagaguucuuccaugagaaaguuuaaggauuucauaagcacccuugaaguugaaauagugaaguuuuaagagaagcauaaaguaaugcaaggucuuuuuaaaacuggucaguaguuucuguaacuugaaucuuuuagaauaaauagggaauaaaagccaguauuuuugaaccucagaauuuugguauuuuaaugccagaaaguaaaccuuaaaacccaacuggucccauaccuuuguacggcagaugaggaaaucccaaaaguuuccagugaguaucagaagugauacuagcacccaggucuucugacucugcaguauccuuuccgccagcauguaccaugugauaacuuaagcuuuuuucgaagcucugauuuuuuuuuggcagucuuagugauguguugagaaggugacuauccugcucaaagguguugccuuccuuuuccccguguuugccaagugcguaggccuguuuuucgaaucagagaugcauuuaaaguguaguuuggaaaaugagauccucaacagugauguuguggauauuagcaucuguugccauugcauguaauaaccaaaucuuuauuucagaaauacaaaauagccuugauucagauguaccaguguagccaugagaaagugauuugauuuucugacaucaaauuuguuucuccauagaaauguaauugggaauauuaaaaauaauuuaaguacagggcaacaauuucauuucaucaggggacuggcauaccauagacccacauuuuuuuuuuuuuuuuuuguuuugagacggagucuugcucugucgcccaggcuggagugcaguggcgugaucucugcucacugcaagcuccgccucccagguucaagccguucuccugccucagccuccccaguagcugggacuacaggcacccgccaccacaccuggcuaauuuuuuuguauuuuuaguagagaugggguuucacuguguuagccaggauggucucgaucuccugacauugugauccgcccaccucagccucccaaagugcugggauuacaggcgugauagacccacauuuuuuuacauuauaacauuucuuacauuagguugugucuuauuacugauauauauguuuuuuuugagacagaguuuugcucuuauugcucaggcuggagugcaauggcacaaucucagcucaccgcauccucugccuccugggcucaagccauucuccugccucagccucccgacuagcugggauuacaggcaugugccaccauguccggcuaauuuuguauuuuuaguagagacgggguuucuccauguuggucaggcuggucucaaacuccugaccucaggugauccgcccgccucauuuuuucuuuuuuaccaguaauuaauaguacuucuuaaaaaucaaugguguuuuauauuugaugaaauaugguacuuacagcuuauuaaacuucacucguaagucaauauuaaaugaauauauaauuuaacauuugaauaguggguuguuuggaguuuagggguaaguggcugcuagcuacucugcuguauuauaagguccuguagguguagacugcaguagccugugucuuacauaugcauaauacauaugguuaauaaguguacauuuguuaaauucaugaguacgugcacgaauaaauguuuaccagggacacaguuugagaggugaguugaaggaguauugaguauuucaugaauagagccuuggguuauugguuaggagcaugguacuggucauacaaggcccaugguuugagucucuccugggcaggugcucuuugaccauagauugcaucauucaucccaccagccauuuuauaaaugauguguuacuaucugugguaaagaggaccaguauguggcugacagguacaaaucuaucaccccuguugaaaacacaucucucucagauuacucagccucuuuccuucauugucuuuauuacaguuuguacuguugguaguuuuguuuuuuuuugugcaauguuuagcucuuuuacagggcaggaaacuucauguggguagggccugagccugucuuguucaccugugaaucccuagcaccugacagauagccugucacagucaacaucucaaagcaguuuggucugcucauucugcaucgguaauaauaacgcuaauaaaaagcucuuagggauauaacacuugcuguaucuguuuuaaaugcuuuauauauuacuaacucauuuaauucucacaucagccuaugaaggagauacuauuauuguccguguuuuacagugagggcugcgccuuuacaaauguauuauauguuaaaaacuuagagguauauuugugcauacugcacauuauaugcagacauggauuaguauguuuauaaauaaacauauaagauguacacaaggacauguagaaaacauuuuuggcuagacuuauuugauuuuaaaauaugaacuauuuuuucucucuuuuuagggauagauuugccuuuguguucauguaggguuguaaacccaguuuugggaguguaccagagacugugcuaccuggugccaauuuaaggaguaauuucauauuaauaucacagccucccaggggcagcuguuauuccacuucuagaugggaagacuaaggcuaagggagaucaaaagguaugcucuggguuacauggcugcuggaaggcagagcauaaacucaagaccaggccugucugauuccugcgaugauguucucagcugcuccugggacgcagucccaagguuaagcuggacaauuucuaagaaucuggaaagaaggagguggccuaggauguggcaacuacagcauucgccaucagaaauuuuuccugguggccaaccucaccuuuccugcucuaauauuuaauuuaaaauacuuauuuucggcugggcaugguggcuccugccuguaaucccagcacuuugggaggccaaggcaggcggaucacuugaggucaggaguuugagaccagccuggccaacauggugaaaccccgucucuacuaaaaguacaaaaaaauuagcuggguguagugaugugggccuauagucccagauacucaggaggcugaggcaggagaauugcuugaacccgagagguggagguugcagugagccgggaucgugccacugcacuccagccugggcugcagaguaaaacaacgucucaaaaaaaauaauaauaauacuuauuuucuucuuauuaguaaagcuaggcaucucaucauauauggauuugcaguuugucauccauuguguuucuuguucauggccuuuaucaguuuuucucuuaggcuuugggcuccacuuuuuguuggcucuucauguugcucacguuaauuccuugucuguuaaauguuaggaaaacacuccccuggucugucauugccuuuaacucugccuaugguguguuucacucugucugaaugcuugcuuuuuucauguagguaaagauucaauuuguauuauugcuuuuggguuuuauuuauuuaaaaaaaugucagcauggcguuuguacuagauuaauguagcuuuggggaccgccagaagcauuuuagggccgaacuuccaugcagucucuauaugaauuuuagggaaaccuaugaucuuuauauguacaaaaauagauauaggguucuuuucccucuuugcugauacgugggaguucaagauugacuuuuuccaacucaccgaaaaagagacgaaccuuaugguguuuagcuugguagaaguguuucuuuuggagacccuguuucuuguccuggaauucagugaaauguuucccauagaccuacuguguguaaggcacugaccauauaccauaggagacaagaugaguaagacaugguccugacacucauggaguuuacaguuagcagugggaaaaguauuuagaugguacuugaaauagucuugaaauaaauuuaagcuuagauaauuucacuuaaaaauaacaugaugaaaagaguaagaauaugugugcacucaguaauguagugugugaugguguuuauuguauacccacaugaaagcguuuguagcuucuauucuucuuaaucucagaucccuuuuaaagucccccaguauacucauaaaucauguauaucgugugaagauauaggaauucuugacuguguaauguuuuauuuaaauguuaauuuauauggaucaauguaagugaaauucucagaaaguugaggacauuaaaucuuuaauugaaagguaagagauauuugcaagaugguuuggccaccaauguaugccuuguguucuaaauuucacuuuaggaagucacuuacuguaguaauuugguggcuuugucacccuccccaccucuuacacauucauagacuucucuaccuugaauagguguggggaguuuauccaccccaaaugcccaaggcuuuuuuuuuuuuuuauuauaguacuucacacaccacgcaguuauggcccacuuuuauaugaguucagauagauugugaauuauuugagggcugagacacugucauucaucacuuuauccuugacaccugacauuauggcuugguaugggugcuccucaaauguugauugaaucaaugaacgaacucacauuucaguaccagaugauaaccuugucuggcaucauacagguuuauugucaggauggaaugugaucaggaauuucacuuccuugccauugaauacauuucuuggauuugccuguaagacgauaauagucuguuaguuccagcuuaucuagaagugggucuguaugagcccaggccugguguguagauggggagaucacacaugcaugagcgcacacacaucuacaccugugcauuagagguuucccaagauuuaguuaauuagaugcugcaggcucucaggggcauugcacaggcugaguaacacuaaaaggcuaggggauugggagguaagcugcuguuuaucacacuucugauacacuuuuuaugagcaccaaagaucugauguuguaaaaucuugagcuccauagaauugauccaggagaucuggaguuacuacgagaaagcagagaucuucguuggucuguuauuggagcugugcuuuagggacacagacagaccugccuuuucucagggugacuucugcuccuguggaaggagaagugaauugucugaucuuuguuaaguuagugaguauaagaguacuugugcagaaccaaacuuuaccuacaaaaaguauuuuauguuaacaaguagggacuccagauauccugaucauaacaucugaucuuauaaucaaaucuucuaccuucuggucugaaaacauaugguaugauaugauaugauaugauaugagcauuuguugaagaugcaaugggagggacugguaaagccaauuccacuagucagaaauuguagcaggguaggaaaggguguagcuucuacacaaauaccaugguuguagguguucagcugggagaaguggaagccaagggcaagaaugggucucgaaugcagcacuggcaagggugggcugugcugcacagcucaguagggacagggucucaggccauaaaucccugcuguguccacuggccuagagucagaugcuuagcugugacugaugugccagaacuugaccugcaaagcccauggccccuuguugagcacagucuaguaugagaaagcugccuguuacguagcaguucuuuguguguaccaaauauuauccaggugguaagggcuaaaucugggccugucuucucccuagagguguaagggauuccauauacuuccuccagaagcagauguuguugcucuuucaguuauguaaugugaggucaggacuuagguggguaugaggcagugauuuaaggcagaaagcauggaguggacucugggcaaauaugugacagguguucuuuuuuuguuguucaauagagauuacuccuuauguucuuuucuugggcuagcuucaugggcuaccacaaugauagguagaaggccuggcuacuuugaaagggccagggaugggccacagagaagucagguuguuaguauuaauggacauuuagaagguagcccaaaauuuuaagucaucuauguuccuccuacuguguuuugaaauguggggagcugguuguaguaacuauuuagauuucucaauuucucuuuuagguagguugcugcaauaaccuaggguuuuuuuuuuuuuuuuuuccuaacaagcuuuuuccugucuugucuacuuuccuauuuguuuuauuuucccugugucuuuuauacaugaguucauaucagaagagauuaagugauuuuguauuauauuuuagauaaguuuuauccuaugacuuaacauuuaauauguuguucuuacuagagaaugaguugcugagugauuuuuacuuguauuccugacaaaguuugccucuuagcuuaccuauuuaaagguauuaggcuuuaaaaauuugggucaaguggggaaacguggcuguuuaguaaacauuguuaauaggggugacauuuuguuuucagucccuggauuuaauuuuaaccauuuaucuuugagccccaguuuuuuucuaggaaauaaaaaugauaaacauugcuuuuuuuucccucaguucaggaaaaaacuacaagaucgugguucuugauaaagagaggauccuggagaauggaacaaugucuugucuguuuuucuuauuucuguggucacugugucuuauuuaaaagguggcauuuagguuugccgugaucacaggauagcgcgugcauuaaagaauuuuuuuuuugugaucaaguugaauuauuguucaaaaguuuagaaaaauuauaaugugucuuuuuuuuuuuuuuuuuuuuuuuuuaaccucuuagugccgcagaauggaauucggcauuguuccuacacagcuucucggcaacaucucuauguugauaaaaauacaaagauuauuugccaggguuucacuggcaaacagguauguauaucuagauuuuuauuuucaaauguagacuagagauauaacaaauuaacuauuuuuuuauuuuuaauaucucaaaaauaacacaugauuguugcagaaaaauauacuguacagcaaugggguuguaucucaggaggagguuaguugcuauugucagccuauaacauaaaaauuguguuuaaacuuaccuugcaaaggaguauauuguaugcuuacuaggaguauauuguuuuggaggcccauacacuuucuuucagcaaauacaacacuaaugauuuuccuccaguguugaaagagaucaccguuucuuugacuaagcacuaggucaacuagauucuuguguuuagguuuuguacaaacagacaaaaaaccguauuguuaaacacagaauccauauucaguguggagaaaugcucaaacccagagaggcucauggauacugagacaagggaagaacccgcccacugacuuuuuucaucuuauacuuucucugggaugauggccugggacuagcaggcagaauugccugaaguguuuuaauuuguugucauuuauuuauauucauucucucauacucuuuccuguucuuuucauagauuuuguguaaguguaaauaaauauaucugugaugcaauucuauaauaaaaugccacauaagaaucuucuuuccuuuuuccuaccuuucuacuccccaggaacuccuucuguuaacaaguuggcauguauccuuucagauauuuuucuugugcaugcaaacauauuuauauaauauguguuuuguaguauuuauuauauagaauuauauauauuuauauaacguuauccagcauauaauauauauacaauccauauuucuauaaaauagauaccuaaaaguaaaauuggauguuauauggucuguguauuuacaauuuuaauagcuacugcuaaauugaacuuuaaaacauuggaacagauuuauucuuccaccauaguagaugcacagaauuuuuuuaaaagggaauacuaucaaaucaauuagaguauaaccacgugucuuaacccaaaguaucccuuuuuuuauuauuaaaggagauauggcaagauaaaagcagucaauuuuuuuuuuuuuuuuuuuuuuuugguaauuuaagguuaaugauuuuucuguaauuaaaagaauugucaugucaauucuucaguauuuugguaaucuagagcagaggucaguaaacauauucugcaaaaggccagauuguaaacauauuagguuuagugggucauacagucuguguuacaacuacucaaaaguauuuuaacagcaaaagcagccauagaaaauauugucaaugaaugggccugggugcguuccaauaaaacuuaauuuacaaaaccagguagugggccaaauccuauagacugcaguuagcagauuguuucauguaaaaugguccuuuugcuuuuuguuuuuuguuuuuuguuuuuuuuuuuuucugaaauaacugagcacacgaauguguugcaguggaccuucuuuuucuucuuccauuccucuauuacuguaaaaaaaaaaauccaauaucaaaaaaugaaacacccauaaaaccaugaaacuuuguuccuuguaaaaauggcaggaugugguagcccacaccuguaauccuagcacuuuagggagccagagcagcaggauugcuagaacccaggaguuugagaccagccugggcaacauggugggauuccaucucuacaaaaaaaacagaaaaauuagcugggugugguggugcaugccuguggucccagcuacucaggaggcugagguggaaggaucacuugaguccaggagguugaggcugcagugagucaugauugaaccacuuacuccagcuugggugacagagugagacccugucucaaaaaaaaauguuuauucugauagcuaaauaaucuuauguaugccacuucccuuauauacauucuaaggaaaguagaucuucauccaagauuugaagugcauucuauuauccccuucccaguugauguuauauccagccuguuuuuuguuauauauuaauaugauuagcauauaaucaaauguuugauuaacccaaauucuccacauaaauuuauuauauauaauuuuuucuguuugccaaauauuauaugauuaugugacauuuuaagcugugagcuuuuuuguaagaaccauugcccaugguguaagcacuauucagaacugucucuauauucuaaauaaggugauaguuugccuaaauauuuaaauccagagguaguuacagcguuuuucaguuaccugcaguuaacauuguuucucauucacucuccuuuuuuuuguuguuuuuaaaguaagugagaguguuaauugccucagguuuguugauucagauucauuuuagagauaauggugaggucugaaguuuagaacuuacuuccacaguaaaucugcauauugucucauuaguuuguuuucucaguacacacauuguuccacauaugaauuaaaaauccuugcauuuuuagaguauguuucagcaaugcaguuuuccagugggugucaucuuguuucuuuuacuggguuuauaagcugcuaaaaugauuacuguuccuaacauuguacuggcuggugaugaugguaaaacuaagaaacauaagcuuauuuugaauagauguguuauuccuguuuagcacuacuuuaggauuaaaauuugguacuucugaauuuaccuggcaguguagucuagggcagugcuucucagugucuguagcaaaaaaccaguguaggugcuuguuuuuaauuuucagucuaauguagaucaauauuuuuauaaaauacaguaaaagcuguagcaaugucauacaaacauuuuuacuuuuuuaaauugcaaacauuuuuacuuuuuuaaaaauuagauuuucccccucccucucucccuuccuuccuuccuuuuuuuguuguuuuucuuuuuccucuuaucucauugcagagcagcaagagucuccaaacuauacuuugaauagcacugcuuuaagagagagagagcacuggccugugguucuuucaaaacccugccccugacuuuagacaaauuaauuaacaugcuuggggccaaguuuccuauuuugaaaaagaauuugaaucagaaaauuucugagguccuucuuaaggcccugauuuuuauuccuuuaacagaacgugaauaguugggaccacauuuugaagguccuugaaaugaucacauagauucguucauuuuucaacagcuauuuauugaaugccuacuguauauugauuuaggugucauauugcaaugaacaaaguggacauaaaucacugucuucauggaauuuacauuuuagugguugguggggaauauaucaacaaaaucaaugaguauauuaugugguauguuaugaaguauaauugcuauggaagaaauaagccggggaaaggaggaguguguguaguccuggugguuaggauggaggagagggugauuuuauaucagguggucaggggaagucugaucucugaacuaagauguuaaggagauguaggagugaaccaaguggauaucuuagggaaggauauuccaugcagagggcacagugaggccaugaggcaggcaugugccugcuguguggaagccacaaggccagcguggcuggaguguaauaaguaggcagguacgggauucugauguggggagacagcuuguaaauugacuuguaggccaguauauggaguuuggcuuuuacuugacugaaaucuaagacaaucagaguguuugauuagaggagugccgugaucuucauuauguuuugaccagaucacucgggcugcuguggggauuagauugaaggggagcaagggcaauaacccgucaagaguugaagugacuuagaccaaggugauagcaguagaagggggaggaguugucaauuauacuuugaagauagagaaauaagcucuacuaauggaucuaauaugggacauaugagaaagagaauaaucaaggauggcuucaguauuuuuggucugauuaucuguaaggcgugaaguugucuuuaacugagaugggguagauggaggggagugauugggaacucaguuuuggacauguugaguuugagaugccugcuaguucucaaaguggaggugucagguaggcaguugacaaugugaauauggaguucaaggcuuagauaugugggguguaugugucuuuguguaugugggaggggucaccauauggaugauauguauugccaugauaagggaugacaucaccaagggcaugaauuuagaugaaaaagagaagucuaagguguugcgggaagucaggaacccugaacggagggaccggcugaagccacggcagaagaacauaaauugugaagauuucauagacauuuauuaguuccccaaauuaauacuuuuauaauuucuuacgccugucuuuacugcaaucucugaacauaaauugugaugauuucauggacacuuaucacuuccccaaucaauauccuugugauuuccuaugccugucuuuacuuuaaucucuuagucccaucaucuuugugagcugaggaggauguaugucgccucaggacccugugaugauugcauuaacugcacaaauuguuuguagagcauguguguuugaacaauaugaaaucugggcaccaugaaaaaggaacaggauaacagcaauguucagggaacaagagagauaaccuuaaacucugaccaccggugagccgggcggaacagagccauauuuuuucaaaagcaaaugggagaaauaucucugaauucuuuuucucagcaaggaacaucccugagaaagagaaugcaucccugaggguaggccucuaaaauggccacuucggggggcggccaucuuuugugguugcagcuguagggaugaaauaagccccagucucccguagugcucccaggcuuauuaggaugagaaaauucccgccuaauaauuuuuggucagaccgguugucugcucucaaagccugucuccugauaagauauuaucaaugcaaugcgugcuggaaacuucauuagcaauuuuaauuucgccccgguccugugguccugugguccugugaucucacccugccuccauuugccuugugauauucuauuaccuugugaagcacaugaucucugugacccacacccuauuuguacacucccuccccuuuugaaaaucacuaauaaaaacuugcugguuuuacggcuuagggggcaucauggaaccugccgacaugugaugucuuccccggacacccagcuuuaaaauuucucucuuuuguacucugucccuuuauuucucagaccagcugacacuuagggaauauggaaaagaaccuaagugaaauaucgggggugaauuuugcccaauaucuggcugaauuucccccaauacuaaggagagagaaagagaagaggaaaaccaggggaagucaagccccagaagccuagugaaaaugaaucaguccuuggagcuguuuuugguugucauuaacuggauggaauuaugagaguuaggagggugugcuacuggcaucuaaugaguggagcccauggaugcugcuaaaugucccacuaggcacuggaugaccucucauaagaaagaaucauccuguccaaaaugucaauaaugcugagguugaggaggaaaagugaauggauagagaaauacagguuggugggugggcaguauugaaggcuuacuuaaggugagugaucauuaauuuaaaaugagaccaguugacauguuuuuuuguuuuuuuuucccuuagccacuuuuuggcugcacauguauaggcuuagaaguaggggaaaaauuggauuugacccagguugugguuuugccagauauuuaaguugaagugagagaaagccaagauuguugugggaggguaaugaucuaccaugaauuuuaaacugaggagugugagcacaugaggaguugagaaacagggaguuucugguuaucagccaaguuugaaaacagggaaucaaagaggccuuguuuauagcuauuuuggcuuuucagaggcuuguuuugcuucaagauucaaagcuauguuuaguaaauauauguuauugucugggaauaguuaaccuauuuguuuuucuuuuccuaaguugcuaagauugcuuuugcuucucuugggcuuaccagucugcuguuucucauggaucuugugcuuuuuccccucagggcaccuuucacagccagcaggcauuggaauauggcaccaaacucguuggaggaaccacuccagggaaaggaggccagacacaucugggcuuaccugucuuuaauacugugaaggagguaauuagugguaccugaguuuggcaagacaagaaaagcaagggaagagcgagcauucuuuggguagagaucuuaauuauguuuuuuugguagagucacuugcuauuugaaaauucaguaaccuagagaaauuugaauugccaucaaaaccaguguguuauuuuuguuucuagguaugaaucagcuauuaagggaggaaguacuguggccaggcuucuguugggcuuuuuacgcuuuccuuaccuuucuucuuccaguauguuaguaguacaaaugucagcaaccaccccuuaauucuuccugaguggggacuaugcaguaggcacugugcuagguguuucauucaaauugcccuguucaggccucacuacaacccucggagguaggugcuguuaucauccucauuuuaaagauaacgauguuacuagugcaaagagguuagagaucuugcccauggucucacaacugauuaaguggcaggcuuaggauggcuuggaguagaguggucccgugugaagaaacuaaauuguagagucagauuuacaaaucacaguguccuagauucuccgcaaacugcugauuucuuaauaguuaccuuuuaaaaugauuuuuaaauuaaauuuuauuauuuguuacaaaacugauagguacuuuuuguaaaaauucagacgauacaaaaaguaaguaaaguuaaauuuuacaguguuuucgaaaucucagauuuugccucuguagggagcuaauuuaagcucaguguguagucuuucauucucuuuugacucuuauaugaauauauacaaaacuaauaguauuuaaaagaaacuauaguguaaauucuuggguauuuaauuuuaaaaaucuaggaaauaaacuuaguucuuugggaugauguguugaucagccuuaaauguauucuuccucucuucuuuugcauauuuuuaagguauguuuuaaagcauuacauuuuuuaaagcacaaauuuaaaguccuuccugccuuaaauucuauuauggcugauuuuauaaccucaaaauauagagaggagauguuuuuuuacaauuccucuagguugacuuuucuuuugucaugagccucuuuuugcuuuuuuuuuuuuuuuaaagaaaguucuucuugcuaagcaauccauuuauaauuuauagugacacaaauaguugugacauuuggaauauucuauaaguuuuuugacagauauuguuuauuuuucacccguucugcucuuacaaagggcuuuuugaaugaguaggguugguaccuuucauccauaugacgucccagcacaauauuugcuguugucacaguauagcuucuggcaguauuuguagacuuuagagguagaaaacuauguaauguagguacuuuucauuaaaguaccuacauccccaugaugugacuuuuuuugauuccauacuaguuuuaauguuuuuugugucucccccucuguuaucaucuugaacagaguuuuaaaaaauuauuuuuaacccccggcaucauuuguggaugauauguuggcauucuuugacucuguucacugucaggcugcuuucagauuuacugacaugccauagagagugagaugucacagaagcuuucaauucacaguggcauucaaaugggcugagaaagggcuaugcuugauucuguucuacucugacaguguagcaaauuugagaaugggaagaaugcuaugucucuggguaguguccuuuucuuaccccaagacauuauuaaaaugaugguauugaauuuauuuuacaauguuuaugauuuaacaaauaauaaggugcuucgucguuaauguuucaggccaaagaacagacaggagcaacggcuucugucauuuauguuccuccgccuuuugcugcugcugccauuaaugaagcuauugaggcagaaauucccuugguuguguguaucacugaaggaauuccccagcaggacaugguacgagucaagcacaaacugcugcgccaggaaaagacaaggcuaauugggcccaacugcccuggagucaucaaugugagugcaaaaaaacaaaaagaaacucagauuaagccucucacaaggcuaaacagcuuugagugaaugcgaguguauuuguguguaugaccugugagugacuuuuuuuuuuaacauuucugaaaacuaugauuacuuucagccuggagaauguaaaauuggcaucaugccuggccauauucacaaaaaaggaaggauuggugaguuuguuuguuacauucuuauagauuaaaacguuauuugccuuaaacccucaaaacucacaaagaauuuuugacuuugcaaaucaaguuuaauuaauuugacuugaguagaauuuaccagggaaguuuuguagucuaucaauucuguaucuugaauauaaugaguuuauuugagaagccguuacaauucugcagaaucagugaagauuuuuuugguggugggaguuuaaagauuuuuuucugcucagcacucuguggauuacuccauguguuugcauauaucaguaguuaauuucauuaacuguuauaacuuaguuauugcuaaggaguauucuguuguauaauuauaccacaguuuguuuauucauucucccauuaaugaacauuuggguuguuuucauguuugagccuuacaaacaaggcuuaggucaacauuuguguacaggucuuuuuguggaaacauuuucguuucucuugggcaaaauguguaggaauggaauugcuaagucauguucauaugaacauaagucaaguauauuuaacuuuauaagaaacugccaaauaguucugcaaaguggcuauaucauuuuauauuuucaccauuaauguaggagaguuccacuugcuccauaucuucacaaagauuugguauuguuagucuucauuuuuuugagacagaguuuugcucugucgcccaggcuggagugcaauggcucgaucucggcuuacccccaccuccgccucccagguucaagugauucuccugccuuagccucccgaguagcugggauuacaggcaugcgccaccacgcccagcuaauuuuguauuuuuaguagagacggguuucuccauguuggucaggcuggccucgaacucccgaccucaggugaucugcuggccucggccucucaaagugcugggauuacaggcgugagcuaccaugcccggcuauuagccuuuuuaaauguagccauucuacugagaguaaaaugguaucucuugugguuuugagugucccugaugacuaauaauguagagcaccuuuucaugugcuuauaaggccauucacauaccugcucaauaauuaccuuguucuuuuagauaucacaaacuuucucaaaauguuuuagguuuguaggcaccuuagaaagcagggcagugaucagaaagggaacucagauggccugucaggaaaauugcccugcuacuugguuaguuccuugaggaaauagccaaaguaacauuucaaaguuagccacauuaggcuuguguuuaggcuuuacaccaaaauuucucuaaacuauacuguuuuucagucaugaaagaugauugaccauauuuuucucuaucuauaaaccauggcuacuaauaaggguaauuaauugucacagugggugucggcugugcaguuuacagaauuggguuaaagaucaugauuuuucuuuauuaccaaugucucuuggagcugucagcccugcugccaguggcaguacuugauaauuucauuuacaagagagauuucagggagcuccauaggccaucugaguuccaguggggccagauccauguaucacugaugcucuuguacauauuugaauauuucuuauauucuugggucuguuuugaaggcuguggucuuaaggugagcauggaaggaaugcucugugcugaguugccuuucugaucacugcucugcuuucuaaggugagcauaaaccuaaaaaaugaaaaucaagagaaguucagggaaguccuuuagaccuugccuuugugaauggucauaacccauugaugagacagucgucugggagacugcuuuuaauuccuuugaaaaaggacuuuuuuuuuuuuuuuaaaaaaaagaagaaaauaugugacacuguguccagaguugguuccuuccaguggguucuuggucucgcugacuucaaugaagccgcggaccuucgcagugaguguuacagcucuuaaagguggcauggaccugaagagugagcagcagcaagauuuauugugaagagugaaagagcaaaccuuccauggcauggaacaggaccugaguggguugcagcugcugacuggaguggccagcuuuuauucccuuauuuguccccugcccguguccugcugauugguccauuuuacaaaccucuagcuacagagcgcugauugguggguuuuuauagagcacugguuagugcauuuuacaaacuucuagcuagcuacagagcgcugauuggugcguuuuacaauccuagcuacagagugcugauuggugcauuuuauaauccucuuguaagacagaaaauuucuccaaguccccacucaacccaggaaguccagcuggcuucacuuucaacacuacaagauuuuugagggggugaggagagaaagaugguuauuugugccaacucuuccuauuuugguaccauugcuaauagucucaauagccuccuugacuucagauccuuagguugagaguuaagggaaaggaaggacuuuucagucccuuggauauuucugaauggaauauaauguaauguaauagcaguauaauaguguaauggauuuccaguuuuuguuaauaacagcuaauauaauugcauaucugcuaauugaguguuaucgaagaaagugauuggauuccaaauugaugauauuuaacugcaccauguuauuuauuucucuuaugauagacaguuuguuacucucaaccacaugucacauacuugacucuucuggccucuuuuaaaauuuuaaacugccuauauugagauaacuauaaauucauguguaguuguaagaaauaauacagacagaucacccuuuauccaguuagcccaaugguuaacaucuugcaaaacuguaguauaauuucauaaacaggauauugacauugauacagucaauauagagaacuuuucuauaaccacaaguauccuucauguuacccuuuucuagucacgugccuccugcuuccacccccuucucaguuccugacaaccaguaaucuacucuccaauuguauaauuuugucaugucaagaauguuauauaaguggaaucauacagaauguagccuucugggauugccuauuuauagucagaauaagucucuagagauucauccagcuuguuguguaucaaugguuuguuucuuuuuauuacugaggaguauucaugguaugaauguacuucaguuuguuuaaccauucaccuguugagagacaucuggguuguuuucaguuuggccuauuacaauuacagcugcuauaaacauuuguauacugguuuuugugugaacauugucuucauuuuuuuggaauaaauguccaggagcaugguugcuggguuguaugauacuugcauguuaguuuuuuaagaaacugcugaauugcuauccaguuuaagaaacugcuaaauugcuauccaguguagcugugccauuuuccaugucuaccagcaauguaugauccaguuucucuacagccuugccagcauuugguggugucacuguguuuuuauuuuagccauucugguaaguguuuagugauagcucacuguaguuuuaauuuguauucgccuaauggcuaaugauauugauuaucuuuuuauagauuuuuaaaauaaauuuauuugccauuuguuaucuuuuucagugaaaugccccuccuuggguuuugcccauguucuaauuggauuguuuacauuuuuaugguuuauuuuuuacaguucuuuguauguucuagauacuaauacuuugcuggauauccaguuuacuuuuucauauuuauuuaaaaguaucuuguuuguaucuauaaaaacucuucuugggauuuugauaggaauacaccauuacauaaguagguaggcauuauccaccuaaucuucucaaugaugaaaugucccauagaggggagggaccguguugaagacagaggauguggaugggacaaaggcacugagaauaggggaaaagugauaaaugagacauacgugggguggaaguuguggugguugucauuuguuaugcauuaggguucaguaagugaauaaucuuaaaacuauuaaaauuaaauuucacuuaagaggguggucuuacuccauugaugaguuuucaguuucaacucacuuaguaaacauauauguuuaccuucugugccuggaacugugcuuuaagcugggaauauagggguugugaagacucuuauuuauugacccauugaaaauuauagucuagugaagaagguagcugcuauagaaucucaagcaccauugguggucuuuuacugaaccaggugguaggagaacauuguucuuaauuggagaaucaguguguggucaggauauucaaauuucaggcugguugaucaagccugacuaugaauuuauuuugccaagccaagauuauuagauaaaaauuaaaacuugaaauuuauccuucccuuuuuuccuuauggaccuuuuacagauggaucauuccauuuuacugugucagcaguaggaggccauguuauguggcagauucgagggcagggcucaggccagcagguagucuccuuagagauguuaagcuguugaucggaggcacugucuugccuucugaauaaaaaguuuguguucguuccaucccaaggcagucuuucuguaaggcaaauauaaauaucugccuguuaaagcuagguagaaucaguauuuuagaucagcuuuucaggauuucugcucuugauaaaauuuuuguuuuuuaaaaagcauuauuaugauuuuaauauaauucuuaacagugcugaaaguuagcauuaccuaaaagugaccucaaacuuaguaguguuugcuguaacacuagaaaaaaauaauuaccuguagguugcuguaggccauucaguguucucuucuugauccucccucuguccucaguauuugccaucaguaccugccuugaccucaggagcaagaagaguugacaagaaaugagcccucuuguuaccggaagguacuggaauuguacugcaagaacugcuguucuuguuuucuuagaagaaaaaauucaaccaagagaugcacaacaaggguuaaguagcagaguuuauugaaggaagauaaaaugcauucaaagagaggaacggcugacuggcuggcugaccuccuggaaaacaguaguggcaguguuuauuuaaagagacagcacacccugagagaugauucagaacaggcugcuggaaagagaggaugagcuagcagcagcuaaugcugggggacccucuuuaugagaauauugcaugauuauucaugaggggggcaugagaggguaucaguugcaaccauguuuuaagcagucuccuuguguguacaugcuacaugcucuguaguuguacaugcuaguauacaccucgcaugucucauuagcauuuaaaaucuccacacagggaugugguuuuuacuauuauaaugaacaaaagccuacuguguagucauugccuucuugcagacggucagcaggcagcgccuccaggacuuuucccagggcuccccugcuugcuuguuucuggccaucugccuaacauucuuacgugucuuaugguaacauuagggcuaauagugaaccauucaaugaaugacguuguuucuaccccagaaauacucucacagugguagggaagauauaacuucugcuuauuucuuaguaaugagggcaguaggaaauaugaaagcauugaggagauuuagagaaggaaauuauaucucacuucucuuugggggugaucaggaaagaccucaaagagaaaguagcauuuaauguggaccuugaaggaugauuagaaguuuugucagaugguggaggugaaacacuccaucuuaagcagaacaaauaugaaaagauaggagagcaugaaauaucaaugaggaauaacccaguuucacuagguagggaaauaguaagaaacaagucuggagagggaagcugggacucugcugggcuggcgaguuagagcagaguuccacgugaagugaggcaucgucgaggauuuaguugucacugucuagugaaaugcaucuaaaagagcaaucugacaguguucuguagggucugcuuagcaaugacuaaguuacguacacaccauucuuugaauuugacuuugaauuugguauguagaaccugaaguuauugugugcccaaauucauagugagaagauguguuuaugcauaggucacacacuuaguacgcauuaguauacaauaauggugacauagcacuuuguuuaagaguguaaacauguagcacggaaguugagguaacuuauaguuaugguuuuugucucagguugacaagaauucuaccugcccugguagggugaucauauuguuagaaaagggucuucugaguucuucagaguugcuccaaggcaggaguuuaaggaaaguaaaccauggacacccuggauuaauuuuuuuguuugucuaaaguauuacauagauuguggcuuugaauaaauuaccuuucuggaagcucagccaagcauaguaaacuacaagagaagacaucuaacugucacuccucccuggcccccacuggcucuccucccucggcgcacaccuaauccagaugugaaauuaagugcuuucacacagguccauuuauaaaggaaauuaggugggagacuugauuccagagggaucuugaccuuauuccccaguuuucuuuauauugauuuuaaagccuauauauugguugaaaaucauugggaaaauaguuguggagaagauagguaguauuuuaaaaugugacuaaugcuaguuuugaugguuuaauaguuuggguacuguauuauucuguuuuauauugcuacaaaggaauaucugagccuggaugauuuauaaguaaaagagauuuguuuggcuuaugauucugcaggcuauacaugcauggugcuagcaucuguucagcuucuggugaggccucaggaaucuuuuacucauggcagaaggugaagggggaguagacgugucacauggugagagagggaaugagagaggccaggaucuuuucaagaaccagcucucauguaaaggaacagagugagaacucacucauuaccauggagaggucacuaagccauucaugaaggaucuauccccaugacccaaacaccucccaccgggccccaccuccaacacugggcaucacauuucaaccugagauuuggaggggacaaauacccagacuacauaagguaguauaagucuaaucuauuacauucugccacuguagguaugauuaguaccuaccaaauuuauacugauacuagcuucuucauaaagauucucagaagagguaauuuaagucuuucuugcauuguuuuuauagucauaaaauaaccuuaacuaauaauauacuuucuccuuugucuaaauuaaaaaaccccccugcuugaauuuaagccuuuccuuuucauuucaucguuugaagauacuauugauuuugauggcaaaucauggaaugaauuuuauaccuauguuagucacucgaaguguuugguaauuuaguuuaccauguuuuagucuaacauagaaacacaaucuaauauuuuugaauucucuuucguuaaggcauuguguccagaucuggcacccugacuuaugaagcaguucaccaaacaacgcaaguuggauuggggcagucuuugugcguuggugagggacuuuugcuaaaaucauuuuauuggaguguggugucuucauuggaugaguauaauaauaauuauugauuuuauuauuugcaaaagauuuugauacucuuaugaaaaggauguuacgaucucaaauuuaauuugcuuaaguguaaaguuauucuguaguuguuucaagauucaugguccaagauuucauuucuagguugaagaacuaacaucuuggaacacguggcucccgaagcaccuuggugccugaaaacaucacuugguuugauugcucugaagaaaugguuccuuauauuaggacuuuuguuaucauugccauuauguucaucagugcuuuauaguuacugaauucuuugccauucagugucucauucuugagggaagccucucaggugccucugagcuggaaaauuguacuguuagagccuuauuggugagaaagucaagguugaggaagguucauuuccucagaaccucucuuuuuaucacacuauacugccucccauuugaaaaaguaaaaauuacaaauuuuuacauuuuaaaauaauuucauuauuuguugccaaaagccaaggcaaauuccuccuuuucauauuaauaaauauucuuucaaguucuuagaauaccuguuaauguuuuagaauuaucuuuacgaaaaaguaacauauagcucuggaguguuuuuauuaagauucaaauucauaaauuaaauauugaaaacauuaauugagcauuuguacaugcaaagcacaauauaaguggaagauacuuuuuagugugacagagaauaagaaaagguuugaaacaggcuuaccgauuccuucuuuuccagcuucaguuuugaauuuguaaguggaggauaauaaugccuaucucacagagaaguugagaaaauuaggaaaugacagaucuaacgugugccaaagcauaggacuugacacacgguuggcacuuaauaaaugccgguucucuucuuccacuccauuuuucagagaugcagugaaaagaaagaaaucaauccugcccucaguaaguuuguaauuuaaaaauaaaaaacggcagccugucuguagggaacauuuacuuuaacccuguccaugaauuuguucuuaaaugugguguguaguauggcucugauaugcaugcucugucaucauccacucuggauccagaacacgagcagucaggguacucacugucacucacuggcacuugugucuuaaaacuugugggugauuuaucugcagcauacuucaucaaauaguuucuuuacucaaagaaauuuguuaaauguuuauucuuuccucugguguaacaucagcaugcaacacagauacacauuuucuuaaaauguucauuucuaaggaguuaucugggaauaauuuugugggacagaagaggcuugauaaaggagcuaaaacaaaaagaggguugucuucguuacagcccuagaauauuccuagaauaucaggaaccaaccaccauuuagcauuuauauaauauuaccaacagaaauaaauguagcauuuugugauuuuuuaaauauuaaaugcaagagcaaugauacauuuaaaaauauaagagagaaggguaagaaaaaugacaaacuaguuaaaaacauuuauugaccuaaauuccaugguucacccuuaaauuuccagcuauugauauuuuucaacuuuuucaggcauuggaggugauccuuuuaauggaacagauuuuauugacugccucgaaaucuuuuugaacgauucugccacagaaggcaucauauugauuggugaaauuggugguaaugcagaagagaaugcugcagaauuuuugaagcaacauaauucaguaaguuuggguuuggaaaaacauagcucuuugcucuuaauaucagaggcuuguuucagaaguuauuuuuauuuuuucaaaggugaauuuuuugagaaaacaugaaagauaaaacuuucugagcagggccuucuauacuggacacucagacaauucuguauuauuucuggguugauucucugcuucucuauucugaacucuccuccccaggcaucaccccacacuuugugguagguaagucguucuccugcugaacagauacauucaggccaucagcccgagagcccgcacuugaccugcagacuugguuuucaccugugaccaguauucuuucucccgaucucagagggaaauaagugguuuuuucucuuuuucaaggcugaccuaaagauccuaucccuugugcuuuuuuucaggcucuggcuuccuuccaguuuuagacuuuccuuguggaauggcacuucccuucagagaucaaguagaaaagcuuuacugucuauguccuggggaggcuuuccuuguugcuucucacuuagaauuaaauguaaaggaguaguguugaguuaugucaucauuucauucagcuugagggaguuaagcccuguuccuguggugaaaggagagaugggggugcgguagugacugaagcagugugguggccaccagcccccacucagugaauuugugcuguggccauuguugugucagagaacugugggaaaaaaaucaagcaacugauuuucagaauuucucuuauacugaggaaugagugaaaauuuuucuucaggggaccaggcaagagaguggagaucacuuucucucuauauguaugaaaaaaauccaccagugaaugaauuaaaugccacauaaaauaauacuggagaguuaaaggaaccaauaauaucauguacagggugguuuacacaaaacaaggcauauuuauuuguguuuuaaggaauuuucaagggcuauuuugaauauacuugauuuucuuuuguggugauuuuaagcccuaacucccauauuagauaugacucagguuuacccucauucucucauucucuuuccuuacuuuucauucauucuugaauccucagcaaucaggcuccugucugucacuuagaagcuauaugaccuugggaaugcuuaaucucucguugccucagguuccuuauuggaaaaaugacgauauaguagugccugccuccuagaguuauuguaaggacugcgaaguuuaaaugacuuaguaacguauagcaaaguagugcccggcacuuaguaagcacucuuacugagccacuggcugcuguggaaucuucuuacucuccugacauuguguuugcacagaggucaccaguggccuugauucauucgucauccucuccauccucuugguuucuuucugguuuuccuccucuuuaucauucccuggaucuauuuucugugccuauuucuauggcagaaaccugagaacuaacuuuuauuucucucuuauccuguuucuacucaguuaccaagaucugucucugagacaucagagguuugucuggauucagagccuugucuguacuuaguccaucuacuuugguuuggguccucaucccaucucaucuggaccaucucagugguuuccuucuugaucucucuuauuuucuccaaccaccccccuuuacucuuaggccauucuguuuauggccacccaaauuaucugcccuucugaaacauggguauuggugcuguuuguccuugguucacaucagacaguguuucccauguaauguuucccauuacaugucagcuaaaggcagauuuagcaugguauuccaguccuucacauaccauccaaaccuucccuuuuagaucaguuuuccaucugacaugccaguuuucauucucacuugccuuugcuuguuccuucugcaaggaaugcuuaguaucugacuuucacucuagacuguguuauggacugcagggaacuguuaacuucagugcccugcccaguccccuggcacagugggcaccaauacaggucauguaaauggaagaguagauuguuaaggauuggaguaaaauguuagauucccuuguguucagaaaguuguacaguuugaaauauaaguaaaaacugacuucuuuaaaaaaaaaaguuucgguuaauacagcauugugcuguguuaaguugaauuuaaaauguauuugggcccaauucugaaucccuggaauagccuaguauuuagugggaaaaaugaaacauagacauuuuguuucauuuggcaacauguuuccuauuccugguuaguuguuauggaauuaauuuuuauugagaaccuaauguguacaagauuguaaguuaagcaguucagaugcugcauuauauaaaaugccuaguguaauacuugguguaaacacucgauaaacaugaucugcugcugccuuucuuguuaucauuacaaugaugauaauuauuugcaaacguucugguguuuaacuuuuauccugaugcuuugguaaguuguuuuuguucuuucuuuaugaaugagaaaacugguacaggaagauuaguaacuugacaaugguagguauacagcaaacgaacuggggugagauucauacccagguuugucugacuucuccauuucaccauggaaggaugaggugucagauugaaggaguuaaggacaaagagucaucaauccugggcauaggcucagacuacacugauagcauucuaacuggccuuucuguuuuuagacauaccuuucaucauuuuuguguccuauuuucagacuacacuuccccauagucuuuuaguuguaguucucuccacuuaaaaaacaaaaacaaauaagccuccaauggcucuuuguuaaugggacagaugcaaauuuguuugccauucuaggcucaacaaagucuugauccuuucuagugcaacaauauucccacuuuuuggggaacaggggaguggaaucaaauacaaauuaaugccacucaaacaugagauucucauauucuauguagaucuuaugagugaaugaguaaauaauuuguggagucuuuucuuuuuaauucuauaccauagguacuacaguaggugccaggcauaccgaaguuagugaaaauauaaccucuguguucagggaauucauaguuuaguagaagaacacacggggaauagguuauagccagugugcugaauuuaauaguagaaggguguaaaaggcacaacagggucacugaugagaugaucaccuaugagggcauuuguggggagggugggagggagagauagaaaaggcuuauggggaagaggaagcuagagucagaucuuaaaaguuaaguaggaguuugccaagcauccaaggaggguggagagcauucucagcaaaggcacagagcuagagcauucugggguuacuggaagauaaggagaaagggaggaaagguggcagaugaggcaggaguaagcagugucugaccauguagcuccuugcaugcugcaucuuagugggaaucagggcagucagucgaaccagaguagcagucauucacugccauguacuacucacagugcaaagaaaaaaaaagccaguuucacuuaugaguguccuugaugaagcaaugcaaauuauuaauuuuauuaaauuaugacccuggagucaguauuuugugauaaaaugggaaguaaagcauugucacaauugaguugugagcugaacuagcugcccuuuucaugggacaccaauuuuacuugaaagaaugacuggcagacgaacugguaauucagacagaucucuucucaauaaugaacaaaguaaaccugcugugucaagggaaacaguugauaguauuuguugcuaauaauaacauuugaacuuucaagugaauauuuaaaauuuuagaaaauuugcaucugcaacugugagcuugacagcuuccuccuaccuagaggcuuuucuaaugagcuugauggugauacugauaacugauuuguuguuauuaaaugaugaaacaugucagcauuuggaagaucugcauaacucagugaacccauacauauuuccuaacugaggaaugcauguuacaaaaucacugugguuaaaagaucacucaaagugcaagacagauuaaugaguuuuaaauuaacaagggacagaaaguucacugcuaugguuucagauuccaacauugcaccuaaccuguaagaaauuaccacuugagagauuugguuaguaucaaagaagaauacucccaauuaucuguaaggcagucauuuaaaauacuucugccuuuuccaguuacauaucugugugaggcuggauuuuccuuuuauacuucagcuuaaauaacacacuacaacagauugaaugcaaaagcauuuaucagaauccauuugucuuucauuaaguuaaacauucaagaguugaaaauauaagugguaaaauaacgcaacucuucucacuagaaugguuuuuaaaguguuaaaauguuauuuuuaagugaauuaacaaauauuuauaaaauuuguuuuaauuucuaauauacuaaauaucauuagauauaauacauaucaacaaaagcucuuugagaucgucaauaauucuuuuaaguauaagggaucccuagaccaaaugaucugagaacugcuggucuaggggaagaugaugguaccuaagugaaagcucucagguuccacuugugcucaaguucugccuuuucaguccucucuguuuuaccugguuccuuauuaucucuggacuucuguuaugaacaugauauuaccauuaauuaugaaacuuaaucauauauucauauauuaguuuaugguaucuuuuuuuuuuuaagacagagucuugcucugucgccaggcuggagugcgguggcaugaucucagcucacugcaaccuccgccucccggguucaagcgauucuccugccucagccucccgaguagcugggacuacaggcgcgagccaccaugcccagcuaauuuuuguauuuuuaguagagaugggguuucaccauguuggccaggauggucucgaucucuugaccucgugaucugcccgccucggccucccaaaaugcugggauuacaggccugagccaccaugccuggccuaugguaucucuuaauggauugagguauauacauauuuuauauuauuucuucaacuacuuugcaugucuagaguacagacauuuuuauauuuucuuuuuuuuuuuuuuuaaaccucagaaucuaguauauagagauuguacauuagaauggauuuuugcugaauaaaaccaauucugaucuucccucuuagacacagaauuccagaguggaaagggcuuuugggcaucaauccaguuuggccauuucauuucauagaugaggaagcagaagucugguucucaagaagccuuguccaaggucgugcagcuuuuguuacuagaaaauuaaguccuagguccuuuccaguauacuucccaccucaucuuuuucuuuuagcacauuuauuaagggugaacuaauaaugaauuaaggcauaauauuagguugaaguaaagcaacccagucuugugucuuaaauuauuauuaucgcaaaucauauuuuccaguaugcucuuuuacuuuucaaaugauagcgucauguguauuugugaaguggaaguuuuauauugaacagauacggacauuggcacaguguuguauuccugaguuuguauggaaaguuaacucaaaggagaaugcagugguuucaaucaugguuuaauauuuguguugguuuuccuaagaugaauggugggcuuuccccugcccaagccauuuaccauuuaccagcagagucaugaauuugaggucccguuuugauugacuucuucauuagagcauuuaaaauauuacuuucuuucuaggguccaaauuccaagccuguaguguccuucauugcugguuuaacugcuccuccugggagaagaaugggucaugccggggcaauuauugcuggaggaaaagguggagcuaaagagaagaucucugcccuucagagugcaggaguuguggucaguaugucuccugcacagcugggaaccacgaucuacaaggugagcuccaacaguggcccaggugcucugagguugcaggcuuucucuguguguggccacacuggauaccuggaaaucauggccuuugcuucugggacuuaauugguuuucugaugugcagcuuaauaguuuguaucaacucuauugauguccuagugcccuaauuaggcaugaccaggaauaauguucuuauuuuaaagcuuucuucuuuaaacauugggauuuuuauuuuuguaaguggcaagauacaacauacacaaaaagcaucuugaagaucguaagugucaugauuuccauuuugagaguuuggaagguagcugugcagagaacugcuuuauguuuuguuacuuguuuuuuccuuugggauauagccacccugaccccauggguuucuguuucuagggagaggagguuggaggcugaguaacaagaaauggaaauuggaugaagaaggaguuuggguggagggagaucuaaagaggauggggagauuggcccuggcuauguugugauaccauuguuaaccauuuuuuugguuuguuuuugguuuuuuguuuguuuguuuugcuuuuccuuuuuuaauaggacauuauggguuuaaauauucuaaguaauuugaugucuuuuguaaucucuuugcacugauuuucagcuugucucuuugagugaucauuuaaggcucucucucccucauuauuuuuaugaugguauaccccugccacacacacacaaaaagcaaaaaacaacaaaaaaucuccucuuaagcaugcugaaaauagguaccaguugguuuccuagaagggaacagcauucagagagaauuucaaaauccugauuugguggucuucuuugcccuugucuuagagauaaauaaaguggacuccuuuuuuuauugaucuuugcaugauccugcucuuggaauauaacacuaugugccaaaguguuugaaagaaaucuaggugcuuagugagagugagaaauaauuuuauuugaaggugggguaaggagaaaagcaaaugcuuaaauucacauuggagauguguguuaccauuuucuuccaguaaguggcagcagggaucuacacauuuuauccuaauuguuacaaucuagaaaaauaugauuuuugguauuguuuccuuaaacacuacuuugcuuaagauauuuguuuguuucagguauuucuaagguucuugacauuuuguucaaauccuuguaacaaucugucuuuagcuuuauucucugagaaacugagcaaaccuguuuccauugccuucuuagaaggguucauguauauagcacuacagaagcauaaugaaguuucucagcucccaaaauuauuguuauuauacugcugugaaaaaauaaauauuauucaaaaccucccucucugcuucuggauuuaggaaauguaaaguugaagcucugcaucuguuucgugaaauucaggcugacacagacugauuuugaaagcuguuauucuguguucaaacacccucauccugguacauuuuucuucuguaauuugauuguucaggggauccuaaagauaauagguuucaaaaucauuuugauccuaaaugugauuuggaucuuuuaucuuuauucauuccaucucucuucucucucucuucuguuucugaaggaauuugaaaagaggaagaugcuaugaaagaaaaaaaaaauuccuaaaacuguggaauggaucacguagacauguaacccagcagcaguuugcuucuguuguccacugauuaaucagccuaugugccugacacuggucuugcaguacaacuggaagccaaaacaagguggaagauguccugaauuaagauguuuucaccacauuguauuacagagacagccaauaaaucuacuauuugauuucaauaugg

SEQ ID NO: 14706 - RNA, 501 nt, Homo sapiens
cauggccgauccucgcgugagacagaucaagaucaagaccgguguggugaagcgguuggucaaauaaaaagugauguaugaaaaagaggcaaaacaacaagaagaaaagauugaaaaaaugagagcugaagauggugaaaauuaugacaucaaaaagcaggcagagauccuacaagaaucccggaugaugaucccagauugccagcgcagguuggaagccgcauauuuggaucuucaacagauauuagaaagugaaaaagacuuggaagaagcugaggaauauaaagaagcacguuuaguacuggauucagugaaguuagaagccugaaacuuuucucguauggggugguuuuugcauuaaauccugggguccauuuuacaauccauuauuuuugaccacugcgguguguucaaguaguaugagaaugugauuguuuuuaucugguuacauauauauuucuuugucuaauuuaauaugucaaauaaaugaguucaucuaaa

SEQ ID NO: 14707 - RNA, 2052 nt, Homo sapiens
uguggaacaaugcuacaucuauacuuggguuggcuuaaucaaccucuucgauggugggcccuaaggaagcaccaccagaaggaggagcuccaccaacagggaaucccccaggcauucuuccuggcaugccuucugcacucugguacagcuuggugaugauuggguugcaaaguuccuccagcucuuucugcugauguucaaauucuuccuucuuggcaguccgauucuuauugugccaguugauaauuucauuacaccuguccagaaucuucuguuuguccucaucauuaaucuugucuugaaguuucucaucuucgacaguugcuuucauguugaaugcauaggacucaagugaauucuuggaugacgccuugucccucugcuucucaucuucagcuuuuuaauucucagcuuccuggaccauacguucaaugucuuccuugcucaaauggcccuuauuauuagugauaguaauuuuauucucuuuuccuguacuuuuguccacagcagagacacugaggauaccauuggcaucaaugucaaaagugacuucaaucugaggaacaccuugggguucaggagguaugcccgugaauucaaacuugccaagcagguuguuauccuuggacauggcacgcucaccuucauaaaccugaauaagcacaccaggcugguugucagaauagguaaugaaggucugugucugcuugguaggaauggugguauuacaguugaugaggauggucaugacuccacuagcaguuucaauaccaagggaaagaggagugacguccaagagcagcaaaucuugaacauuuucagacuugucuccagacaggauggcugccuggacagccauaagcaacagcuucaucauggcugaugcucuuauucaguucuuuuccauugaagaagucuuggagaagcuucugaaucuuggggauacuaauagaaccaccaaccaggacaauaucaugaauuugugacuugucugguuuggcaucucgaagggcuuucucuacuggguccagggugccacagaacaggucagcauucaauucuucaaacugggcacagguaauggagguauagaagucaauuccuacauagagagaaucgaucucaauacugacuugggugcuggaagagagaguacgcuuagcauguucacaagcaguacggaggcaucuuacagcucucuugcucucacugauguccuucuuaugcuugcgcuugagcucagcaauaaaaugguugaccauucgguugucaaaaucuucuccacccaagugguugucucuggcuguagacuugaccucaaagauuccauccucaauagugaggauugacacaccgaaagugccaccccccaggucaaagauaagcacguuucuuugugcuccaaccuuuuugucugaacuuuuguaaacaauagcagcaacaguuggcucauuaauaauucuaaguacauugagaccagcaauaguuccagcaucuuugguaaccugaaacugagagucauuaaaguaagcuggcacugugaccacagcacugguaacagucuucccaagguaggcuucugcaauuuccuucaucuuugucagaacaauagaggauaccuccucuggauagaagcuuuuggucucucccuuguauucuacuuggaccuggggccugucagcaucauucacuaccaugaagggccaaugcuucauaucagacuggacaacagcaucaucaaaucugcguccaaucagacguuuggcaucaaaaacuguguuggugggguucauugcaacuugaugcuuugcggcaucaccaaucaacuguuuaguguccauaaaggcgacauagcuuggagugguucaguuucccugaucauuggcaauuaucucuacuuuuccgugcuggaaaacacccacguaagaguagguggugcuaagaucaauaccaacugcaggucccuuggacaugguugcuggcauguagcccuggcuccgauaaagaagaaagccacaggaacccgagagcugcaggcgaguucaaugagcu

SEQ ID NO: 14708 - RNA, 1017 nt, Homo sapiens
gugcugagauugucucaagccccaggaaaaaugguggaaaauucacugucaccauugccagaaagaccgauuuauggccuucugcuucucuuaagcucccaauuuggcuucauacuuuaccucguguaggcuucuauuccugaaucuuggcuaaacuccuuagguuuaaccuauuggccucaaaaauauuggacaguugcauuaccucucuacuuccuuauuacuauaguaauuggcuaugugcucuuguuuguaccccauucacucgacuccauucguacaaucacagauaacuaugcuaaaaaucaacagcagaagaaauacuaagaggaggccauuccagcauuaagagcuauuucuauuuagugaaguaaaccaaauuuucuuucuuguagccaaagaccuuuacaccaaaaacugaaauguaccuggccauacuaaugagaggugaagcuggcugggcuucugggucggguggggacuuggagaacuuuucugcacugacggggagugucugcagcuucauuccugaagucagcgagaccaccagccgaccggaaagaagaaacaacucccgaugugccaccuuuaugaacuauaacacucacugugaaggucugcggcuucacuccuaaagucagcgagaucacaaacccacgggaaggaagaaacucuggacacaucugaacaucugaaggaacaaacuccagacauaccgucuuuaagaacuguaacccucaccgcgaagguccgcggcuucauucuuaaagucagcgagaccaagaacccgcuggagggaauaaauuccggacacacuaacaccaagcauuuauuuauuuauaaguuuuugccaucguaauuuugaccauaaauuaauucaaccaucucucuuauuaauagaggagauguaaaaauuguaaauugaucuucucuuagauuauguucaaugaauauuguaaguguucucauguauuguuaaugaacagaauaaaauacagcauuaccauuaaaaaaaaa

SEQ ID NO: 14709 - RNA, 11728 nt, Homo sapiens
uuaugggaaaaguuuuaaauuuuuaaugaaaaagacuuagaacaauguauuauuuacauguaaauaagaaaagagagcagaauccccauauccucuucaaaggaagggagacggcaggccauuuaugagaagaaaguccauauaaaccccauuaaguagaaucuggaucuaaauacuuccaaacaggaguacacagcaggugaacagucucccucaucccacugaucugcugcuucagauaagaucagcaacugaaagugaagaaagaaacagauuaaggaacaacacaaacaaaaugaaaauuuguuaacguaaauuuaacuaaaaccucacaacagacuucucaaaacaaaaaacaggccagacauaguggcucacgccuguaaucccagcacuuugggaggcugaggugggcagaucauuugaggccaggaguucgagaccagccuggccaacauggugaaaccccgucucuacuaaaaauacaaaaauuagcuggcuauggugcacgugucuguaauuccagcuacucaggaggcugaggcaggagaauugcuugaacccaggaggcagagguugcagugagccgaaaucgcgccacugcacuccagccugggugacagagcgaaacuucgucucaaaaacaaaacaaaaaaacccacaacaacaaaaaaacaaacucaggugccccaaacuaagaauagggaaguucccucuacaauuacaguagagcuggacgauuuccuaccguucaucggcaucucaucaaucugaguggaauaguacugcucgauaucucugaggaugcggaugucgucauucuuuacaaaguuaauggccacacccuuccggccguaucgaccugaucucccaauucuucaggaauaaaauaauauuacaguuaguauauauaacaaucaagauuuaguaaaugugucacagaagugaagccaaugagagcuugcaccuuaccuguguauguacaauucucuguuauuagggagaucauaguuaaugaugagggacaccugagggacauccaacccccuggcccagacaucuguagaaauaagcacucggcugcaaaaagaaagaguguuugaggcgauuaaauuacucauacaaguguaagacuggacuugcuuccauugcuaauuuuaaggaauccuggcugcagguccaaaauauacgagauucuccucucucaacagucugucugcaaacgugaagccucagggacagcaccagaaaccccugugcagaggggcuguugguggauuuaguuacuucggucaugugcuccaucagauuaaaaaaauagacaucuuuuacuagacuaucuuuaacuuguuuaaucgguccuaaaccaauaauugggaaaaauacuucacuuuugccuagcaaaaaauuaaaaacgguaacuucagccgggcauggcggcggcuuaugccuguaaucccagcacugccagaggcugaggcagauggaucaccugaggucaggaguucgagaccagccuggccaacauggugaaaccccaucucuacuaaaaaugaaaaaaaaaaaaaaaaauuagccauuccagcuacucgggaggcugagacacaggagucacuugaaaucaggaggcagagguugcagugagccaagauugugccacugcacuccggccuggguaacgaagugagacugucucaaaaacaaacaaacaaaaaaagacacacacagcacauauguuaagcugaccacaaggugggcaaagaaggaagucugaaucaaguucaaaugaaugaaaccacccaauccacgcuuucugaccacuguggaauuaaacuaaucgaaacgaugaacagaaaaccccccuacuuacuggaaaagaagacacacgcuuguaaccaaggugaccaaccuggcuaguuaaggcuaguuaucaccucaaccuaaguauuacaggagcacagcggaccccuccuuaacuggaagguuuucugcucacccagggccucagcuuucagagcagaagcuuggcauccccccggguguggggccugcacuuaggcgguacauaugaagugcuuagacacagucuagcaaacccugaccugcagagccacagcauagcagacccaccuggcgcccgaccggaacuccuucaugauggacucccgcucuuucuggggcaugucuccaugcauugaggauacagugaaguuggcuucccucauuuucuccgucagccaguccaccuacaaauccaaucaacagaugcuacugcaagcuaguauaccaaagcagagaugugcauucgggacuuuaccgcaucauuugcagaaccaguaucaauauucguaagguaacugcucuuaaaacucagaaucauccuaacuggauguaaaaacuuuuucccagaaaauguuggggugcacucacaaaacccucuuacuucauuuucuccauauaaugacucuauggggggagggggccaggugugcucauucucauuugaaauuugaauuccaaucuuguuagaauguagcccaacuccuuuccuuucucaggaaaguggccgacaguucucaggucugccuccacauuaccaucaccuggggaucuaaaacuacucaggccuggguuccaccuucagccaacgaaaucugaaucuuuagggguggcugauaucgcuguucuguaaaugaaguuuuaauggucacagccacgucugaccguuugcauauugucuacagcugcuuuuacaagagaacacauacccugaaagcuuaaaauauggacaaacuggcccuuuacugaaaaaucuugauuuaugucauucagagacucaaucugcaguuucccuucagcacauggaugcugugcagugccucuuaccuuucuuuugguguugcagaagaugaccgccugagugauggucagugugucguagaggucacacagagugucaaauuuccacucuucccucuccacugccacgaaaaauugcuugaugccuuccagagucaauucaucacugaaggacaaagacaaauccuguuacauacucauccuuccuucuaggacuugagggugggccaagccaggauccagggagacccugguggaaaaggucacaccgugauaucuggugcagacccagcagccccagcccuguccuccauccuaucaccacuuccgucacacaggccuccauucuguauccuacuuaacauuucacaaugugcaccacauggaauacgauucuaaacgaaacacugauaaauaaauagucaccuaauuuuuaaauuuagaauuauugguucaaaccacaaugaggauuauaaaagauggguuguuuuguuuuguuugagacagggucuugcucuguugcccuggcugaaguacaguggcacaaucaaagcucacugcagccucagccuccugaccucaagcgauccucccaccacagccuccugaguagcugggacuauaggcaugugccgcccuaccuggcuaauuuuuuauuauugguagagauacggucucuauauguugcccagccuauuugguuuuuuaaaacaggaauuuuaaaagaauuugcaugcuuucaauuccuuuacacucaggcaagaggauagccugagguccggguuuugacacgagcuucagcaacacagccagacucuggcuauaaaaaguuuuugaaauuacgacauaaaauccuuuauaaaugcggcccaguguuuuaguaaacuugacaagaggggcuccuaccguuucaccaagaugcggauugggucggucaugaacuuguuggucaucuccagaaucucguguggcagcguggcacugaugagaaccaccuguguggcuggaggcagguaccuguauacaucguaaaucugcucuuugaaaccugggacagggagcaagacaggugagggauguuuagggcggcacacccagaaauggaaggugcacgcccaguguucccacuggguuagaggcagaguggugauaagguacguuugacaggaaaucucauuuuuacagcaccaggccacauccacgcguucucuccgucccuacuccccgcccaccggaguguuaucugguugagggaaucugguuucccuuuggugcuucuucaaucugaagugaucuagggaucaagaaacccaccccgagaguccuagauaccaaauaaaaagcaauagaggcuggccugagucacccacaaugaacaaauaaauaaaaucaagguaggaauuuuuuguucauaauugccaaggcacaauuguuuuuccacgaugaaaacacuauucacauucagaacagucacuggcuguuucaauuuuacacugugaaaauuuaagaacuaagaauuaugucaguagaagaguaauucuuuuguugcucauaccuuuauucaacauuucaucagcuucauccaaaaccaacauuuugauagcacguguccuuaggcuucugcgacgaaucauaucuauaacaugagauuuugaaauacuuacgacaaaucacaucuaugagauuuugaaauaaucacaccugaggcucccaagaaagagcucaucauuccacuggucucaggguuccagagaccuucccucuaccuccugcaagugacccaggugcaaaagucuaccgugcggccuaccaaaucgaaagcuguccuguaccauuuaagcacuucuuacaaauacuaccggcagcaccauuuuuagcgacaaaagugcuuaccaaaaacacgcccuggagugcccgcgacaacaugcuguccguaauccagcuuccugauguccucgccaacauuggugccuccaaugcaggcauggcacuggacauucauguagucaccgagagcaagcagccccugaaacaaagcacagguucacguccagggugggagagagaaacauccacguuuuccaaaaagaaagacuguuucuccuccgagaugaucaccgauuauuauuuaugccauuauuaucucgaaaccacaaaauucuccugcucuuuucucugacaaaaacaaguuaauuuugcuuuuuuuuuuuuuuuuuugagacggagucucacucuguggcccaugcuggggggcagcagcgcaaucuuagcucacugcaagcuccgccuccaggguucacgccauucucccgccucagcuuccugaguagcugggacuacaggcgcccgccaccacaccaggcuaauuuuguuuuuguauuuuuaguagagaugggguuucaccguguuagcacaccgugcugugugcacccuauauguguauucagagagucguuaucuccugaccucguaauuggccugccucagccucucaaagugcugggauuacaggcgugagccaccacacccggccugcugguuucuuauuacaaaagcuauaucauuaacagaaaagaauauauaaaauucauaaucccauccaccgaagaaaccagcauuaacaucuuaauauacaucuuuuuaaacauacaucuuuauacuacguuaaguauaaaauggguacaauuuauuuuuuuuuugagacagaguuucacucuucuugcccagacuagaguacaacggcacaaucucagcucacugcaaccucugccucccggguucaagugauucuccugcucagccacccaaguagcugggauuacaggcgccugccaccacgcccagcuaauuuuuuguauuuuuaguagagacaggguuucacuauguugaccaggcuggucucaaacuccugaccucaggugauccacccaccucgaccuaauuuauuuuuauuaaaauugauuuuucgcaaaaaaucuacauuucuaaggcuguaaaaaacuaccgagagcacacaagccacaccaaaaaugacuuaauacaaaccagcaauuuauauaaugauuaauggcaaaauguuaaucaggaagaaaauuuugagguaucagaaaacaggauuggauuaaauaaauaagucgguguuucacaacuaaaucacaaaagcaguacuuguuaaucggacaccgcuaucuuuagccaucucaccuucuggaucugcacagccaacucucuugugggagccaagaucaaagcuugaguuucacgaaccuggugaaauaauuuaucagaaaauagagaauccgcaguauuaucaaaguggauuguaguaauucacacucagaucuauaugagaaauacuaucucauauuaaucauacuucucaucucuuacagguuagcaaauauugucauuuaaauugcaaauccaacaauaacuuaaugugucagcauccucgucugcagacaagagcuuccucuaguuaaauagaaaaucaugacagaauauuagugcauauauuaguguacaacuaagacucuguguaaaaauuugcugagucaauacauacuagaaaauuuuaaauuguacuuuuugaacacuguaguuacagaagaaaaagcaaguauuuccuagaauuacauaacaguuuguuuuaagaauggcaaauuaccugaauauccaaacacuggaggacugagauacugaagguggcuguuuuuccugugccggacugagaccuauucaaggaaacaaaagcagugggauuagagggaggacaggccacgccacagcugcacuccaaggccugggcuccagaggcacuuagguaccuucuuccagcaagcccccguaccuaauaacaucuuaacugcgaggaggcaggacucgggcccagugucacagcuuguuaaguguccaugaagaaagagaguagacauggcuucugcacgggggcaauggagccacagacucucuaacuucaagagguguuucauaggugucagaaaaaggaggacuccccuuuaucuaaauacaacucuuuuccuucuaggauuuuggacuaacucucucuuccaaagaaauuuuuguguaaaugagucuuuuuugaaauuaggcaaacgaggaauaaagcuauuaaaagaggauuuguggugcuaggagauauggcuauauacaaguuuucauccauaguuccuggcucacagcucccauagcccuuauuacagucuuauuaaauugauggguuaggccucaggaaacaaucucucugaccuucugcucuccuuucaccugcuccacagcagggcucuaaucuucccugccuuucagauugugagucauaaagacccucaugucacggcgugguggcucaggccuguauucccaacacucugggacgcagaggcagcauuaauugaagccaggaauucgagaccagccugggcaauacagcaagagaccccauuucuaaacaaaacaaaaaacuaaccaggaacgguggcacauucuggcagucccagcuacuugggagguugaggcgggacgauuccuuaauccucgaaguuagagguugcagugagcuaugacugcaccacugcauucccgccugggugacgaagugaggccccauaucuuaacaaaaaaaauguuuaggccgggcacaguggcucacgccuguaaucccaaggcuuugggaagccaaggcagacagauugccaggaguuugagagcagccugggcaacacaacaaaacccugucucuacagaaaauacaaaaauuaauugggcauggugaugugugccuguagucccagcuacuugggagggugaggugggaggaucgcuugaggcugcuaugagcuguaaucacacgacugcacuccagucugggagacagaguaagacccugucucgaaaaauguaaaaaauuuaaauuucaaauuuuuuuuuaaaaagcauuaugguauuaucccagaaaagcuccugcccuauucccuuaugggggaaagaaugcugaccucauggaauuuuccauaaaaacccaagaggacuggguucgaagagcuucuagauggcugaacacagacaguggaacacaaggagguuccgggaggugaccacccgccccuuggaggcugcaccccuccccccauaucuguauccucugcaguacccuuuauaauaaaccacuaaauguguuucccugaguucuuugagcugcuguuccagcaaauuaauccaaccuaaagaggggauccugggaacccaacuugaagcugcuuggucagaaguucuagagauccgaacuuauaacuggugucugaaaagaggguagucauggggacugagccgucaaccugcaggauauggccuaucuccaggcagguggugugaguugaacuggaggacacccagcuggaaaagccccacaccucugcucacagaagucuucuucugugcugaugacuguugugguggugugagagcagaggaaaagcacagucuguuuuuccgaaauuguguuauauacaauuccacaugccagcaaaccacuaagcaaagcuggcuaagaaaaugaaagccuuggccgggcgcaguaacucaugccugaaaucccagcacuuuaggaggccaaggaggguggaucaccugaggucaggaguuugagaccagccugaccaacauggugaaacccccgucucuacuaaaaauaugaaaauuagucgggcaugguggugcaugccuguaaucccagcuacuugggagggugaggcaggagaauagcuugaaacugagaggcaaagguugcagugagccgagauggcaccacugcacuccagccugggcaacagagcgagacuccaucucaaaaagaaaaugaaagcuuuccacaguagagaacacaaauuuaaaaaaguauuaaacccuguggcuaaagucagggaaaguguuggaacugagcguguacaagcugagggaaacagucaucccagagcaucuaacugcacugcgcugcccaaauuuacauccagcccugcgccgcaccccaggacaacuuacugugcgaugacaucucucccuuugaugaucugcuugauugcucguugcuggauugcugaugguuuuucaaaaccugcaaauaaaaacaaaaaauuagcccucaccacaaugacagcauagaaacccuguacugugagcuccucaggggcagacaugguuuguuuuuugaaccuguccuccagccuaacccaguguucaacauagcaagcucucaaaacccaggggcucaaugaauugggcugagugauuucuacacuaacgugggauauuauuuguaaagaccaaucucuauuuuuaaaaaaccaccaaauuguagaauauagacaacaguuuuguuuaaaaaaaaaaaaaaaucugggugugcagcaucuggaaguguaagugccaaaauguuccuggcaguuacugcaguagagggguggaaagaaacuuacuuuuuacucuaauuacucccuuagguuugacuggauuacaaacaaccuauacuacuuuuuaaauuaaaaaaaaaaacaacaaaaaaacaggaaagucacucuagccauuguucucuccuacuagcuagcauuaagucuguguguugcugacaggucuacaacucuguuuaaccugcgugggucacgcugcaggguguccuauguuguucugucuggaugcagcucacuaacuacaacaccaucacaccaucucucuugcaaagcaacuacuacaccaaagggugaggcuauuuugaagaagaaccacguguuuuucaaguaaauaaaauuuuauguacaaaaacucuauuucaauuauuuuuugguagucucuuaaauguagcucugcucaguucuggggcauagcgaaaaauaagaaacaaaagaaaauguagcacaauuucccaucuuaacacaaaugcaaauauagcagaugauuuaaacucuucaugaagagcaagcacauagaugggaaacuaacaacagugucuuagggcagggacugccugagugccaggaaaccagguggggcugucagccucacugugaggcugccugagaugcuuuuucaccacgcauccucagcaacuucgcuucacuuuguccaaacuguuguggcaucaagaacuacaggauacggccaggugggguggcucacaccuguaaugccaucacuuugggaggcugaggcugguggaucacugaggucaggaguucaagaccagccugggcaacauggcaaaauccccucccuacuaaaaauacaaaaauuaguaggacgugguggcccacaccuauaaucccagcuacucgggaggcugaggcaaaggaaucgcuugagccccagaaguggaaguugcaauaagcugagaucaugccacuacacuccagccuuggugacaagagcaggacugucagaaggaaaaggaagaaagaaaaggaagagaacuacaggauaaaaaaugucccugucccaagcauuaaacacaggccauuuaucccagaugcuggucauucccaucuaugugcccaacccaaccucuucuccaggcucucccucaacuuccucacaucuuucaaacauaccaagagacagcuccugauucugacucucuggagugcugccuaccuagccaaauguuugcagcaucaaccaccgguuacucaaaacacuccaacucuccuccuucugucacucacguucaauccaucagccaaugcugucagcucccugguacuccaucuccaaggcagcacaauccucucuucccugaacugcagcaaaagcucccaacucucuuguuuccucuccugccuugccucgccucaccucaaaucuacagacacccagaagaaucuuuaaaacuguaaaugugaucgugucacauagcuacuuaaaaccuuccacuggcuucccacuagauuucuaaaugaaauucaaauuauucgucacccuacacgucuuugcuagaucugccccgacuagcucuccaaaaucccaccacaggggacuucuuucaguuccuggaaugcagcuggcuaagggcugcaaggcccuggcaccagcuguuccuucugccccaacugcucuucccucuucucauaacagucuccuucauccagaacucugcucaaauggcacccccuccugcgaacccccuuaccucucugcuuuacuaauucucuccuccuucccagucccacucuauucaauuaccccgcuucagguucuucagguugccugggcaaccugacaguaugcuuuccccccaaacgaaauucaaaacccguaaaggcgcaaacccuuccgguuuaccgccaaaaccccaguaccuagaaaagcuaauagguagaaaucaguuaucugcugaaugaaggacgcugaggugccucgaagcggcugcagcccccgacagacccagcgccgagcucugcacgggggacacacaccgaaagcgccgacacagccaggcgugagggcgaggacgggggugggggugggggucggacgucacuggcccccgagccucgacccugaccacgaccuccggagcgcagggccggcccgggagucaccagucuggcccucagcccccggcucgcccccgacucgcccccggcuggcccccgcggcccgcgcccgcucaccguaagcguagaugccccgcagcagguccucccgcaggcccauggugucgaacgugggggucacauccaccuccucgcuggucucgaauuccacuuuagucaugucuuccucuuugagcagccgcuuucgcgccgagcccgaggucgccaucguggccguggucgccaugauucagaguccgcggaagagc

SEQ ID NO: 14710 - RNA, 2710 nt, Homo sapiens
ugaccaucccugagaucuuuuuauaaaaaacccagucuuugcugaccagacaaagcauaccagaucucaccagagagguaagugggagcugagagaagaugagaccuguggaagggcaaccucacauaauacaggagaacgcaugggagggucccuuccucagggagcacaggagcucugagacucagcaaggcuguacugggaggucucagggaugggugaguacacagauucacagcucauucagaacuguagaagaugaugaaugugaccaagaucacuucaguccuaggggacuacagaaggaaaaagacaagaggcaguaggauaucuguguguccucccgcugaccacacuuccuuuagugacccgauugccuccucaagucgcagacacuaugcugccucccauggcccugcccaguguguccuggaugcugcuuuccugccucauucuccugugucagguucaaggugagauuucucugccucuagcacuggguucccuaugaauccucagagccaagaaaaggaggaaggcuccugugugucacgugagguaaugacguggugucuaaugaaacugccugcaguuccugcaucaucacuccuuccuucauguuaacuugcagugggaggcuccacugugguccacuaacaauggaaugagauggcuuccauuuagucaguggacucuaauauacacuggugggaaaguguggagggucagcaaugagauguggggagggacaaugauuggaggacccaauauagagauagcccacagugaagagaguguugaaugguugaauaaggggaaaggguaauaacagacuagaugguggcccauuuaguagggcuauuuugagauaaagaacuucugaaaacacaagggaagaugaagagcugucaggaauguggucuuccuccccaagggcagaccuagauauuccccaaggucaucucccacccacccccuacucuucauuuuacucucucccuuuucuuccaccccaggugaagaaacccagaaggaacugcccucuccacggaucagcugucccaaaggcuccaaggccuauggcucccccugcuaugccuuguuuuugucaccaaaauccuggauggaugcagaugugagugguuagaugugggguuggaggugauaggggaaaguccaugcaggucucagggggaggagggucuccuucaggagaguuccuugggaaugaggaugaacacgcuuaucuuucacacaguccuccucccaccuaccuuuucccugcccucccucagugggucucaggcuccaucucauucucuuugucccccucaaagcuggcuugccagaagcggcccucuggaaaacuggugucugugcucaguggggcugagggauccuucguguccucccuggugaggagcauuaguaacagcuauucauacaucuggauugggcuccaugaccccacacaggugcgaguauauccuccccucucuguuaccucucaagguacuguuguugcccaggcgcacucccuguccccagucccugcccaggaaguacuuuagggagcacuggagcucagauucugggggacauuugggagaauaggaaguccaugaggcagcugaagagcugaauucuacggagaucccuagucuuuaaagaaaauuagucggacucuuguaaaacuuuuacauaauucucaagggaauccuuacaaaucaauuaucugagcuucagggagucuguaucuauuauucugagggaauucuaaauuaagauaggaucaaauuuugcccccauacagaauagacauuaucuuugagguucgcaggcuaaucacaaaugcuacaccaauuauuguucugcaaguaacauauuaccuugagugauuccaaaguucuuguguuuauugguugggauuuucccaaagcaaugaggaguuaaggaaaagauuccagugcagaggacucuagggcagcaucuggaagaucagaccaaaaucccugaugcuggggaggaaucagguguuacagcucaggggccaugcaaagagaccugcaauggccauuuucuucaccuggcugccuccucuucucuauagggcucugagccugauggagauggaugggaguggaguagcacugaugugaugaauuacuuugcaugggagaaaaaucccuccaccaucuuaaacccuggccacugugggagccugucaagaagcacagguaagaaacagaagagcugccucuucccagcacuuuccacuccucauccccaauuuccugaccuucaggaaauccuuuucagcuagguaaugcaguguuuaugugccuucucccgucuccucucaucucugccuucuuugagucucauucuccuggauugagaaacuggugaagaugagagagaagcuuuaaauccuaggcuaaaaccugggaugccucuucacuggguucacaaguucccccagccccaugccuuuuauauucugucucccuaggauuucugaaguggaaagauuauaacugugaugcaaaguuacccuaugucugcaaguucaaggacuagggcaggugggaagucagcagccugagcuuggcgugcagcucaucauggacaugagaccagugugaagacucacccuggaagagaauauucuccccaaacugcccuaccugacuaccuugucaugauccuc

SEQ ID NO: 14711 - RNA, 1572 nt, Homo sapiens
cauggguaaaggagaccccaacaagccgcggggcaaaauguccucguacgccuucuucgugcagaccugccgggaagagcacaagaagaaacacccggacucuuccgucaauuucgcggaauucuccaagaaguguucggagagauggaaggugaggcaggagagggacggagcucagggggugcaggugugguuuucggcuaggagggccuuaggcagguaguaggcaacucaugagcuucaacuuugccaccccagugacucaccugaauaucuuaagaguuccaggcagacgauuuuagguuuuuacuuauauaagacuucgaaagcaaaaugcuguuaaggaaaaugugguccuuaaagaugaucuugucgucuuuggauguuuauagguaacaauuuugcuguauuuuuggcucuuauuuuauguccacagaccaugucugcaaaggagaagucgaaguuugaagauauggcaaaaagugacaaagcucgcuaugacagggagaugaaaaauuacguuccucccaaaggugauaagaaggggaagaaaaaggaccccaaugcuccuaaaaggccaccguaaguuuaaaauaacccaaauugcuccuuggauuuuuccuucaguuuauuaaacucuguugcuuccuuucagaucugccuucuuccuguuuugcucugaacaucgcccaaagaucaaaagugaacacccuggccuauccauuggggauacugcaaagaaauugggugaaauguggucugagcagucagccaaagauaaacaaccauaugaacagaaagcagcuaagcuaaaggagaaauaugaaaagguacagugucaucuuuuuuaaagccguggauaagacuagguauagguaauaacuguagaaaaccugggaaauuuaguuaaucuuguauuaaugguugucagcuauguuuugaaaaggccuaaugaaaauuguacacuucaacacaagguaauugaaaccuuccuuuugacugaaaccaguguuuguagcacuaguauauuccugcagacagacuuguaguuacuuguaguuauuguauagucuguauagucuguuauuuuuuuuuuuaagcagagagucaaagaaauuguuuuauguagauauauauaaaaugugaagguacaggagggacuauggcacugugugugauguaaaaggguauugguagugaaaguacugauacugcuguaucgcaacccuugucauuuuacgucauuaacuuguuaaagccuagugggauaagugcucuaaaaacuuagacugguuaccuuuuuagacaguuauuaggguuauuggucaaucaucuuagauuguuuacaacuaagugguuuuucacaguugaguaaugauaccggaugcuuuauuuuuuugacaauauuucaggauauugcugcauaucgugccaagggcaaaagugaagcaggaaagaagggcccuggcaggccaacaggcucaaagaagaagaacgaaccagaagaugaggaggaggaggaggaagaagaagaugaagaugaggaggaagaggaugaagaugaagaauaaa

SEQ ID NO: 14712 - RNA, 592 nt, Homo sapiens
aggaagccaaccugcaagugauccugggaaauguagcuugcaagggugagccucugugacgcagagcagagaagcugcggggaucugaaagcaaacauggucuuuccaggacaugcucugugcugggaacuggggcggaaaaaaucaaacuggacaaucacagcccaaagacacccauaagcuauaccaauaguuccagugcagugugguaagggauuagggaucuauguggugcugggaagggccugcggggggggggggggggggggcagauaaauaaagauucucggagggggugacaucugagcugaaaugcaaaggaugaaucaguuaaccagaugaaaaugagaguggguuugggaaggccauuuuaggguagaggaugcuugaagacaagggacagagaaagaucacgacuucuccacaaggaauccuuugguggcuccucauuguguauaggagaaaaucuaagacccucuccagguaguagaaggcccugcugucuccagccucagcuccaccuccagucuaccccugagacucuaggcgcccuauacuucugucuguggacauagugcucacuauuucuugu

SEQ ID NO: 14713 - RNA, 4159 nt, Homo sapiens
aggaaacugccuacuguucugcccuuccugucaguuuguaauuacuuguuaauguaucugucuucugccaauagacucagccccuuccuggcagaggcuggugucuccuuuaucccaguauccucagugcccagcccuggcacacucaacuuggcacucagucaauaucuguuggcaggugaacugugccagggucacaugcaucugggacauaaucccccuuugcucugcugcuccgcagucagaacagaaugucugaggacaggaggacccugggccgggugucccaaaugcccaucuccuggacccuggacaggugcugcugccuaaggucugucuggcuguaacuugaugcagcugagacugagaacuggaagaacaggaagcccugugacucacaaccgcugcaacaggauccuggaggaguggcccguaugccucccuggucagcucugcgcuuacccgcugccucggguuugugagucugcagugugucagagcuggcauuggccugagguggcauggcugcccuggcgaggacaaguuccuugucccaucugaagaaguggcauaggagaucugaguuucgguucaugggcuuucagaggacaggagacuuacagaauccauguucugcugugugucuuccccccggcucaucuuuuuuucuuuuaucagaaacaucuggcccugcccuggcaacuuuguagaauaaacuugcugcucuuuguacagccucagccuucccaggaggagucugugagggcauuauuauuaaugaggucacugacagcaguugcuuggcuuucccagggugggcacaccugugcccuagguuagggcacucggcuggucacuggaugcuaugggucuucagggacuaggccugugauuuggggaggcuucuccaagucuugguuuccuugucagagaguugugguaaaacacuggcaaaggaauaaugcaaaaauaugaaauucuuuugaaauuaaguugcaagcaugugucagcacagagucacuggaagucuuuguguggccagauuuaaaugauggaucucucuuuguuuggccucuuuugaccucuuuaaucuucuuuggcucuuugacuguguauaguggguaaacuugggccaagucagugcaaccugccuuuuuuuuccagcgucuuuugaauugaaguauaaugcacaugggaaacugaaagcagcagguaaccaccauccagauccaguaacagaucauuaccugaaccagccccguguucuccuacccaccaccaccaucaaguguaaucacuguccugacuaacagcauaggucuguuuuuguacuuaauauaaauagacucauacaggauauaaaagaugccauuugugucuggcauuuuucagccaguguuuuacuguauuuugagauucaucuaugugguugcauguagugguagguggugcauucuuguugcuguauacuaucucuugcaccacucuggcuuguuuuuguuuuuaagagacagggucuugcacuguugcccaggcugagugcagcagcgugaucauggcucacuacagccuugaccuccuggcuucaaaugauccuccucagccaaaguauuaggauuacuggugugagccacugugcccaucccaccacccuguuuugacugugguugauuuaaagcagacgaaaguagucauaauaaggccccugacuuccagaagguaugguccuuucuaaguuucugucaaaggggccaaauaggaguguugaccuaauauauagaugacccgauuguaucuucaggacaagaacaugcauguuaagaaaggugaaguucaaucaguuggucuucuagggucuagaaacuaaaagguaggauuuuuagcuguggucaucuagggcaccuggagagacgguucuagauaaucaauuagaaauaucccaagacuggggagacaaaguucagcugugccacaggcauccugcauccuuugcuuugaugcuucuaugcuuguggaguaacuuucuuauccuaugugaucacuugaauucagcccucuaccaggagggugugcccugcagacacaagugaugaacauuugcuuauucauguauuauguauuuucugcuugcuuacuaaaaggauuuagugauuugguucagcuuucaguaaaaagauuucuagaacgagagucaucaaacuggcgagaugauuacugaaaaacuugacaggccaggugugguggcucaugcuuguaaucccagcacuuugggaggccaagauggaaggauugcuuaaggccaggaguuugagaccagucuggacaacgcagugagacucugucucuacagaaaaaauaaaauuaaaaaaaucagcuggguacgagggugcauaccuauagucuuagcuacuugggaggcugcaguggaaggaucaugagcccaggaguuuaaggcugcagccuaggaguuugaggcugcagugaaccaugauugcgucauugcacuccagccugggcagccgagcaagacucugucucuaaaguuaaacaaacuugacgaagcuccaagcuuccugacagucaaggcaaaaaggauaguuaguucucuuugagucagucguuuucaucccaucggccuauaacagguagcacagugugucugggcagccagacuuucuccugacacuaacccuuacuggggacugaauggcuagggaagcauuagugaaagacacagcagcuuuaccuggugcaguggucuuuauagucuuuccugugagcccuugauuaaaagugauagaacuaaaccuaugaagcauuucauggggagcuaauguaauguugugaaggugaggagcuuucuguuccuggaauugguaauuucccagggucuuaggggcuugcccaugccuccugagccuuuucacacugcugucucuagguaagcauuuaucugcuaagguggcugagcuccaaaaguauccccuuugauugccagucucucaggccacuuaaaucugugacacuucccaugggcugccuuguauugugcccgacauucuuauuagacaagacucaucucuccacgcauucuagagacacucauugaucuauaauaugagccagcuucuuugauauaaaguccuagagagcagggcuguugauuucuuaaaauuuuuaagaauuguaauaaaauauuaaucacaaaauuuaccauuuuaaccauuuuaaguguacaauuuaguggcauuaaguguguuauucacauugcugugcaacuaccaccacuauucauuuccagaauuaauuucuuguaaaauuauguuucuguacacuagugcuuuguauuuaauagcuguuccauaaaugccauaacauggaagaugcugggguugcaacaguagucaggauucagggauugaaugauacggaucuuacagacuuagacauugaaauuuaagguuucguuucgucuacacuucccuuuuaaaacccuugaguaccuuacucaagguaggaucuguaguacuucauauaaaaacugucaaaauuggaauauugcugucuucuggauguaaauaauuugaucaaggccagguucccacagggaccagauggggugggcucaggauccaggcaguggcaccagucuuucaguugcauugggccugcagaaugagaugggcgcuucugggccagaaggguugacauucauccaggugauccagauucuaguuucaacugugugaccugggucgaggcugcuccccgaugggccugguuucucugagaucccuuucuugcagucaccuccaggccuuuccuuccugggcuuccccauaccuggccaggacuguguauggcccacccugcacacugcauacuucgaaguggagccuccaugaauguccccuuuuguucucuccauuuguugcuuugugacagugacacaauuuccucuccuuuuuuaagugcuggucuggaggaaaaugcagguacuuaaggggauggguguuaauggcuucccauuuuggguauuaucuuauuuccuagagaguaugggguuaauuugucuuuagggcuuccccugacaccaaccccaauucuguagaggaagugggcaugucagacugguauguuaugggaaaaacugaaacug

SEQ ID NO: 14714 - RNA, 3123 nt, Homo sapiens
ccgccgcagggccaggaagcgcggaaggaaccgccgggggccauggacggagcagugauggaagggccgcuuuuuuugcagagucagcgcuuugggaccaagguagucuggcgcauggaugccgaaccuuauccgggcuaguagugggugagagagcccagaaacagggagaggugggcagcgggcuggagagcggcgccgggaguuggagagccugugacuuucccgugaaguugcuuugcacacucccgggaagcgucuguagucuagggguucugguccuggggagacggaguggcaucguccuugggaaacuucgcccccaaccccguuuggaagccccagaucccaaaucgacuugcgccgcaaccuccuuccccgucgggacccgggccgccugcgcacgccacucccucucgagcacucucucucucucccuagagguggaggaagaccugggccgugcucuacccggccaguccccacggcguagcgcggcucgaguucuuugaccauaaggggucgagcucuggggguggccgagggagcucgcgccgccuggacugcaaagugauccgucuggcugagugugugaguguggcccccgucaccguggagacccccccugagcccggcgccacugccuuccgccuggacacugcucagcgcucgcaccugcuggcggccgacgcgccguccagugcagccugggugcagacgcugugccgaaacgccuuuccggugaggagcugcggcgaugcggggugggggcaguuacagaggcagagaaauggggcugccucagaccgacccccgcuccccgcugaggaaauuacggguuucucgaugcucucuacuacagaaaggcagcuggacucuggcgccuaccgauaacccaccuaagcuuucugcccuggagaugcuggagaacuccuuguacagcccuaccugggaagguagacgccucagaagcccgggcagggauggagugaagaggaggagggccgagggccuuugggaaguggguggauacccaggggcccauggggaaguaagaaguaggaaggcccugagaucuggcuuccgagugagugcuuggacacuaugcucaugaguccucuggguccccacugcugcccccgucccucccccgcagcugucuaaucguguaugccuuccaggaucccaauucuggguaacggugcagaggacugaggccgccgagcgcuguggccugcauggcuccuacgugcugaggguggaggcugaaaggcugacucuccugaccgugggggcccagagucagauacuggagccacuccuguccuggcccuacacucuguugcgucgcuauggccgggacaaggugcaggggcuguccgggagggcuuccuggguugggcagcugugggagggguggggcaggacagaaagugggaagcucugaccuuuggaucccccuuucuugccuacccggugaccccgcgucuguucgcagguggucucuucuuuguagauacccuaacuagugcaggcgugugacucacuuccucugauggcuccugguaauguguuucccccucuacccuccuuaggucauguucucuuucgaggccggccgccgcugccccucaggcccuggaaccuucaccuuccagacggcacagggaaaugacaucuuccaggcaguugagacugccauccaccggcagaaggcccagggaaaggccggacaggggcacgauguucucagagcugacucccaugaaggggagguggcagaggggaaguugccuuccccaccuggcccccaagagcuccucgacagucccccagcccuguaugcugagcccuuagacucccugcgcauugcuccaugcccuucccaggacucccuauacucagaccccuuggacagcacgucugcucaggcaggagagggaguacaacggaagaaaccucucuauugggacuuguaugagcaugcgcagcagcaguugcugaaggccaagcugacagaccccaaagaggaucccaucuaugaugaaccugagggccuggccccagucccuccccagggccuuuaugaucugccucgggagcccaaggaugcaugguggugccaagcucgggugaaggaggagggcuaugagcuccccuacaacccugccacugaugacuacgcugugccacccccucggagcacaaagccccuccuugcucccaagccccagggcccagccuucccugaaccugguacugcaacuggcaguggcaucaaaagccacaacucagcccuguacagccagguccagaagagcggggccucagggagcugggacugugggcucucuagaguagggacugacaagacuggggucaagucagagggcucuaccugagaaggacggcaaggcugagguggcuaagggggaccauggggagguggcacuagggaucaaagaagaugguuagaaccagcagaagccagagggugggaggggccaugcugugugagaccaggggaccagagggaugggagagucaagggaaggacaaucccaggaaguccuaagaaguggggcagauggcagggcugaggaugggcucugcaucccccaaagccaucccuucccuacuuccccaaaugaagggacggcugugggaccaggucuguggaaaguggugcauggucagaaugggugcaguuugaggggccuguguggaggccucagggagauguuggacugugccuggauccuuacuccugcauuguucuuugccagagaccuauuuaaaaauuuuaaaauucucauuaaagucagcuuggguuuaagaaguuuaugugugugaagagaaaaagaggggacacagugguuggguugggugugguggggaucaagaggagaaccaggaauguguugagagucacggagaggcaaggggcccaggaagggaacagaaguguggcgguucagugccuggggagucaagucaagcugcccugggcuagaugugagcucuguggcccugggugauaacaucugcaacccucaguuuccccugugccccucuguaaaauggaaaagcuauaaugggcucuaccucacagggcuuuuugua

SEQ ID NO: 14715 - RNA, 22554 nt, Homo sapiens
agagacccacacgggccuccggggcuuuauuuacccuggccgggcccgcccccagccccgcccgagccgggcuguuuagacuccgcuggcccgggacucggagggagggcugggguugaaccgcuucccgccaccaccggggccgccccgccgcccggccgccgcuugcaugucagcucccugaccgcagaggccuggccuccaugccgcgggaagagaaagcuucauugaacgagccgggagggccagggagggggagggggcgcggcaguggccagcuccacggggagggaggacccagaggaggagaggagggaacuggccgggaggaauggaaggagaaggcggaaugugggagggcucagggggaugugggagggacgaacggagaagggggagagagggggguccagucuccccuggccgagcauuuuuuuuuuuuuuuggaaguccuaggacugaucuccaggaccagcacucuucucccagcccuuaggguccugcucggccaagguagggggagucacgcuaaccgcagagggaaugaguaggggauggagaggauguggagggaccagggaaaacggguggugugggauggagucgaggggaagccacccaacugagaguuugauucuugucaaagggcaagugagacagaguacacggaggaggcacauaccggaggcgggggcuacggguguucgaacagggccgccaggagcgcccuaagggagggggcuccuccgggaggcgcugccccuggguccccaacccagaacaaagcugccuuguuggauugauuguuuggguugggggaagcauguugacgggggcuugcuguagaggggcuguucucagcccuaggcagagaaggccuuggcugaggagccauagcgccuggccucccguugcccggugacagggauggugguguuggcaggaggcugggacaacccuaccccaucccccgcccagccuugaggccuggcccuccugggccucuugacccugcagggcaucugagagccugcguguuggggagggcgugcagcagguucuccaggcgagcuuuggugccagccuucccugccugggaaucugcuggguuaggacucugggcucccauucaggggaucugugaucccagggccgccuagggccccuuacgugccucucugcacaaucaguacagcugucuguccucccucugaguaaauggggucaucuggaucccucccacguccgccccuuggcucuugucaaucccucuccuucucacccgcggugugcuugguuccccuauacugagugcuuaguucuuugccuaucacuuucuauccguugucucucuccucugugucuuucugguuuucucucucucauucccacagucucccuuccucucacauccugucugucugggucuuccucucucucuacgugucucuugcucagucucuaucucuuuuuauugacccuucucugacucucgaucucucauaguugucucuuaucucugggucucucaggcugugccucuaugaccugugccucagcccuuauuuaauguguuucucucccugucucuuggucccuggggcucuuucucuccuguugucucucgcugucucugucuuacucagugucuguuuuucuuucgugacuucucccucucuuucugacucugggccccacucaaucuguuucucucacgcacacuuugucucuggggcacccaggccuucccugccaugcgaccugucagugucuggcaguggagccccugggggcugcugcugugccugcugugcaguucgugcuuggggucuccguccccuuccacgggcccugagaagaaggccgggagccaggggcuucgguuccggcuggcuggcuuccccaggaagcccuacgagggccgcguggagauacagcgagcuggugaauggggcaccaucugcgaugaugacuucacgcugcaggcugcccacauccucugccgggagcugggcuucacagaggccacaggcuggacccacagugccaaauauggcccuggaacaggugagcaaugauccaggcauauccuagauauuuccuauguguggccaaagugcagggaaagggaacacgaggauggcacagccauagggacacacgacaccaagaacagccagcauugaguaaauccauggaugacaaaccaagcaacauaguuacuucccagagcugugugaccuuaggcuagucagugcuuucucugagccucagaugcccuguaugcaaaaugacuagaugaugucuaaguucuuuucugcugcaaaaguaugauccuacaaagccauccacaaaacagcccagauacaggugagcccuguacaaauaaaguacaguuagucucaugggacgcuaagagcagguaaaugauaucuggaugucccaaagucacaaggggucacagacacugcagcuaacaaaaucagguuaugggccagagcuaaaacuaacaaggugguacugucuaaggacaaguauaaaaucuaggacaaguaugagugugggugguggaggcuuaagagcaguucccuaggugaggccuaggacugugcccaugguaugaacccacagugggaaugauggacagaagcaggugcaaccugcagcugauuccccaguucccacuggcuagaccaccuguggaauuaagugucauuuguagaugcuguguuuuaagagggacaguagaaaauggaaauacuuucagaggagagcugccuagaugugaaagauucagaagccaaguuucaaggaggaauugcugaagaaucaggggauugauauggaaaguaaaaaccuugcauagcaauggcguaaugguuguuuuuaaauaugggaaggacagucguguggcugaaggauuuuucugguuggcaccaaaggaaugaaucagaugugguaggggaaagucaugaagagucacaaggacuuugaugguuacacagucugguggggcaggagcuaggugucuccgcaacaacuggguaaguccuguugggaugugaaugagauguccuugaacauuggcuaggacagaugaccuuugaggcugcgcccaauucugagaggaagccagugauacuccacaggguucaggccgggcucaguggcucacgccuauaaucccagcacuuugggaggcugagguggguggaucaccugaggucaggaguucgagaccagccuggccaacaugguugaaacccugucucuacuacaaauacaaaaauuagccagguaugguggcacaugcuuguagccccagcuacuugggaggcuaaggcaggagaauugcuugaaccugggagacagagguugcagugagcugagaucaugccacugcauuucagccuaggcaacagggcaagacuucguuucaaaaaaaaaaaaaaaacagguuucagacagagagaagaacaaggggcuauauggcagcacagacagggcgggcacaagagagaaugcaaggaugugaagaaaggaucuuagacauccaagccucacagauagaucaaacuccuaagcccccacguauuggcuuuauggucuuaagcaaguugcucagcuucucuaaaccccaguuucuuuauauaaaacaguguucuggcagcucuguucuaagaaugaucacauaugugcacaccauggcagagcaccuggcacacaguagguaccugauuaauuguagcuaucaaugaauggguagagacugaucagaacuucaggguugauucuugguuuuuuauucaccguaucagguucuugaguauccccagaucacaccaauuuucccucaaucuuaugcccccuuccuauucccugccaggguccccugucccgucuccaccccuuaucauaccagaaagaugggaucaucauggccaagugggaggccucagcacucacucuucccuacauccccauuacucccccauccucccuccccaagcuucucugucccuucaucuccccuuccacaggccgcaucuggcuggacaacuugagcugcagugggaccgagcagagugugacugaaugugccucccggggcugggggaacagugacuguacgcacgaugaggaugcuggggucaucugcaaagaccagcgccucccuggcuucucggacuccaaugucauugaggucugcauuuccuagacauacacacacacacuacccaggauagccgagaguacuguggggugguuagcggagacauuagaagguaguuaccccugggggaucauuuggauuggugggagacuuggaaaagcaaaugauagagcucccagaugcuguaaaauccaacagguuuuuagcauucacauucaaggggcuaaaccuggcaugagccucuccagcuucaucccuagucaccccuggggcaccuggugcucuccuucuccucaaauguuccugcuuuccugagacaucuuccuucugacuuucuccuccuucaaagccauuuccuuuuugaagugcucccuccugcuccaggcacagggagggccuccuuccuagugcccugaauccucucugggagcacagcacaucccacgcgcugcuggcugcaagagaguccacaccgcggacugcggccaucguggccgcucucucagcgccgccucgggcccaucccgccacuggguuuacagcaggcacaccaagcaggguuccuuaagggcggcgggacacaugaaaggugccacugggauucuuucccugcuuguggccccgcccccagguagagcaucaccugcaaguggaggaggugcgaauucgacccgccguuggguggggcagacgaccccugcccgugacggaggggcugguggaagucaggcuuccugacggcuggucgcaagugugcgacaaaggcuggagcgcccacaacagccacguggucugcgggaugcugggcuuccccagcgaaaagagggucaacgcggccuucuacaggugaggggccgcgggcgccgggcggagcaggccgggauuggggugcucccugaugaauagccuugggagacaucugagcagguccggggcacgggaggacccgggggucgggacgcgcgggaaaauauggaggccguugcaaagcuggagaguugggaaaucuugugggaccacgaaaggugccccaagggaguaccugaaauggggaccagcgaggcucccgcucucucguggccgacgccugggcgggcaggcggauuccucggccccggggcgcgcgccggccucgcgaggccacucccaggcgcgggggcgauuccagcgcuggcgcugccggccagcgauuuccgaguucaguaaggacgcggccgccccugggaggcggcgccugggugugucccgcgcaggcugggcgcccaggguccgggggcccggggacggcggcgcgcgauggccgaagggcgccaggagagaccgcgccagucucucugcccgggccgccccggggcggggcgcguaugugaacgcucgagcccucggggcuccuggaaguccuggaaguuucccaggaucucuuuuggcgaggcccaaccucuccaccugcgcuggagcccugggguccaguccggcuuccagggaaacgcaucacccuggaaacugccugugcuuaacgucucccuucccuggaacaucuacuuugaucuuuuugagaaacugccauugacagccaggcauuuauuuggaaaucuuuacacccucucacuguaaucuauuuugcgagccaaaaauccucccuuucuucagugguucccuagaucaguauugcugaaaggccucuugauguccggauagguuuccgcgggcacacuacuucagauggggucugaugccgccagcuacuguagaaauccucaaccccgacugaagcgugcucggauuacacugucuuccuacugcggcagcuucccacugcuuauacugaacuugucaucacuuaaaaccaguucaggucuucccuaugcuuccuacugauagagcagccuuuuccaacccagguauaggugacguuuaccuauuacauuuguuuugauacauaauuuagaagccauaaaaaagccaugaugaucccaugagauuaucuugaguccugaugugacuuuccaucugucauuuccccucagccuccucugcugaacagacauggcagcuuugccuucuggcuucauccaaauggcuaaaaguuguuguggaaauguuuaaaaccaaagucuaacucuucuugcaaaauguuccuguagauuuucaucaagcuucuaaucaucagcuguaaaauauguuccuuccaccaacugggaagaaacagaacacuucaaugauguaaccaacauuucaccuuaucuaucuauauauuucuuaucuguaaugaaaucaugggagauucuguuaguuuuugauaaaauccagauaugcuauguucacagccauucuccagccuuccaauuuaguaauccugucaaaaaagaaaaucauaguaguuugagucuauuuuuacugaaauccuuuuaggucucuaagaaucaccuuauuuuuuccuaaaugcuuacaaacuucuauuuaauaauuuauucuagaauauuacuuauguguagauugaggaauugaggaauccuuuuucuccuuuuuuuuuuuucuuuugaaagucaggauauuauccagucuccagucuuuucuauaccugcucacacuuucuuugccuuggcucugaggcucaucugaaaugucuuucaguacugaggacuuucgguacuuuaucuggccuggacacucaaaccacuuuaaaacaaacgugcugugccucuuuacuuucauccaucuuggggcugcauuuccuucucugugcugcuuaccuucccuaauuuaaaccccauguucugaaagaugcguagaauuuagacauuuccagugaagaagauagcgugaacaaagguguagagauccacucacccaauauuuauuuacugagaucuuacuaugugccagguacuguuguagacacuacccguggcucaugccuauaaucccaggacuuugggaggccacgguggaagcauuauuugagcccaagaauucgagaccagccugggcaacauaaugagacccugucucuacagauaauuuuuuaaaaauaaaauuagcugaacaugguggugcgugccuguagucccagcuacuugggaggcugaggugggaagauugcuugagcccaggaagucaaggcugcagugagcugugaucaugccacuacacugccuggguggcagagcaagacccugucucaaaaaauaaauuaacuaaggccgggcacgguggcucacaccuguaaucccagcacuuugggaggucgaggcgcggaucaccugaggucaggaguucgagaccagccugaccaacauggagaaaccccaucucuacuaaaaauacaaaacuagccgggugugguggcgcaugacuguaaucccagcuacucgggaggcugaggcgggagaauggcuugaacccgggaggcggagguugcggugagcugagaucgcgccauugcacuccagccugggcaacaagagcgaaacuccgucucaaauaaaaauaaaauaaaaauaaauuaaguaaguaaguaaauaaauaaguggugaaggaaggccucuuggagaaggcaucauuugagaaaagauuuaaaggaggugagggcacaagcuaugcagaccucuagauaaacauuucuaggaagagggaucaaaaaugaaaauauucuggggugugugugugccuguguguguauguagugggugaugggauaaggccucuccuucuccuggaggccacuguggcuggagcugagugaaaaagaagaaaaugguaggagaugcaguguagguggucuucggaaaagaaugggaagccagauccugcgggccaucugggagaggauggcuuuuguucugugggagauaaggaaccacuggagggcuuggagcagaggugugacaucgggcuuccauuuuuuuuucaguacuacuuucacugcuuuauuaggaauagauuguaagggaugcaguagaagcaagaagucagguggcugguuaugggguuauugucuucugaaagccacguaaagaaagugaaaggugauggugaccagugaaaguggugaaaaaugaucaagauuuacagacaguugaaggcagagcuauaggacuugcugauggauucagugugaugugagagagaggaguuaaggcucucuccagguuuuuggccucagcuaaguaagaaauuggccucaccugacaaggaaaacagugaauggagcauguuuuguugggagaugggcuuggggguggaggguaggaacuugguuuuagaccuguuaaauuuaagauucuuuaagacauugaaguggcgaggcuaaguuagguaauuuaauauaggacucuggaguucaguugaguaaaacauauaaaguccugaaacuggacaacauaccaaggaagugaauguaaauuuaaaagacagagagaggcccagagacugaaccuuggggagacuaaauauuuaaaagucagaagauaagaugaaugcaaacagugaggugagguaggaagaaaaccaggggagugugguggccugggagccaaguaaagugcuucgaagaggagagagugaccagcuaagucagugcugcccagaccuaaaaacaugaggacugagaaacaaaugcuggauuuagcaacaguaaagucacuguuggccccaacagagaugauaaugaaugguuuauauuuggaagacaguaaguuagcaagaguagguuuauacugagaaauaguggaagaucuggauaaagggaggccagaaaauggaaugcuuuaggugccaaauuggagaguuuggccuuugccuuauagaaaaauuacaaauaaagguauuuauaugggacaagaauaaagccaguguuuuugaaaguuugccugauaguaguggaugaggagaggagggucuugaugcaguaagaccagucaggaguuuguucuaaaauugaagcuuaucaggaggguaaaaacaaagauggaggaaaaugaauagauguaggaugacugauagaacauagagaaugagagaacagacaccuaaaaugauuccgaugcugccugagagaaggaugguaccagcagccaucucugggcuucagguuaauaugaacuagcuuuagagaugggcuguccuuggaaaguuugagacacaggaauuguccccagguaugcaaagcugaaauaaguuuuagggaucaggaauauuuguuggacauaucggaaucucauacuaagucugggauauaaaggcuggagaaagagauacacuaaagcacagaggccauucuucguggggaaagagauugcgggagcccugggagauucugugauggggcuaugaucuagauccuucacaggucaggcccagcagagggagcauucucacaggugauacaauuauuacaauuaugaaagauaggcaagacaguuguaaacaacucuccccuccuuagggaaaaaaaauggaucugcuggcuuuuagaggaagucaguaagauuuagggaaugagaaaaucaaaaccugauguauuaaucauuuuucaauuuguuuugguaguucuacccuagaacauguaaaaguuguagaacuuuagaauaagaaaagaauguacagauaauugaacuauuuacuacucuuuuacagguaaugaaauugaggcucuaagagcuucagugcuauuuaagaagucacucuucuaguucauuucagcuugacagauguuuauugaacuccuauuugccaaguacugugcaaggugcugagaauacaaaggugaauaaaugacaagagagguuauuaggcugcagaucauagaagaccuuauaggccaucauaaggauucagguccuuaugauaaaaggauugggaagccuuugauguuuggauuguuuguuuguuuguuuuguuuguuuguuuuuuugagagggagucuggcuuguugcccaggcuggagugcaguggcacaaucucugcucacugcaaccuccaccucccuggguucaagugauucuucugcuucagccuccugaguggcuaggucuacaggugcccaccacgcccagcuaauuuuuguauuuuuaguagagacgagguuucaccaugcucgccaggcuggucuugaacuccugaccucaggugauccgccuaccucggccucccaaagugcugggcuuacaggcuugagccaccgugcccggccauugaaguguuuuaauggggagggcuaugagauggcaugaucagguuugugacuccaaaagaucauuugaaucuauuucuuuuuuuucuuuucuuuucuuuuuuuuuuuuuuuuuuuuuuugagacagagccuugcuuugucacccaggcuggaguguacuggugcaaucuugguucacugcaaccuccgccuccuggguucaagcaauucuccuaccucagccucucgaguagcugggauuacgggcacgcgccaccaugcccagcuaauuugcugauuuuuggguauuuuuaguaaagaugggguuucuccauguugcccaggcuggucuugaucuccugaccucaggaucagaucaagugaucugccuguccuggccucccaaagugcugggauuacagcuaugagccaccacgccccgccuuugacucuauuucugagaauaaucaggagaggagcaaaagauauggauuggagagauauuuagaaguaaaauugacaggacuugguuauugauugacuuugggauccaagaaagggagaagucaggauugaccccuagguuucuggaguggauuuuacugagauaauuaucuuuuuuuuuuggaccuacauuacauuucagauuacuuucagaucucuaccuagaaacaucaagaaggcaaugaaauagacaagauuaugaauacacuaggugugaauuagaccauauagagggcccuauaugaagugagaacaaaaugccuaagaaagagcuccacaaauuuuaaugaccagauaggggaggagccugcagagaagaccaagaaagagcaaccagaauuaggaguaggcggcucuaggcacacugccuaggagucagcccugcucccuggggagccacucuggaaauuaauaauaauaauaagcagaauuaggaauaaaaccaggauauuguaguguuauagcagccaaggaaagagaggacagucagauguugcagagaggucauuaagaugaagacugaaaaaugucugcuggauuuaacaaaauagaaguuugcagagugauagguagggaaaaccagaggaaguggguugaaaaaugaguaagaggaggcugggcaugguggcucacaccuguaaucccagcacuuugggaggccaaggcaggugaaucaccugagaucaggaguuugagaccagccuggccaacaugaugaaacuccgucucuacuaaaaauacaaaaauuagcuggcugugguggugcgugccuguaaucccagcuaccugggaggcugaggcaggagaauugcugagcccaggaggcggagguugcagugagccaagauugcaccacugcacuccagccugagugacagaucgagacucugucucaaaaaaaaaaaaaaaaaguaggaagagaggauauaaagaugauaaguauggacagcucuugagaaauguuacugugaaggggaggagagauaaguagagggugugugugugugugugugugugcauguguaggagugauuugaauguuuaaaaggauucaguugagaaaaagaaaugguaugcaggacugagaaaaauuguaagagauggaauuuagaaacauuuagguacaguagacuuagagaagaaaaauaguugaaagguaugagaagaggauaugcaaauguagacagguuuuuguuuuggguuuuuucuuuguuuguuuguuuguuuguuugauuccuuguuuuugagacagggucucucuauguugaccaggccagagugcaguggcgccaucauggcucacugcaaccucgaccucuugggcucaagcgaucaucccaucucagccuccugaguagcuggaacuacaggcucgagccaccacacccggcuaauuuuuaaauuuuuuguagagacgaggucucacuguguugcccaggcuggucucaaacuucugggcucaagcaguccuccugccucagccucccaaagugcugggauuacaggcguaagccgcugccccuggccuacauagguuuuuauguuugauggcugaaggaaggaacaaaugguagguggaaacaaacacaucugugaaugaagaaauuuaaaucaagacaaauaacagcacugguccucaaugaggacaaaguccuuaacauaacuuauauauaauuuuauauauaaaauauuuauaagauaaaagggucuaaacucuuuuauauaaauaugaaauaagauuacauauguuuguguauauauauauauaaauaauacaaagaccuguugauauaagguccuuaaauaauuuagagaagagguacuucuaaauuucuagauaauaccaaaauguuuuaguacuacucuggagaucaaggugaacucuccagguugauuggugaagaggccaaguguauuucauuuuagacauuuuagacauguuugagaaaaagacauuuggagaaaaaauuucacaccauauuuauaagaugaaagagucuaacuauuagcaaugucucaguaaagggaccugagaguuguauauucuuugccaggaauguccaacacuuuggacacuuuggcaaagagaccaacuaaguacauccucaggaagaagcugaggcagaaaauaucaaacagcuucugacugguuuaaaauauauacguauauuuaaaucccaaggugucuucacacauuaaacagucaucccucaguaaccaugggggauugguucuaggaucucccaaggauaccacaauucaaagaugcucaagucccugauauaaaaugcuauaguauuugcauauaaccuaugcacauccucuguaugcuuuaaaucaucucuagauuacuuauaauaccuaacauaauguaaaugcuacauaaguaguuguuauauuuuauugcuuagggaauaaugacaagaaaaaaaguugguacguguucaguacagauggagguugaaucuacagaugcagagcccauggauauggaaggccagcuguacuauguugaaauaugacuccucaagagaaacagcggagcaggaacauguucaaagaaaggacaacuaaggcugggcucaguggcucaugccuguuaucccagcacuuugggaggccaaggcaggaggauagcuugggcucagaaguuugagaugagaccagccuggacaacauagugagacccugcuucuaacaaauauuagccagucaugauggugcacaccuguggucccagcgauucagaaggcugaggugggagaaucacuugagcccaggagauaaggcugcagugagccaugguugcaccauggcucacugcagccugggugacagaguaacccugucucaaagaccaaaaaaaaaaaaaaggaaaaauuauuuauuucccuggaaguaaguuugggagaugaacucaguuugugaaugaccacagcauaugggauuggaacuucagcaggaaggguggugucauuguaaggagccuggccuguguuccccagucaaaccaaguuaacgcccuuggauauucggccuugguucuugguccugguccagcggccucaggccugaacaaugccagagucuuucucaaagagagcauccaggaaaaaaagacacaguagccucccuaggccugacucaggcuaguucugccgccuagccuggucagucuggcaaucuuaacaauccuaacgaugcuccccuuagcccuccacugagguuuagcacuaacaucuggacucaggaguccuuacuugccaucugcccuagcuaauuucugagggugcuggcaugggggcaccguccugaguccacggccuucacuucugcucacccaccuggucaugugcugaagaggccaagcagcuaugaaagcuugggucucagccaggugcgguggcucacgccuguaaucccaacacuuugggaggccaagacggguggaucacaaggucaggaguucgagaccagccuagccaacauagugaaaccccaucucuacuaaaaauacaaaaaaaagaaaaaagaaagcucgggucucaggagugucugcuguuauaauauccugccaccaggaagccuucggacugcuagaagagaaaucuugccccugguccuaguugcaccagcuuuuccacuugguucuacacuaacccugacuacuguugucuuauccucacagaaaguugaggaagcgagcggccaaggucucagcccgacaccccaagccccuuggaagguauggggcaagagccccgggaccuccugcucgcccugcggccccaggagguggauggauggauggcagccauccauguccaucccagaacccaagcugauggauuagggaugugaggaaaauggcuuuuccugcagggaggugaagggagcaggcauggggaugggcaagcuuugaucuuagggaacacaaggaggaaguaauguaggaguggcugagaagccucccaucuuuacaccuaccccaaauagcuuggauuccagccucagccaccuucauucuuccuccuuccugcccccuccaucaccucccuuaguucacccacauucccauucucuccccucuccaccuuuccucuucccuucuccccuucccaacucccccaccuggauugacaucgcuagauuucccauuacuguugcugaauccagagagcagcaugaguuccugaaaugcaguucaaugguguucagcagacgguggaugcggaaaaucuucauuuuucccauccccaugcugcccacaaagggucuuucccagaaacagaaaaauaacccuguaccuuuccugcgccacauauguaaccacuaccucuaccaacuuccuucuccuuuuugcggaccaaucaccaagcuuaaagucaaacccaaaccccgaguggucagggggccacacaagagguaaauaaaauucagguuggguggaaaggagagggagcauggaguuacucggcuguggccagggagggaggggguccaggaggccuuuguggcugaaagagcugaccaagaggaggagcagcagcagcucuuagaaaucaccuuccagggcauuuacugaaguguuacgcaagacugguccuuaccuuggucucaggaaugaugcuuguccuaggauuuguuuuuucacucacugacuaccucguuccacauguuuacuuaucuuccccugcugaguuccaggagacaacauggugcuuuucucuuucagacgccauacuugcgucuccuguaagagguuacauuugccuaaaggaucaguguucccaaaucaaaugcuuuauuugauuaguuguuaaaaauaagugcuaccagcuuacucgagauggagggaaacucagcguccccuuuggaaccuuuaccaggaaugcagucagauugacagccccugccucucuggcucauuuuccacaauuaggcucccaguucccuaauuuuccuccugggcuccuuuagaacucgaagugggaagcuuccaaccccuguaauuacaucuaacuugucuucaaaaggcaguuugcacauuaaaagucucccugauaacuucaagagggacugaaguaucgauaauucaucccuuucuccccuccuguucucaacaaguucuagucucacccagugguccccucauagcccucauuccccagcuucucuggugguuucaaaggaucucagaaauuuggggauguucuuguagugcccuucuagcuuagggucaucuuugcccaacauggccacacucuagccuucccugaccugcacauuaaaguacacacugccauuuuuauuuuguucauuguagacaacgggaaugaggauguuuagaagauagauguauuuuuccugugaugggcuccuugacuuuuacuuucagccaaacaggacugugggagagugccugaucucuuagaucuucaggauccauuuauccugagcuuccaaagguauucuguaaagucuccaggcuuccuuugucuguuuuguguauaaacuuuuccuccuccugugucuuccuagccaauggcuucaagucaucauauuccauccuuccucugacaucaagugauagggcacauuauugcaauaaugcaugacuacaucagccucacaggcccguuccaccagcaccagaccucauuuucuucccuuucucugcgggcagaguguacuucacucuggcacgugccucacugcagccucucauucuacugguaucgauaaagaaguccccccauucucucaaacaucucggcagcauuuccaagccuuagcaucuauaguucagucccauuauccuauucagauggcuuugggacacuguuacguugaaauugcagaagcauggacugccuuuuuaaagacuuacacagcacagguccugggaugucuuugccauuuuguuguucacauccaucuccuuucucuggucauuuauucccucaaacuuugaccuguccugcauuuauacaucuucauucuugcauaugccagucccaguuuuucuugcgucuaccugcuggucuguucuugcugcaucugccccuccuaaucuguccugcagagucucuggccucugcggagcuauggagaugggagacuuccuuaguccuuugcauccugacucauucaguuauuccagucucagcaucacagaaggacuugcucgcccuggcuuuucaggcuuccugugucagccacucccuccuggccauuucuuccaacuggaaaguccugguuuccccuucccugaggccuuagccucagccuccuuuagggccagcagccugaaaccacuuggaacaguuucuuccaggcaagucgagacuagccauccuucucuuaagguuguucuacugcaggagguccccaaggccccuccuaucuggguaguugaggcucccucagccuggaaacucagcaauccccauguaucucccgagggaaacauggaagggggaagaagaggagauaaauggucacaaaaggguggggggcaugguggaggcaugaagugggaggauguuuguggggccaagaggcaggagcauuguuuuacccuacugcaccucacuccugucccccuaggcugcuagcccaacggcagcaacacuccuuuggucugcaugggguggcgugcgugggcacggaggcccaccucucccucuguucccuggaguucuaucgugccaaugacaccgccaggugcccuggggggggcccugcaguggugagcugugugccaggcccugucuacgcggcauccaguggccagaagaagcaacaacagucgaagccucagggggaggugugugagacagugauuaugaccuuucccaccccagguggagaaccccuagccuggcaaccccagacuaagcacagcccugaccuuugaggacagagaggagccuuccagggggugggccacagaccugauaccacccacucccuuccaccaaagucucacucaucucccaggucugcuuagcccuccgugcagauguugccauuugccucuguugggcacuucucucuucuauaggcccguguccgucuaaagggcggcgcccacccuggagagggccggguagaaguccugaaggccagcacauggggcacagucugugaccgcaagugggaccugcaugcagccagcguggugugucgggagcugggcuucgggagugcucgagaagcucugaguggcgcucgcauggggcagggugagguggcauggaggugggagggagagggaaggagguacaugcuccuggggggcauauuccuucggaagguuagguguccccugggcagacaauauaugcuuaauuacaacuuccugaucuuugccaucuggcccuaggcaugggugcuauccaccugagugaaguucgcugcucuggacaggagcucucccucuggaagugcccccacaagaacaucacagcugaggauuguucacauagccaggaugccgggguccggugcaaccuaccuuacacuggggcagagaccagggucagucauccucucuaccuugguugaggucucuuucauccuauccaggucuggucuccaaucuacaguccaauggcccccagcccauugccccaggccccugcccuccugcagcucccaccugacccaucacuugcuagcccauuaugugccugagucacgcuucagccacaucuguuagagacucccacuaccucaccccaaagcuuucuccagcgcuuccauucugugucacuacagauccgacucagugggggccgcagccaacaugaggggcgagucgaggugcaaauagggggaccugggccccuucgcuggggccucaucuguggggaugacugggggacccuggaggccaugguggccuguaggcaacugggucugggcuacgccaaccacggccugcaggugagugggaaggaaaggggagccgaggcuguugucucaaagccuguguuuugggcagagggcugaggaaugagucccuuggcccaagaugcuggauccugggccuuacagaaacaucugcauauguccccaggagaccugguacugggacucugggaauauaacagagguggugaugaguggagugcgcugcacagggacugagcugucccuggaucagugugcccaucauggcacccacaucaccugcaagaggacagggacccgcuucacugcuggagucaucuguucugagagugagugaaggagggggugaugcaugccagggaagggagugucugggccacccguuugcagggaaagggggcuguaaucuggaggggcacuucuuccccauaaaagagccaguuucgccgggugcaguggcucacgccuguaaucccagcacuuuaggaggccaaggcggauggaucacgaggucaggaauucaagaccagccugaccaagauggugaaacccugucucuacuaaaacuacaaaaauuagccaggcgcaguggcaggcgccuauaaucccagcuacucgggaggcugaggcaggagaaucacuugaacccagguggcagagguugcagugagccaagaucacgccgcugcauuccagccucggcaacagagugagacuccaucucaaacaaacaaacaaacaaaaacaaaaacaaaaaacuagucuuacacacuagggagggauggaagcaccccucucugugaagucagcagugacuucuaacacccccuuccuuucuuggugcagcugcaucagaucuguugcugcacucagcacuggugcaggagaccgccuacaucgaagaccggccccugcauauguuguacugugcugcggaagagaacugccuggccagcucagcccgcucagccaacuggcccuauggucaccggcgucugcuccgauucuccucccagauccacaaccugggacgagcugacuucaggcccaaggcugggcgccacuccuggguguggcacgagugccaugggugagaggguagggagucaaguagaagggcaagaccacgggggauggggcaaaccuucugggggcagagaaggaaacagaaguucccuucuccccacaggcauuaccacagcauggacaucuucacucacuaugauauccucaccccaaauggcaccaagguggcugagggccacaaagcuaguuucugucucgaagacacugagugucaggagggugaguuggggacugaagugaaccacaugguauccauugcacagccuuuccuuacacugacauaugccaaucccuccagaugucuccaagcgguaugagugugccaacuuuggagagcaaggcaucacuguggguugcugggaucucuaccggcaugacauugacugucaguggauugacaucacggaugugaagccaggaaacuacauucuccagguaccuggagucuggggcuuccagaugggugaguggggggagcguuaaagacaccuuugaauucgaggauugucgcuggguuaaguggccuuuuucucacucacagguugucaucaacccaaacuuugaaguagcagagagugacuuuaccaacaaugcaaugaaauguaacugcaaauaugauggacauagaaucugggugcacaacugccacauugguauuugaugggaagagcaacccaggaagauuaggggaugggagggaaagacguucauucucuuuuccauagcuuguuucuccaucuucccaccuuccuguagagcucucagucccuccacuucuacccacccuucuccacagugcaucuaucucccucccucugugcagggcgccucccaaauugccuguccacucugcaggugaugccuucagugaagaggccaacaggagguuugaacgcuacccuggccagaccagcaaccagauuaucuaagugccacugcccucugcaaaccaccacuggccccuaauggcaggggucugaggcugccauuaccucaggagcuuaccaagaaacccaugucagcaaccgcacucaucagaccaugcacuauggauguggaacugucaagcagaaguuuucacccuccuucagaggccagcugucaguaucuguagccaagcaugggaaucuuugcucccaggcccagcaccgagcagaacagaccagagcccaccacaccacaaagagcagcaccugacuaacugcccacaaaagauggcagcagcucauuuucuuuaauaggaggucaggauggucagcuccaguaucuccccuaaguuuagggggauacagcuuuaccucuagccuuuuggugggggaaaagauccagcccucccaccucauuuuuuacuauaauauguugcuagguauaauuuuauuuuauauaaaaaguguuucugugauucuucagagcccaggagucagugcuggugguuggagggaccugcccccacugguucauuuaacccucugucucggugcccucagaaccucagccagaaaggcaaggaggaaaucagagcaggagccucauacucuuggugaucuauucauucugugaccucaggggucacauauaaggucaguguuucucguccccgccggaucugcacugccaacugggauuggguucgaacagcuucauaaacaucuucagcauuuuguaccaucugcuccccaauggccaaaaucacaucaccaggccgcagaccagcccuauagagaaaaauggacagagagaaaggaaggaguacaaagccuaguucaaggacacaugcacaccuugcccauccccauaucacacugcagccucucccucaccggugugcaggggagcccaggaugacuuuauggaugaguacaccaugcugaacaucgggaaagcuugguucucgaagcuguaguucagcaaggaugcugaaaguacacagaucacccuauuagccaaacccaggcauucuccccauccugaguuccaccucaagucucucaucaacacauugauaaauauauggacaggacaugggcuagguacuacaaaauacaauggcaacucacuuucugucuucuagcaauaaagugcaacauguacauaaaagauguacaccacaugagggcaccaaaugacaaacaguguuaaaucaauagcacuaaugucauucuagaauacuaagagaagcuuuaaggggaaagaacuuaaguugagccuaaaaggauggaucugauauuaaccauauaaaacaagaacagcauaaauaaaaaacaugggaguaggaaaucagguuggcugaguauucauauaggaagguauuacagccaggucuagaaaguugauuuacagacagauggaaaauggcccuuaaaugccaaguuaauggauugaaggcuugaaaucaaagcaguaacaggaugaaaucaaucuggugacagguguacaaaguggagugggauaagaaagucaagaugaugaagggagacagcucuugugauuauuucaagugugacacaguucaucuuagauaaagacagaaaugagaacaaagcucaauagaggugccccccucugauuacacuggucacauuacaugucacugucccuaaagcucauaccugggacucagggucagcaucaucaccccaauguagcgccgcugggacccacugauuccggaggaggaaucugugacagagggacaaauga

SEQ ID NO: 14716 - RNA, 22554 nt, Homo sapiens
ucauuugucccucugucacagauuccuccuccggaaucagugggucccagcggcgcuacauuggggugaugaugcugacccugagucccagguaugagcuuuagggacagugacauguaaugugaccaguguaaucagaggggggcaccucuauugagcuuuguucucauuucugucuuuaucuaagaugaacugugucacacuugaaauaaucacaagagcugucucccuucaucaucuugacuuucuuaucccacuccacuuuguacaccugucaccagauugauuucauccuguuacugcuuugauuucaagccuucaauccauuaacuuggcauuuaagggccauuuuccaucugucuguaaaucaacuuucuagaccuggcuguaauaccuuccuauaugaauacucagccaaccugauuuccuacucccauguuuuuuauuuaugcuguucuuguuuuauaugguuaauaucagauccauccuuuuaggcucaacuuaaguucuuuccccuuaaagcuucucuuaguauucuagaaugacauuagugcuauugauuuaacacuguuugucauuuggugcccucaugugguguacaucuuuuauguacauguugcacuuuauugcuagaagacagaaagugaguugccauuguauuuuguaguaccuagcccauguccuguccauauauuuaucaauguguugaugagagacuugagguggaacucaggauggggagaaugccuggguuuggcuaauagggugaucuguguacuuucagcauccuugcugaacuacagcuucgagaaccaagcuuucccgauguucagcaugguguacucauccauaaagucauccugggcuccccugcacaccggugagggagaggcugcagugugauauggggaugggcaaggugugcauguguccuugaacuaggcuuuguacuccuuccuuucucucuguccauuuuucucuauagggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccucagaccccugccauuaggggccaguggugguuugcagagggcaguggcacuuagauaaucugguugcuggucuggccaggguagcguucaaaccuccuguuggccucuucacugaaggcaucaccugcagaguggacaggcaauuugggaggcgcccugcacagagggagggagauagaugcacuguggagaaggguggguagaaguggagggacugagagcucuacaggaaggugggaagauggagaaacaagcuauggaaaagagaaugaacgucuuucccucccauccccuaaucuuccuggguugcucuucccaucaaauaccaauguggcaguugugcacccagauucuauguccaucauauuugcaguuacauuucauugcauuguugguaaagucacucucugcuacuucaaaguuuggguugaugacaaccugugagugagaaaaaggccacuuaacccagcgacaauccucgaauucaaaggugucuuuaacgcuccccccacucacccaucuggaagccccagacuccagguaccuggagaauguaguuuccuggcuucacauccgugaugucaauccacugacagucaaugucaugccgguagagaucccagcaacccacagugaugccuugcucuccaaaguuggcacacucauaccgcuuggagacaucuggagggauuggcauaugucaguguaaggaaaggcugugcaauggauaccaugugguucacuucaguccccaacucacccuccugacacucagugucuucgagacagaaacuagcuuuguggcccucagccaccuuggugccauuuggggugaggauaucauagugagugaagauguccaugcugugguaaugccuguggggagaagggaacuucuguuuccuucucugcccccagaagguuugccccaucccccguggucuugcccuucuacuugacucccuacccucucacccauggcacucgugccacacccaggaguggcgcccagccuugggccugaagucagcucgucccagguuguggaucugggaggagaaucggagcagacgccggugaccauagggccaguuggcugagcgggcugagcuggccaggcaguucucuuccgcagcacaguacaacauaugcaggggccggucuucgauguaggcggucuccugcaccagugcugagugcagcaacagaucugaugcagcugcaccaagaaaggaaggggguguuagaagucacugcugacuucacagagaggggugcuuccaucccucccuaguguguaagacuaguuuuuuguuuuuguuuuuguuuguuuguuuguuugagauggagucucacucuguugccgaggcuggaaugcagcggcgugaucuuggcucacugcaaccucugccaccuggguucaagugauucuccugccucagccucccgaguagcugggauuauaggcgccugccacugcgccuggcuaauuuuuguaguuuuaguagagacaggguuucaccaucuuggucaggcuggucuugaauuccugaccucgugauccauccgccuuggccuccuaaagugcugggauuacaggcgugagccacugcacccggcgaaacuggcucuuuuauggggaagaagugccccuccagauuacagcccccuuucccugcaaacggguggcccagacacucccuucccuggcaugcaucacccccuccuucacucacucucagaacagaugacuccagcagugaagcgggucccuguccucuugcaggugaugugggugccaugaugggcacacugauccagggacagcucagucccugugcagcgcacuccacucaucaccaccucuguuauauucccagagucccaguaccaggucuccuggggacauaugcagauguuucuguaaggcccaggauccagcaucuugggccaagggacucauuccucagcccucugcccaaaacacaggcuuugagacaacagccucggcuccccuuuccuucccacucaccugcaggccgugguuggcguagcccagacccaguugccuacaggccaccauggccuccagggucccccagucauccccacagaugaggccccagcgaaggggcccaggucccccuauuugcaccucgacucgccccucauguuggcugcggcccccacugagucggaucuguagugacacagaauggaagcgcuggagaaagcuuuggggugagguagugggagucucuaacagauguggcugaagcgugacucaggcacauaaugggcuagcaagugaugggucaggugggagcugcaggagggcaggggccuggggcaaugggcugggggccauuggacuguagauuggagaccagaccuggauaggaugaaagagaccucaaccaagguagagaggaugacugacccuggucucugccccaguguaagguagguugcaccggaccccggcauccuggcuaugugaacaauccucagcugugauguucuugugggggcacuuccagagggagagcuccuguccagagcagcgaacuucacucagguggauagcacccaugccuagggccagauggcaaagaucaggaaguuguaauuaagcauauauugucugcccaggggacaccuaaccuuccgaaggaauaugccccccaggagcauguaccuccuucccucucccucccaccuccaugccaccucacccugccccaugcgagcgccacucagagcuucucgagcacucccgaagcccagcucccgacacaccacgcuggcugcaugcaggucccacuugcggucacagacugugccccaugugcuggccuucaggacuucuacccggcccucuccagggugggcgccgcccuuuagacggacacgggccuauagaagagagaagugcccaacagaggcaaauggcaacaucugcacggagggcuaagcagaccugggagaugagugagacuuugguggaagggagugggugguaucaggucuguggcccacccccuggaaggcuccucucuguccucaaaggucagggcugugcuuagucugggguugccaggcuagggguucuccaccuggggugggaaaggucauaaucacugucucacacaccucccccugaggcuucgacuguuguugcuucuucuggccacuggaugccgcguagacagggccuggcacacagcucaccacugcagggccccccccagggcaccuggcggugucauuggcacgauagaacuccagggaacagagggagaggugggccuccgugcccacgcacgccaccccaugcagaccaaaggaguguugcugccguugggcuagcagccuagggggacaggagugaggugcaguaggguaaaacaaugcuccugccucuuggccccacaaacauccucccacuucaugccuccaccaugccccccacccuuuugugaccauuuaucuccucuucuucccccuuccauguuucccucgggagauacauggggauugcugaguuuccaggcugagggagccucaacuacccagauaggaggggccuuggggaccuccugcaguagaacaaccuuaagagaaggauggcuagucucgacuugccuggaagaaacuguuccaagugguuucaggcugcuggcccuaaaggaggcugaggcuaaggccucagggaaggggaaaccaggacuuuccaguuggaagaaauggccaggagggaguggcugacacaggaagccugaaaagccagggcgagcaaguccuucugugaugcugagacuggaauaacugaaugagucaggaugcaaaggacuaaggaagucucccaucuccauagcuccgcagaggccagagacucugcaggacagauuaggaggggcagaugcagcaagaacagaccagcagguagacgcaagaaaaacugggacuggcauaugcaagaaugaagauguauaaaugcaggacaggucaaaguuugagggaauaaaugaccagagaaaggagauggaugugaacaacaaaauggcaaagacaucccaggaccugugcuguguaagucuuuaaaaaggcaguccaugcuucugcaauuucaacguaacagugucccaaagccaucugaauaggauaaugggacugaacuauagaugcuaaggcuuggaaaugcugccgagauguuugagagaauggggggacuucuuuaucgauaccaguagaaugagaggcugcagugaggcacgugccagagugaaguacacucugcccgcagagaaagggaagaaaaugaggucuggugcugguggaacgggccugugaggcugauguagucaugcauuauugcaauaaugugcccuaucacuugaugucagaggaaggauggaauaugaugacuugaagccauuggcuaggaagacacaggaggaggaaaaguuuauacacaaaacagacaaaggaagccuggagacuuuacagaauaccuuuggaagcucaggauaaauggauccugaagaucuaagagaucaggcacucucccacaguccuguuuggcugaaaguaaaagucaaggagcccaucacaggaaaaauacaucuaucuucuaaacauccucauucccguugucuacaaugaacaaaauaaaaauggcaguguguacuuuaaugugcaggucagggaaggcuagaguguggccauguugggcaaagaugacccuaagcuagaagggcacuacaagaacauccccaaauuucugagauccuuugaaaccaccagagaagcuggggaaugagggcuaugaggggaccacugggugagacuagaacuuguugagaacaggaggggagaaagggaugaauuaucgauacuucagucccucuugaaguuaucagggagacuuuuaaugugcaaacugccuuuugaagacaaguuagauguaauuacagggguuggaagcuucccacuucgaguucuaaaggagcccaggaggaaaauuagggaacugggagccuaauuguggaaaaugagccagagaggcaggggcugucaaucugacugcauuccugguaaagguuccaaaggggacgcugaguuucccuccaucucgaguaagcugguagcacuuauuuuuaacaacuaaucaaauaaagcauuugauuugggaacacugauccuuuaggcaaauguaaccucuuacaggagacgcaaguauggcgucugaaagagaaaagcaccauguugucuccuggaacucagcaggggaagauaaguaaacauguggaacgagguagucagugagugaaaaaacaaauccuaggacaagcaucauuccugagaccaagguaaggaccagucuugcguaacacuucaguaaaugcccuggaaggugauuucuaagagcugcugcugcuccuccucuuggucagcucuuucagccacaaaggccuccuggacccccucccucccuggccacagccgaguaacuccaugcucccucuccuuuccacccaaccugaauuuuauuuaccucuuguguggcccccugaccacucgggguuuggguuugacuuuaagcuuggugauugguccgcaaaaaggagaaggaaguugguagagguagugguuacauauguggcgcaggaaagguacaggguuauuuuucuguuucugggaaagacccuuugugggcagcauggggaugggaaaaaugaagauuuuccgcauccaccgucugcugaacaccauugaacugcauuucaggaacucaugcugcucucuggauucagcaacaguaaugggaaaucuagcgaugucaauccaggugggggaguugggaaggggagaagggaagaggaaagguggagaggggagagaaugggaaugugggugaacuaagggaggugauggagggggcaggaaggaggaagaaugaagguggcugaggcuggaauccaagcuauuugggguagguguaaagaugggaggcuucucagccacuccuacauuacuuccuccuuguguucccuaagaucaaagcuugcccauccccaugccugcucccuucaccucccugcaggaaaagccauuuuccucacaucccuaauccaucagcuuggguucugggauggacauggauggcugccauccauccauccaccuccuggggccgcagggcgagcaggaggucccggggcucuugccccauaccuuccaaggggcuuggggugucgggcugagaccuuggccgcucgcuuccucaacuuucugugaggauaagacaacaguagucaggguuaguguagaaccaaguggaaaagcuggugcaacuaggaccaggggcaagauuucucuucuagcaguccgaaggcuuccugguggcaggauauuauaacagcagacacuccugagacccgagcuuucuuuuuucuuuuuuuuguauuuuuaguagagaugggguuucacuauguuggcuaggcuggucucgaacuccugaccuugugauccacccgucuuggccucccaaaguguugggauuacaggcgugagccaccgcaccuggcugagacccaagcuuucauagcugcuuggccucuucagcacaugaccaggugggugagcagaagugaaggccguggacucaggacggugcccccaugccagcacccucagaaauuagcuagggcagauggcaaguaaggacuccugaguccagauguuagugcuaaaccucaguggagggcuaaggggagcaucguuaggauuguuaagauugccagacugaccaggcuaggcggcagaacuagccugagucaggccuagggaggcuacugugucuuuuuuuccuggaugcucucuuugagaaagacucuggcauuguucaggccugaggccgcuggaccaggaccaagaaccaaggccgaauauccaagggcguuaacuugguuugacuggggaacacaggccaggcuccuuacaaugacaccacccuuccugcugaaguuccaaucccauaugcuguggucauucacaaacugaguucaucucccaaacuuacuuccagggaaauaaauaauuuuuccuuuuuuuuuuuuuuggucuuugagacaggguuacucugucacccaggcugcagugagccauggugcaaccauggcucacugcagccuuaucuccugggcucaagugauucucccaccucagccuucugaaucgcugggaccacaggugugcaccaucaugacuggcuaauauuuguuagaagcagggucucacuauguuguccaggcuggucucaucucaaacuucugagcccaagcuauccuccugccuuggccucccaaagugcugggauaacaggcaugagccacugagcccagccuuaguuguccuuucuuugaacauguuccugcuccgcuguuucucuugaggagucauauuucaacauaguacagcuggccuuccauauccaugggcucugcaucuguagauucaaccuccaucuguacugaacacguaccaacuuuuuuucuugucauuauucccuaagcaauaaaauauaacaacuacuuauguagcauuuacauuauguuagguauuauaaguaaucuagagaugauuuaaagcauacagaggaugugcauagguuauaugcaaauacuauagcauuuuauaucagggacuugagcaucuuugaauugugguauccuugggagauccuagaaccaaucccccaugguuacugagggaugacuguuuaaugugugaagacaccuugggauuuaaauauacguauauauuuuaaaccagucagaagcuguuugauauuuucugccucagcuucuuccugaggauguacuuaguuggucucuuugccaaaguguccaaaguguuggacauuccuggcaaagaauauacaacucucaggucccuuuacugagacauugcuaauaguuagacucuuucaucuuauaaauauggugugaaauuuuuucuccaaaugucuuuuucucaaacaugucuaaaaugucuaaaaugaaauacacuuggccucuucaccaaucaaccuggagaguucaccuugaucuccagaguaguacuaaaacauuuugguauuaucuagaaauuuagaaguaccucuucucuaaauuauuuaaggaccuuauaucaacaggucuuuguauuauuuauauauauauauacacaaacauauguaaucuuauuucauauuuauauaaaagaguuuagacccuuuuaucuuauaaauauuuuauauauaaaauuauauauaaguuauguuaaggacuuuguccucauugaggaccagugcuguuauuugucuugauuuaaauuucuucauucacagauguguuuguuuccaccuaccauuuguuccuuccuucagccaucaaacauaaaaaccuauguaggccaggggcagcggcuuacgccuguaaucccagcacuuugggaggcugaggcaggaggacugcuugagcccagaaguuugagaccagccugggcaacacagugagaccucgucucuacaaaaaauuuaaaaauuagccgggugugguggcucgagccuguaguuccagcuacucaggaggcugagaugggaugaucgcuugagcccaagaggucgagguugcagugagccaugauggcgccacugcacucuggccuggucaacauagagagacccugucucaaaaacaaggaaucaaacaaacaaacaaacaaacaaagaaaaaacccaaaacaaaaaccugucuacauuugcauauccucuucucauaccuuucaacuauuuuucuucucuaagucuacuguaccuaaauguuucuaaauuccaucucuuacaauuuuucucaguccugcauaccauuucuuuuucucaacugaauccuuuuaaacauucaaaucacuccuacacaugcacacacacacacacacacacacccucuacuuaucucuccuccccuucacaguaacauuucucaagagcuguccauacuuaucaucuuuauauccucucuuccuacuuuuuuuuuuuuuuuuugagacagagucucgaucugucacucaggcuggagugcaguggugcaaucuuggcucacugcaaccuccgccuccugggcucagcaauucuccugccucagccucccagguagcugggauuacaggcacgcaccaccacagccagcuaauuuuuguauuuuuaguagagacggaguuucaucauguuggccaggcuggucucaaacuccugaucucaggugauucaccugccuuggccucccaaagugcugggauuacaggugugagccaccaugcccagccuccucuuacucauuuuucaacccacuuccucugguuuucccuaccuaucacucugcaaacuucuauuuuguuaaauccagcagacauuuuucagucuucaucuuaaugaccucucugcaacaucugacuguccucucuuuccuuggcugcuauaacacuacaauauccugguuuuauuccuaauucugcuuauuauuauuauuaauuuccagaguggcuccccagggagcagggcugacuccuaggcagugugccuagagccgccuacuccuaauucugguugcucuuucuuggucuucucugcaggcuccuccccuaucuggucauuaaaauuuguggagcucuuucuuaggcauuuuguucucacuucauauagggcccucuauauggucuaauucacaccuaguguauucauaaucuugucuauuucauugccuucuugauguuucuagguagagaucugaaaguaaucugaaauguaauguagguccaaaaaaaaaagauaauuaucucaguaaaauccacuccagaaaccuaggggucaauccugacuucucccuuucuuggaucccaaagucaaucaauaaccaaguccugucaauuuuacuucuaaauaucucuccaauccauaucuuuugcuccucuccugauuauucucagaaauagagucaaaggcggggcgugguggcucauagcuguaaucccagcacuuugggaggccaggacaggcagaucacuugaucugauccugaggucaggagaucaagaccagccugggcaacauggagaaaccccaucuuuacuaaaaauacccaaaaaucagcaaauuagcugggcaugguggcgcgugcccguaaucccagcuacucgagaggcugagguaggagaauugcuugaacccaggaggcggagguugcagugaaccaagauugcaccaguacacuccagccugggugacaaagcaaggcucugucucaaaaaaaaaaaaaaaaaaaaaaagaaaagaaaagaaaaaaaagaaauagauucaaaugaucuuuuggagucacaaaccugaucaugccaucucauagcccuccccauuaaaacacuucaauggccgggcacgguggcucaagccuguaagcccagcacuuugggaggccgagguaggcggaucaccugaggucaggaguucaagaccagccuggcgagcauggugaaaccucgucucuacuaaaaauacaaaaauuagcugggcguggugggcaccuguagaccuagccacucaggaggcugaagcagaagaaucacuugaacccagggagguggagguugcagugagcagagauugugccacugcacuccagccugggcaacaagccagacucccucucaaaaaaacaaacaaacaaaacaaacaaacaaacaauccaaacaucaaaggcuucccaauccuuuuaucauaaggaccugaauccuuaugauggccuauaaggucuucuaugaucugcagccuaauaaccucucuugucauuuauucaccuuuguauucucagcaccuugcacaguacuuggcaaauaggaguucaauaaacaucugucaagcugaaaugaacuagaagagugacuucuuaaauagcacugaagcucuuagagccucaauuucauuaccuguaaaagaguaguaaauaguucaauuaucuguacauucuuuucuuauucuaaaguucuacaacuuuuacauguucuaggguagaacuaccaaaacaaauugaaaaaugauuaauacaucagguuuugauuuucucauucccuaaaucuuacugacuuccucuaaaagccagcagauccauuuuuuuucccuaaggaggggagaguuguuuacaacugucuugccuaucuuucauaauuguaauaauuguaucaccugugagaaugcucccucugcugggccugaccugugaaggaucuagaucauagccccaucacagaaucucccagggcucccgcaaucucuuuccccacgaagaauggccucugugcuuuaguguaucucuuucuccagccuuuauaucccagacuuaguaugagauuccgauauguccaacaaauauuccugaucccuaaaacuuauuucagcuuugcauaccuggggacaauuccugugucucaaacuuuccaaggacagcccaucucuaaagcuaguucauauuaaccugaagcccagagauggcugcugguaccauccuucucucaggcagcaucggaaucauuuuaggugucuguucucucauucucuauguucuaucagucauccuacaucuauucauuuuccuccaucuuuguuuuuacccuccugauaagcuucaauuuuagaacaaacuccugacuggucuuacugcaucaagacccuccucuccucauccacuacuaucaggcaaacuuucaaaaacacuggcuuuauucuugucccauauaaauaccuuuauuuguaauuuuucuauaaggcaaaggccaaacucuccaauuuggcaccuaaagcauuccauuuucuggccucccuuuauccagaucuuccacuauuucucaguauaaaccuacucuugcuaacuuacugucuuccaaauauaaaccauucauuaucaucucuguuggggccaacagugacuuuacuguugcuaaauccagcauuuguuucucaguccucauguuuuuaggucugggcagcacugacuuagcuggucacucucuccucuucgaagcacuuuacuuggcucccaggccaccacacuccccugguuuucuuccuaccucaccucacuguuugcauucaucuuaucuucugacuuuuaaauauuuagucuccccaagguucagucucugggccucucucugucuuuuaaauuuacauucacuuccuugguauguuguccaguuucaggacuuuauauguuuuacucaacugaacuccagaguccuauauuaaauuaccuaacuuagccucgccacuucaaugucuuaaagaaucuuaaauuuaacaggucuaaaaccaaguuccuacccuccacccccaagcccaucucccaacaaaacaugcuccauucacuguuuuccuugucaggugaggccaauuucuuacuuagcugaggccaaaaaccuggagagagccuuaacuccucucucucacaucacacugaauccaucagcaaguccuauagcucugccuucaacugucuguaaaucuugaucauuuuucaccacuuucacuggucaccaucaccuuucacuuucuuuacguggcuuucagaagacaauaaccccauaaccagccaccugacuucuugcuucuacugcaucccuuacaaucuauuccuaauaaagcagugaaaguaguacugaaaaaaaaauggaagcccgaugucacaccucugcuccaagcccuccagugguuccuuaucucccacagaacaaaagccauccucucccagauggcccgcaggaucuggcuucccauucuuuuccgaagaccaccuacacugcaucuccuaccauuuucuucuuuuucacucagcuccagccacaguggccuccaggagaaggagaggccuuaucccaucacccacuacauacacacacaggcacacacacaccccagaauauuuucauuuuugaucccucuuccuagaaauguuuaucuagaggucugcauagcuugugcccucaccuccuuuaaaucuuuucucaaaugaugccuucuccaagaggccuuccuucaccacuuauuuauuuacuuacuuacuuaauuuauuuuuauuuuauuuuuauuugagacggaguuucgcucuuguugcccaggcuggagugcaauggcgcgaucucagcucaccgcaaccuccgccucccggguucaagccauucucccgccucagccucccgaguagcugggauuacagucaugcgccaccacacccggcuaguuuuguauuuuuaguagagaugggguuucuccauguuggucaggcuggucucgaacuccugaccucaggugauccgcgccucgaccucccaaagugcugggauuacaggugugagccaccgugcccggccuuaguuaauuuauuuuuugagacagggucuugcucugccacccaggcaguguaguggcaugaucacagcucacugcagccuugacuuccugggcucaagcaaucuucccaccucagccucccaaguagcugggacuacaggcacgcaccaccauguucagcuaauuuuauuuuuaaaaaauuaucuguagagacagggucucauuauguugcccaggcuggucucgaauucuugggcucaaauaaugcuuccaccguggccucccaaaguccugggauuauaggcaugagccacggguagugucuacaacaguaccuggcacauaguaagaucucaguaaauaaauauugggugaguggaucucuacaccuuuguucacgcuaucuucuucacuggaaaugucuaaauucuacgcaucuuucagaacaugggguuuaaauuagggaagguaagcagcacagagaaggaaaugcagccccaagauggaugaaaguaaagaggcacagcacguuuguuuuaaagugguuugaguguccaggccagauaaaguaccgaaaguccucaguacugaaagacauuucagaugagccucagagccaaggcaaagaaagugugagcagguauagaaaagacuggagacuggauaauauccugacuuucaaaagaaaaaaaaaaaaggagaaaaaggauuccucaauuccucaaucuacacauaaguaauauucuagaauaaauuauuaaauagaaguuuguaagcauuuaggaaaaaauaaggugauucuuagagaccuaaaaggauuucaguaaaaauagacucaaacuacuaugauuuucuuuuuugacaggauuacuaaauuggaaggcuggagaauggcugugaacauagcauaucuggauuuuaucaaaaacuaacagaaucucccaugauuucauuacagauaagaaauauauagauagauaaggugaaauguugguuacaucauugaaguguucuguuucuucccaguugguggaaggaacauauuuuacagcugaugauuagaagcuugaugaaaaucuacaggaacauuuugcaagaagaguuagacuuugguuuuaaacauuuccacaacaacuuuuagccauuuggaugaagccagaaggcaaagcugccaugucuguucagcagaggaggcugaggggaaaugacagauggaaagucacaucaggacucaagauaaucucaugggaucaucauggcuuuuuuauggcuucuaaauuauguaucaaaacaaauguaauagguaaacgucaccuauaccuggguuggaaaaggcugcucuaucaguaggaagcauagggaagaccugaacugguuuuaagugaugacaaguucaguauaagcagugggaagcugccgcaguaggaagacaguguaauccgagcacgcuucagucgggguugaggauuucuacaguagcuggcggcaucagaccccaucugaaguagugugcccgcggaaaccuauccggacaucaagaggccuuucagcaauacugaucuagggaaccacugaagaaagggaggauuuuuggcucgcaaaauagauuacagugagaggguguaaagauuuccaaauaaaugccuggcugucaauggcaguuucucaaaaagaucaaaguagauguuccagggaagggagacguuaagcacaggcaguuuccagggugaugcguuucccuggaagccggacuggaccccagggcuccagcgcagguggagagguugggccucgccaaaagagauccugggaaacuuccaggacuuccaggagccccgagggcucgagcguucacauacgcgccccgccccggggcggcccgggcagagagacuggcgcggucucuccuggcgcccuucggccaucgcgcgccgccguccccgggcccccggacccugggcgcccagccugcgcgggacacacccaggcgccgccucccaggggcggccgcguccuuacugaacucggaaaucgcuggccggcagcgccagcgcuggaaucgcccccgcgccugggaguggccucgcgaggccggcgcgcgccccggggccgaggaauccgccugcccgcccaggcgucggccacgagagagcgggagccucgcugguccccauuucagguacucccuuggggcaccuuucguggucccacaagauuucccaacucuccagcuuugcaacggccuccauauuuucccgcgcgucccgacccccggguccucccgugccccggaccugcucagaugucucccaaggcuauucaucagggagcaccccaaucccggccugcuccgcccggcgcccgcggccccucaccuguagaaggccgcguugacccucuuuucgcuggggaagcccagcaucccgcagaccacguggcuguugugggcgcuccagccuuugucgcacacuugcgaccagccgucaggaagccugacuuccaccagccccuccgucacgggcaggggucgucugccccacccaacggcgggucgaauucgcaccuccuccacuugcaggugaugcucuaccugggggcggggccacaagcagggaaagaaucccaguggcaccuuucaugugucccgccgcccuuaaggaacccugcuuggugugccugcuguaaacccaguggcgggaugggcccgaggcggcgcugagagagcggccacgauggccgcaguccgcgguguggacucucuugcagccagcagcgcgugggaugugcugugcucccagagaggauucagggcacuaggaaggaggcccucccugugccuggagcaggagggagcacuucaaaaaggaaauggcuuugaaggaggagaaagucagaaggaagaugucucaggaaagcaggaacauuugaggagaaggagagcaccaggugccccaggggugacuagggaugaagcuggagaggcucaugccagguuuagccccuugaaugugaaugcuaaaaaccuguuggauuuuacagcaucugggagcucuaucauuugcuuuuccaagucucccaccaauccaaaugaucccccagggguaacuaccuucuaaugucuccgcuaaccaccccacaguacucucggcuauccuggguaguguguguguguaugucuaggaaaugcagaccucaaugacauuggaguccgagaagccagggaggcgcuggucuuugcagaugaccccagcauccucaucgugcguacagucacuguucccccagccccgggaggcacauucagucacacucugcucggucccacugcagcucaaguuguccagccagaugcggccuguggaaggggagaugaagggacagagaagcuuggggagggaggaugggggaguaauggggauguagggaagagugagugcugaggccucccacuuggccaugaugaucccaucuuucugguaugauaagggguggagacgggacaggggacccuggcagggaauaggaagggggcauaagauugagggaaaauuggugugaucuggggauacucaagaaccugauacggugaauaaaaaaccaagaaucaacccugaaguucugaucagucucuacccauucauugauagcuacaauuaaucagguaccuacugugugccaggugcucugccauggugugcacauaugugaucauucuuagaacagagcugccagaacacuguuuuauauaaagaaacugggguuuagagaagcugagcaacuugcuuaagaccauaaagccaauacgugggggcuuaggaguuugaucuaucugugaggcuuggaugucuaagauccuuucuucacauccuugcauucucucuugugcccgcccugucugugcugccauauagccccuuguucuucucucugucugaaaccuguuuuuuuuuuuuuuuugaaacgaagucuugcccuguugccuaggcugaaaugcaguggcaugaucucagcucacugcaaccucugucucccagguucaagcaauucuccugccuuagccucccaaguagcuggggcuacaagcaugugccaccauaccuggcuaauuuuuguauuuguaguagagacaggguuucaaccauguuggccaggcuggucucgaacuccugaccucaggugauccacccaccucagccucccaaagugcugggauuauaggcgugagccacugagcccggccugaacccuguggaguaucacuggcuuccucucagaauugggcgcagccucaaaggucaucuguccuagccaauguucaaggacaucucauucacaucccaacaggacuuacccaguuguugcggagacaccuagcuccugccccaccagacuguguaaccaucaaaguccuugugacucuucaugacuuuccccuaccacaucugauucauuccuuuggugccaaccagaaaaauccuucagccacacgacuguccuucccauauuuaaaaacaaccauuacgccauugcuaugcaagguuuuuacuuuccauaucaauccccugauucuucagcaauuccuccuugaaacuuggcuucugaaucuuucacaucuaggcagcucuccucugaaaguauuuccauuuucuacugucccucuuaaaacacagcaucuacaaaugacacuuaauuccacagguggucuagccagugggaacuggggaaucagcugcagguugcaccugcuucuguccaucauucccacuguggguucauaccaugggcacaguccuaggccucaccuagggaacugcucuuaagccuccaccacccacacucauacuuguccuagauuuuauacuuguccuuagacaguaccaccuuguuaguuuuagcucuggcccauaaccugauuuuguuagcugcagugucugugaccccuugugacuuugggacauccagauaucauuuaccugcucuuagcgucccaugagacuaacuguacuuuauuuguacagggcucaccuguaucugggcuguuuuguggauggcuuuguaggaucauacuuuugcagcagaaaagaacuuagacaucaucuagucauuuugcauacagggcaucugaggcucagagaaagcacugacuagccuaaggucacacagcucugggaaguaacuauguugcuugguuugucauccauggauuuacucaaugcuggcuguucuuggugucgugugucccuauggcugugccauccucguguucccuuucccugcacuuuggccacacauaggaaauaucuaggauaugccuggaucauugcucaccuguuccagggccauauuuggcacuguggguccagccuguggccucugugaagcccagcucccggcagaggaugugggcagccugcagcgugaagucaucaucgcagauggugccccauucaccagcucgcuguaucuccacgcggcccucguagggcuuccuggggaagccagccagccggaaccgaagccccuggcucccggccuucuucucagggcccguggaaggggacggagaccccaagcacgaacugcacagcaggcacagcagcagcccccaggggcuccacugccagacacugacaggucgcauggcagggaaggccugggugccccagagacaaagugugcgugagagaaacagauugaguggggcccagagucagaaagagagggagaagucacgaaagaaaaacagacacugaguaagacagagacagcgagagacaacaggagagaaagagccccagggaccaagagacagggagagaaacacauuaaauaagggcugaggcacaggucauagaggcacagccugagagacccagagauaagagacaacuaugagagaucgagagucagagaagggucaauaaaaagagauagagacugagcaagagacacguagagagagaggaagacccagacagacaggaugugagaggaagggagacugugggaaugagagagagaaaaccagaaagacacagaggagagagacaacggauagaaagugauaggcaaagaacuaagcacucaguauaggggaaccaagcacaccgcgggugagaaggagagggauugacaagagccaaggggcggacgugggagggauccagaugaccccauuuacucagagggaggacagacagcuguacugauugugcagagaggcacguaaggggcccuaggcggcccugggaucacagauccccugaaugggagcccagaguccuaacccagcagauucccaggcagggaaggcuggcaccaaagcucgccuggagaaccugcugcacgcccuccccaacacgcaggcucucagaugcccugcagggucaagaggcccaggagggccaggccucaaggcugggcgggggaugggguaggguugucccagccuccugccaacaccaccaucccugucaccgggcaacgggaggccaggcgcuauggcuccucagccaaggccuucucugccuagggcugagaacagccccucuacagcaagcccccgucaacaugcuucccccaacccaaacaaucaauccaacaaggcagcuuuguucuggguuggggacccaggggcagcgccucccggaggagcccccucccuuagggcgcuccuggcggcccuguucgaacacccguagcccccgccuccgguaugugccuccuccguguacucugucucacuugcccuuugacaagaaucaaacucucaguuggguggcuuccccucgacuccaucccacaccacccguuuucccuggucccuccacauccucuccauccccuacucauucccucugcgguuagcgugacucccccuaccuuggccgagcaggacccuaagggcugggagaagagugcugguccuggagaucaguccuaggacuuccaaaaaaaaaaaaaaaugcucggccaggggagacuggaccccccucucucccccuucuccguucgucccucccacaucccccugagcccucccacauuccgccuucuccuuccauuccucccggccaguucccuccucuccuccucuggguccucccuccccguggagcuggccacugccgcgcccccucccccucccuggcccucccggcucguucaaugaagcuuucucuucccgcggcauggaggccaggccucugcggucagggagcugacaugcaagcggcggccgggcggcggggcggccccggugguggcgggaagcgguucaaccccagcccucccuccgagucccgggccagcggagucuaaacagcccggcucgggcggggcugggggcgggcccggccaggguaaauaaagccccggaggcccgugugggucucu

SEQ ID NO: 14717 - RNA, 4056 nt, Homo sapiens
uuuuuuacuauaauauguugcuagguauaauuuuauuuuauauaaaaaguguuucugugauucuucagagcccaggagucagugcuggugguuggagggaccugcccccacugguucauuuaacccucugucucggugcccucagaaccucagccagaaaggcaaggaggaaaucagagcaggagccucauacucuuggugaucuauucauucugugaccucaggggucacauauaaggucaguguuucucguccccgccggaucugcacugccaacugggauuggguucgaacagcuucauaaacaucuucagcauuuuguaccaucugcuccccaauggccaaaaucacaucaccaggccgcagaccagcccuauagagaaaaauggacagagagaaaggaaggaguacaaagccuaguucaaggacacaugcacaccuugcccauccccauaucacacugcagccucucccucaccggugugcaggggagcccaggaugacuuuauggaugaguacaccaugcugaacaucgggaaagcuugguucucgaagcuguaguucagcaaggaugcugaaaguacacagaucacccuauuagccaaacccaggcauucuccccauccugaguuccaccucaagucucucaucaacacauugauaaauauauggacaggacaugggcuagguacuacaaaauacaauggcaacucacuuucugucuucuagcaauaaagugcaacauguacauaaaagauguacaccacaugagggcaccaaaugacaaacaguguuaaaucaauagcacuaaugucauucuagaauacuaagagaagcuuuaaggggaaagaacuuaaguugagccuaaaaggauggaucugauauuaaccauauaaaacaagaacagcauaaauaaaaaacaugggaguaggaaaucagguuggcugaguauucauauaggaagguauuacagccaggucuagaaaguugauuuacagacagauggaaaauggcccuuaaaugccaaguuaauggauugaaggcuugaaaucaaagcaguaacaggaugaaaucaaucuggugacagguguacaaaguggagugggauaagaaagucaagaugaugaagggagacagcucuugugauuauuucaagugugacacaguucaucuuagauaaagacagaaaugagaacaaagcucaauagaggugccccccucugauuacacuggucacauuacaugucacugucccuaaagcucauaccugggacucagggucagcaucaucaccccaauguagcgccgcugggacccacugauuccggaggaggaaucugugacagagggacaaaugagccccacccagcuacauccuuccuucccugcccucuucucccaguagaccacccuccaggaagucccacugaaugcccuuccccuauuuccaccacauuaaaggaacccguuuccccauaaggcaggcucacucuucuuuuccccacgaugcagaaacucucgaagacgaucagaagggauggcaaaggagauuccagcugugaccuucaugguguucacuccaaucaccuccccauccugcagggauacagcccccaguucccuagccuaaacaaauaguaggggaugggggcacccgaacaaaaguaccagcaaguguuggggagaucugguuggauauugagagauagccaacaaagaacugcucagaaacuugaccaaacauccuugaauuaggggaaaccuacccuucccacacugaccuggggcagggauucuuggaaggaaggaugucucacucaccagguuaaccaggggaccuccagaguuuccaaacuguaggacaaggagaaaacaugaaagagaucuggggauucuaagucugggggcauaccaggauguagguacuuucuccaaauucucuucuuucucagcccaugaauaaguggccacauuuuugcagccuaagcucuauauaggcucauccaccauauaucaguuggugcuuguaccacacagccucuccccccucccccaucauuugucauuucucuccuaucaggacgcacaucaauagcugcaucaguuugaauguauuccacauugguuugggggagucccaggucucuggcuggacgcugagcagagcuaacaaugccggaugugaucguguucugcagugcaaagggacuucccauggcaacaacaaacuccccuugccggacaucagcugagcgucccagaggcagcguggggagaggcuccuaagggagaauggguaaaagagaccugucaucugaagaugcgagcaaauaagcagcuccaaccagaccuggccuaccccagcccccaccuuagucugaauccucagcguugcgaugucugccacgggauccacagcugugaccacggccucauacgugucgccgcuuagcagucucacacggacucugcgccgaucagccaccacaugggcguuggugacaaugagcccaucggcagccaccacgaauccugagccguucgagauagggaccucgcggcccaagaaagggugccugaaauggagggaaagcacagauaagaggaggcucugaccccuccuacccgcccgcccuccagccuguggcuucagugccucccggucuacccccaccauuaccgguccaggaucucgauauagaccacggcaggugcugucuucuccaccacaucugcgaugaaguuguacugacuccggggagaagcgggcggcgggcuagggacggcggcgaggacggccggaggaccccgacccccgccccacaacaacaacagcacugcccccccagcgcccagcgccaccgccagccacgcgcgcgaacggguuccagaguucucugaggccucccggguccugguaucuggggucaccgcagucaguugugcccggggacccggggucccagacgucaggcaugcucgggguucagugaccccaacagacaaccgggcccagagacugggggucccauaagucacucgggcccgggggucagaaguuccugacgucagcagggcccggaggucaggggucaaacggggucuccucccccagcgaaugccccccaaagcccgccaugcccgaaggcuccagccugcaccccgccccgcccucggcgcagccaucagcuccgccuuggcugccuccucgcccgcccuacucagaggcggcacccaggacgcgagcaggcggacaguaggacgcggggcacgccgguaccugaaguccuucagaagugcacgccgggaccaggauuccgggaggccgacuccucccugccccacgaaugccgggaauuguggucuccgccggacgcgaguugugagacggcccaaggggccgcgggguaugcugggaccgcuagcccuuccggcgcgccucaggacuucggguccccucaccccgggcggaugcccaaagacuccgccuucccaagagccccugcggccgggcgcgaaaauggcggcggcggcgacggccgggcgcuccugaagcagcaguuauggagcuucccucagggccggggccggagcggcucuuugacucgcaccgguaagagacccggcgggaagagaccgauccccgcgugcucucggccuucggcgccugaccacuucgccucucgcccccaggcuuccgggugacugcuuccuacugcucgugcugcugcucuacgcgccagucggguucugccuccucguccugcgccucuuucucgggauccacgucuuccuggucagcugcgcgcugccagacagcguccuucgcagguuccgacgcgggcguucggggagugucagagcugggucuggcccgaggccacacagucaccaccuccuguguccccagauucguagugcggaccaugugugcggugcuagggcucguggcccggcaggaggacuccggacuccgggaucacagugucaggguccucauuuccaaccaugugacaccuuucgaccacaacauagucaauuugcuuaccaccugua

SEQ ID NO: 14718 - RNA, 4056 nt, Homo sapiens
uacaggugguaagcaaauugacuauguuguggucgaaaggugucacaugguuggaaaugaggacccugacacugugaucccggaguccggaguccuccugccgggccacgagcccuagcaccgcacacaugguccgcacuacgaaucuggggacacaggagguggugacuguguggccucgggccagacccagcucugacacuccccgaacgcccgcgucggaaccugcgaaggacgcugucuggcagcgcgcagcugaccaggaagacguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccgguaaugguggggguagaccgggaggcacugaagccacaggcuggagggcgggcggguaggaggggucagagccuccucuuaucugugcuuucccuccauuucaggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaggugggggcugggguaggccaggucugguuggagcugcuuauuugcucgcaucuucagaugacaggucucuuuuacccauucucccuuaggagccucuccccacgcugccucugggacgcucagcugauguccggcaaggggaguuuguuguugccaugggaagucccuuugcacugcagaacacgaucacauccggcauuguuagcucugcucagcguccagccagagaccugggacucccccaaaccaauguggaauacauucaaacugaugcagcuauugaugugcguccugauaggagagaaaugacaaaugaugggggaggggggagaggcugugugguacaagcaccaacugauauaugguggaugagccuauauagagcuuaggcugcaaaaauguggccacuuauucaugggcugagaaagaagagaauuuggagaaaguaccuacauccugguaugcccccagacuuagaauccccagaucucuuucauguuuucuccuuguccuacaguuuggaaacucuggagguccccugguuaaccuggugagugagacauccuuccuuccaagaaucccugccccaggucagugugggaaggguagguuuccccuaauucaaggauguuuggucaaguuucugagcaguucuuuguuggcuaucucucaauauccaaccagaucuccccaacacuugcugguacuuuuguucgggugcccccauccccuacuauuuguuuaggcuagggaacugggggcuguaucccugcaggauggggaggugauuggagugaacaccaugaaggucacagcuggaaucuccuuugccaucccuucugaucgucuucgagaguuucugcaucguggggaaaagaagagugagccugccuuauggggaaacggguuccuuuaaugugguggaaauaggggaagggcauucagugggacuuccuggaggguggucuacugggagaagagggcagggaaggaaggauguagcuggguggggcucauuugucccucugucacagauuccuccuccggaaucagugggucccagcggcgcuacauuggggugaugaugcugacccugagucccagguaugagcuuuagggacagugacauguaaugugaccaguguaaucagaggggggcaccucuauugagcuuuguucucauuucugucuuuaucuaagaugaacugugucacacuugaaauaaucacaagagcugucucccuucaucaucuugacuuucuuaucccacuccacuuuguacaccugucaccagauugauuucauccuguuacugcuuugauuucaagccuucaauccauuaacuuggcauuuaagggccauuuuccaucugucuguaaaucaacuuucuagaccuggcuguaauaccuuccuauaugaauacucagccaaccugauuuccuacucccauguuuuuuauuuaugcuguucuuguuuuauaugguuaauaucagauccauccuuuuaggcucaacuuaaguucuuuccccuuaaagcuucucuuaguauucuagaaugacauuagugcuauugauuuaacacuguuugucauuuggugcccucaugugguguacaucuuuuauguacauguugcacuuuauugcuagaagacagaaagugaguugccauuguauuuuguaguaccuagcccauguccuguccauauauuuaucaauguguugaugagagacuugagguggaacucaggauggggagaaugccuggguuuggcuaauagggugaucuguguacuuucagcauccuugcugaacuacagcuucgagaaccaagcuuucccgauguucagcaugguguacucauccauaaagucauccugggcuccccugcacaccggugagggagaggcugcagugugauauggggaugggcaaggugugcauguguccuugaacuaggcuuuguacuccuuccuuucucucuguccauuuuucucuauagggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaa

SEQ ID NO: 14719 - RNA, 3504 nt, Homo sapiens
cggcacccaggacgcgagcaggcggacaguaggacgcggggcacgccgguaccugaaguccuucagaagugcacgccgggaccaggauuccgggaggccgacuccucccugccccacgaaugccgggaauuguggucuccgccggacgcgaguugugagacggcccaaggggccgcgggguaugcugggaccgcuagcccuuccggcgcgccucaggacuucggguccccucaccccgggcggaugcccaaagacuccgccuucccaagagccccugcggccgggcgcgaaaauggcggcggcggcgacggccgggcgcuccugaagcagcaguuauggagcuucccucagggccggggccggagcggcucuuugacucgcaccgguaagagacccggcgggaagagaccgauccccgcgugcucucggccuucggcgccugaccacuucgccucucgcccccaggcuuccgggugacugcuuccuacugcucgugcugcugcucuacgcgccagucggguucugccuccucguccugcgccucuuucucgggauccacgucuuccuggucagcugcgcgcugccagacagcguccuucgcagguuccgacgcgggcguucggggagugucagagcugggucuggcccgaggccacacagucaccaccuccuguguccccagauucguagugcggaccaugugugcggugcuagggcucguggcccggcaggaggacuccggacuccgggaucacagugucaggguccucauuuccaaccaugugacaccuuucgaccacaacauagucaauuugcuuaccaccuguagcaccgugagugagagcgaggccgagagcgccacggggcgguucccuggggcccagcugaaggccccccuguccccacucgcguuccccauggaggauacugagccuuaccccuaaccccgauccucuacccaacaugucaguuuuuuuuuucauuuuccucaauauuuuucuucuugcuuucucuucuccugguucccagccucuacucaauaguccccccagcuuugugugcuggucucggggcuucauggagaugaaugggcggggggaguugguggagucacucaagagauucugugcuuccacgaggcuuccccccacuccucugcugcuauucccugaggaagaggccaccaauggccgggaggggcuccugcgcuucagguggguuuagcacagguauggggcgccagcuggguagguggucaagcuugugggcccuugaguuuuuacaacuuucuucggcccuuagaccccaucaucuccaguucauuuccuuucuguccacuuuaaguucuuucuccugaaucccuucauucuucaauuaugugcuuguagaguuugacaguugccuguuauaaggcaggugugagcugcugacuaggcuggcuggauucccauccuacuuucuccuuccucuucuaguuccuggccauuuucuauccaagaugugguacaaccucuuacccugcaaguucagagaccccuggucucuguggugaguguguguugaacagggaaucucuggggcuugaaggggaaauuucccaucccuggcccuggcuuaggccucaucucaugcccuccccucagacggugucagaugccuccugggucucagaacugcuguggucacuuuucgucccuuucacgguguaucaaguaagguauuaacuguccucacauuuuggucgcuggggagaggcucaccucaaggucaaggaauuaguggccucugcccuguccauuuguagaucuuuauaucaagguucuaccacagaggcaacacaaaguauuuacaguauuuacuauuuucccacccaccaugcaaagagguaccaaaguggggaauggugacagccucuacccugggugcccacaacauagcccuggauuguuucuuugcagguggcuucguccuguucaucgccaacuaggggaagcgaaugaggaguuugcacuccguguacaacagguggucgggugcacagacaggguggaggcggggucccugcuuaggaggagagggaggaaagcuugagaucuugacacuuccagucuuccaauucucccuagcugguggccaaggaauugggccagacagggacacggcucacuccagcugacaaagcagagcacaugaagcgacaaagacaccccagauugcgcccccagucagguauguggucucuauacauuacagcuuuugggguuuuuuuuuuucggccuacugugauuccuccccuauuucugugcuaguuagccucuccuucuaguucucuacuuaccagaauuucuuuuuucuuuuuuuccuuuuuccacagcccagucuucuuucccucccuccccugguccuucuccugaugugcaacuggcaacucuggcucagagagucaaggaaguuuugccccaugugccauugggugucauccagagagaccuggguaugggaaaggguggccccacacugggagaugggcacagggaggaaaaguggguugugaaggaagaaaguaaguagggaguggacucccuucucuuuucuccccagccaagacuggcuguguagacuugacuaucacuaaucugcuugagggggccguagcuuucaugccugaagacaucaccaagggaacucagucccuacccacagccucugccuccaaggugagacccaggaaauggucagauccaaguguuggggugaguugggggcaggcuauguacucccuuaucccugaccuuucuuuuuugauccugagacccuagcauagugccucucuugcaaaguaggcauucgaugcguguuuaaugaugaugacuccgcaagcccucugacauugugaucaccucaguuucccagcucuggcccggugaccccucagccaacagcccuaacauuugccaagucuuccugggcccggcaggagagccugcaggagcgcaagcaagcacuauaugaauacgcaagaaggugaggggguuagaggacaauuaauaggauguggcaaauuggagaauggaauuauggagcuacuacggcaaagccugaauaauaucucucccuaugucccacaggagauucacagagagacgagcccaggaggcugacugagcucaaaggaacaggauggcacccagagccgcaggacggagacugggggcagcccucacccaacucacaacaggcuggaugggugggugguaaaaagggaaggaugaggcucccccaaugucacauuaaauucaugguuuucauucaaggcaucuguugucucucucggucucaaaagcccugugaguggguuccuuauuccuuggcugcgggggaugggggugagagucuucucguacauuugaaggggguagucagacugcaacugucuaaaaucaccuccucaugccaagugaugagugauaaauuaaggaaguguaacugaacugaagacccagc

SEQ ID NO: 14720 - RNA, 2189 nt, Homo sapiens
ccgggaugcaagucccugcgcugacgcccggcagcggcuggcacgggcgcggcugcuccgggugcacagggaugcugcuguuucggggaccccggcgcccugccuuggccagccccgcgggccccugaggccacucuccggagcgcgccgccgcugggcuucuggcgcugccugaggcauccuccccaaccaccgaaccuccggcgguucuccucggcccagaccgauggagccggggaugcuggguccacacaaccucccacaccacgagccaaucagcuucggcaucgaucagauccugagcggccccgaaaccccagggggcggucuaggccugggucgcgggggccagggucauggggagaauggggcguucucggguggauaccacggagccucgggcuacggucccgccggcucacuugccccgcugcccggcagcuccggagugggcccaggcggcgugauccgcgucccugcgcaccgcccgcugccugugccgccgcccgcugggggggcgccugcagugccugggcccucggguuugggcggcgccggaggccuagcgggacucaccuuccccuggauggacagcggccgccgcuuugccaaggaccggcucacgggugagguugucugaccccuccagcgucacgcccgacucugaccccgucuccucauuucuuagcuuucugcuccaacucaaggaccccuuucacaccucccacuagauccucccaggggauccucccccaacucaaaucucuggguccugccuccgagaggugauggggagggagcugccgucggugcccgcgcccuccucuguagucccacuguccacgcguggggaggggagggugaaguuacaggggacgucucccucgcaucccaggggaagggccuuucuuggcuauagggcucggcugaugcuuagggcccggguaaggacagggcgcgggaguucugcggccuggacagccgcgcggccuucucaguggcaccucgggccacccugcaaauccugcccuggucuuucuuccucccgguagcugcgcucucgcccuucucugggacgcgccgcauaggccaccccuaccaaaaccggaccccuccgaagcggaagaagccgcgcacguccuucucccgcucacaggugcuggaguuggagcggcgcuuccugcgccagaaguaccuggccucugcggagagggcggcgcuggccaaggccuugcgcaugaccgacgcacaggucaaaacgugguuccagaaccgacgcaccaaguggcggugaggcgcggcgcgggcgagggcggacugggguucccgagcagggccuggugagaagcgacgcggcgggcgccccgcugaccccgcgucucccucccuuaggcgccagacggcggaggagcgcgaggccgagcggcaccgcgcgggccggcugcuccugcaucugcagcaggacgcguugccacggccgcugcggccgccgcugcccccggacccucucugccugcacaacucgucgcucuucgcgcugcagaaccugcagcccugggccgaggacaacaaaguggcuucaguguccgggcucgccucgguggugugagcgacgcccguccgaucggcguggagcgccgggcccggagcgguggagcgcgcggcugccugcguccauggucuaguggcagccgggcgcgugaggagcggcaggccuugaggcugucgucgagggcuccuccaccaccggccggcucccaagccagcguugcgcagaugcacggccagcucagaggcggccuuucccgccauuuuucacuucacugccguuacgcccucgcuggaaccugaggcgccgagagggcgggaccugcaggacaguagccaaugaggugcggggagggggccgggcuggccaaugggagcugcuuuccugagggacucgaaauucuccggcggguggucgggagcuggggcucugaggggcucuagcggcguugcgcgcggugccggcugggucuguaccaaaggugugaaggaaagaagacaccgaccacggcgaagcaauagagggggugcuggagcgcgagaggcuggcugauugugaccgaaaccagaggguuguccaccccgggcaucucaucccucaacuguaaaauaaucgcuaaggauuccuuccugacuuugag

SEQ ID NO: 14721 - RNA, 3215 nt, Homo sapiens
agcaggggggagaaugggggaauaagaucacuaccaagucccugggggucucucacuccccaucccccggcacccucuccgagacucugcaaagcccaagaaacucccuccgugaagccgggagaagacccgccaucuggacgaagcuccgcuacgcggacgccgacagggcggcauuacgaggagaggacccaggaggggcuucuucagcagggucgucgucacagaagaccgacgacccugagcggguagcgggcacagacugccaggccuuuggggguaggagggggcagucuuucgcaggcuccgaaaguuagucuugaggucgcguagggccuauuaugaugauuucuacaggagguugaagagauaagacccuucccugugcucccccccccccacuccuuaauuacggauugagcaggggaggggccgguggggcucaggugagcacacagggagaaagggacgugggcggggccuuacagagggugagcgaauccgaaaagaccuagaaccucguugcugggagacaagucccgcccugcaggcggcaccggaaguggccggcugggaucagccuuuaagauggcgucuccucaggggggccagauugcgaucgcgaugaggcuucggaaccagcuccagucaguguacaagauggacccgcuacggaacgaggugcaagggcggcaggguuacugcuguggucggccagcggugcgaauuggggcgggcuaaaggacgggcgguggcuggccgggcgcccagugcgccugcgcagagacagagugcccagugcgccugcgugguugcgaucggguugccaaacuccgguuaggacgccugcgcguugugucgccgacguuguguagucuccccugggaaaggagggucaggcgaguccacgugagggaagcccccgcugugcgcggagcccucugcugggcggagggggagugccagcccccaggagcuaauccccggcugauggcgcagggcgcggggcuuggccgucuagugugaugaaggaggcgacccccaaggugggaaggcgcacggguugggguuugaggguggaugauuggugacggaggguguaucuucaggaggagguucgagugaagaucaaagacuugaaugaacacauuguuugcugccuaugcgccggcuacuucguggaugccaccaccaucacagagugucuucauacuugugagugccuuggagacugccuaguucuuccagucccuagucuucaccaagcugacugccagcuucugugcggccugccucacgcauccaggcaccccacccagcccaugaauccaguuuccagagggccugagaaucugcuuuucuuuuccugcagucugcaagaguuguauugugaaguaccuccaaacuagcaaguacugccccaugugcaacauuaagauccacgagacacagccacugcucaaccucaaacuggaccgggucaugcaggacaucguguauaagcuggugccuggcuugcaagacagugagucaccaaccugacuuugaggggccucuugaggacuaauugcugaguggcagcuugaggugacggguuugguaggacucacguaggcagaaggccaaagaugagggaaggacaaaaagugaggaagggcuaauacuuuauucuuuuuuuucuuuuuuugagacggagucuugcccaggcuggagugcaguggcgcaaucucagcucacugcaagcuccaccuccuggauucaugccauucuccugccucagccuccugaguagcugggacuacaggcgcccaccaccaugcccagcuaauuuuuuauauuuuuuaguagagacgggguuucaccauguuagccaggauggccucaaucuccugacuucaugaucugcccaccucugccucccaaagugcugggauuacaggcgugagccaccgcgcccggccccgaagggcuaauacuuuauucucauacuucaccuucuucuaggugaagagaaacggauucgggaauucuaccagucccgagguuuggaccgggucacccagcccacuggggaagguauguccuuggccgcgggacaguaaagaccccagagcauucuucuugcccaguuuugcucucuggggaaagaggaguauggaaugugugccaccagccaccucacuacccuaucuuucucagagccagcacugagcaaccucggccuccccuucagcagcuuugaccacucuaaagcccacuacuaucgcuaugaugagcaguugaaccugugccuggagcggcugaggugaggagaaggucagggguugcaggaggugacagugccaaugacccagagccagggagggucuaggggagaggcugagcagugagugagugccuauccccuugaagagaguauaucauggcucuggguggggaagaggaggaaagauaggauucccuaaccugugucuauuuccccccaguucuggcaaagacaagaauaaaagcguccugcaggugagaagggcugaggggagggccucucuaaggagacucaccucccaugguccuucccucacacaccuugcccucuucccuccccucccugcucccagaacaaguauguccgauguucuguuagagcugagguacgccaucuccggaggguccugugucaccgcuugaugcuaaacccucagcaugugaguagucccacaguagguuucuugagggggagaaggggcuaagaaaggagggacagagucuaggguggaccaggguaguuuuugaccugccagaaaguuccuaaaauuaugcccccaucucccuccuaggugcagcuccuuuuugacaaugaaguucucccugaucacaugacaaugaagcagauauggcucucccgcugguucggcaagguaagccaggccacccucccugggaucacacccccuucagacuccccccaaccauccuacaguccucaggggaagggugggcugaggggcccuuugaauaauauaagaacauuccccacugacuacuacuuccucauucucuccuuagccauccccuuugcuuuuacaauacagugugaaagagaagaggagguaggggccaagcccccaccccaucccacuccccuucccuccccagauauuuaugugaaaugaacugcagcuuuauuuuuugaaauaaaaacuuuuaaaaagcac

SEQ ID NO: 14722 - RNA, 2082 nt, Homo sapiens
ggugcggcagagucucgacuuuauucucaaauauugggaaaguagccuggacaacauagcgggaccuccucucuaaaaaaaaaaguuuuuuaaauuagccugggguggugcugcacgccuguaaugccagcuagucgggagguugaggcaggaggaucgcuugagcccaggaggucgcgacugcagugagcggugaucgcuccacggcacuccagccugggcgacagagcgaggcccugucucagacaacaaaacaaacuuacaaaaaaaccgggaaaggugagcgucuggacugugggccggaagaggcccaaguggaccuccuuccuccacccuggaacucuggccagaggcagagcgcgaggugaggaguccagggccccagagcccaggauuggcggcggcuuugucuucaaucguccaccuguaucuccucgucugacagguggggccgggagucagggccggcagggccgaggcagaggccgggaucuggagcgccuucgggcagugcuaagcugcacaggacuuccggggacaacgcgcguagcgaggcgacgucggcgcgcaucuccuccacaucgcgcuugagcuuggcucgccgguucuggaaccaagugaccaccugcgcguuggccaggccgagucgcguagcuagcccgucucgcucggacggcgccagguacuucuggaagacgaagcgccgcuccagcuccagcaccuguugcgcggugaacgcagugcgugacuugcgccguuugcggccgaagggaccagggcccagcgcguccggaccugcccgcccuguagggauagggagggggucaguuuccagccuccgggaaucaggcugggccuggaaagaaaaguuggggguggggucgggccgguggcggugggggaaguagagggagagccaggaaggcggacggagaccagaacugugaucccuuaucgggagucaggcccagguggggauauggggcgcaaagcgggcuggccacaggggugcgaaaggcagcaggcugagggcauauuguaggggcaaggaagugaaggaagggagggaugauucagaggugcagggucaaaccuucugggguggagccuuugaggcuuuuaggagccucaggcugagcaggcuauaaguugagggugacaucagaggcgaguaagagucagggcagccgacccagcgugguggugguaacaggacuuagaucaugcccuuccauggaucgggucgggcauucgguuuacaguuccuuagugacaccagagcccgcuccuccggccccaaagggagauaaugagguacagagagcgagaaaaggcagagugcggaaucccgcgcccagugcugcgccaagggcuuucugcuccuugacuccccucgagaagagaguggcuuggagcggagcuuggucacccggaaagacucgacucuccagcgcuuucugugccgccuuugcaggcucacucguuuaccgccugcggcugaagccuuuugucucuuucucuccugccuuucucuaucgcgauugccccgccuacaaggaacagagcaacaggucgcucaguuggcgacggucugcccuuuucccuuggcacuggcggccuuccggagccgccgcggaaccuagggacuaacggaggagaggugagaagucgcaggugcgaguccuggcacgugggcugaggacaggggaggauuaggguggguggccugggcugggacaaagguuugagacggggaaccaggaggagagaggugaggaaaaggcuaagucagaguccgcgaccuugccggcucuauaccuucagagggcugcagagcgcgcgcgucaaguccgcggaaaguuuuacuagucagcuccuccagcgcgcacagcggcgacguuggacccggacccgacucuggaagcugcggcgcagagggugcucgggggaccaugcgcggggcuaggaugucugcgaugcuuaagaguguccgggguguucggggcucgcgucccgaguucauggucggccgggcuggggcgguccggcuguccguugcgcuaggcuccgcaaacgccuggg

SEQ ID NO: 14723 - RNA, 11147 nt, Homo sapiens
gggacagagugggcggccauguuuguuaggggcagaagccucccauuacggagcacgagagaguccaugaagguccccgcgacucccggacuggagaaaacggcucuugcgauggggcgaaguccgagcugcggcgggcguugguccgugcagggaagugggaaucguuagguucguucuggacccgccgccccauggcccaggcgucucgcucagguagccugccuccacucguuaucgugcccccgcugagggcgcaacccgggggcacuggggaggagcagugggagagaagucgaacgggcggucuucgcugggagguucacugcuggccgagcggaacuucuggagggacgccgugguggccgacgccggcggaugugagcgaggacuacgaggcugaugcugcggccuggaggcgggggcccgcagguggcggcccgaucccucccgcgcugcagcgucuccgggcgguguugcugcggcugcaucgcgagcgggagcagcuccuccaggcccgagacugcgccuaccaccuacagucggcugugcgacucaugaagacccugaguccuggcucgccauccggcggcccuagccccuugccccaguggugccgcgaccugcagcugcacccuucccaaggggcgguucugcgaaucggcccuggggagacucucgagccgcugcugcuagcgcgccccaucggacuagccgcccagugccuggaggcugucaucgagaugcagcuucgcgcucucggccgggagcccgccagcccgggccugucgucccaacucgccgagcugcucuuugcacuucccgccuaccacacacuacagagaaaagccuugagccacgucccaggggccgcacguccuuuccccacgucccgugugcuccgccucuugacgggggagcgggguugccagguggcaagucggcuggacgaggcgcuccaaggaucggcguugagggaccagcuccgcaggcggugccaagaggagggggaucugcuaccagggcugcugggccuggucgggggcguggcggguucagccagcuguggacuagggcucggaggggcuggggccuuguggagccaauacuggacccugcugugggcagccugugcucagagucuggaccuaaaucugggacccuggagggaccccagggcaacagcgcaacagcugagucaggcacugggucagggugagugaugggcuugggugggcguuugggaaggcuggggucucuuccuuccccuuggccaacucacugaccugccauccugaaggcaaaagcaggcccuuuagaaagaacaccccuggguucagacuauagcuucugagcuuucaaggcaaagucuugcuuuccaccccagucccgagucuuggaggaagcaugccuucuugccucaucauugagugggcagggguuguggaaagugagaccuuguuuucaggccccagagucauuucucccacuagcaucccugccucaggagugugagaaggagcuggcaucuuugugucacagacuacuucaucagucgcuuaucuggagcugggaccaaggugagaaggaaggggcacugggggugacauaagucccagguuaccgcuuccccaccacacuauacucucucauccucagguuucugccaggccuugggaucagcucuugggggucagagcagccuucccacauccucuggcacugcugaacuuuugcagcagcucuuuccuccucucuuggaugcccuucgagagcccagguuacgacggauuuucugccagccugcaggugagacgaggggcuggggcuggggacacagagcaguugaggauaucucuuuucuuucacucuguucugaaaucugccucuucccaaagguacuccaugaccccuaagauacucacucugcugcucaaauccccagauccugcgccugucgcccuaggucucuguacccuucagaccaccuugcucugguuccugggcagagcucagcaguacuuggcagcaugggacccagcuuccuuccugcuccugauccaaaaggacuuaccugugaguggcuggggaguagggaggggagcagccugagcuaggcugagcccucacucccuguuuccacccaaagccucuguugcaugaggcagaagcuuuguauagccuggccucagaggaaagcuuagcucuggaaguggagcagcagcugggccuggagauccagaagcugacugcacagauccaggugagaacaggggccucaacaguggcaguguaagacccuauguucugugccaaguaucgggggugggaagaguagaacaucucaguaacuuggaaucuccuuggagucucugcuaaauguaucuuuuuuugcucuguucauuuuuuguucucuuuaacuuuuuuuuuuuuuuuuuuuugagacagggucucacuuugucacccaggcuggagugcaguggcacaaucucagcucacugcagccucuaccuucugggcuuaaacgguccucccaccucagccucccuaguagcugagacuacaagcucgugccaccacacgugucuaacuuuugaauuuuuuuaguagagacaggguuucaccauguugcccaaucuggucucggacccuugagcucaagugauccauccaccuuggucucccaaagugcugggauuacaggcaugcgccaccaugccuggccccuuuaacauuuuacuauggaaaauuucaaacauguacaaauguagagagagguguauaauggacucccauaugucugucaccaagcauuuaacaauuaucaacucauggucaauuucaucuguguauccccuacccucuccccaguaaugccagacucucguuuuugauggcaacaguggaucauugccucgauucauuauuucauuagagguuguaaagugguaacauuucaauucucaucauuccuacuucauuuaugaguuggauuacuccuaugaagaaaaacuugccuucauuaaugauuugguuacucuuagguauauuuuagagagaaaauucaggauaaaugauugcaucuuucucuuuacuuaccaguuaucggcacauuucuccucucuuaaaaguuuaauuuguauuuuuauuaaugcuuugggaggccaaggcaagagcauugcuugaggccaggaguucgagaccaccaggggcaacauagcgagaccacccuaggcaacacagacucccaucucuccaaaaauuaaaaaauuuagcugagcaugguggcaugcgccuguacucccagcuacuugggaggcugaggcaagaggaucguuugagcccaggaggucaaggcugcaguaagcugugauagccacugcauuccagccagccuaggcaauacagugagagacccugucucaaaaaauaaaauagugcaugucuauaguuuaaaaagugaaauagaauauuauuuuauaaaacuaaugaaaaaacagcacuuuguuugcccucacucaccucugauuucuauuucacaguaguaaccuucauccauguuugccuguuucuccuaacauuuucuuauauguuuaugaauaaagccauuauacuuuuucuuccccauuuugcacauuuaucuauuccuauguggaagaugucugguuuuuuguuuuccugcucaguuuucuccucuuugccccgaauagggguguggcuguagaguucaguccuuaacucucugcuuuucucucaguauuccugcuuacccacagugucuugcugcugugaacucccggguucagucuuucuggcucccagaguucuuuuuuuuuuucuaagauggggucucacugucacccaggcuggagugcaguuaugugaucuuggcucacugcaaccuccaccuccugggcucaagcaauccucccaccucagccuccugaguagcuggaaccacagguggaagccacaaugcccagcuacuuuuuuuuuuuuuuuuuuugagaaggugucucacucugucacccaggcuggagugcaguggcgugaucucuacucacugcaaccuccaccucucagguucaagugauucuccugccucagccuccugaguggcugggauuacaggcgccugccaccacgcccagcuaguuuuuguauuuuuaguagagauggguuucaccauguuggccaggcuggucuggaacccuugaccucaggugauccacccaccucagccucccaaagugcugggauuauaggugugagccaccacacccggccaaugcccagcuacuuaaaaaaauuuuuuuuuuuguagagacaagguuuugccauguugcccaggcuggucuugaacccuuuuuaaaaaucuuuuuaaaaaacuuuuuugggaggccaagguggguggaucgccugaggucaggaguucaagaccagccugcccaacguggugaaaccccgucucuacuaaaaauacaaaaaaguagccgguaugguggcaggugccuguaauccuagcuacuucugaggcugaggcaggagaaucgcuugaaccuaggaggcggaaguugcagugagccgagauagcgccauugcacuccagccugggcaacaagaacaaaaauucugucucaaaaaaaaaacagaaaacaaaaaaauuuuuuguccaggugcaguggcucacaccuguaaucccagcacuuugggaaaccgaggcagguggaucaucugagguuaggagaucaagaccggccuggccaacauggugaaacccugucucuucuaaaaauacaaaaauuagcuggacauugugguguacaccuguaaucccagcuacucgggaggcugaggcaggagaaucacuugaauccgggaggcggagguuccagugagucgagagcgugccauugcauuccagccugggcaacagagugagacucaaaaaaaaaaaaguauauauauauauuuuauuuauauuauaucuauauauauuuuauuuauauuauaucuauuuauauauauauauauuuuuuuuuuaauuagaaguuuggcucgugacauagcccucaggagaucugagaacaugugcccuguucuugaacucuugagcucaagcaauccaccgccuuggccucccaaaguucugggauuacaggcaugagccuccacacccagccuggcucccagaguucuaguuaaacaucugcauuugccuguugggcauuucuaccucaguuuacugcugucuacuuaaacucaacaugccccagagcaggcucaucaugaguacugcacacagugacggucauagagcccugaggaaggaaggcuauagugggcaugugguuaaagaacgcuccauacauggccuauggcuggagaugguggcugggaagccucagaggaguggcugggguuacuggaagugggcaguuuguagauccuuguggggguagcagagagguggccuuaccagagcagagguuccuuuuguggguauguucacugggguugggugugggguaggguaguaagcaauuuggcaucaaauuguggagggcaugaacaccagccccaacaauuugcgcuuuaccucauaagugagggggugacauuuuaagagcagaaggguguaaucccagcauuucgggaggccgagauggguggauaacuugaggucaggaguuugugaccagccuggccaacaugguaaaaccccaucucuacuaaaaauacaaaaauuagccaggcauggugacgggugccuguaaucccagcugcucagaggcugaggcaugagaaucgguugaacccaggaggcagagguugcagugaucugagauugcgcaacugcacuccagccugggcaauaagagcgaaacuuggucucaaaaaaaaaaaaagaggcauugugaguuuucuuccuguuuggacuauaagaucccagugggugggggagagacugucacacacucugcaccuuguauucccucaguguugaguacagaggcuccuaacaaaaguccguugacaaaagggcaauuuccuugacauaaauaagggaggagaagggggcuugcauuuacuggagaagagaggaagauuuuggauuuagacagguugucagaugugccaggagccauaugggcuccacuccaugucuggccgcccccaggucuauccugucuucaggcucccuggcaucuaccauuucuuuacagagcagcugccauuaaccacauuuacugggguuccucucccucaagaugggcuguagagcagaaaccagcuuuauugcuguguucucucccuccaaaaacaaccuaucaaaccaaagaaacaaacccagcauauaggccuuuucuugcuuuauggguuauauugcucuggagugggcugugaagaauaauaauauauaauaaugccuuucaauguaaggacauuccaaaacuuccugagucucagaacauucaaauagucauugcuucugguuuacauacaguucuugucuuccuuuuguaggugauaaccaaaagaucauuguaggcuggguguaguggcuuaguggcucacaucuguaaucccagcacuuuggcaggcagaggcaggccgaucaccugagaucaggaguuugagaccagccugaccaacauggcaaaaccuugucuuuacuaaaaauacaaaaauuagcugggugugguggugcacuccuguagucccaccuacuugggagccugaggcaggagaaucacuugaacccgggaggcagagguugcagugagccgagaucacgccacugcacuccagucugggcgacacagcaagacucugccucaaaaauaaaaggucguuguaauuccccuuucuucccucaauuucugcccauugcagaucauacaaucccucuuucuggcauaugcucuguguguguguguguguguguguguguguguguguguguguguguguguguguguguguugcgggggugggggcaggguaugucuuucuuuuuccuuaaagcucuuguauaguaaaauuaaccucaaggauuuuccaucuuuugaaccaagcuggggagagcaagguaauccuagggcaauuguucauaauuuggguccagaccucuuggaaaacccaaugacaacuauggcauugcuccucaaaaaauggccaggcauacacaacuaugcaacaauucugggguuuuauggaugucaaguuggacauagagcuccuuagauauagaggaucaucauaauuugacaagccccuuuuacuuucucccuaucccuacagcuccugccugaagagucacuaagugucuuuucucaagaaugucauaaacaagccaugcaagguuucaagcucuacaugccacggggucgguacuggcggcuucgucucuguccugguaacuccucaucccagcuucuccuuccagaguuccaaggggguaauagugucucagcccuuccaaauuccgguuccccuccacugucuccauccuuguccucagcuucuguacccuucccuccugaaauccuacccucuucucccaaacacuccauuuagggguucaauggaucuccacagccuuauauucugucuucucuauuccagaaccucccagugcuccuagugaguaugcugguuuagugguccgcaccguacuggagccuguguugcaaggauugcaaggguugccaccucaagcccaggccccugcccuuggucaggcucugacggccaucgugggugccuggcuugaccacauucuuacccaugggauucgguucaggucaggaguaaagguggaaguggcagggggugaauggaacugggaaaaggaaggggauaagugggagaggcaggagggucaaguggccauacuguaccucugccuucagccugcagggagcgcugcagcucaaacaagacuuuggaguggucagggaguugcuggaagaggagcaguggagccuguccccugaucuccgccagacccugcucaugcucagcaucuuccagcagcuggauggggcccugcugugucuguugcagcagccccugcccaagucucaaguccacaggaggccccccuguugcugugaguuacuccccuucgcucacugcuuugugugucccaaacccuauucucaccauuaaucuggcuucaguauauccccagcagccaccuaccuuccacuccugccuuaccaggugcuugucaggagguccagaccacgaaauugcccagcagcugccucaauagccuggagagcuuggagcccccgcuccagccuggaacaucuccagcccagacaggucagcugcaaagcacacuaggaggaaggggaccuagcccggagggcuaccuggugggaaaucagcaggccuggcuugcccucaggcaacaccagcgaccccguuggcaccugccguuuuuuuccugccugggaaccaguccugaauccuaaggagccugggaccaggagccagaaaguuaagagcuccccaucucuagcuggaaaauccagacauuuggaauugcauauuaaggaagcccagaacuggaagcuuggaggaaagcauacuggagaauaagcuacaaagagccugggcuuaagaauccaagauuaggggcugggcgagguggcucacgccuguaauccagcacuuugggagaccgaggcaggcggaucaugaggucaggagaucaagaccauccuggcuaacacggugaaacccuguuuccacuaaaaauacaaaaaauuagccgggcgugguggcgggugccuguagucccagcuacucgggaggcugaggcaggagaauggugugaaccugggaggcggagcuugcagugagcugagauccagccacagcacuccagccugggugacagagcaagacucugucucaaaaaaaaaaaaaaaaaaaauccaagauuaggcagggcaugguggcucacaccuauaaucccagcacuuugggaggcugaggcaggcggaucaccugaggucgggaguuccagaccagccugaccaacauggagaaaccccgucucuacuaaaaauacaaaauuagccaggugugguggcgcaugccuguaaucccagcuacucaggaggcugaggcaggagaaucgcuugaaccuaggaggcgaagguugcggagagccgagauugugccauugcacuccagccugggcaacaagggcaaaacuucgucucaaaaaaaaaaaaaaaaaaaaaaaaaauccaagaucacuccagcaccuggaauccagaguaaagagcaagaccauagccuggaaccugaaggucagacccuugggagguucaggccuaguucuccaucacugaagauaucucagggauaaagaguugagugcucggccaggugagggggcucacgccugcucacgccuguaaucccagcacuuugggaggccuagaggggcggaucacgagguccgaucaagaccauccuggcuaacgcggugaaaccccgccucuacuaaaaauacaaaaaauuagccgggcgugguggcacgcgccuguagucccagcuacucaggaggcugaggcaugagaaucgcuugaacccgggaggcagagauugcagugagccgagaucgcgccacugcacuccugccugggcaacaagagcaaaacuucgucucaaaaaaagaaaacuggcuagaaugcacuucaacuuaaguccugggagcuacgcuaauucauggagaaccacagagguuuaauaggcauuucuauaccuggaucagccccaaggacaguauuacccuguacugcccuuccuauuacuauuuucagucauuuacuaauauugggcuguaguacuuucacguuuaagcuuuggcuauucagagcucacuacguuuaaucuucaguuaccugaaugguguuuaccuucugguguggaucaucccggcuuguguuagugcucucucuuuggaagaagccaggauuuaagaucgaguuagccuagauguggcccagcaggguacagaaggggaaaggcugcagaaaacgggcguauuuucgugcaaagagguuuuugcgccauuuauuuaugguuuucaccgucguaugagaggacuauucaugauaggcuguauuugcugacagccuacuuugggcucccccaugcguugugccgaaaccaccucuuucuuuccugccuuccuccgccugggcuaggaagcccagagcugcgguucgcaggccugcuaagcagccggcggccggaagucuaucccgcagaagcgcagccauucacggccucacgcaaugcgacacuuccgccugcacgaguucuuccggggcggaggucaccauggcagcugccuuggcucggcuuggucugcggccugucaaacagguucggguucaguucugucccuucgagaaaaacguggaaucgacgagguacgaaggggaaguggguagaagcgggaaguggugcgccuuccuucagccggggcuuuaagcccucagcuuggcgcuccucuguuuuuccaccguaggaccuuccugcagacggugagcagugagaagguccgcuccacuaaucucaacugcucagugauugcggacgugaggcaugacggcuccgagcccugcguggacgugcuguucggugggcuugguggagacgggcaggagggaacagcgagcagcccgcgcgccccuaagccccagcacugcggucccucccugucucacucguuuguuucuuccccaggagacgggcaucgccugauuaugcgcggcgcucaucucaccgcucuggaaaugcucaccgccuucgccucccacauccgggccagggacgcggcgggcagcggggacaagccgggcgcugauacuggucgcugacagcgccaaagagaccaacaagaugauuuuagcguggacuaggacacuuaaccuaagaagaguuucacuuaaucauucaaaucacuaucugaagggucacggagcgcaaaauaaaguuuaaaacccugcuaccacaauguuucuggaacaagacuagaucagagaggugucuggaugaaccugaauuuauuucacuuucuuacuaucacucacugcuuaacccuuuugaauuug

SEQ ID NO: 14724 - RNA, 3185 nt, Homo sapiens
uaauccuagggcaauuguucauaauuuggguccagaccucuuggaaaacccaaugacaacuauggcauugcuccucaaaaaauggccaggcauacacaacuaugcaacaauucugggguuuuauggaugucaaguuggacauagagcuccuuagauauagaggaucaucauaauuugacaagccccuuuuacuuucucccuaucccuacagcuccugccugaagagucacuaagugucuuuucucaagaaugucauaaacaagccaugcaagguuucaagcucuacaugccacggggucgguacuggcggcuucgucucuguccugguaacuccucaucccagcuucuccuuccagaguuccaaggggguaauagugucucagcccuuccaaauuccgguuccccuccacugucuccauccuuguccucagcuucuguacccuucccuccugaaauccuacccucuucucccaaacacuccauuuagggguucaauggaucuccacagccuuauauucugucuucucuauuccagaaccucccagugcuccuagugaguaugcugguuuagugguccgcaccguacuggagccuguguugcaaggauugcaaggguugccaccucaagcccaggccccugcccuuggucaggcucugacggccaucgugggugccuggcuugaccacauucuuacccaugggauucgguucaggucaggaguaaagguggaaguggcagggggugaauggaacugggaaaaggaaggggauaagugggagaggcaggagggucaaguggccauacuguaccucugccuucagccugcagggagcgcugcagcucaaacaagacuuuggaguggucagggaguugcuggaagaggagcaguggagccuguccccugaucuccgccagacccugcucaugcucagcaucuuccagcagcuggauggggcccugcugugucuguugcagcagccccugcccaagucucaaguccacaggaggccccccuguugcugugaguuacuccccuucgcucacugcuuugugugucccaaacccuauucucaccauuaaucuggcuucaguauauccccagcagccaccuaccuuccacuccugccuuaccaggugcuugucaggagguccagaccacgaaauugcccagcagcugccucaauagccuggagagcuuggagcccccgcuccagccuggaacaucuccagcccagacaggucagcugcaaagcacacuaggaggaaggggaccuagcccggagggcuaccuggugggaaaucagcaggccuggcuugcccucaggcaacaccagcgaccccguuggcaccugccguuuuuuuccugccugggaaccaguccugaauccuaaggagccugggaccaggagccagaaaguuaagagcuccccaucucuagcuggaaaauccagacauuuggaauugcauauuaaggaagcccagaacuggaagcuuggaggaaagcauacuggagaauaagcuacaaagagccugggcuuaagaauccaagauuaggggcugggcgagguggcucacgccuguaauccagcacuuugggagaccgaggcaggcggaucaugaggucaggagaucaagaccauccuggcuaacacggugaaacccuguuuccacuaaaaauacaaaaaauuagccgggcgugguggcgggugccuguagucccagcuacucgggaggcugaggcaggagaauggugugaaccugggaggcggagcuugcagugagcugagauccagccacagcacuccagccugggugacagagcaagacucugucucaaaaaaaaaaaaaaaaaaaauccaagauuaggcagggcaugguggcucacaccuauaaucccagcacuuugggaggcugaggcaggcggaucaccugaggucgggaguuccagaccagccugaccaacauggagaaaccccgucucuacuaaaaauacaaaauuagccaggugugguggcgcaugccuguaaucccagcuacucaggaggcugaggcaggagaaucgcuugaaccuaggaggcgaagguugcggagagccgagauugugccauugcacuccagccugggcaacaagggcaaaacuucgucucaaaaaaaaaaaaaaaaaaaaaaaaaauccaagaucacuccagcaccuggaauccagaguaaagagcaagaccauagccuggaaccugaaggucagacccuugggagguucaggccuaguucuccaucacugaagauaucucagggauaaagaguugagugcucggccaggugagggggcucacgccugcucacgccuguaaucccagcacuuugggaggccuagaggggcggaucacgagguccgaucaagaccauccuggcuaacgcggugaaaccccgccucuacuaaaaauacaaaaaauuagccgggcgugguggcacgcgccuguagucccagcuacucaggaggcugaggcaugagaaucgcuugaacccgggaggcagagauugcagugagccgagaucgcgccacugcacuccugccugggcaacaagagcaaaacuucgucucaaaaaaagaaaacuggcuagaaugcacuucaacuuaaguccugggagcuacgcuaauucauggagaaccacagagguuuaauaggcauuucuauaccuggaucagccccaaggacaguauuacccuguacugcccuuccuauuacuauuuucagucauuuacuaauauugggcuguaguacuuucacguuuaagcuuuggcuauucagagcucacuacguuuaaucuucaguuaccugaaugguguuuaccuucugguguggaucaucccggcuuguguuagugcucucucuuuggaagaagccaggauuuaagaucgaguuagccuagauguggcccagcaggguacagaaggggaaaggcugcagaaaacgggcguauuuucgugcaaagagguuuuugcgccauuuauuuaugguuuucaccgucguaugagaggacuauucaugauaggcuguauuugcugacagccuacuuugggcucccccaugcguugugccgaaaccaccucuuucuuuccugccuuccuccgccugggcuaggaagcccagagcugcgguucgcaggccugcuaagcagccggcgg

SEQ ID NO: 14725 - RNA, 3185 nt, Homo sapiens
ccgccggcugcuuagcaggccugcgaaccgcagcucugggcuuccuagcccaggcggaggaaggcaggaaagaaagaggugguuucggcacaacgcaugggggagcccaaaguaggcugucagcaaauacagccuaucaugaauaguccucucauacgacggugaaaaccauaaauaaauggcgcaaaaaccucuuugcacgaaaauacgcccguuuucugcagccuuuccccuucuguacccugcugggccacaucuaggcuaacucgaucuuaaauccuggcuucuuccaaagagagagcacuaacacaagccgggaugauccacaccagaagguaaacaccauucagguaacugaagauuaaacguagugagcucugaauagccaaagcuuaaacgugaaaguacuacagcccaauauuaguaaaugacugaaaauaguaauaggaagggcaguacaggguaauacuguccuuggggcugauccagguauagaaaugccuauuaaaccucugugguucuccaugaauuagcguagcucccaggacuuaaguugaagugcauucuagccaguuuucuuuuuuugagacgaaguuuugcucuuguugcccaggcaggagugcaguggcgcgaucucggcucacugcaaucucugccucccggguucaagcgauucucaugccucagccuccugaguagcugggacuacaggcgcgugccaccacgcccggcuaauuuuuuguauuuuuaguagaggcgggguuucaccgcguuagccaggauggucuugaucggaccucgugauccgccccucuaggccucccaaagugcugggauuacaggcgugagcaggcgugagcccccucaccuggccgagcacucaacucuuuaucccugagauaucuucagugauggagaacuaggccugaaccucccaagggucugaccuucagguuccaggcuauggucuugcucuuuacucuggauuccaggugcuggagugaucuuggauuuuuuuuuuuuuuuuuuuuuuuuuugagacgaaguuuugcccuuguugcccaggcuggagugcaauggcacaaucucggcucuccgcaaccuucgccuccuagguucaagcgauucuccugccucagccuccugaguagcugggauuacaggcaugcgccaccacaccuggcuaauuuuguauuuuuaguagagacgggguuucuccauguuggucaggcuggucuggaacucccgaccucaggugauccgccugccucagccucccaaagugcugggauuauaggugugagccaccaugcccugccuaaucuuggauuuuuuuuuuuuuuuuuuuugagacagagucuugcucugucacccaggcuggagugcuguggcuggaucucagcucacugcaagcuccgccucccagguucacaccauucuccugccucagccucccgaguagcugggacuacaggcacccgccaccacgcccggcuaauuuuuuguauuuuuaguggaaacaggguuucaccguguuagccaggauggucuugaucuccugaccucaugauccgccugccucggucucccaaagugcuggauuacaggcgugagccaccucgcccagccccuaaucuuggauucuuaagcccaggcucuuuguagcuuauucuccaguaugcuuuccuccaagcuuccaguucugggcuuccuuaauaugcaauuccaaaugucuggauuuuccagcuagagauggggagcucuuaacuuucuggcuccuggucccaggcuccuuaggauucaggacugguucccaggcaggaaaaaaacggcaggugccaacggggucgcugguguugccugagggcaagccaggccugcugauuucccaccagguagcccuccgggcuagguccccuuccuccuagugugcuuugcagcugaccugucugggcuggagauguuccaggcuggagcgggggcuccaagcucuccaggcuauugaggcagcugcugggcaauuucguggucuggaccuccugacaagcaccugguaaggcaggaguggaagguagguggcugcuggggauauacugaagccagauuaauggugagaauaggguuugggacacacaaagcagugagcgaaggggaguaacucacagcaacaggggggccuccuguggacuugagacuugggcaggggcugcugcaacagacacagcagggccccauccagcugcuggaagaugcugagcaugagcagggucuggcggagaucaggggacaggcuccacugcuccucuuccagcaacucccugaccacuccaaagucuuguuugagcugcagcgcucccugcaggcugaaggcagagguacaguauggccacuugacccuccugccucucccacuuauccccuuccuuuucccaguuccauucacccccugccacuuccaccuuuacuccugaccugaaccgaaucccauggguaagaauguggucaagccaggcacccacgauggccgucagagccugaccaagggcaggggccugggcuugagguggcaacccuugcaauccuugcaacacaggcuccaguacggugcggaccacuaaaccagcauacucacuaggagcacugggagguucuggaauagagaagacagaauauaaggcuguggagauccauugaaccccuaaauggaguguuugggagaagaggguaggauuucaggagggaaggguacagaagcugaggacaaggauggagacaguggaggggaaccggaauuuggaagggcugagacacuauuacccccuuggaacucuggaaggagaagcugggaugaggaguuaccaggacagagacgaagccgccaguaccgaccccguggcauguagagcuugaaaccuugcauggcuuguuuaugacauucuugagaaaagacacuuagugacucuucaggcaggagcuguagggauagggagaaaguaaaaggggcuugucaaauuaugaugauccucuauaucuaaggagcucuauguccaacuugacauccauaaaaccccagaauuguugcauaguuguguaugccuggccauuuuuugaggagcaaugccauaguugucauuggguuuuccaagaggucuggacccaaauuaugaacaauugcccuaggauua

SEQ ID NO: 14726 - RNA, 4341 nt, Homo sapiens
cgggaggcggaggcggaggcgcaggcgcuggcuggcaggugucgcuaaccggacgguggucgccagggcgagaggcgggagccggagaggugaggcaggacccgggcuccacugccgccucuccgagcucuugugacgcggaccucagugccaggauggcucggggcgagcggcggcgccgcgcagugccggcagagggagugcggacagccgagagggcggcucggggaggccccgggcgacgggacggccggggcggcgggccgcguagcacggcuggaggaguggcucuggccgucgugguccugucuuuggcccuggguaugucggggcgcugggugcuggcgugguaccgugcgcggcgggcggucacgcugcacuccgcgccuccuguguugccugccgacuccuccagccccgccguggccccggaccucuucuggggaaccuaccgcccucacgucuacuucggcaugaagacccgcagcccgaagccccuccucaccgguaaccgggccccagggcgggcaggcaggcggacuccuaaucugggcgccccagcuugaagcgagagcaagggugggaaggaauggaucaggagaguuaugaagagggaugacccggagacccggagggacagguccccugcucuuugacuuacguggccauucuacccccaggacugaugugggcgcagcagggcaccaccccggggacuccuaagcucaggcacacgugugagcagggggacggugugggucccuauggcugggaguuccacgacggccucuccuucgggcgccaacacauccaggauggggccuuaaggcucaccacugaguucgucaagaggccugggggucagcacggaggggacuggagcuggagagugacuguagagccucaggucagggccucaggacacccuuuucucagcccagacccccuccauccuucccuugcugccagcaaaugcagcaugaagugggcucuggcugccuggcuuaaauccugccuuaaacaacugccuguauaaccauuucuauuuaccaucucuaagccuugauuuccuugcuuguaaaauguacaauguagauaauaauagcacuuaacucacaggacuguaagaauuaaaugaaaaagaggcugggcgcgguggcucacgccuguaaucccaguacuuugggaggccgaggcuggcggaucaccugaggucaggaguuccagaccagccugaccaaaauggagaaacaccgucucuacugaaaauauaaaauuagccgggcgugguggcgcaugccugugauccaagcuacuugggaggcugaggcaggagaauugcuugaaccagggagguggagguugcgcugagccgagaucgugccauugcacuccagccugggcaacaagagcaaaacuccaucucaagaaaaaaaaaaaagccaggcgcgguggcucacgccuguaaucccagcacuuugggaggcugaggcgggcggaucaugaggucaggagauggagaccauccuggcuaacacggugaaacccggucucuacuaaaaauacaaaaaauuagcugggcgugguggcgggcgccuauugucgcagcuacucgggaggcugaggcaggagaauggcgugaaccugggaggcggagcuugcagugagcugagaucgcgccacugcacuccagccugggcgacagagcgagacuccgccucaaaaaaaaaaaaaaaaaaaaagaauuaaaugaaaucaacuguguagaguucuuaguguaggacauaguacaaaaguauacuguuaucucccagggcacccagugcaaggcucuuuaucucaucccgcuuggguguaccugguuacccucagugacccucauuacugccagacguauguuguuuacauuaccccugccuacuguuccuuucccucacuaaggcugauucucaagagggaauucaagagagaaugccaaucuaacacuguucuuuucuguccucguuggucacucaggacucagguacuucugcccucccuuuggucucccuguucuucuauguggugacagauggcaaggaaguccuacuaccagagguuggggccaaggggcaguugaaguuuaucagugggcacaccagugaacuuggugacuuccgcuuuacacuuuugccaccaaccaguccaggggauacagcccccaaguauggcagguaacugggggaaaagaauguugggggauggaaggggugguuauucccauuuucaccagucuccauguccccugccugagaccucccaaccugacuccugaacacuuuguauuucucuuuauaaugcccacugccuucucuugaauaauauuuccuauuuaucuucuccccuucaagcuacaaugucuucuggaccuccaacccaggacugccccugcugacagagaugguaaagagucgccuaaauagcugguuucagcaucggcccccaggggcccccccugaacgcuaccucggcuugccaggaucccugaagugggaggacagagguccaagugggcaagggcaggggcaguucuugauacagcaggugacccugaaaauucccauuuccauagaguuuguguuugaaucaggcagugcccaggcaggaggaaaucaagcccugccaagacuggcaggcagucuacugacccaggcccuggagagccaugcugaaggcuuuagagagcgcuuugagaagaccuuccagcugaaggagaagggccugagcucuggcgagcagguuuugggucaggcugcccucagcggccuccuugguggaauuggcuacuucuacggacaagggcugguauugccagacaucgggguggaagggucugagcagaagguggacccagcccucuuuccacccguaccucuuuuuacagcagugcccucccggucauucuucccacgaggcuuccuuugggaugaaggcuuucaccagcuggugguucagcggugggaucccucccucacccgggaagcccuuggccacuggcuggggcugcuaaaugcugauggcuggauugggagggagcagauacugggggaugaggcccgagcccgggugccuccagaauuccuaguacaacgagcaguccacgccaaccccccaacccuacuuuugccuguagcccauaugcuagagguuggugacccugacgacuuggcuuuccuccgaaaggccuugccccgccugcaugccugguuuuccuggcuccaucagagccaggcaggcccacugccacuaucuuaccgcuggcggggacgggacccugccuuaccaaccuuacugaaccccaagacccuacccucugggcuggaugacuacccccgggcuucacacccuucaguaaccgagcggcaccuggaccugcgauguuggguggcacugggugcccgugugcugacgcggcuggcagagcaucugggugaggcugagguagcugcugagcugggcccacuggcugccucacuggaggcagcagagagccuggaugagcugcacugggccccagagcuaggagucuuugcagacuuugggaaccacacaaaagcaguacagcugaagcccaggcccccucaggggcucguucggguggugggucggccccaaccucaacugcaguauguagaugcucuuggcuaugucagucuuuuucccuugcugcugcgacugcuggaccccaccucaucccgccuugggccccugcuggacauucuagccgacagccgccaucucuggagccccuuugguuuacgcucccuugcagccuccagcuccuuuuauggccagcgcaauucagagcaugauccccccuacuggcggggugcuguguggcucaaugucaacuaccuggcuuugggagcacuccaccacuaugggcaucuggaggguccucaccaggcucgggcugccaaacuccacggugagcuccgugccaacgugguaggcaauguauggcgccaguaccaggcuacaggcuuucuuugggagcaguacagugaccgcgaugggcgaggcaugggcugccgcccuuuccacggcuggaccagccuugucuuacuggccauggcugaagacuacugaagggagggagaggaggggagccaagacacucaugccacucuggcucugaagggacaaaggcuucuggcuuuugcccccagccccuuggauaccaguaauucaaaccuuccucauuucaucucaggugucuccuugcugucaucccacauagcccuggggugaaugugaauccagagucuauuuuucuaaauaaauuggaaaaaacauuuugaa

SEQ ID NO: 14727 - RNA, 4341 nt, Homo sapiens
uucaaaauguuuuuuccaauuuauuuagaaaaauagacucuggauucacauucaccccagggcuaugugggaugacagcaaggagacaccugagaugaaaugaggaagguuugaauuacugguauccaaggggcugggggcaaaagccagaagccuuugucccuucagagccagaguggcaugagugucuuggcuccccuccucucccucccuucaguagucuucagccauggccaguaagacaaggcugguccagccguggaaagggcggcagcccaugccucgcccaucgcggucacuguacugcucccaaagaaagccuguagccugguacuggcgccauacauugccuaccacguuggcacggagcucaccguggaguuuggcagcccgagccuggugaggacccuccagaugcccauagugguggagugcucccaaagccagguaguugacauugagccacacagcaccccgccaguaggggggaucaugcucugaauugcgcuggccauaaaaggagcuggaggcugcaagggagcguaaaccaaaggggcuccagagauggcggcugucggcuagaauguccagcaggggcccaaggcgggaugaggugggguccagcagucgcagcagcaagggaaaaagacugacauagccaagagcaucuacauacugcaguugagguuggggccgacccaccacccgaacgagccccugagggggccugggcuucagcuguacugcuuuugugugguucccaaagucugcaaagacuccuagcucuggggcccagugcagcucauccaggcucucugcugccuccagugaggcagccagugggcccagcucagcagcuaccucagccucacccagaugcucugccagccgcgucagcacacgggcacccagugccacccaacaucgcagguccaggugccgcucgguuacugaagggugugaagcccggggguagucauccagcccagaggguagggucuugggguucaguaagguugguaaggcagggucccguccccgccagcgguaagauaguggcagugggccugccuggcucugauggagccaggaaaaccaggcaugcaggcggggcaaggccuuucggaggaaagccaagucgucagggucaccaaccucuagcauaugggcuacaggcaaaaguaggguugggggguuggcguggacugcucguuguacuaggaauucuggaggcacccgggcucgggccucaucccccaguaucugcucccucccaauccagccaucagcauuuagcagccccagccaguggccaagggcuucccgggugagggagggaucccaccgcugaaccaccagcuggugaaagccuucaucccaaaggaagccucgugggaagaaugaccgggagggcacugcuguaaaaagagguacggguggaaagagggcuggguccaccuucugcucagacccuuccaccccgaugucuggcaauaccagcccuuguccguagaaguagccaauuccaccaaggaggccgcugagggcagccugacccaaaaccugcucgccagagcucaggcccuucuccuucagcuggaaggucuucucaaagcgcucucuaaagccuucagcauggcucuccagggccugggucaguagacugccugccagucuuggcagggcuugauuuccuccugccugggcacugccugauucaaacacaaacucuauggaaaugggaauuuucagggucaccugcuguaucaagaacugccccugcccuugcccacuuggaccucuguccucccacuucagggauccuggcaagccgagguagcguucagggggggccccugggggccgaugcugaaaccagcuauuuaggcgacucuuuaccaucucugucagcaggggcaguccuggguuggagguccagaagacauuguagcuugaaggggagaagauaaauaggaaauauuauucaagagaaggcagugggcauuauaaagagaaauacaaaguguucaggagucagguugggaggucucaggcaggggacauggagacuggugaaaaugggaauaaccaccccuuccaucccccaacauucuuuucccccaguuaccugccauacuugggggcuguauccccuggacugguugguggcaaaaguguaaagcggaagucaccaaguucacuggugugcccacugauaaacuucaacugccccuuggccccaaccucugguaguaggacuuccuugccaucugucaccacauagaagaacagggagaccaaagggagggcagaaguaccugaguccugagugaccaacgaggacagaaaagaacaguguuagauuggcauucucucuugaauucccucuugagaaucagccuuagugagggaaaggaacaguaggcagggguaauguaaacaacauacgucuggcaguaaugagggucacugaggguaaccagguacacccaagcgggaugagauaaagagccuugcacugggugcccugggagauaacaguauacuuuuguacuauguccuacacuaagaacucuacacaguugauuucauuuaauucuuuuuuuuuuuuuuuuuuuuugaggcggagucucgcucugucgcccaggcuggagugcaguggcgcgaucucagcucacugcaagcuccgccucccagguucacgccauucuccugccucagccucccgaguagcugcgacaauaggcgcccgccaccacgcccagcuaauuuuuuguauuuuuaguagagaccggguuucaccguguuagccaggauggucuccaucuccugaccucaugauccgcccgccucagccucccaaagugcugggauuacaggcgugagccaccgcgccuggcuuuuuuuuuuuucuugagauggaguuuugcucuuguugcccaggcuggagugcaauggcacgaucucggcucagcgcaaccuccaccucccugguucaagcaauucuccugccucagccucccaaguagcuuggaucacaggcaugcgccaccacgcccggcuaauuuuauauuuucaguagagacgguguuucuccauuuuggucaggcuggucuggaacuccugaccucaggugauccgccagccucggccucccaaaguacugggauuacaggcgugagccaccgcgcccagccucuuuuucauuuaauucuuacaguccugugaguuaagugcuauuauuaucuacauuguacauuuuacaagcaaggaaaucaaggcuuagagaugguaaauagaaaugguuauacaggcaguuguuuaaggcaggauuuaagccaggcagccagagcccacuucaugcugcauuugcuggcagcaagggaaggauggagggggucugggcugagaaaaggguguccugaggcccugaccugaggcucuacagucacucuccagcuccaguccccuccgugcugacccccaggccucuugacgaacucaguggugagccuuaaggccccauccuggauguguuggcgcccgaaggagaggccgucguggaacucccagccauagggacccacaccgucccccugcucacacgugugccugagcuuaggaguccccgggguggugcccugcugcgcccacaucaguccuggggguagaauggccacguaagucaaagagcaggggaccugucccuccgggucuccgggucaucccucuucauaacucuccugauccauuccuucccacccuugcucucgcuucaagcuggggcgcccagauuaggaguccgccugccugcccgcccuggggcccgguuaccggugaggaggggcuucgggcugcgggucuucaugccgaaguagacgugagggcgguagguuccccagaagagguccggggccacggcggggcuggaggagucggcaggcaacacaggaggcgcggagugcagcgugaccgcccgccgcgcacgguaccacgccagcacccagcgccccgacauacccagggccaaagacaggaccacgacggccagagccacuccuccagccgugcuacgcggcccgccgccccggccgucccgucgcccggggccuccccgagccgcccucucggcuguccgcacucccucugccggcacugcgcggcgccgccgcucgccccgagccauccuggcacugagguccgcgucacaagagcucggagaggcggcaguggagcccggguccugccucaccucuccggcucccgccucucgcccuggcgaccaccguccgguuagcgacaccugccagccagcgccugcgccuccgccuccgccucccg

SEQ ID NO: 14728 - RNA, 2591 nt, Homo sapiens
ucuuguugucugggugagcggcggaggcgcugcuguggauuggucacagggagaaaccucugaucuguuccuauuggcccguccgucaagggacgaugaugauugguagggcagagcaaucugaguccuaguugguggaguucugcccggauggaagcuccggccgcggagugaugguggccucagcgaagaugggccgggcagggaccauggcgguggcagcagagguggcaggggcggggcggcuggcgguagaggaggcugugguccucagggggcuguagguggagguauggcucgggccagcagcgggaacggcagcgaggaggccuggggggcacuucgggcgccgcaacagcagguaucccaauagcuccaaaaccuaucacgacagccauuugucucuuuccccuuuccuugucccuuccuuuugggggugggggaggaacucacggagccaaagguacugugaaguuccuaaacaugucucuuccacucuuugucuaaacuuuguaacguagaugcagcugacuuugccuguagccucauagaacccaucccauggcugcaguggaagcuugcgguggcucuccagugaccagaggcauagugaggucccagggaggcucccucugucuugcaacaguuauuugugaucuuuuucuaugugccuauugucacaacagaguccggcagcgucuucucuugagggagcaauuuggagaagagcuggaacccagacucgcgcccuggaugccauccuuuaucauccacagcaaucccaucugguugggagcacugcucugggucucacacugccccuccucuauccuagggagccugaggcccagggguggaaagauccaguugcgggugggggguagugaaccgcgcaggauaaugaaagcaacuugcuuuggaaaugaccuaccgcuacccguugucugagacugagauuaucucagacugucuucuggcuucugccaaaacacucccuuaacagaaagcaccgaggggauggggguagggggguuggggagagugaggcuugagugugaaggaagucucauauaugcagagcugaaaucucccucuuuguauguccacacuuuugucuuguucucuagacugauucuugcuauuccaaauccucuuccacguugacagcccuucagauauuucaacacuccucucagcauccuccacuucccccaucucuccaagcugaacuugguucacagggugggauuguguaugugcaugcaggagguggggguggacagugcccugggcuggaaucccccuuaguucuaagugccuccuugcccgcagcuucgagagcugugcccaggagugaacaaccagcccuaccucugugagaguggucacugcugcggggagacuggcugcugcaccuacuacuaugagcucugguguaagucuccaagagggcuauuuccaggucccuguguccacccucccuuggaccucagaauuucggccuucagggccccuucucugcaugaaagaugccugaguugcucccuccuugccucuugcaggguucuggcugcucuggacuguccucauccucuuuagcugcuguugcgccuuccgccaccgacgagcuaaacucaggcugcaacaacagcagcggcagcgugaaaucaacuuguuggccuaucauggggcaugccauggggcugguccuuucccuaccgguucacugcuugaccuucgugagugacuugaugcccugggucagcuaccaguggcccuccccaaaccagaaccccaaaucgucucacauucccuuuuccacacauuucaaaguauuuuucccuaauauaaaaacuagcacccuauaccugguugucuucaaccaaucaugccaauuuucuccccugcaggcuuccucagcaccuucaagcccccagccuacgaggaugugguucaccgcccaggcacaccaccccccccuuauacuguggccccaggccgccccuugacugcuuccagugaacaaaccugcuguuccuccucauccagcugcccugcccacuuugaaggaacaaauguggaagguguuuccucccaccagagugcccccccucaucaggagggugagcccggggcaggggugaccccugccuccacaccccccuccugccgcuaucgccguuuaacuggcgacuccgguauugagcucugcccuuguccugccuccggugagggugagccagucaaggaggugaggguuagugccacccugccagaucuggaggacuacuccccgugugcacuacccccagagucuguaccgcagaucuuucccauggggcugucuuccagugaaggggacaucccauaaguaguuuugagaggguggauggguuacuugcccaccagaaacagcccuagucccaacuccuugcguuccuuuggccccucccugccuaccuagaaucugccugaaagggcuggagaggggcaguauugggggacugugcuagcuuuacccccgcaggacauacacaggagccuuugaucucauuaaagagaugugaaccagcuacuuguggauuugggug

SEQ ID NO: 14729 - RNA, 3094 nt, Homo sapiens
ccgaagcaccggauguaauuuaauaggguggggaagauacucaagagcgggcaugggacggggcgcagaguccggguuaagggccuuacguagccaaaaggggggauccaggacccucgggcccccccagccgcaucugcagguugaugcgguagcacugaagacuacagagugccuggccugugcgggagcaagcguagcggcgcggauggggacagccggggacagagcagcgcggcggcgggccugagggggauggccgcugagacacugccgugggggcggggacgccaggugggaaggaaaggguggaacccugugcuccgcugcaguagcgcaccaugggggccggagccgcagcccgcccuccccgccgcucgccccgugcgcccccccggccuccccgcccacuggucgccgcagucuuggugaggcgcucgauagucugguucuugugcucuucugcccgccgcgccgccuggagccgccgcuuccgcgcccgcuccucgcgcuucagcagcaucuccucugugagggcgggaggugggcagcccucagcuacaggcagcggcagcauaggggaagguugacuccgcgccuucuggagcagagcucgcuagggagagacagagacggggugcugucugaaaauggaggaagauggagaggcgaggucggccagaucgggggaggggaaagaagggacauggaaggcagggucuugagcagugcaggccuucggaggcgggauauuaauuaaugagcacccucuccaggacaccuuccauagguuccucuucauaaauacugccuccucccagaucuccugacauuuagcuuuagguccuuaucucucaaggggagaagcaucaguaauguuaccugccugaccugugcaccaaaacuguaccagcuuucccagaggucuguuguuauuuuuaaucuuaucucaauagagaguaucagguggauaacugcucaagccaaaaucccaggcuuagccuugauauauuuucucuccauuccccuccccacaaguaucuacuuccaaaauauagccauaauucaucugauuuucuccaucuccaccacuuucgucuugguuaaagcaaccacugccucucagcugauuacuucaacagcuuccuaguuguucuccauacuucuaucucuugucuccacgaagauucauucucuacaaagaugccaaaguaaucuauugaaauguaaaccaaguaugucacuucucugcguacagcccuucaguggcuuguccacuuuuucuucuccuuugcuagacauguuccagucucaaggucugugcgccugcuggucucugcucaaaagcucuucugguauugcaaauguuaucucuucaaagaagccuucucuaacuacccuaaugucucucuuccaucauuucuaucuguuuguuuacgccacuuucuauuucaucacccuuuucuuuuugucauaaaccauauagcuuuuugaaauuauuuacuuauuuacuucccagccccccaacacacacacuagaauacuagcuccaggagaacagaaacuuugucuuuucucuacuaucgauauccccaaugccacgcaaagugcgugggucguggagaguucucaauacuguauacauuuggugagugaauaaacaaugaaccaacauaccugucgagcaguaagcagccgcucauugaucuccuucuugaggucuccauugucauccagcucccccuucuccagggcauccagccaccucuguuccuccucuuccuccugacccccuaacccuccugauaggucccgaaguggagagggagagagauuacugucuucaucugggaaggaaguuggagaaagaaaaacagaauuguucagauggggcacccuaauuuggcugaguuaauacugggacauggaaaauccuaacccauuucagaaccaaccuucuuucuuuaggcggguauaauaagaaacccaguuuccccaccuccagauccucacccagccaggcacgguacugcucaagggggacuccuuccauagguuccucuucauuauccacaaccauaaggggagagggugagcgaggccccucugggaucacagugaagguaggaacacugcagagaagcaacacuacucuuuaaaaugagcaagcgucuccuccuccuacuccguagcuacacccaacuuuccccacccucuuagacucuugcugccuaaaucuggacccugaagucacaguguccauucggucuucuagaaagcccagucggcuucuaacuacuaucucugcuccuaaaguuccccuuauaaaacuaugacccucuuggccucaccucuugguccccaggacuugucccccaagcuugauuuugaguuugagcugaggcuuggcaggggacggcugcgugggcccggcgucuucuuccugaugguguuucuucuuguguuucuucuugugcuucuuguguuuuuucuugugcacuccauggccaugggcacccgccaggcucaacuccagggcuucuccuguggaaggaaagccugucgacaguguuuggccggaggguggcaggggaagcccugaauaaccuaagccccuacuggaucccacccuucccgcaguacucgcuguuaccauaacaacagcaccgccuuucuccuugccaccuguggccgaaguacccuggacucuccgaggagcaagaacgggacuucuuuucuaacacgaccuaaauugcuugaucuauucgcgcuuacccggcucaggggccuccauagccccagaggugcucccacgccgccacagcuuacucaugagguccugcgaggaaaggggacuagaaaugguugggacacacgcagacacgccuuuuccgccccgcggaaaaacuggagccagcaaaacaaccaguuacuuccgguucauggcaaccauccuugugcggggcacgcuucgcguccaaaaucgucccugagaaacgaggauccuuccaacgaacguuccggucccucugaggucgggacagcccaaaugggcagggcuuuccccuggcuccgccuccccacgcuagcuuuc

SEQ ID NO: 14730 - RNA, 3094 nt, Homo sapiens
gaaagcuagcguggggaggcggagccaggggaaagcccugcccauuugggcugucccgaccucagagggaccggaacguucguuggaaggauccucguuucucagggacgauuuuggacgcgaagcgugccccgcacaaggaugguugccaugaaccggaaguaacugguuguuuugcuggcuccaguuuuuccgcggggcggaaaaggcgugucugcgugugucccaaccauuucuaguccccuuuccucgcaggaccucaugaguaagcuguggcggcgugggagcaccucuggggcuauggaggccccugagccggguaagcgcgaauagaucaagcaauuuaggucguguuagaaaagaagucccguucuugcuccucggagaguccaggguacuucggccacagguggcaaggagaaaggcggugcuguuguuaugguaacagcgaguacugcgggaagggugggauccaguaggggcuuagguuauucagggcuuccccugccacccuccggccaaacacugucgacaggcuuuccuuccacaggagaagcccuggaguugagccuggcgggugcccauggccauggagugcacaagaaaaaacacaagaagcacaagaagaaacacaagaagaaacaccaucaggaagaagacgccgggcccacgcagccguccccugccaagccucagcucaaacucaaaaucaagcuugggggacaaguccuggggaccaagaggugaggccaagagggucauaguuuuauaaggggaacuuuaggagcagagauaguaguuagaagccgacugggcuuucuagaagaccgaauggacacugugacuucaggguccagauuuaggcagcaagagucuaagaggguggggaaaguuggguguagcuacggaguaggaggaggagacgcuugcucauuuuaaagaguaguguugcuucucugcaguguuccuaccuucacugugaucccagaggggccucgcucacccucuccccuuaugguuguggauaaugaagaggaaccuauggaaggagucccccuugagcaguaccgugccuggcugggugaggaucuggagguggggaaacuggguuucuuauuauacccgccuaaagaaagaagguugguucugaaauggguuaggauuuuccaugucccaguauuaacucagccaaauuagggugccccaucugaacaauucuguuuuucuuucuccaacuuccuucccagaugaagacaguaaucucucucccucuccacuucgggaccuaucaggaggguuagggggucaggaggaagaggaggaacagagguggcuggaugcccuggagaagggggagcuggaugacaauggagaccucaagaaggagaucaaugagcggcugcuuacugcucgacagguauguugguucauuguuuauucacucaccaaauguauacaguauugagaacucuccacgacccacgcacuuugcguggcauuggggauaucgauaguagagaaaagacaaaguuucuguucuccuggagcuaguauucuaguguguguguuggggggcugggaaguaaauaaguaaauaauuucaaaaagcuauaugguuuaugacaaaaagaaaagggugaugaaauagaaaguggcguaaacaaacagauagaaaugauggaagagagacauuaggguaguuagagaaggcuucuuugaagagauaacauuugcaauaccagaagagcuuuugagcagagaccagcaggcgcacagaccuugagacuggaacaugucuagcaaaggagaagaaaaaguggacaagccacugaagggcuguacgcagagaagugacauacuugguuuacauuucaauagauuacuuuggcaucuuuguagagaaugaaucuucguggagacaagagauagaaguauggagaacaacuaggaagcuguugaaguaaucagcugagaggcagugguugcuuuaaccaagacgaaagugguggagauggagaaaaucagaugaauuauggcuauauuuuggaaguagauacuuguggggaggggaauggagagaaaauauaucaaggcuaagccugggauuuuggcuugagcaguuauccaccugauacucucuauugagauaagauuaaaaauaacaacagaccucugggaaagcugguacaguuuuggugcacaggucaggcagguaacauuacugaugcuucuccccuugagagauaaggaccuaaagcuaaaugucaggagaucugggaggaggcaguauuuaugaagaggaaccuauggaagguguccuggagagggugcucauuaauuaauaucccgccuccgaaggccugcacugcucaagacccugccuuccaugucccuucuuuccccucccccgaucuggccgaccucgccucuccaucuuccuccauuuucagacagcaccccgucucugucucucccuagcgagcucugcuccagaaggcgcggagucaaccuuccccuaugcugccgcugccuguagcugagggcugcccaccucccgcccucacagaggagaugcugcugaagcgcgaggagcgggcgcggaagcggcggcuccaggcggcgcggcgggcagaagagcacaagaaccagacuaucgagcgccucaccaagacugcggcgaccagugggcggggaggccgggggggcgcacggggcgagcggcggggagggcgggcugcggcuccggcccccauggugcgcuacugcagcggagcacaggguuccacccuuuccuucccaccuggcguccccgcccccacggcagugucucagcggccaucccccucaggcccgccgccgcgcugcucuguccccggcuguccccauccgcgccgcuacgcuugcucccgcacaggccaggcacucuguagucuucagugcuaccgcaucaaccugcagaugcggcugggggggcccgaggguccuggauccccccuuuuggcuacguaaggcccuuaacccggacucugcgccccgucccaugcccgcucuugaguaucuuccccacccuauuaaauuacauccggugcuucgg

SEQ ID NO: 14731 - RNA, 1280 nt, Homo sapiens
ccuccucccagaucuccugacauuuagcuuuagguccuuaucucucaaggggagaagcaucaguaauguuaccugccugaccugugcaccaaaacuguaccagcuuucccagaggucuguuguuauuuuuaaucuuaucucaauagagaguaucagguggauaacugcucaagccaaaaucccaggcuuagccuugauauauuuucucuccauuccccuccccacaaguaucuacuuccaaaauauagccauaauucaucugauuuucuccaucuccaccacuuucgucuugguuaaagcaaccacugccucucagcugauuacuucaacagcuuccuaguuguucuccauacuucuaucucuugucuccacgaagauucauucucuacaaagaugccaaaguaaucuauugaaauguaaaccaaguaugucacuucucugcguacagcccuucaguggcuuguccacuuuuucuucuccuuugcuagacauguuccagucucaaggucugugcgccugcuggucucugcucaaaagcucuucugguauugcaaauguuaucucuucaaagaagccuucucuaacuacccuaaugucucucuuccaucauuucuaucuguuuguuuacgccacuuucuauuucaucacccuuuucuuuuugucauaaaccauauagcuuuuugaaauuauuuacuuauuuacuucccagccccccaacacacacacuagaauacuagcuccaggagaacagaaacuuugucuuuucucuacuaucgauauccccaaugccacgcaaagugcgugggucguggagaguucucaauacuguauacauuuggugagugaauaaacaaugaaccaacauaccugucgagcaguaagcagccgcucauugaucuccuucuugaggucuccauugucauccagcucccccuucuccagggcauccagccaccucuguuccuccucuuccuccugacccccuaacccuccugauaggucccgaaguggagagggagagagauuacugucuucaucugggaaggaaguuggagaaagaaaaacagaauuguucagauggggcacccuaauuuggcugaguuaauacugggacauggaaaauccuaacccauuucagaaccaaccuucuuucuuuaggcggguauaauaagaaacccaguuuccccaccuccagauccucacccagccaggcacgguacugcucaagggggacuccuuccauagguuccucuucauuauccacaaccauaaggggagag

SEQ ID NO: 14732 - RNA, 1280 nt, Homo sapiens
cucuccccuuaugguuguggauaaugaagaggaaccuauggaaggagucccccuugagcaguaccgugccuggcugggugaggaucuggagguggggaaacuggguuucuuauuauacccgccuaaagaaagaagguugguucugaaauggguuaggauuuuccaugucccaguauuaacucagccaaauuagggugccccaucugaacaauucuguuuuucuuucuccaacuuccuucccagaugaagacaguaaucucucucccucuccacuucgggaccuaucaggaggguuagggggucaggaggaagaggaggaacagagguggcuggaugcccuggagaagggggagcuggaugacaauggagaccucaagaaggagaucaaugagcggcugcuuacugcucgacagguauguugguucauuguuuauucacucaccaaauguauacaguauugagaacucuccacgacccacgcacuuugcguggcauuggggauaucgauaguagagaaaagacaaaguuucuguucuccuggagcuaguauucuaguguguguguuggggggcugggaaguaaauaaguaaauaauuucaaaaagcuauaugguuuaugacaaaaagaaaagggugaugaaauagaaaguggcguaaacaaacagauagaaaugauggaagagagacauuaggguaguuagagaaggcuucuuugaagagauaacauuugcaauaccagaagagcuuuugagcagagaccagcaggcgcacagaccuugagacuggaacaugucuagcaaaggagaagaaaaaguggacaagccacugaagggcuguacgcagagaagugacauacuugguuuacauuucaauagauuacuuuggcaucuuuguagagaaugaaucuucguggagacaagagauagaaguauggagaacaacuaggaagcuguugaaguaaucagcugagaggcagugguugcuuuaaccaagacgaaagugguggagauggagaaaaucagaugaauuauggcuauauuuuggaaguagauacuuguggggaggggaauggagagaaaauauaucaaggcuaagccugggauuuuggcuugagcaguuauccaccugauacucucuauugagauaagauuaaaaauaacaacagaccucugggaaagcugguacaguuuuggugcacaggucaggcagguaacauuacugaugcuucuccccuugagagauaaggaccuaaagcuaaaugucaggagaucugggaggagg

SEQ ID NO: 14733 - RNA, 16494 nt, Homo sapiens
uagguggggagggggacgaagaaggaacauuugggacugugggauguugaaauggucucuucggaggcugccgggauugaaacugggcaaggucccagggcccgaguagagccagagcgugcuacgcggcgaucccugagccacgggguuuucagcgcccgggaagccaggcuugccagguuggggcggcuggcggggcagggcuucucgguccgucccaaguccagguaggcgcucgcgacccgcgcgggcagggagaacgcgcucccacagugcucgcgaggugcagugcgccccugggggcuccggggccgucgggccaggucggcuuggcgcccagggacuggccggacgggcugggccuuuggcggggguggaagaggagguugccgcgcccugcccggcccaggugucgucuccgggggcgggguuuggagccccgcagcgggagauucccggccggacuggcggacgagcgucgagagacagaagccgaggagaggaggcuaagccgggcggcgcggggagcgcacugagcaggcaaagucgcagggccgccagcauguucucccgaaaccaccggagccgggucaccguggccaggggcuccgcccuggagauggaguucaaacgcggccgcuuccgacucagccucuucagcgaccugcccgaggugagagacucgcgucccugccuuccccuuccgcggcucccgggggcagccccagccaccucggccuccuucccucgcccgcgugcacgccgaggggcggagacgcacggucuggguacaaacccgacggaguuguugacuuaaaaaguaagguguggacggucugcauuuucaucggauccaugcugcccauuccgcggccugguuaggauuaucugccugagccuggaaaaagcccggguuggucucaauuuguagggccccagcucgacuccuaaaaugugccugaaccccaaaaugucuugggcauccccgggccaagggcggugggcagcuaggcgggccccaagcgcucggacucuuggccugggcucccgcuuguuccccagucgccagccccaucccacaaccugucgcagccaucugggccagccucugucaucaaccccgacuuuaggccggggccgcucgcuuccccgaagcccaauucaaaggcuccucuaugccccugcagggcuuuuaacuccuugggguuacuucccacacgcaaaauuuccgccuccuuuucuggggccuaagaggaguccagccccuaggcugagcguuucccccguccgccguccacgcguuaaccuguuggauccccaccuguaacgcccuaagggcuagggcggggcugaaggugugugguugagcggggacugagagggcgaauagcuaccccgaagacucuucuguccccaaggucagacucacacucgcccaaggagagcccaguuccaagccuucccuuccgggucuggaaaggguuaagugaggugggccuuccuuccgcccccucuaccucccggcugggauuccaggccuggcuucugcccuuucccuccagccugcccagaacaaagaggcucuuucacacccuugucccggcgucccgggccuucucugacucagaagcuaguggaccuggggagagggggccuuugucgcguccccuugcccccaagcgacugggcccgaggaacccgcguggggccagcgugggggaguaaggggcgaggcccgggaccagggggaggggccugugagcuggggccgccccugggauuagcccggccuucggggacagcucggaggagcuggggcggagccgcagggccuggcggccgccgagugaagugugacuccgugggccuggcguggaggcgggggcgcuaggcugcagcuggcucggaaucggggcugguuuccugucuggaagggaaggggccugcagaagggagcggggacagcagcagacaggcacaccccugccuuccucucucccucuccucccuucucuggaaaagcgagguaauugugagcccaggguggagcgggcuggaugggggcccugaguuggaagggguggcccuagggcugggcugcuuugccaacucaccccuuugucccauucccugggcucacucuccccugagguccucaccuguguggcucuuuuucccaacuuucucaaacuaagcuggaaccccucucgggaagcuccaaccuccugcaaaccccaugacucuagaaccugcaugaggcgucguuucccugcccccuuccaguugugccugccccucacugcccucuccgcacacagauucccuguccaccaggccagggaugugggcgggggcuggggagcggccagagucggaaugaaagggccuuuuucuuccacagcugggagaacagcugccaccaaagcgagacuggacacucugugccuagagcccccucugcagcuggccuuuccuccugggaccccacuuauccucacuucgcuuucuuuuucuucccugccuggcucccggcagggccccggagcagcagugggcgaggaaaauuugucacagcagccagagggguuuaacaggagugcagagggauaagggcagcuucugcccucugcccaagagcuggccaccucuuuaaagacugagggaacagugggaggaggaacugugggacagugugguaccuaucuguccccccucuggagggguugacaagggaaagggcaccggggggcacagagaugcaggacagauugcacauccuggaggaccugaauaugcucuacauucggcagauggcacucagccuggagguaaucccccgacccuuggaguacacaccuccuucacuugcaucccagccccaaucucugcccugcccauuccugcuacagcaugguggggagagccaggccugcuuaaagugggaagagggacaggugguucccuaugccuuguguugggugcaguguguggacccaggcucaguucugcccaucauagucuuauguuugcagcagggucuuuacaccuauuucaggaagcucugugggugaguguaaaugucuguucuggggacaaggguuccuuuuaggcaugggaagaagagaggaguucaaugugagagagguuuacagaaaggauguagccuugcuagagaagagaaggacucugggcuaugaguaaggauucugcuggcccuugagacagcaaggugcuguuuauucguguauuuguuuuuuucaauucuuuacagagacgaggucucacuauauugcccaggcugguccuggcucaagugaucucccuaccucgaccucccaaaaugccgagauuacaggcgugagccacugcaccuugcgcuauguauuauuaaacacauguaaauuuuauguacuaucugccaagcucuuuucgaccauaggauaccucagugaauaagacaagaaaguuccauuguagugggagaacagaaauauacauacgaacacauaaauaauaucacauaaagaaauuaugaugaaaauggggauguaaugaaaaucagaugagggaggcaauguuagauguggaggucaggggaagccucuguugggagaucuuugagcuaagcccaggaggauuuggagauaugugaagacuggaggaagggcaaaggcccugauaugaggaugaggguaauauauuugugggaaagagagagccaguguggcuggaauauaguaguugggguggagcugaugggcaggggccagaucaugcagggccuugaaggccaugauaaggcaccuggauuucaccuuaagugugauguugggccauggaaggguuuuaagcaagggaaugacucaugccauguuuuuaaaugauggcugcuauggagaauaggcuggugggaaguugaggguaggguuggggguggaggguuggcaagagaguucgcaaauguccaccaggugggaggcuguuucacucccacuucaggugggagugaaccugguggugugaauuaaaaugcucaugguggagaaagggaguagauuucaaaugguggugguaggucugacaggauuugcugauggauuggaugggagggcaaagaaagagaacuccaggaugauucccagguauguggcuaagcaacugggugguguggcuguuuacggagauggggaagauggaggaaguuguggaagugacugccuggaccaggcaggggcugcugcugagaggucagaggcaggacugcaaagagucuagaucaggaauggcaggauauuguaugugcuguccccccucaagcccugcccccacucccuggaucauaguagauguuacuggucaauuuuggcacucuuuaucaacgagcccagaccuggccucagaaucuuucucaggaccgucuuggcauaaacugugcagguuguguccuucacacaggugccagccagaggugagaguccuggucugguuucagcggcaucaggagggagcacguuuaucuaauuuguuugccuggagagggucagcuuuuucuaauuuguggaaagguguccagugaacucguugggacucuaccuaauuauccuccaucagugcaugagauaaaaccuauuugccauucauaguccucugcacuguccacaucaguuacauauggcuauuuaaaucuuacuuuuaguucauuaaaauaaaacaaaacauuaauuccuuaguugcuguagccauauuucaagugcuagauggcuacugaacauuuccaucaccgcagaagguuuuauuggacagagcuggucuagguauguaaauguuuaaauucugcauccuacccuccuccaaaaaauguaaauuuucucuguggaaggccuguucaaguucuggggcagaggagaugcuuaguuucacuuuggucacucuccuuuaggagaguggcugagggugcuguguucuuucucaaccaaguucagcagguccucaaaagagagacccauugauguuucagggaauggcaaaagagauagucguggaagaguaaauccaagaagacuuucuggaggaagugacucaaguugcaaguaaagggggcuuauuuuaaaauaugugcuaggcccagguagagaugagacuuucccauauaauucucaaacaaugcuacgaaggagguggaauacuccccauuuuacaaacucagguuccaggggucaaauucugugggcuugucaagucccuaaaccaggauuuguacuuagcccugguggagauucugaagggaaaaaaggguagugagaagcagagcaggaagucagagacuuaagagagugggagggguggaagggauaucaacagggggccuaauguguguggggcccaugacucauccucuagccccuugggaucugacccggguccagcugacacccagcucugcgcucuuucccaggggaaaugcugcccgcuuggggagaggguguguuuggguggggagggggcaacaaggaacuaucccuggguuggggaaacgcuagaagcacaaggguccagauccugagccaggauucccaguuccucugccugaaagggugggagccaguuuccuagggcgcucccggccuugggccuugggagaguggauuuggggcuggagaucaguagggaaauagaggaggugucuggacucguggucccacucauccaugcugggcccagugaccucccuagggccccagcucucccaauuuauacacuauucgcccuccauacucucaggcaaggggucaccuuggagggcaaacgcuacgcgggaggggccucccggagcuggagcacgucgugaaggccaggagccuuuuccagggcggcgcgggcgcacuccuggagguccggucccgccgcgauggagucucgguggaggcaccgccuugagccaagcccagccaggugcccggagggaccuccagcgcccugguaccccucaguugcucucgcggcaauugggagcugaugucaccggcguccugagcgcugcagcuggaggcggugcagcuaugcuggcgcccuggcuccuccgauuucccgcggcccucggacccagccggcuccccaggccagugcagcucucuggaccucgcgcgccucugcgcgccucucgcaauggagcgggcuggggaaggauccgugagugcugggacugggaugagacuagccaagauggggguugaggacaccuccgugucccccuccugccaggcucacccauuugggauguuuguggcugaagcugggugcagacugggguggggguugucgggcagcgcagaacccuggugcagacaaaacuagacugggaggaccuauguagucugaaagggcuuccuggugaggggcuuugggaaaggguuggcuuauuacagaaggaaaacggguggauggugaugggggaaggugauaaaaguccggccuagcacaguggcccagaaaauagccaaggaagcaucuguaggcaggcaggacaaggcuuuuuagaagagggaauuuaggguguucgggucugagagacuugaaggcuggagccacuagggacagaugcaagggcacaguguauggaggagagcuggugugaggaaaaagacagguuuggaguggucacauuaguuccccuguuucaaauggauggcucgacuugucuccugaaccaaucuguacacugugauagaguuagucuuccaacuccucucugaagcuuuccuugaucaccucagccagaagcaaacagaggcuguuucuugugagcaugguugugccaugacauggcacuuauggagcagccauuaaagucaucaucucucaccucccagcuggauuuuaaauguacaaccuuggacaguacagggaugcuccaguguugacugaguaaaugcugcuaccaccaaaguauagcgucauuaaaauaagcaucccugccauuaauguauaccacaugcugggcacugugcuaagugcuuuaaguuccugccucacagaauucucacagcccuaggacuauuuccauuccugauuuacagauggggaaacugaggcuuagggagguugagcaaauugcccauugcuuuuuaagaagcaggaccuccagggcuccuuucuaaaugaauguuccugagaauccuggugucucuuccagggccucucagcuggcccuuauccacagucccucauuccuggaccaccuaccuucccauccccauuccuugccucugaccucaucucccaagcucagagggccgguagguggugauucucuuaauuugggguguauagguuucugugcagcgucagugaacacuguaggugguaugcuccuuguccacugaucccuugccaacuagaugucccuggcaucacuugagucugagggauaacucucauuugccuuuccuucuguccauucccaugaguuggugguucucaaccuggguguaccucagaaucacuuggggaguuuuccaaaaguacauaugccccacuccuagagauucuuauucugcaaaucuuagguagggccugaucauuuuuuuuuaaacuccaaagaucuaauauuuuuuaaaggaaauacaauuuccaguaguacaaaggguauauauaaaguaucauuaggcugggcgcaguggcucaagccuguaaucccgcacuuugggaggccgaggugggaggaucacuugaggccaggaguucgagacuagucuggccaacauggcgaaacccugucucuacuaagaauacaaaaguuaggccaggcauggugucucacaccugcaaucccagcacuuugggaggccaaggcggguggaucaccugaggucgggaguuugagaccagccuggccaacauggugcaaccccgucucuacuaaaaauacaaaaauuagcugggugugguggcucacaccuguaaucccagcuacuccggaggcuaggcagaagaauugcuugaaccugggaggcggaguuugcagugagccgagaucaugccacuucacuccagccugggcaacagaguaagacucggucucaaaaaaaaaaaaaaaaaagaauacaaaacuuacucgggcgugguggcacaugccuguaaucucagcuacucaggaggcugaggcacaagaaucacuugaaccuggaagguggaaguugcagugagcugagaucgcgccacuguacuccagcuugggugacagagugagacucggucucaaaaaaaaaaaaguaucauaaauguuuuccaucccuggcucccaggccuacaaucacuaauauuuuaugcauaaacaugcauaucuauaucuauguauauauaugcaugcauacauauauauauaucaugcacaaaugguaguaugugcaauacuacccuucuuuucucacaucauuuauuuuggagauuguuucauaucugcauacaugugcauaucucuuuccuuaaugucugcaauacuacaggguacagauguacuguuacuuauuuaaccaauguccuacugaagggguuuuaauuuugguguuuaaaacaaugccacaaugaggccgggcgcgguggcucacgccuguaaucccagcacuuugggaggccgaggugggcggaucacaaggucaggagaucgagaccaucccgguuaacacugugaaaccccgucucuacuaaaaauacaaaaaaacaauuagccggaugugguggcgggcgccuguagucccagcuacuugggaggcugaggcaggagaauggcaugaaccccaggagguggagcuugcagugaacugagaucguaccacugcacuccagcuugggcaacagagcgagacuccgucucaaaaaaaaaaaaaaaugccgcacugaauauuuuuguauguauggcuuuaccuagauauaugugaaauuauauguguaagauaaacugcuagguauuggauagcugaauuaaaggauauaugaauuuguaguuuucauagauuuuuuuccaaauugcacucaaaagaggcugaaggaauuuauacuuccaaccaucaaaugcaugagggcaucucuauuuuucuuauuuguuuuauauauauauauauauguuuuuuuuuuuuuugagccagagucuugcucugucguccaggcuggggugcaguggugcagucucggcucacugcaagcuccgccucccggguucaugccauucuccugccucagccucccaaguagcugggacuacaggcgcccgccaccacgcccugcuaauuuuuuguauuuuuaguagagacgggguuucaccguguuagccgggauggucucgaucuccuggccuugugauccgccugccucugccucccaaagugcugggauuacaggcgugagccaccgugcccggcuguuauauauuuuuuuagagguggggucucacuauguugcccaggcuggccuugaucuccuaggcucaagggauccucccaccucagccucccucacacaccacugcaccuggcuacaaagcuucucugguuauucgugggcagcugagauugagacccaaugccugcucuugaacugccuaaaacauuaguuucuugucaguuuuacuggccacagcccaccuggggacuggggagugcuuuagccuguccacugacugacauuuccuucucacccuucccccaacccuggcuaggacacggaguugcagaggaagcuagaccaugagauccggaugagggaaggggccuguaagcugcuggcagccugcucccagcgagagcaggcucuggaggccaccaagagccugcuagugugcaacagccgcauccucagcuacaugggcgagcugcagcggcgcaaggaggcgcaggugcuggggaagacaagccggcggugagcaagggggagacgaggccucgauggaggcaggaggccuucuggguggugguggugcagcaugugcguguguggcauguggaccaccuuaaagaugacuuccccaugaagucuuaucagggaccugggagagaccuugguguuuuaccaccacuguguguugcccagaggcgcauuugugaguagccagggcaggacuuagaaaagucggugugucuggugaaagguagcugaucugaaggguagcaaguaaugcaaaagcacuaauuugcuaagcccugucugugauccaguaagacuggcuaucuggcuuuuggaaaauuaauuuccucaacgcugguucacaaaaucaccaauuuaccacauacugacaauaguuuguuauaucugggguucaccuucagaggcagggagugggaaaggaaauaagaaaccacuuaaggaaagccuacccauucaaacaaauuagauugugcauucuaaaagggcucagcuucuggauguaaaauguaagcaacacugacauuagacuguugaucugacaagucuauaaugacuuaagugaugccaugauaaaaccaaaauauuggggaaaauauuuggcaaauuauucuaagaauaugccaauuuggauaaaguggucauuuggagaacugguuuuuaggaaaguggccuacuuacuccacugaggcugcuaggggaaauagucccagccccucacagguauggugcccauuccagccaugaaggcugacacaagaggagguugccaggagcucacccaugaagcuaccagaagaaggcagaaaacccacuguauggcuaucccaugaagcuagaggaagggcaagcugguggggggacagccucugagaggcagcauggacagacucuguccugccaaaguccucacacagcccacacaggugauuugagguacaccccaagugccuggcagcuaaacacauugccauuagugccacaucauuuagcuuaaggcucuacuaagucaguaauuacuuuaguggcauuaugaguaaguacagaugaacuggcagucgcuucaggaaagggacacauggugaguccugaugaugggcagggagggaaggaagguggggugucgggcccugcaguggggugugggggagcugcagaacuuggggcacuaguaggguacaccauaucaggccaggaggaaaaaggagaaaucaaaguuggggagugguagggaaggaaaagggucuguagugaauggaacguaacucuucccuauuggugauuuuccuuugaacaaauguuggccaaauuauuuucugacccaguacccuccuauaucaaagaagugaugggauggugggaaauaagcagcuuuccuauuguuaaaaaaaaaaaaaauaaagacuggagaccccucuaagccagggguuuaauggagagcccuggaaaugaagucuuucugugggcaccuguccccucaaggcugcaccuguccuuggcagggaucuggagagguggucagggagguugcuuggagagaggagcccugagcuugugccuuaugugugaguuaauguggcuugagugucccugguguccccaagccuggcaaacugcuggguucaaugaacaacuuucccuuauagucccucagcccugccugucggccuggcugggaaccugguggcugaggcgcugggaucagggggauccuagagucguugggaccagagcaagggggaauaguggcuagaggccaggccaggacauugugauuuauccacaggccuucugacaguggcccgcccgcugagcgcucccccugccgcggccgggucugcaucucugguaagaagcacagcuaccccagcugcugguaccccuugcccaagcacacggccuccugccccaucucaacaucuauucuuaccccucugccccuuagaccuccggauuccacucauguggaaggacacagaauauuucaagaacaaagguggugaguuccacacacccugggacaaauucaggggaaugacccugaaguaggaggcucucgugggacguguuuuuuguuuugcccuuuguccccagacuugcaccgcugggcuguguuccugcugcugcagcugggggaacacauccaggacacagagaugauccuaguggacaggacccucacagacaucuccuuucagagcaaugugcucuugugaguaccucacacuguggcuaccuccuuccuccacucugcuccaguucuggaugagcgaguuccaggggaggaagcugggaugggggcaggguggagaggaggggcaccuggccuucucuguggagcuguccugcacuugccucacccacauccccuacccucugccucccuggacuuuccugugaccacccuccuuucuuccucccaccagcgcugaggcggggccagacuuugaacugcgguuagagcuguauggggccuguguggaagaagagggggcccugacuggcggccccaagaggcuugccaccaaacucagcagcucccugggccgcuccucagggaggcguguccgggcaucgcuggacagugcuggggguucagggagcagucccaucuugcuccccaccccaguuguuggguaaggccuugcacaccgacaccacccucagcugccuguauucugcccacaggugaccuuugaacuguguugagugugcagaacccauuuugcauugcugccaggaugugcagacagauaugaaugagcaguggccacguagcugggaggcauuccagcccacgccccagagcugggcugaagccaguccagaagaccagugggaaggcagggagacuuaggcccuggggucuuaccuuuuuagcagcagcaaauacauuuuauuuuuagagacagggucucacuauguugcccaggcuagucucgaacuccugggcucaagugauccucccgccucggccucccaaagugguaggauuacaggcgugagccacagcacucagccuagcaaauacauuuuauguggauagagcagagcuucuugguuggagcagaguacccugggaccuauggugguaccuaaaugcaccuggagacaccgcaugggaccacugagacucugagaagcaguuugagaaccuuuggguagugaacagaauacugauuuuggacauagauauggguucaaauucaaacucccccacuuuccaccuauaaauuaugggcaaguuucuuaaccucucuaagccucaagcugccucaucuaguugaagaaugccaccaaccucacagggcugucauaggaauacagugggauaaaacauauaaagcauacguccugacacuuagcuggagcucgguaaauguucauuccuaacccucuggggaggcaagcgaguuuucuguggggcagucugaacaauggggcagaucugcucagcccuuagaguuccugcuggccaacaugccccucccuuggcugaugcucucuccuaucucccucagugguccucguuaccaccucuuggcucacaccacacucacccuggcagcagugcaagauggauuccgcacacaugaccucacccuugccagucaugguaaguaugugugugcaugggggacauacacaugugauggugagaagaggggcugugggaugguccccuucucauuccccuaccucacccugcacuuccuccucccccagaggagaacccugccuggcugccccuuuaugguagcguguguugccgucuggcagcucagccucucugcaugacucagcccacugcaagugguacccucagggugcaggugagggggcccugaggaguggaagggagcagggagaaggcagaggagagcuggauaaccaggaauagaagagcuaaugaaaaaucaagauuuggguggaagaaaugggguauggccagacgaggggaggaauggacagcaggguggacaaaacgaacagguucucauggggggcugagaagagggauacugggggccgugacuuccccagaaaauguugagucauuugugcagcaagcuggggagaugcagaacugggcacaagugcauggaguucugaaaggcacaaaccucuucuguuaccggcaaccugaggaugcagacacuggggaagagccgcugcuuacuauugcugucaacaaggugaugggucccuugguaguaaggccaccaagggcacaggcccaggagccucuccuucaggccccaggagggugggcacauaccucagagagauagaagcaggccuccugcuccugacagugccacauccagcuucaggggcccguauuuuccccaacuacagcaucacugugagaggaucgucccauucacuugccauccucagucccugccaaaucucagagaggguucucucgccugcagguucagggcuuuucauccucucucccucuucucccucagauuccaauuuauaucuacuuuaccacuucccauuucucuccagguccaauugcccuucuuugcucccuaucccuuuuaugggcuuuccugccuacuuuuugucaguucugagggaccucuggcuggagcauccuugccuaccuuugugucuucccugccuugcucaaucccuuuuucccugucucaagcugcuccuccuccccugacucaggacuggcugucucauccccagcccuuuuuugccauuccuuccuacucuggucaguaggaggcaaaugagagggcucagcaaaagccccacaagcucauucuucuaaggcaggcgugaucaaggcugccugauugucacugccaacuucugugaccaagguagaccucuucuuucuccugcaggagacucgaguccgggcaggggagcuggaccaggcucuaggacggcccuucacccuaagcaucaguaaccaguauggggaugaugaggugacacacacccuucagacagaaagucgggaagcacugcagagcuggauggaggcucuguggcagcuuuucuuugacaugaguaagagagaagggggcuggguugaaccuuugggaagaacuggaguuugucauuuuuacuaaaggccucuguuucaagauuauguggaagggaauguagcaggagaaagggcagccuggcucucucuuuuaaucagcgcucuucuuccaggccaauggaagcagugcugugaugaaaucaugaaaauugaaacuccugcuccccggaaaccaccccaagcacuggcaaagcagggguccuuguaccaugagauggguaagugagaggaaugugaacuccaggaagcuaaugggaaguaggguuggggacuucaagagaaaccagauaauggaaacagagagaaagcacacucugggcuacaccagaucucuggggacccaagucucacccaaucuuguguguucuuuucuccucuccaacucuuuuuagaaccaccuccaccaaaguucaaaacaaaaccccagugagccaggaucauuucauuaauuucuuuccuaauuucuucuuuucuguuucccuuucugcauguggauuccugucucuucuucugaccccucacuugccuggcaccgcuuucauuuucuccucuugguuucuucacccaccucugcuccccacuccuccccuucccauccccaucuaccuugugccccaugucccacagucuuaucagagccuguagccccagggggcccaggugaggggcugcuccugcaggauaacgcaaucuccacugagauccaggcuuugcuuuccuccuauuacagugacaggugauagggcuggguaggcuuggggccugagcucugacuagcccaacccucccccaaccccuuccuggugccacagcuauugagccgcuggaugacaucgcagcggugacagacauccugacccagcgggagggcgcaaggcuggagacacccccacccuggcuggcaauguuuacagaccagccugcccugccuaaccccugcucgccugccucaguggccccagccccagacuggacccacccccugcccugggggagaccccgaaccuuuucccuggaugcuguccccccagaccacuccccuagggcucgcucgguugccccccucccaccucagcgauccccacggaccagaggccucugcagcaaaggccaaccucgcacuuggcuccagucaccagugugagagagaaaggugcuggcauaggaucugcccagaagagaaaaugacccaugcgcaguugggcucuggauacggcgcugucuauagcaaguuggccagucuggccuccuguuccucugcuggaccugggguaggcugcaggggugggcagaagccccucuuaaauugugguugccaugguaccgagggacucauuccuggggcucgcugggaccucccuaaacccuuccuggaagaaaacuggaaccaacucugcccuaccucccugcacuaaccagcuuugaggauggcacugaagaacccuuggagcaaacauaccucccuugugacucccacaucaaccauuaaaguuauuuaacag

SEQ ID NO: 14734 - RNA, 2277 nt, Homo sapiens
guuccuaaggcaacucagguguuuauuucuggcuagcagagggagggaccaguuacuacugccagaggcucagggaucagagggaggcagcaggcuuagaggagcgugaccacacuuugggggcugaguucuucauuagcugugcuacggucaccugggcuuuggggcaccugucuggaugggauguugcucaacgggaggaaaggugcuaccuucuuuguccucuuguucaggcacaccagagcugagcaacaccugggugcuccgguuccacaugcucacaccaggggccagcuucagggcuucuggcagcaacacgggcuuccacaucaccugggaaguggcuucaaggaccgggggugugguucgaggccaucugccaggauccuggcccucccugucugccagcuccagacccuguggaggcacgcggguccggccagcccacagcucgcccagcagcucggccuuccccucccaaccgcugggccaccugacacugggccacagcuuggggcugcggcugcgggccacaucagggagcaccggguguguggugaggaagcggauccuggaguuugggaguggcagcuuugacucgagggauggcgacgauaggccuaaauuuaaaguggggaacaggagugcggggcccgaguccaagucacggaaaggaaugccuggccggagagggaagaacgcugccggggagacacgggugccggggccgagggcuugggguucggcccgggccuuggucuucucgccccgcuggcguccgcgguaggcuuccaaggggcguguuugagagucugggaccaggaccucagccagagggcgcacccaguggcacgggagccucgcaggguccaggcguuucacggccgccuugcggcgcauccugugguggugggcgcucagccgcacauccgagugcccggcccgcugcugcuggcaggacgcggaggggcggguggcgccgcccacagagggguaggacaccaacacgcccgaggcgaugcagggcacccccucugaccugaguuccagccgauccccagccgcguccaguugaggcaugcaacaguagaggucuuccaacgacaaauggaagccgaggggguguccccucccaguugaggccugggggcuggcuaccagguacggauccagagaagggucggcaucgucggcaggcgccuccuccaccgacaguuggaagcucgcgcucaaggacccggccgaggagaggccucuagacuggccguccgcuuccucuacaggaccuccgggcccugccuccugaaacagcucugaugugggaggaggggccgacgugacucucagcugcggagaaggcucccaagauuccaucugcuccugggagccucgacccauccacgaccuuccuaaagggauccgguccacgcccccaggguccuggggaaaugcacucgggcagugagaugucggaaaggggagagcaggagcaauggcagaggaguccggagaggcuccugaggaguguacuucgccuuggaaguucuccaggcccuccgagguggacgcgugcagcacgggcacugaacccugagcccaggaguccgucgugcaugccgaaggcuccucguccucaccccaugugggguccucagcuacugcagauucucccucgucccgggccaggaagcgccacucggugaucugcagcauggccucccgggccuggcugauggugaauggaaugcacugcggaggcgagagaggaucucaggucggcagggaggggcgggagagggagacgagucugaaggacccggaucccggcccaccugcugagucagguagacuuugaaagcagaguccaugacucgagccagcaagucggccaagauguccccuacgacguccucgcccuccucgagggcuguaagcgccauccacucggccucacugagccgcccaggcacaauauccaccugcggcacuggcacagugggcggccgcacuuuuuccgccuuggaccgggucaccccgcggucucggaccugccucuccugccucugugagaacaaaacauggcaaucagagcaggaaaccaagaaguggaacggaagaguagcuauaggcuaggaggaagcuuucucaaguugucuagugggaaggaaaagggccaauugacgaagagccuacuaugugacagauacuuaguagauguuugaccuaauaauuuucauuaacagcccacuaaccacaauugacagauaaagaaacuga

SEQ ID NO: 14735 - RNA, 30728 nt, Homo sapiens
gcggggagggcggggccggccccgcagggucuugggcgucggucgucgguggggucggagcugggcgcggagccccucacagugcagguacggaggcgcgacucugccaaccgucugcuccgccggcccccuacguguucgugagguugccggcggugggcuggggaccgagcccggugugcggggcggggacuggcaggggugggcgcuugucgggguccgggggcuccgccugagcguuugccccgaggccggucugacccaccucagcucuucagccuagcauuguucuccugggaucagagugacugcgccuuagaguuccuccagaacugcaagggucuccccuccguuccugcgagcgucugaggcgccccugaauccauacugagcuacagguuuccugugggcacaugguugagaaauucgucucaaacggggagaaaaaucguaaaggacucacagcaugggagucuggauaugacuugugugugugauccuacuccugggguccgccuuagcuggcaagaugauccuugaggucaucuugcgcaucccuugucuuuagacagaaccacagcuaaaucacacagauaaggaucucugcuguuucagaggcagggauuugaaaacuuaccgucauuuauugcagugaggagagcagcaaacccauguugaccacuggcuacucagguauacuuaagguaccgagaggcgaagagcuaggagguagagauugacauccuuuacuuaauguacugccaaagccuaagcuaugagauguuaaaagagauaaugauaacuuuauuuuuaaaaaaggcauuuuguuuucgaaagcuguuggaaaauucgugguuaaacuuuacuacagaauauugcagagccuuuaauaugcuaauaauauuuaccaugaaucuccaacuggggguaugguauguagaauuuugaaaauuuuacuaggauauacuguuauucuugggugaugccucuggcuaacaugugggaaccguuugggaauuggaguuccagaauuagaaauucaggauuuagaaggggcaguaugggucagugcgcuuugaguuuuaauggcgugcacauguaaugcgaucucguuacaguacagauucugauugguucugcauuucuaacaaguucccaggugaugcuaaugcugcuggcccauggaacacaaucugaguagcaaaaguauagaucacuggauugaaaguuagagaccauguuuuccagaacagaugugcugccuugagagagucacuuuaucuguccaggccuauaagguaggagucuggacuacaagaucucaaauauuucuuucagauuuaaaauucugugagucuagucgaguuaucccuguaguguugaauucuaucugaaauauucuugccaauuuggcaaauuuugcagcuuggcuugaacauuuaaaauaaugggcaauuaucugcauauagggcaucccauuuuauucuuggaauagcucaagaaggaaguucuucauguugcugaaauacaucucugcaacuuccaugcuguugguccuagauuaucucuuaacaaucaaacaggaaagaaguguuacccgucuuccuaaaauguugacuccaaguauuagaugacagcugugccuacuaugauuuuucuaagcggaauuguauuuaauucuuccauuauguuuaagaaaucccuuucuuaaauuugucuuuguucucuguggaguguaguggggcuuuggcuggacuuugaaggauggguguggcuugcaagacuagaaaaguaucuuaagcaguugacacuggugcagagaugggacugcaucuguugaauccaggauuguuugauuauaguaagaaaugagauuaucagugaaagaugucgggcagauggguguagggacaaagcaguauuuuagcagauguaugugcuuuacugugauguauaaggugguuggaacuagggaaggagggggagacggagcuggauaggcuucacauagcaauauuagacaauuuagguugauaauaauaaugccuuauauuuauguaugacacuuuacagaacuuuucacaggcaugauuucauuugaucuaauauuccuacgagguaggcagagcagcuguuaugcuguuuuguagaugaugcaccaaagaggguaaaugauuugccuuaauuuucaaagcuauuacauggcagacugaaguagugauagugauaauggaggagaaaggaaagaugcaggaggcaguacuaaggacgaauugauaaguggggccugacugaccaugaggguacaaaggagaagaaguuguuagggaggagucaaaguaguugggugaaucauaauaccauugagaacugccacucuagguuuuacucugccagcucuaucauugcuagcagcugcuuggaguuauagguugaaagggauuauagaugauucccagguugcuuggccugucuacagcuacuaggugauacugggggcacuugggcuaucugucccauaccaaggaaaauaggaacucgguccucaguguccccugaagauguaagagcuggaauauugccagauucauaucuauauuaagguccuugccauccuggagacucugacuuuggcuuuguaucauuuuccuuuugagauucaggcugauguuaguugaaugugaucaagggacagguuagcuauuuagucuggccuccccaagggcuucacuacagcagagcaugggcccuugcugccccaaauccuuccuaaugcuguuucccaggagauuugcaccucaccuagagcugucucugugguucuuuuacccugaaaguauacaggauugagauuuagugucacuaccaaauuccauaggaccuagggcuguuccugcacuuuuaguuucuuaggcuucugucuggaguggaaagagccauguuuacugaggguuaggggagagaugugugugugcguacauaugugcacauaaguggugauuuccccaguggugguggucuucaagaguggagcuacucucagggaaagcugucagagccaguuuauauccugagugugauguugguacaggcaucuauucaacauugaauaccuucucuuugcaaagcccuacgccgagugcuuagauacugagauggauacaauccucuguccuggaggaauucauaguagaguaagagaugauauuuuaaauagaaugugguauugaaauggagauaugucucaagugcucugugagcacagaggagggaaugauuagcuccacauggagaagccaggagagucuuuaggaaagaggugagaauugggcugagccuugaaggaugaggaggaagaauuguccuggugacauuuguaacauuugcagaugcauaaagggaaaggcagauagauccaaguggcuggaauaaaagagaacuuuggugauugaugcgaccggauucauaaugaagccauguuguuuuauuuuguuuuguuguuuagagaugggguaucacuaugcugcccaggcuggagugcaguggcuauucacagacaagaucaucacgcacuacagccuugaacuccuggccucaagugaucccccucagccuccugaguauaggugggucugcaggcugcugugccaguuugaggccaguuuuuuguuuuguuuuguuuuugagauacagucuugcucugucaaccaggcuggagugugguggugagauuuuggcucacugcaaccuccugaguaguugggacuauagcuacuacaggugggacuacuuagccuccugaguaacugguacuauaggcaugcaccaccaccacacccagcuaauuuuuguauuuuuaguagagacaggcuuucaccauguuguccaggcugaucucaaacuccuggccucaagugaucugcccgccuugggcucucagagugcuaggauuacagguguagccacugugcuuggucaaggccagguuguuaauggccuguagugcagugcuaaaaagauuucauuuugugggcagagaagccacuggagacuuuuaggcaggaagaugacaugauuguauuuugggaagcuaaauguggaaauugaagggggagaaccugguucagggacaucgggagacucuuguaauaucauagacaugguuuagggcugagcuaaggauuaggucaguggggauagagaggacaggaugaaucugagagagacuggagaaacagaauuaaccagacauaaugacuaaauugguuguugagaacaagagagggaguuguugcggaugacucaguuuucuauuuugaguggaugguggugccaauagcaaagagagaauauagaagaagaacuuuuuuuuguuuguuuguuuuuggugggggagauaccaaguguguuuugggucauauugaacuugagggcucuguggcaguuagcagacagugagauaugagucugaaguucagaagaguuucugucuaggggcaguaaguaugagugguaguugaaguugugggaaugguugaggucucccagccacgcuuacagaaggcugaaaauaaugacagaggagaugagaaggauugacgugcaaggguaggagagaauguugcccaggaagcuaggaaaggagaaaauuccaggaaaaggauugacaaucucaguugcuacagggagaucaaguuaggaugagcuugggaaaugcaccuugagguuguguaggacauuggggucaccagggcucuuuuaaagugugagcagcuucaguggagugguagggauggagccagauagcaauggaucgagaaguagaugggaagugaagauagagaauguguacucacuuugaguaguucagcagagaaaggaagaauacagaaugguggcagcuuguggaagagguagcagggacuuguuuuuccuagaauggaagucuuguuuauggguuuucugaugccauguaagauccaguagacagggugcaaugaagacacaagagaaaagacgauugcuaaaucaaguccucagaggagaggggaaggggugggcccugaaaagaaggggauaccauuuucuuuaaagaggaauguuggaagaaaggaaggaauuuaggaagaaagagauaaugacauaugcaugcagauauaucuaaauuuucaaagaaauucuuaccuaauagggccaguuuucuuuuucagcaagguuaucugcugagaggugggaaugcugguguuggcuugggugggaguaaggacuugaaaauguaaaggaagcuugaaauaacuguuaagaggaaagaggaagacaguggaacugaaauaagcuccaagaguguugaguacccucugaacugaaauccuacacuauaagccuccccuucaucuuucucauaauaauaauggcugacauuuauugagugcuuuauacaaggcacuguucuaagugcuuuucaggcauucucaugugauuuuuacaacaauccuguuagaaaguuauuguuauuaucccuuucuuccagaagaggaaauugaggcauagaggauuaguagcgcuuguauuugaugaaucucuuacgucugcagaaauggauuccuuuuccugaggcaucagagaagacagaaauuuaaucccaacucccgguuucugaaccuugagagccuagagucuaggguugcuaaggagggaaucuuaccaugccaguuugugggcaugaugguggcauggagggggcaggacagugggaucacuguugcugucagcuuuugacaacuacauagggaaacucggauauucuugagugauuuuuccagcauccugacuagaaagacaagugaccgauagugauuugucagguauugugggcugagauugugucaucugagaggugaauaagaagagagaccuugucccuguuccuaucaccuagaaaaggagaauuuuuucuuggcagagagacaggcagaucuaaaaccuuauauaauaacauaaugauuauuaacucaccuuauguguuuucucaguuugugugacagauacaauuuguagguaagcuguauaccugacuugagugaaaggagagagugaugggauggcguggauggaagagaaacggacuuaccuuuuccugcugcagccacugaagcaucaucucuguguccuuccuuuugagguugccauggauacgccuuugcauggugguuugaggagauugauuuccauuaugaucagaugaugacguggguuuaaaaagagaaaggauggaaugcucugcuuuuggggaguggccggcgagcugcccaaaaggcagagcccaguacagccgauagggcuguggcuuuguuggcugcuuuggcuuuugcugaaguugugaaauggugcaucucucucuuuagagcgcaggcucaggguucccugucuacaggguccuagugccaggaacuugcugguugauucagggggaggaaucagcaggaacuucgaacagccuaaguaggacuucugauaccacugagaggauugagguucuugagugcagggcugagugccucuugccuucuugcagaaguuccuauauugaagauaagugaagcauauagcauagcuuuucuucuugacuuuuagaggucugggcccuuggaggugggccuggaagucacuggauauuucuggggaaaggggacauuuugagauggaguagagcugcauucagagugggaguggguuuguagacguuuuuuuaggguaaugaggagcuggagaagggaaggaaguccguugaguguguaggccuuaucuaugaaauccgcaaggcagauacugaguaggaccuaggaacaaaaagcucuguguacguugucuucugggguccugugaauaucuggaauccagcuuuccaagcuuccagucucccagccuccauuuaccacucaguaagcagaccuuuuccuuucugacuccugaaggacuuagguccacguuuaucucuuccuuacuagugcuuucagagauguauaguuuugccuugcugucagacugccuggguuucagacaagcuccucuaggagugggaaagcagggaaagcagacaguuggguuagcccaggaucaagguuugauaaggugagacaagaggagaucaagguaucaaaggaugcuggggugccaguaaaaacaagguagaaaugguucagacaggggagaaaugguagagguggaaaagaggcuuuuccuccucacuuucuccuuuuucauucuccaaaaucuuauuuuccuauaauuuccugaaauuucucuaagacuauuggcagacacagagauuauuauuuaucagacacagagauuuuuccccuccucucuucucauuuuucuagauauuuuagugguauuuaauaucauuggagaggaaaauggauuagaaauccaagaggugucugucuccucccuggcugggguaacauuaacccaggauuguccuaugggauaugggccugggcccgguaaugcuguggaaggagcaccuaccuguagagauauucagaugugccccucugccauuuuuuggcuaugagacuugggcaagucauuugacuucugagacauaguucugucaucuguggaauggagagaauggaaucuguuuuggcuacaucacagguucauuuuugaaggagauagugaaguacauguauucguguaugcaauuaaguuuuccccagagaaggcccuaagaacaggacgcauuuucucucuccuaacauguuguuucuccucccauuuuuuucaguucuguuaauguuucaauuauuacauuucucaugcuugaaaacuccugaguguauuuauucauuuacuuauucaugcauucauugacccaucuauuuauccuugcagcauuugaguuccuacugugcgcaagucaucguggauauucccuuaaaauaaugaaugaagaugauaucuaccauuuguugagcacacagacauugugcuaaacgcuuuacuuaaaucuuauuuaaucuucaaaaugucccugugagguaacauuauuucuuccuuuuugcaguugagguaaccgggacucaggaaguuaaauaucuugcucagaggagaaccaaagguauauucaggucugucuccagagcccauguaggccugcugccucuuuccucauguuugaucuauuacaaggccuucucagggcuuuuuugguacugucucugaacuggccucuuucuucuccuccugauccugguucaaaccuuccuuacccugugucaaauguugcagcagccuccuugcuguuauuccugucuuugccagguugcuccugccugcacuccauccugcaggugucaucaguuugaucuuccuaaaauaguuuucacuaugcagucuccugcucaggaacaagacugccuuccuguuauuauuggaucaaguccuucucugucugccugauguuaaacuccgugccuacccacaguuaccucccaguauguugcaauguuauucaauaaauguuuauucaauaaauauuugaccaugagcuacuuacuggcuauuggaucauaaagaggaaaaggugugggcuaugcuucaaaaggcuuauaguuugauagaauaaccaucuacaauucguuacuucagcuaagcuaggguucuuuacuauucgcuagucaagcaaaguuauuucugccucuguucauacuguguucacaaguuacagggcuuuguaggccuuuccacauauuuuuuauuuuuauuuuauuuauuuauuuuuuuuuuuuugagacggagucucgcucugucgcccaggcgggacugcggacugcaguggcgcaaucucggcucacugcaagcuccgcuucccggguucacgccauucuccugccucagccucccgaguagcugggacuacaggcgcccgccaccgcgcccggcuaauuuuuuuuuguauuuuuaguagagacaggguuucaccuuguuagccaggauggucucgaucuccugaccucaugauccacccgccucggccucccaaagugcugggauuacaggcgugagccaccgcgcccggccuccacauauuuuuuaaaauucccauaauucaaggcaugcuuagguacucccuuucuuucuagcucaccucucuccugucuauaauuucuuauauuuauuguguagauguauauaccauuuaguaucaugucagguaauucuuugcaguucuauaauuucuguacuuuuuacaaggugcuuuuuuuuuuuuuuuuuugagucucagucugucgcccuggcuggagugcaguggugcgaccuuggcucacugcaaccuucaccucccggcuucaagcgauucucaugccuauagucucucaaguagcuaggauuauagguaugcgccaccacacccagcucauuuuuguauuuuuaguagagauaggguuucaccaugucagccaggcuggucuugaacuccuggucucaagugagccaccggccucagccucucaaaguguugggauuacaggcaugagccaccacaccuggccuacaagguaccuguauaugcuuuagcuuuuuugaaccucaugauacugacguagauauggcagauauuauuuucauuucauaggaaaauaaacagauuccaagaaauuaggggacuauugauaccuaugugguuagugaguugugaggcuauuuuuagaucugagcucuuuugaauuuuuuaaggcaguguggccuacaggaagagcagggccuuggaagccuagauaugucugugguaauggugagggguaguagaaagcacagagggcucugggucagguuguuuccaguuuuggcucuacuccucacagucugugugucuucagggaaguugcucaguucucaaagacucaguugccuugucagcaucaucccuggccaaccucucaaugggguuauuguaaugucuauauaugaugacauuguucuuagcuaacuuuuauuuagcacuuauuaaauaccaggcgguguccuggaugcuuuguuuggauuaucucagcuaauccucacgauaccucucugagauauguucuuuguuacuucccuaugacggaugaggaaauugaggcauagagauguuaaguaacuagaccaaguuuauguagcuaccaagugauaaagccaggaaaguagccugagucuagaaccaguacucaaccaugguucuauaaaaugucuuuuuuuaagguguccuauagacuguaaagugcuccgaacaugugagguccaggcugcaaggaugugccuggcccugcccaccuguguaauggcgaauagggaaaggagggggcgacauggagauuuugcagggaggagagagauuauuuccuagggggucuggccaggacugaagauuuggaauuguguuuuggggccauauuucugaauguuggcugucauucuccuguugggcuaccuggccuaucuuaagaggguagagcgggguaaagucacuguucugccagugaaguaagcccagugcagaaaagacaggcgucccuaggcccaagggaacuagauccauaccauacucaguggagccauaggucagaccccaggccaaccuuguuggcuguguaggggcagggacccuggucuuuugguuucuagcccaugauagaugggccagugaaugaaagcagugugguaacauagucccuuggagaccucucauuagaaugcauaaucucauuaaauuaaacaauucuaauuauaaaaguaauacaugguuacugaagaauuuuugugaaauacaaaagcguagaaaauaaaccauuucauugggucugagaugcuaggaggcaaggccaagaguacaaggggcagaugacugagguggacugggccuugugcuacaagaagaaagaagggcucucugcuuuugacuacugccuuuaguaauccaguugagucugauacucuuguguuuuacaaccuggccccuuauaacaaccauaaagggugaagggugacuauggcaaccuuugccagccuugugggagggggcuaggguacuuggcuugcuuugcuaugugugugaaguugccuucauuacugcccuucucuugcugccuccugggcagggccugccuccucuggcucagugugagauugaaauccaggcccuacucacaugaauuuggacccugaguccagaguuuagagaggggagggagagagaagagcaccagaaagguagaugagagacccuuauuuuggcuguguggaggcucuaggcagcugaucgcuuugaagugucacuugaugcuuaugggccugcugaggccuuacauccugggggagaggggaacagugauggugaguggguacagacuaggaggacgugucaagacugcuuccagcccuaggacaguguauucaagaguugagugcugagggucuguggcguaugcccagcccuuaguuucuggcccacgugaagcaggggggcacuaggacccagaggcuagcacgguuccugacaagucuagagcagcacuagcgcagagugagacucaucagcuggcaagcaggauucugugucucuggguucaggaauccucaggcagcagaggggacuugcuccucagcccccaucacugcccccaccccuacccguguaggccaccgagugaggcccauggacuggggagggcugugccugacgacuccugugucccucuaugagggcccagcgcccugacccuccugccuagguuucuaccuuuucucucugucuuuggccagcugggggaggggguagaggccgggugagcaacauggcacagagcaagaggcacguguacagccggguaaguggcccuaaucugggauggcccuggagggcugcuggggaaggccuggcugccuguggacaucauugcugugggggcuggggagauaggcuggagcucagcugagggcacucagacuguguuuucuaaggagcccucgaagcccuggugguguaaggcuggacaggcuucccuuuacagaguugaucccuaaauggggacuagcaaggccugaccucugacucuaauuggcccucauaccaggggcuccugaggggguccagacuauccuggggacucagaauggggaugauggcucagagaggucuuacagugaagccuuucuuaagagcugcuuuguuauuuguuacuugcuuucuuucucuucugagauagaaucuguagcuacuguuguggcccccugguucugagaggcuuauugggguuggaaagugggggagucucugacuuuggguucagccuuuuauaucacuggcaauuccuuuuauugucagguccaugagagccauccugcuguuccaggugugauuugggguccuggagccucugggaacuacauccucaccuuccuggaugagcuguuuggggaagggaauuaggcagugauaggcugggagguguccuggcucuucccuggcucugccagggcucccuucugaagcuauuauaaaugagaguaucagaagggucucccauagagucuuuaggaugaugguaucacuucaucaugccucauucaucuguuugcugcaaggccccugguucauggaguugcuguugcuaaaaaugaccuaagugugauuuucuucuaaaccaugggccuauuugggaccuaauuuucuauuguguucagucaucaugggugugccgaagcuaagagcugcccaaggacagugucuuagucuguuguuuugccuugcccaucuguggagugauaaaccauucauuuggaccacugagcagagucuuggggacagagcgagggguagauccacccaauuuacuuggccuguguuuuccuuuuuauagcaacauagcauggagaagaaucuccagagcuuggggauagagaguugaccaaacaagacucaggccagguagaaggggaguugaaugguugaaugggcuguggugaagcaucugggguuucaugguggguuuguggaugggggugggaggagucagaucaggaaggagagguggugacuuaagggucuggaaggaggcacaauugugugccucugaaagggugaggccuaagaaaaccauuugaaacacagaggagacaagugacaguggaaggggaaacaggauucuguaggaucacccacugaauugccugucuucccagcucagacuccugagucagggcauuggguuguggggagccuggucuaaacugaguuauuugcuugaucuuauuuccccuccugagaagagaauuaaggagacagugcuccugagaaagcagccauguggugacauucacagacuggucaaugaauucugauuuguuauaaaaaauauaaacuuaaaaauucuagcagauuccagaggaauuuggagaaaucuuagaauaucauuggcauuuuuucaaaggggaauuuggggguccacccaauucuguaaaugggguuuaagaaaaugacucugguuguuuuucaguccagcaucuuggcugaggcauuucuuauacauaagaaugccaccuuugaucugaggccucuaacugucuguguuuaccugugucuuucagacgcccagcggcagcaggaugagugcggaggcaagcgcccggccucugcgggugggcucccguguagaggugauuggaaaaggccaccgaggcacuguggccuauguuggagccacacuguuugccacuggcaaauggguaggcgugauucuggaugaagcaaagggcaaaaaugauggaacuguucaaggcaggaaguacuucacuugugaugaagggcauggcaucuuugugcgccagucccagguauucacgcccuucuuuugugucugugcaugugugcacaugucugucgcaugugcagcugauguguugguacuucguuuuccugagcaugggcauaagccucugguugggagaguggaagguagugggggagggaagauugaagaugcauccuuagggaagcugcccuguacucuugguuugcuuggagccuggggaggggcccauauuacagccguccuugaucuggcuauauugaaacuauugaucuggcuauauugaaucuggccucagauccagguauuugaagauggagcagauacuacuuccccagagacaccugauucuucugcuucaaaaguccucaaaagagguaacaaccacccacuuaaaguugccuccccauagccaggaggaguccccaggacuucuccucauaacauggggccacaguagauccuaagauuuuuuuccgucacuaccauauucccuuauuauaucucccccuaccucucuauacaaguacacacuuuguuucuguuugcuuucuacagagggaacugauacaacugcaaagacuagcaaacuggugagugauuugggggugggaauggggaauaauaaagggaggggaaggagaaagaggagggauacccagugcuaggcagguagaaguaguaggugagucugauuugccuucuagucucuccaacuucccuaagaaggaggcuuucuggggauuaauugcuguguuagaguuacaguaaagaugguagaagggaaaaacucauaggcuccagaaguucagggucaaaugagauugagcugagggugauaggaaggacaggucuggcccuaguaguguagccaacuuccuaccuuuugguacccaaagaugccaacaucuaaagggucugaggguaagguuaagguagaagauagaggaagaagcaaucuccuauucacaagugaauggcaaggagccgggcccucugccuccuguuuuaagcuggaugcagagagugcuuccuaguucuucucugcuacucugugcaggaugugugugagguggggcugcagacucugcagcuucucugggccaaggugugaacauccuggaagcugaucuuugaggggcuacucaucucacccugacuccccccuacccgcgucuaaccuguguaagcccgaguuggucuuaacaccuaugcccaggacaucuguucucuaacucugcccuuuccuacuccucaugcagcggggacugaagccuaagaaggugguguguuuacuauuugugccuggguggaugggggccaugagccccuuccccagcuguccugcaugucccugggcugcugcaugcaugugugugugaccuugggcugggauggccagaggaaaugguggccuuggcuuucagaguuccuuugaagggugcaagaacaucaggcucaguguccauacccagguagcacucauuagggaugauucucucugccccaggacuccaagucaaagauuccccaaucaaaaacuauaagcauuugacuguaaauagcagcagugugaaauagaucauuuacuggguuacaguguguucucacuuagcccgagcuuggacgacuguggaaggauagacugggggaauggggcugaggaagguaccaagugaggggguuuugcaggaagaugggaggucagggaacagagccuaggaagaacagucccaaguuggaaaaccuaagagccuucaugugccugccuguggaugggcacagccauaaauauccccacaccccacaacucugccccaucagucugucccugucuccuuccucugguggugugccugaggccuaccuccuaccccuugcagccuuucaucaaccaucauuggaguggggcucaaucaugucacguccccuccccuucccaccauagacucuuuaaacucuuagaucacugccaugaccacuuccucaaaccagccccugccuugggccucugcccaagcuguuuuugaccugcaugugccugucuggccuguauguacugugcuguauguacaauucugugauuuccuugucgucagccuaucucaggccauucugacauugcauggagagcugcuggauuggggcugugggagggaagaggaaaacaucuccuuuuccagggggaaaccagcuccugguuggugauggguccuuuggagucuugccaugguagagaccacaugcugguacuugcuuugguagggaauggggauauaaggaaaauaaugcugugaaggauccugggcccauuucagagucauagaaacuuggcuuuguccuuugauuauugucuccugguuggggcuuccauuucaccucaggccuugaauagagaagagcaugaaacuauggucugauauuuauggaguucuggccccagccuggucugacccugggcuggggccugagcaaugcccaaauccaggggcuuuggcagcugccuggggaaaugugaaaaagcccagccuaggccacccaugcugcccuucugcacucacguuggaaagugucaaucagacaguugagugcccccaccccggagcaccccagucuuccucuccaguaguuauuuuucaaagcagagggccccugcucucacccauguggaucagggagcugguuccagagcaaaagaauaugcuuugaaggggaaggcagaagaaaacucagaugucucugcaaagugccuaguucuuuuuggaaacccuuuagagacaggcuuuaaccugucuacaaccaggggaugguuggagaggagcccaacagucauuagagcugcugcuacccagaugcguguuccgcaggguuucguagucacugugugugcuccucagagcugaagccuguugcuggaggggcacucuagaugugugugccagaugagagacuguaaggguguugccagguuguauaagagacagaaguggaguuaauggggcuguggguagguggguggcgggggcagaaugugaguaugaugagagagacugcuggagcagagaggccaugugucccuccccagugaugcccuggccccauagaaugccauuucugggauagccccuggcccaguuuuuuggagcacgcucuugggggugggcaagggagggaagagaggagccaaaaccuguucuuuggagaaagaagcaggacaagcucugcgcaugacugucaugaggaggaggagccagcaaagcccuagaugguugcuaggugacugaggagcaguggcuccacccccauggagcagaggagggugggugcaugacgucagguggagcuggugcugcggccacugaggcugccaucagccuaagcuggugaacugggccaggcaccgcuccggugccugccggagccuggcgauccagcugcacgucugcgggggccucugugucagagcggcggccguuugcaggcugggaagcugccgcaccgggaggcugagacugcauuguugggauuugaugcacuaaucuccugucuccgccgccuuucccucuguucggucucuugcccucccucccuucgucuguccuuccuccguguguuugucuauccuccucugucccuccucuuuccucuccuugcuuucuuugguuuucugcaaugaugagacaggcaccgacagcccgaaagguacucuugcuugcucucguccugcugcuggguugccagggcaaugguggcagcaggcugcuggggugggggugggggcugauugacuucaucugucuaccuggucggggaggcgggugaggacgaagguggguuagggagaggugugugucaccacuaugccccacacccugggcauuugcuuacugccuugccugcuuuuggcucugccuguguuccaggccuuaacacccaguggccucacaggcuugggcuucaggcagccucuaccgcauaccggaucugggaggguuuccugugguagaaccuagggaagcaggcccagguaucucagugccucuagcaggccugccugccucacccaaccuuugcuagaauaccucuugguuguucucccaguaucccccaauccccaggauuuguaucagggcacuuuaccagggugggauggggaaccuagaauagucuuugacccacagcuguggaagcuuagcccaggguagaagaggugggaauuggccucaguguaugcuggaaauagggcccaagccaaaucuugucuuggcuagagcagugagauacuggguagcaagaacacuauuuggaaauuggaguuaauuguccacuuaccauuuugcaguaaccugaaggggcuguaguuucucugugcugcugcccacccccaccuccuuuccuacagcugggugggguuacuuugcugagcucugggcuucugcuaaugcaauauucaugguccugacaccugagcccucuucccuagugaucgggacugcugcaggaucugguucuggggaaggggguugggggagggaggacagcagcauuguucuacccuagggaccugaucucccauuucugggcuuagauuacgcucgucacaugggguuucuagggaguucuguguagagucuagcacuugaaggaagaggcugaccugggaaaguccuugggagugguggcugggcggggccucuggcucuggacuggaguuggagagaucguuagcaggaggacuggucucaugggaccuucucacuagcugcuuccuuguucuauggcucagccuagagauggacuucugggauuucuggggugucugaaggggugaggccugcaaggauuggacaaaagugggagcaggaaccaaggggaacaggaauucuggguuccugaaguaggaauacagugauucacugaagggagaaggggaugggaugggggggaggguggcuaacuguagccccauuccuguuauuucuucugcucucauugcugucccuuuugcucucugucuuucugccauuguccuuucuuuccugacuacuucucuucuggcuccuguugccuguccagaccacaacucggcgacccaaggugagaaaacaggccccugugugagccacugcugaguguacacacacguuucaggcauguggauguaugagggcacguguaugagcaagugaaaguucgucauaguguauccuggguucucuucagaggaaaggguggggguucgcagugcuggcaggcaccuccuggggaaaauggcuuuuggcuuuuaggagguugucuaagccaguagcuugaaugcaaaagagaaaugaaugggguuguggugguuaaucaaagcaggcuuucuugaacaagggaauuuugaccaguuuugaugggagggauuggaagaaagaugaacuuggccauguaaaaugucaggggauaaggaggugagugugucugugacaggccuuggguggggaugucugaggauugcacaugaucucugagugucagcccacugggagaccuuggggcucagcacuuugagcacauuggcaggccugucugcuccagggcuugaacuucaggucagcuccucugcccaccuucuccccugccccacaggggcauggauaguguugccagaucgggggagaugacgaagaguuguuucaagggggagucuagggguacaacuuucaccuuggcccuuuuaccugcaggguccucugaaauagacugagagagggagauucagcuugacucccaaagagggcuuagcagggguagagagccuggcacccccacuuuuggcccaaccuucuguggaaauuagauuguacuuuuuccgucuagggguggagggcauagaccuggagcaaggaugggacugagaguauaauggaguugcuagaaugaucacaagugggucauagauggggguucuagggaauaacggauucugcucuuaaggguagugccagagcuaggaggaauguggagucagugccaagcgaggagccuuauaaucuuaugucuuucucuuaucuuuuccucccucucuccucugccuccauccucccccuguccuuugucacuaucucucucugccucucuguaucauuuuccuuguccccuucauucuucuuuucucacugugcuuugauacucucuuucugcuuuuucccuuuucugucuccuucccuugccauauucucauauucuguuucuguuccucuuacuaccccuauccucugcuuucuuucuggucugccucuacccuuucugaauagcccacgcgcccagccaguacugggguggcuggggccaguagcucccugggccccucuggcucagcgucagcaggugagcugagcagcagugagcccagcaccccggcucagacuccgcuggcagcacccaucauccccacgccgguccucaccucuccuggagcaguccccccgcuuccuuccccauccaagguaaggccugggguagggguaaaggagaaucaagacacccagaggcuuguggcuacccgcugugucuugaaaauuuccugggguuggcaaagaccuagaacuuggaucagaaagggugaggacauagccuauggauaucuugcuacugacugagccauccuuuccuuucuugcccuuaugccauacuuuccccauauauacugugcuacgguuuccucucagauguucuuaugccacugacuguuggccacccuggggcugggugauguuugcacacuuucuuguguucuuugcgccagcucaguguugguggagaggaggagugggcugugcacagaccgugaggccucuccuuugcaggaggaggagggacuaagggcucaggugcgggaccuggaggagaaacuagagacccugagacugaaacgggcagaagacaaagcaaagcuaaaagagcuggagaaacacaaaauccagcuggagcaggugcaggaauggaagagcaaaaugcaggagcagcaggccgaccugcagcggcgccucaaggaggcgagaaagguuugacucuggaugaaggggguggcuggggcagccugagaccuaaggaagcaugcuggaaacuagacuggagcuggagccuggaacauacugugagaaaggccuggggcaucucugugcugguacccccucccaccuccacuucuuccucaggaagccaaggaggcgcuggaggcaaaggaacgcuauauggaggagauggcugauacugcugaugccauugagauggccacuuuggacaaggagauggcugaagagcgggcugagucccugcagcaggagguggaggcacugaaggagcggguggacgagcucacuacugacuuagagauccucaaggcugagauugaagagaaggguaaggggcccacagcugcugggggccaaacggucaggugagaaccaugccugaaaguguuaaugaucuucuccaggcucagauggcgcugcauccaguuaucagcucaagcagcuugaggagcagaaugcccgccugaaggaugcccuggugagguagggucuucagugcuugccucugaugcuuacucuugugucuccaaauguguuagagcacccaucgccagagacucugacacgugcuuuccuccuucugccuuccucacaucccugcaggaugcgggaucuuucuuccucagagaagcaggagcaugugaagcuccagaagcucauggaaaagaagaaccaagagcuggaaguugugaggcaacagcgggagcgucugcaggaggagcuaagccaggcagagagcaccauugaugagcucaaggagcaggucuggggagcccagccccucacccagaaucccccaccugacucuccuaucaguugaugccuccucuuucuagguaccuuccagcagcccuucucccuauccuccccguaacacagguggaugcugcucugggugcugaggagaugguggagaugcugacagaucggaaccugaaucuggaagagaaagugcgcgaguugagggagacugugggagacuugguaagagaagagcagaccccugacaucugacuuggaccugcugagaaaaagauugacaugugacccuuggccuuugagcagggugugcggugagggacccagccugggcuugcuacccugacccugccuuuuuuuuuuuuuuuuuuuucugagauggaaucucgcucuguugccaggcuggagcgcaguggcgcaauaaucucggcucacugcaaccuccgccucccagguucaagcgauucuccugccucagccucccgaguagcugguacuacaggcaugcgccaccauacccagcuaauuuuuguauuuuuaguagagaugggguuucaccauguuggccagcaugaucucgaucucgaccucaugauccgccugcuuugaccucccaaagugcugggauuacaggugugaaccaccgccgcuggccgacccugccuuucuuuagcccaaacuauggugugguguccuaggaagcgaugaaugagaugaacgaugagcugcaggagaaugcacgugagacagaacuggagcugcgggagcagcuggacauggcaggcgcgcggguucgugaggcccagaagcguguggaggcagcccaggagacgguugcagacuaccagcagaccaucaagaaguaccgccagcugaccgcccaucuacagguacaugcccacuguuugcucucugcccaccaucaccccagggcuuccuuaugacccagcugugcuucacugucucuccuccuaggaugugaaucgggaacugacaaaccagcaggaagcaucuguggagaggcaacagcagccaccuccagagaccuuugacuucaaaaucaaguuugcugagacuaaggcccaugccaaggucaggaaagugugugggucugagggagcccugccugggaugaacugguauggggucugggcuucagauuccugggggaaggggugcuuuguguggugguuuggaagacucuggccugggcuugcccuagaagcaagggaucuacuggagcaaggcaugggaauuuuggggcucuuucagcucuggcuaagaguccuccucccuguucaccucacaggcaauugagauggaauugaggcagauggagguggcccaggccaaucgacacaugucccugcugacagccuucaugccugacagcuuccuucggccagguggggaccaugacugcguucuggugcuguugcucaugccucgucucauuugcaagguauggccaaucaaucacauguuccacagaaaucuagugaacuugccaugaaccaggcauugaagaugcugagugaagacaacagagucucugcccacaaagaguuuaugguauaguggaggaacacagcaaagucaccgauuaauauauauuacaaaugguguguuuucaaggagagauagguucugugagagagcacaauuagagauuugauuuagaggugagcagggugugacugagggaauaacauugucugagggccaggaggugccuagggguuaaccuuggggaugaugggcaggauagcauucuagguggagagauagcaggaguggcagcuuuaagucaggaaagaccuugauuccaccggucccacuacccuuucauuuucacauccugacuccucacaaccuccaguaaucacaucacuacccuuuccccaugcaagauuccccacccagguaagagcuauuucugcuuucucucccauguguguccaugcuccccacauaguuaagcucugaguacuauauuccugagucucuguucuccauccucugcucugaggcccagguuccuggugcuuuuucccacaggcagagcugauccggaagcaggcccaggagaaguuugaacuaagugagaacuguucagagcggccugggcugcgaggagcugcuggggagcaacucagcuuugcugcuggacugguguacucgcugagccugcugcaggccacgcuacaccgcuaugagcaguaagugacuccugacucccucaccccaggguggggguccaggauuggccagaacugagauugccuggcagacucuagccucacagugcccuucucuggucucuagugcccucucucagugcaguguggauguguauaagaaagugggcagccuguacccugagaugagugcccaugagcgcuccuuggauuuccucauugaacugcugcacaaggaucagcuggaugagacugucaauguggagccucucaccaaggccaucaaguacuaucagguguggggcaagaauuugggcuuggggcaggaggcagggaagcuuucacuugaugggggcucuuacuaauauauucaagguuguaugucccaugcuugcugcuugaggccugguuugcucuuagaugaacucuccauaugaugcagcugcuugagggcuuuggauucucuuguaccuccagagacccaugaugaccagggcucaaacuacaguuugggaagaacuccccacccgcuccagggccuaaaaguugucugucuguuaucucuccucagcaucuguacagcauccaccuugccgaacagccugaggacuguacuaugcagcuggcugaccacauuaaggugaaguaucugggccagugauugagcccccguggagaucagaaauggagggcaucaggucaagagaucaggcacccaagaagugucacauaagacuagggcagaguuaccaaagccauaucagggaaacuagaggaccuacuuauguaugggggucagcagaggauggggacuucuuagagauguugauaaggcagaagggcuccugcugggggcugaugauugcaugcuucuauccucacaguucacgcagagugcucuggacugcaugaguguggagguaggacggcugcgugccuucuugcaggugagaacacaucuagaucugugugagcuccucuucuuucuuaguccucacuuccuuacuccgagccuuaaugcuaacuugguucuccauccauuuucuuuuuccugaguagggugggcaggaggcuacagauauugcccuccugcuccgggaucuggaaacuucaugcagugacauccgccaguucugcaagaagauccgaaggcgaaugccagggacagaugcuccugggaucccagcugcacuggccuuuggaccacagguuuaaggcugcaacuggggaagggaaggaaacugaguagaaacaugaaggguauagcacuugaagaucuggaucugguuaggggacaaaaaugguuuugggguagcuggaaacuguggugcugaacccaggguugacuccugacucuggccuggcacacagguaucugacacgcuccuagacugcaggaaacacuugacgugggucguggcugugcugcaggagguggcagcugcugcugcccagcucauugccccacuggcagagaaugaggggcuacuuguggcugcucuggaggaacuggcuuucaaagcaagcgagcaggugggccuggauggcuggguagaagguguggggagaguuagugaccaguguggggcuuuuacuucugcccuuggcuccugcagaucuaugggacccccuccagcagccccuaugagugucugcgccagucaugcaacauccucaucaguaccaugaacaagcuggccacagccaugcaggagggggaguaugaugcagagcggccccccagcaagguagguggagauuuccuuggagaaguugcagaggccuguaggaguaagacuugcagagcuacugcuaguugugggaggacggggagacaggaggaaggcaucuggagagcaccauccugccuagaaggcaggguuuucccuguaacuggaucucucuguaaggagcacagugaugaucucuucucuccacccucacuuucucacccccuaccgaccauuccuuagccuccaccgguugaacugcgggcugcugcccuucgugcagagaucacagaugcugaaggccuggguuugaagcucgaagaucgagagacaguuauuaaggaguugaagaagucacucaagauuaaggugaggguaguguaggcucaggaucugggggccaggaaauugguaggacucaggaaagcagugaguguuggggaucgggaccaagacggcuugggaguuaaggggagaaguggggccugcaaucaaugggagcuguggugagcccucagggaaccuacuaucucauggucuagcccccaguuuccagggacuguggggaggaugucagggaucuagaaguucuguccuuguccagggagaggagcuaagugaggccaaugugcggcugagccuccuggagaagaaguuggacagugcugccaaggaugcagaugagcgcaucgagaaaguccagacucggcuggaggagacccaggcacugcugcgaaagaaggagaagucaggcacuuucccuggggccuugcuuccucuaauccucccacugcuggagcucucugccuccuaacccauaccccuacucagguucucuuauagugagacuccccauuuucuuuacccacugccaaccccauugcaucaccccagccuaagccugugcugcucugcccuggcuucucacuggcagggcuauuccaaggaccucucaggacugaauagucaaggagugcuuuagagaagggacacugccaaagcccagauucucuuucacagagaguuugaggagacaauggaugcacuccaggcugacaucgaccagcuggaggcagagaaggcagaacuaaagcagcgucugaacagccaguccaaacgcacgauugagggacuccggggcccuccuccuucaggcauugcuacucuggucucuggcauugcugguggugaguacuguggaauaggcagcacuagcacagaggagauugucuucucuccuguccuuggccucauuuugaccucugccccaccccccuuacccccggguauucagccaggaacaugcuuacacaguuucacucugugccaguuuucaccaaguuuucccuuccgcugaagaugugugcugaguuucucugggcaaaggagggcauuacuaaauuguuaaugaggcucagaauaaugaugacaguuggucucuaguagauguccuuucuggcucuguaaucugaccuuucugcccagcccuauaucccagaggguugucagccagcagcaggcugggcugacucuccuggggcauccagcccugcccgauaccugcucuugauugcuucucugcuuggacacuguguuuucucacugaguucauguggcuucauuuuaugauguggucauaucuuccacugcugaauuaucccaguuucacuuggggcuuguguuuugaccuuugucuagucacucaguauagucagggcuccucaccuagaguuuuucugguuaccaguucuagccuccccaguuaccugacucaggagguggcugcugcugucuuuguucuccucugcccuauaguuuguuuuguuuacucuccaguuucucacuuaaccuucucaccuccagaagacaggcuuuuugcccuggaauuaaacccuuagggccuccagacuuucccagcugcuccugagucuugucagcugaccucaccuacauagagucuuugacaaagucucuguuacugacaccccuugaucuugggaggugaccaaguaccuucuugacuuuaggcucuugugguacagacagcucuguguucuuuggagagaguuuccaggauuacuacuuuguguuguuuuuagcacucuugaaacaaacauuagcacucuuuaaacaaacauaguucugaauuuaugaaacuucccaccaaaaaagaaggucuuuugccucagagcaauggggaauccuuaggagcaagggaguguguuugcauccccaacuuaagcuuugcugcuggugagcacuaagggugcagacauauuggggucucuggagcauucuccgugcccuucuuggagauggcaucugagacagggaggcaggaacagccucauguuccaaguacuuuguacagugcacacucucuuugccacuguucuucacacauuguacccugucuuguggccucacuccuguuuggugucuuucuuuaacacuuaucugcucguccccaaagauagguggcagagagucuuguuagagaaaguaugaugauuaggaaaaggguuuuccugcagguuguguccaggauuccucugguguguccccguaacccccaaaucaccuaacuccucucuccucuuuuccugcucccccaugggcuaucccgagcacagaagaacagcagcgagguagagacccacucuggccggggguuaccaggcuggugggaguuggagcuaagggagcaggguggagggggaagccaggacuggagaugggugauggggggaugaggaaaggggaagaguaggaauggagcccaauuuucaacccuuuccacuuggggcugaugagauuuuuuaugguccccacaggagccaucccugggcaggcuccagggucugugccaggcccagggcuggugaaggacucaccacugcugcuucagcagaucucugccaugaggcugcacaucucccagcuccagcaugagaacagcauccucaaggugagggagccacggggaggacugggaugggagauggagcauauuugccccauugaugauagaugacaggggccuccuagcaccucuuaccacuauccuucuuuuuucauccacagggagcccagaugaaggcauccuuggcaucccugcccccucugcauguugcaaagcuaucccaugagggcccuggcagugaguuaccagcuggagcgcuguaucguaagaccagccagcugcuggagacauugaaucaauugagcacacacacgcacguaguagacaucacucgcaccagcccugguauguaccugccaacccccaagaugaauaaaacugcccccuccacuuggcccagggauuuagccccugcucaggugguucccccaccacagaagcucuucccagcaguguucuuuggcuucacuguucaguuuguuugauucacccacucucucucaaguacuuguucuguuagagagucuuauaccugcaccccuaacccuuaauccaguagaacugccugccugcgccuuggugggccucaccagcuuucucuccccacagcugccaagagcccgucggcccaacuuauggagcaaguggcucagcuuaagucccugagugacaccgucgagaagcucaaggucagcucaguuugccaggcagagcucacuucacagcauaaacugguggagccaggcacuuguggaguuccucugagcccagcccugugcuagacagcaauuggggaggagauggaagggaaggcaggguucuugccuuggaagcucacugucucagugcaaacagaagacagauucucauaacaaaauggauaagcuaggguaaucuuuagagugacugguucaggcuuuagcuuccaucagcgcugagaucauugugggguagaacgguugggcauggcuucccaagagcgguagaaugugaguugggccuuacaggaugaggacuugcaaaguaaggaggagugcugguguggggaugggguuggagaugagagcaaaaguauguugauauagaggacuaagucccugccccccugguauuagugucucugugaaaccacguggucuugugcuagccugugggggucccauaaaugaacccuugucuuccucuccccuucccuaggaugagguccucaaggagacaguaucucagcgcccuggagccacaguacccacugacuuugccaccuucccuucaucagccuuccucagggugagggggagcaugggguggaggaugggacaguguggagagcucaggcgggccccccucuccuccagaauuggaggaggccuuuggagucucaggucuaacaacugcauaccuuggguuaucuggccaaauuuuacuuacaaguaacucagaagugcuuacagugcuuugaaauuccaauauuuuagcaccuaaacaccuuccgugacuuuugacaccaggagggccucaaaacucccuugucagauuauguauccccauucuuauuugaaaaauguggucacaauagcccaggaucucagaagcccuagucacccaggagcugccuuggucucagugcucagggaccccuucaguggcccacagcucaagugagccccugaccuggagucuuuuucuccucaucaaccaccaggccaaggaggagcagcaggaugacacagucuacaugggcaaagugaccuucucaugugcggcugguuuuggacagcgacaccggcuggugcugacccaggagcagcugcaccagcuucacagucgccucaucuccuaagcacuccuuuccccugcuguccccuucgacccucagcccucuggugccgcucugcccgaugcacagccaccucagccagcccccagguagaaacguggguuaagcucuuccugccccguucagcuucacucccacccuuucagcguccugccccuucaccuugacccggguucccccacucccauucccuggccucugccauaauuuguuguucaacugcucccuccuuccugaggggccucagggcuugugggggguaggcugagaccccaccaccaaagguuaagugagguccccuugauugaggacuucaccccuugauuaaagcaacuucugcuucagugcu

SEQ ID NO: 14736 - RNA, 32144 nt, Homo sapiens
cgucaacggugcgcuggagcgagugagcagcgauaccuagggcggaagugcucucggcggaagugaucgcugugugaaucgugggugggauggccgcgggccgccucuuucuaagucggcuucgagcacccuucaguuccauggccaagagcccacucgagggcguuuccuccuccagaggccugcacgcggggcgcgggccccgaaggcucuccaucgaaggcaacauugguaagggccggaaagcggcugccaagccuuggccuccgccacgcaggcgacagaggcugggaaaggagcugggcccggaauggccugcgucugaugcggccggccucuuuuucugggcugcgaggagagccuuuccccucgcaaagugcacuguguaucuuugccuccuuguuuuuaggauaucgggccucaguacccgcccacaggaacauauuuguuggggcauaaaagccacgcaguuaguggauaggacaagaauuguauuagcuguuuguaauagaucgaaauugaagcgacaagcgggugcaguuuauuuguucuccuagauaggguugccauauuuagcagaaauuaaaaauaauauccaguuaaaauagaauuuaagauaacgaauaauuuuuaguguguguccaaugcaauauuugggacauccuuacagcaaaacaacaacgaaaucacucauugaaaguucaaauuuaacuguguccuguauuuuaucuggcaacccuauucgaagagaguuccuaaauuucagucguucaaauaccacauucacaauuuuugcccugugccugugcuaguugcauaauaauuucuuaaggcuuuucuuagaagaaccucacuuuuuaaacuuaaaaacauguauuaaauuaaaaauuauuuuguuaaaagagugagauccaguaucuugaauaaaaaguagucagaaagcaaaaugaaggcaaagcauuucgauuuaauauuaauaaauucugacuugauacuuuuaucuaccaagucacugagccccuaaaaggggcuuagcaaguguugaguacugaagacguagcagcaaacugagaauuucuuuuuuuauucauucaacaaaucaccuuuugagccacuuccauaugccagcacuguucuuggccuggagaauacagcugugaauagaacaaauaaaaaucucugcucucauggaacucaaguagggagagauggacaauaaacaacauaaauuaagcaaggugaacaauauguuagagaguaauaaguaugauggagaaaaauuagggaugaagaauugagggaaguuuuuauuuuauuuuauuugagauggaguuuugcucuuguuacccaggcuggagugcaaugacacgaucucgacucacugcaaccucugccucccugguucaagcgauucuccugccucagccucccgaauagcugggauuaggggcacccgccaccacacccaguuaauuuuuguuuuguuaguagagacaggguuucaccauguuggccaggcuggucucaaacuccuaaccucaggugauccgccugccucggccucccaaagugcugggauuauaggcguuagccacugcaccuggccgaaguugucauuuuaaauaaaauaagcaaggccucacugagaaggugacaucugagcaaaaaacugaagaugagggagcaaaucacguggauaccugggagaagaaucuucuaggcagagugaagagcaauuggaaaggcccugagguggaaaguguguucggggaauaggagggaaaucguugugacugaagucgagugagcaaggaugggagggaaauuagggcaaaagcccaagggguggccagauuuuauaggccuuaucauggguuuuuaaucuuaccgagauggguagccauuggaagguuugaggagucaagugacaguuuuacuuagauuauaaaaagaucacuguggcugauaacauugaaagugaagaguguuaagugguauugcaauaauuauaguauugugaaaagugaaaguggugagacgugauuggauucuaguuauacguuaacaaaaauugaguuacauuuuaaguaaaauuuaacaguggaaguggugagaaaugauuggguucuaguuauauuuuaagauagggccaauuggauuuggugacagguugaaugcagaguguaagguaaagagaggggccaaugaugacuccaauuauuuugacuugaguacuugaaagauagacuccugauuuucuuuuauuuccuccucuccuucuuccuccccuccccucgcuuccccuccuuugguguggucuugcccuguugccaggcuagaauacagugaugcaauugcaucucacugcagccugccucccaggcucaagccauccucccaccuuagccucuugaguagcuggauccacagguguuugccacuaugcguggcuaauuuuguauauuuuuuguagagacagggucucacuauauuuuccaggcuggucuugaucuccugggcucaauugauccuccugccuuggcuucccaaagugcugggauuacagaagugagccuugguuuuaagcauguuagguuuuuacaugccuauuaauauccaaguagagguguugaauagguaauuggauauguaaguucagaauuagggucuccccggacuggagcuguaaauguaggugguauuuaaugccagagacuauguguugauggaaaggacugagcccugagcaugcaaauauuaugaaacuggggagaugggaaggaauaagcagagacugagaaggaaugccuacugagguaggagaaaaaaacaaaagagaaugauauccuggaagccaagugaagaagguauucagugggagggaaugaucagcuguguuauacuguuuaaguaaaugaaggucuuuggugaacuugaaaagaacaguuuuaggaguguuaggagugaaagccuaauugguauagguucaaggagaaugggaggugaggagaguggguuaagauaacuggaaguuuuuagaaagggaagucauggggugguagcugaaauuagaagagggugugaguguuuaacauuuuuaauuuucuuuuugugaaaagaauuagagcauguuuuuaaguugacagaaguggucuaguggaaaggaggaaaauugguaaaucgggacagaggauagaauugcuggagugauuuuuaagcaagaaagaauggaaucuauugcccagugggaaauaauuuagucuuagcuaggagcacaauucaucccuaguaacaggcgugauggcaaaauauaugagcaccaacuucagaggguguggugggaacuugggaaggucuuuugguugugucuguuuucagagugaaguaggaagaaaggucaucagcuaagagugaauguagagacagaagacaugaaauacucuagugaauaagcaagagaaauguugaauuacuggguaccauuuaggacccacuuggaguuaguggucaugaauuuaaagugagaccagucaccauggcuguguguuuuucuccagccaaauccgaaacauugaaaggaaugggaagggagaguccugcuauuugccugaugauguuauuauuuaaauaugauguuuuguacuguacuuugagaaacacaccccuaaaggaagcucuguccucaaaucccagagagagaacaggguaugucacaaaguaaguacuuaggacaggucaucagauaagguuugaacucccucuauuuuccugacuuuugcuucuuaaccuugucaaauuucucugcuucuuccuugcuuucuugugcaacagaggcuuacugagugaggacuaagaguccacucucaugcugagcacagcagugaaugggauacagcuccuguccuucaaggagcucacaacucacaacuaaguaggagaaaacagauucgacauaauuuucuuuuuuuuuuucuuuuuuuuuuuuuuuuuuugagacagagucuugcucuggcacccaggcugcagugcaguggugugaucuuggcucacugcagccuccgccucccagguucacgccauucuccugccucaggcucccaaguagcugggacuacaggcgcccgccaccaugcccagcuaauuucuuguauuuuuuaguagagacgggguuucaccauguuagccaggauggucucaaucuccugaccucgugauccgccagcuucggccucccaaagugcugggauuauaggcguuagccaccgugccuggccgacucgacauaauuuucauacuguguggugagauuugugauugggcauggaaagccagaaucucugggguaggaauucccaagaggaagaagagggaaaaguguuucagccauagaaagcaacaugugccaagguggugaagccugaagaaacacaugcaguuuuuuggggguuuuuuuguuuguuuguuuguuuuuuugauggagucucauucugucacccaggcuggagugcaguggugugaucucaucucacugcaaccuccgcuucccagguucaagugauucuccugucucagccucccaaguagcugagacuacaggcaugugccaccacgccuagcuaacacaugcaguuuuaaugaaagagaaguaguuggaugugccuggaguugaagggaccugugaaaggguggcagaacaagagguuggaagggugggauuugccauaugucgaagagccuuguggaccaugcuaguuuauccuguuggcagugggaggcuguugaacacuugaagccagugugugccaugaccagauuaauuuaaaaaaggaaauuguguaggaugagaaagaaagcuccauaaaacaggcacuuucuuuguauauuuuguuugcugcaguacccauagugccuugcauccaguuuguuggaugaaugaauagaugaauuggaacagaguugagucugugcacuaguuuuguggcuauuggaguaauuggagggaggaaagaugcaggccugaauagaagaacugaaaugacagagaagugacgguuucagagagauuuuggaagcgggauugacaggaugugguggccacuuggaggugagguaggaggaggaguagaggagggugacacugagguucaugaggaugggaauaaaggaagaggcggucuggggagguuagagugauauguuuuguaugaggugccugugagacauagagguguucugagacagauuggaauaugugccugaggucaagagaguccggagaugggugcugagauuucagauguggaaguuguugacugguggguagagggguaguuggugaagccuuggaaguaaaugcaauugcccaagaaaagggugaugcgaaguggaaugggaggaccuaaucugacucuuuuuacuuucaucucccacuacucuucaucaccccacacacccugaugacucucccuagacagaauuagucacugccuccucugugggcugacauaacauuuuguacccacaacugcugcagcacuugaguucugcugagcuuguuugcacauucaccaccuuccuugggcucugaccacucagugugcuguucaucuuuguauugcugacaccuaacccccgccuugacccaguguacucaguacugaccagauucuugaauccugugcuaugauauccauguggaaguuaggcauugguacccacacagggaauguauuaaacugcuuuuuaaaucaagagugaucaucuucucuaaucacagguaacauccucaagcaaaucagaaugagagcacccauucaggaaaccugaacagggaaggugaaccccuguccugaccaaaauuggguauguuuagagggcuuuucuuguauuccuucugcucuaaguccuauuauucugauccugaaggugcagacagcggcauguaaggaaaauugaucagugaaguagcaacuaauggcaucuagcaugacuuacgaagccauauaagaugugugauugaaagucaaaagcuugguaccuagaaccccugaaaaucuaaaaaauaaaacaccuagccugucuuuuaagacuguucaucccuacaguguauuaucaucuucuugugauuaucuuacgauuacaagcguaaauugaagaaaagauugcuguaugaaaucucacugucagugagucaucucagcauuuuuaccuuauuuucaaagacccaaccagaaaagaggaaacucuuuugcacuuuucaaucaagaaacuuaaacauaaagcaguagagggcuucccuaauaacauguuuccuccagcauucaaaauuagugacuucacaucacuaauaugugucuuacuuauuuuaaguauaaaugauugggcaaagaauccuugggaaaaaauagccuauuuauuucaaauacuguauaguggauucucugugccugugacucaccuccuucccuccaucacuguucucauacucaggaugcaaagguucagucucugucuucaaaagugagcucccagucuagcuggagggagugaugagugaacaaauaauuacagcguaauccuuugguaaaccagagcaggcaguaauuaacucugccuagagaugaaguggcgcuggagagaguucaaggaggcuucacagagaagguggcaguggaaagcugaaucaccugguaggcaaggcgggaggaggggaugucagaucagugagggucuuuugugcugagcagaugaguuuggaucauaggaaggugugagaaaauuuuuugccuuuuuuuuuucguaaacaguuuuucaugaaaaaaggucaucaaaguaaaauguauuaaguuuuuuuuaagccugcugacugauuuuuauuaacuuugccuagaaugccuuuaagcuuggagccuguaugauccuggguacucagucuugggguuggaauauaacuugagggcaagcucucagccuagaucaucauuucaguuauaguacuuaccucugaguagcuacuccauaaacauuuguugauugaaugagugagugaaugaaugcagcaucaaauacaguaucugaaauaaagacuucaauuuuuuuuggaaggacuuuuuaaaaaagacauuagacaguuuuauauguucugacuuuguuggauuuugguaaaagauuucagaauuggauuuuuuuucucauguuuuucaucuuguucaggagaugaaaaugccuagaggugauaaauauaggcuccuaugaaauacagcuguauuagacguaaaauaaugggaucuguuauuuuggguauuacaucauaugcuaucuugcugcuagauuuuagcauuacauagcuaugguaggcauugucaguuuauagaaaauuuuguggggagaaaaaaacaugccuuagaaaaagaugagugguaacaacagaacucuuugucccagcuuguggaaugagaauaguggagcuaaugaaaaucaacauguugaaguaauauacucuuaagaaaguaccuuccaccuuuuuuuaagguuguggcaauauaacaacagagaacacugguggccaggguccuaagggaagguuugaugcugcuuguaaguucugauaccuuccaaaauucauaauacugagaguauauugaaagacaggccgggcgauguggcuaaccccugucaucccagcacuuugggaggcugaggcgggcagaucaccugaggucaggaguucaagaccagccuggccaacauggcgaaacccugucucuacuaaaaauacaaaaauuagucaggugugguggcacgugcuuauagucccaguuacucgggaggcugagaggcuggagaaucaguugaacccgggaguuggaaguugcagugagccgagaucaccccacugcacuccagccugggcaauagagcaagacucugucucaaaaaaaaaaaaaaaggaaagaaagauaacagcaguggcccggcgcaguggcucacgccuguaaucccaacacuuugggagaccaaggcagguggaucgcuugaacucaggaguuugagaccaaccugggcaacauggugaaacccuguaucugccaaaaauacaaaaauuagccgggcgugguggcacacaccuguaguggucccagcuacucaagaggcugaggcaggagaaucgcuugaacccaggaaacagagguugcagugagccgagauugugccacugcacuccagccugggcaacagcuagacucugucucaaaaauaaauaaauaaacaaacaauauauuggacaggucaaacauacuggacagcuacucaggaggcugaggugagaagaucaccugagcccaggaggcagagguugcugugagccaagaucacaccacugcacuccagccugggugacagagagagacccccaucucaaaaggaaagauagcagcuaagcugggaucuaacuaaauugcaguaagucugagauagugauaucauaagagauuggcugaagaaguauggcuuucuguagacagggguguucuggucacuaggaggaggcuucugaagcaauggagagcaaaacaccaccacucuuaggaacccccugugaacaucuugaaacauuugucaaaacaaacaaacaaacaacaccccagcaagaagggaaaaaaaaaaucuaugaugaucagguaucacagcacugagaaaguuauacugugucuggcuuuaauaaaaccauguaacuuugaauuauuuuuuaaaguaauuauuccacaucugugggugguaccuggcacagcucaguuccaguggaauuaguuuaagaaauacugcccuguagugaauuacccaggcucuccaaggcugagaaacauggauggcacagcucucaggacauuucaccaccauuuacugucauuguaugcugaagcugccuugugauuacuaaacuagcuuuccagaagccuuggaauggggcauggguuacagaguacccugaguauuagguguuauuguuccagucauuggaacuguauauuuccuguuacaucuaauuuguuggcauucuagaauuaauguguuuaaauugcaugagucaauuucuuggaguccugacugcucuuagaugaacuaauagugucugaccucagagcccuuccuuuccaucugcaacaguuuuuuaagguaauuguuuuuaacuuuuaaaaaauauaaguaauucuaacaauuguucaaucccagccaucuaacaaaucagcuacguuuaucuuuucauuuaauuaaaauagcuuuuuagcuauuaaauagcagggaccauauuuuagacuuguuaaacaaccuacaaucuaaauauugaccaucugggccaaauauuuuaagcgagggcuuacucagggcagacagguaucugauaauauacacauucaaccacuucgcaccugaccagugugguaggaauucagagcuagagaaguccugaagaaguggcaccuuaggcuugcugggggaaaggauuuagacacaggccuggaagagcaggggagggcauuuauucauuggagugugggaagagcagggaucgaacagaugugaagaagcacacacaaguuagguggagguggggacugagagaugagcgugacuguacaaauccacagauucaugcuguuuguucuuauccugccuauucagagaggaguugggguggcauguaguaaaugucaucuauuaaauguguggguucuuaugcugagacaucagcaccccaaucaguaaccauaaguggaaggaugccccccuucuuucccuugagaaagauuacuucugauagaggagauugagguccagauacagucuuaagauuuauuuuuuauuuuucacaaauguagguuucagagggaacugaaauuaguaauauauuguguauuuuauucauucagcuaggucauuagguuguaauuuguuuucuacccuggaggagccccauccuguagcuggagaaacacaaugacaauugcagugauggagucucacccagaauaccaaccaugcagaaaggaggacuagcuaauccagcuuagaggugucaggaucuggaaaggcuucacacaggagguucaucuaaacagaaccuugaggauugaguaagaguuggucaggugaggagaggaggcgcuucaggaaaugggaaagcauaugcaaagucauauuugcaagagaacauggcaugauuggaguuugguccugcaggaggguaggcuaccuaaaggaaagccaaggccagagaggcauacacagggaucagaucuucuugugucuugcagaccauguuaaagaguuuggaguuugucaugaagcuuguucaggucuuagcucagaugucacuaacuucccauugcacuuagaauagaauucagaccucuuaccauggccacaaggcccuaugugaucuggccccggacugcccauguggccacacccaucuugagccacuccuccauugcuugcccuugcuauagccaguuagccgauagagagcugucaaaagauuguaagcaguguuauuucauauucagucuggccacaguauggagcauggauugaagagagcaaggccagcaucagaaaggcaagagaugauaagaggcuggucuugagcauggaggugggaauggagagaaaaggacaaauaugaaaaauguagaagcaaaugcagaaggauuugguggccacugagguuuggcagaggagggacuucugucagugaguggaugguguguucauacccugaggucugggauacaggaggaagcucaauuuggugggaaagaugauuaguucauuuaggaaauauguugacuuugagguguuuguggaaugucccaaguggagaugucuggagaguucuugaauagucucuggagcucauggagguaugggccaaacauugguauaaaugggaaaagauaacuugaauguugugguacuagguugauuucaucuccaaaauauuucucgaaacaaccacuacuuuucacuccucugccaucaccucggggcaagcugcuauaucuuuuaacuagucugccugcuucugcuucagcccauucuuacacagcuaguggagugaucuucuaaaaaugagaaggagucuuauaauuuuccuacuuaaaaccaaucuucacuaacuucccauugcccuuagaauagaauucagucuucuuaccauaacuacaaagcccuguaugaccuggcccuggacucccugucuggccacacccauguugagccacuucuccaucacuugcucaugcuguagccauacuguauggcuucuucuagggccucaaacuucuguauuguugugugucaaguucuuucucucuuucaggucuuugcauaugcuacucccuuugcaugaauugucaucuuuuaggucuuaccucagaugucauuuuuucaagggagucuccucugaccuccugggcuauauuagugccauccugcauuuuuuccuagcaccuaacacaauauguuaguaguuaauugugcguuuguaucacccauacaagcucugugacgacaaaauccauucuguguuuuguuuaccauuguacccacaguuccugacaguccugagcucauagucagcacuccaugaauauuuuuuagauuuguugaaugaaugagauuauaaucauuuuuauuuuuugucuugaaaaacuuagaaauuuuacacugucacaguacaaauagaauggugacucaagugauagaacuuauggagcugauuucaucuacuuuuacauuuucaacuguuauuaaaugcucugccucuggaagguugagacauggaaauugcaaauuaaaucuuaaaaggaauuuuuccucccuauuggcuguauucauuauggugguucugguuagcaugaauugaucuguuaucagucugacaaugguacggcugcugaguuugaaauucagaaaacuaauacuuguucccuugaguuugggcguuuguggcagaguuuaguagcagccuucuccuucagcccugauuugggaagcaucccaauacaugcuauuugcauugcagcugugggaaaguccacguuugugaaguuacucacgaaaacuuacccagaauggcacguagcuacagaaccuguagcaacauggcagaauauccaggcugcuggcacccaaaaaguaaguuuuuaguugugguggguaguuggcaggcaugggugaauaaucuaauugucauaauuuaauuuacucucagugaguaaaguagcccaguuugaguauccuuuuuaaaauagcuucauuccagaaagcagaccacauacaccagagaggauaugacuuguuugaauaugugcaguuuugauuuuugugguuuuuauaugucuaucuaagugacugccucuguuguuugugguuucccaaagcauguccaaccaucauggauggcuuugaagaugaauuuugucauuccuacacuuaaguauuuauauuauuacuuaagcuaaccacuaggauuaauagcuaauuauagugauuuuaacuuuuuaaauaaagucuuagaaauuagaagggauauuagagagguuccagucacacuuugagucaaugggagagguuacagcuaacauuuaugagcauguacuaugugccaggcacuguacuaugccaagcacaguacauuucacuuacaccucauggcuuaggcccuggugucaagacuauggcuuuggcagaggccauagaguugguuuccagccacaucagucugaguaaggaaagacuuguuucgacaugacccuuagagggagcagaagcaccaugccuccucaggcaccaugaacugcuccugccgccaccugggauauucacugaguggcacauucugguucuuaacucuaauuacuaaacaguucugccuuuuaaugagccauguugcaccccugugacucugacucauugguucaaguucuaccucuuaagucuuuuaacuuuucgccguaacaacccuauauauaguugaagguaaugauuuuccuguucuuucucccccucaagucucucuccuuuuuuuuuuuuuuuugacagucucauucugucacccaggcuggggugcaauggugugaucucggcccacuguaaccuccaacuccuggguucaagugauucucaugccucagccuccugaguagcugggacuaugggugcaugccaccaugcugggauacuuuuuguaucuuuaguagagacaggguuucgccauguuggccaggcuggucucaaacuccugggcucaagugauccacccaccuuggccuccaaagugcugggauuauaggcaugagccaccaugccuggucaagucuucucucuuucaagccaaacaccuccaguuuuccuccaggcuauucuuuacucugaaguaacuuuaccuaagugaugaguccuaguuuguucacuuuccacuuugaauuuacuaagagugcuacuuggaggugaacaggacauucuggauguagucuaagugggacagaguaucauggaacuuguucugggugccauuuuuuuuuauuccaacccagaauuguguuaccuuuuguggcuggcauaucaugccuauugaggauuuuugcugcuuaaguugucucuuuauaugucuguaugugugccuguguguguauuugugaaauuaacuuuccuaugcaggaauaaauuacauaucuuuuucugaguaugccacaggucaccuguguguauuucaaaauacagucaugggcugcauaaugauguuucugucaaugauagaccuuguauacaaugguggccccauaagauuauaacaacauauuuuuacuguaccuuuucuauguuuagauacacaaauacuuaccauuguguuacaguugccuacaguauucaauacaguagcaugcgauacagcuuuguagccuaggagcaauagggugugucauauagcauagguguguagcaggcuaucccaucuagguuugugugaguacauuuucugauggucacacagugacaaaauugucuaacgacacauuucucagaacauauuccuguuguuaagugguacaugauugcauguccacaauuguuugauauuccucccuucuagaaguagagcguaauucuugccuugaaugcagcuggacuuugugauuuguuucuaguaaauagaaaguagcaaaaauaagaaauaccuuucuaggguaggucauaagagacacuguagcuuccaucuuguucugggggaagccagcugccaugucaggaagcagccuuuucaagggggccacacggaaggaacugaggccuccugugaacagguacgugagucuuuuuggaauuggaucuuucagccacaguccagccuucauacaacuguagccucagccaacaucuugacugaaacuucaugagaaacccugaggcccagccacccagcuaagcuccuucccaaauuccuuccccauagaaacugagauaaugaauguuuuuguuuaagccacugaauucuggcauaauuuguuaggcagcaauagauaacuaaucauccuguaaucccauuauucagaaguaaaauggacauuuuucuacagagaaaauguauagauuuacauauacuuacauaaauguauaaaauauauauacauuugcuuuuugaaacaaaaauuuugauugccaccuguaugucacuuaauagacaagaucucccuuucacagugauaucauuuuaaugguuguaguguacugcauaauaugaauauuaucauuuaguuauccaguccucuauuuugaauguuuaguuuucuaauuucuuccuauuauaagcaguguugcaaugaugaauaucauuguagcuauacugcuuguuuuuuaauauaaagccauguuuuguguaucuuuuuguucuuuagugaauugccuguccaaaccccuugccuuguuuuuuucuauugagaucuucaucuuuguguaauggcuucauaaaaacucauuguauguuaaguauauuaacucugucauauauuuguuugucauuuucuuuuuuuuuuuuuuuuugaaacggggucucgccuugucgcccaggcuggaguccaguggugugaucuuggcucagugcaaccucugccuuccgaguucaagcaguucucccugccucagccuccugaguagcugggauuacaggugccugccaccacacccagcuaauuauugaauauuuaguagagaugggguuucaccauguuggccaggcuggucuggaacuccugaccucagguaauccaccugaauuggccucccaaagugcugagauuacaggcgugagccacugcgcccgaccaugucauuuuucuuuuaucuugguauauaauauauuuuuacaauauaauacauuucaguuuuuauguagucuaaccuguccuucuuuuuccucauaguuagcaccuuugauguuaaaauuguagcccaggaguauaaaaauaaucuauuucuuuuuguugcuuuuaugguuuuauguuuuauguggcuuuacaaguuauaagacuuuaguuuuuucacaaaugguuaucuacuuagccaguaguauucuuguuuauuccugagcagaauauauauuuuguuuuuauugugacugagaucuuuuuuccacaucaucuucugaaacugguuauugcuguuuuaauggaaaacaguugauuguuauauuuaucuuauaugauuuaauuucucauuauuuuuuuauuugcuugaaguuuuggaaaauaauaguugucucuaaauaguaaucauuugaaagaguuuucuaauaucugugccacauuucuauuuucuuguuuucuuucauuggguagaacuuccagagcaauauaaacuaauagcagugaggguaguuuccuuaucuuguucugucauuaaugaaacugccucuaauauaucaguguuaaguuuaauguuuauuauucauuucaguagaccgugugguacacguacccuuuuguuacuagaauaguaacuguuuuuaucaugaucaaauguugaauuuccaucaaaaaccacuuuagcaucuagugagauaaacaagggguuuuucuuuuuaaucucuuaguauuagucauagauuuaauaaugguaccauccucacauuucuagaaugaacuuuuuuuuggucaugauguacuauuccauuaauuugguaauguguuguuuggaauuuugcauguauauuuauuuauacaguugguugguauuauuauuuguguguauggugauuuuuguuuguuuugacuuuuggguucuuuuuaggcagggucuuccucugucacccaggcuggaguguaguggcaugaucauagcucacugcagccuugaaguccuggacucagguaucuucccaccucagucucuuggugaguugggacuauaggugcauaccacuguccccaucuacuuaaaaauuuuuuuuuuuuuuuuuuuguagagauagggucucacuuugcugcccaggcuggucucgaacuccugggcucaagcgacccuuccaccucggacucccaagguguugggaccacagaugugagcugugaugccuggcccauguguaguuugugacagguuuuaccaucaauguuaugaaaauaaauggagaaauuuugcaucuuuucuagcauagaaaugaucuauuccuugaagguaugauagaaaucaucuuuaagauuauauggauucaguacuguuugaggggaaucauuauuggacaacuguuuucugccucaguuauucagguuuuuuuuuuuuuuuaagauggaguuuugcuccuguugcccaggccagagugcaauggcacgaucucagcucauuguaaccuccgccucccagguucaagcgauucuccugccucagccucccaaguaguugggauuacaggcauaccaccaugcccggcuaauuuuguauuuuuaguagagacaggcuuucaccauguuggccagacuggucucgaauuccuaaccucaggcgauucacccacuuuggccucccaaagugccgggauuacaggcaugagccaccauguccagccccuagggagaauuucuuaagcugauacucuuuucuuuuucuuuaaagagucucacucugucacccaggcuggaaugcaguggcccuauuauagcucacugcagcauugcuucucagccuuuuggcuaagaucaaguguauagcucacuguagcacugaacuccuggguucaagcaaauccucccaccucagccaccagaguagcugggacuacaggcaugcaccacuaugcccagguaacuuuuaaauuuuuuuguggagacagagucucacuauguugcccaaguuagucuugaacucuuggccucaagcaauccuccugccuuggccucccaaagugcuuggguuauaggugugagcccccauaccuagcccuuaaacugauacucuguaaggaucuucuaauucacuaauuagguuuacugcauuauacagucugcuagcuaccaucuucauuaucuucauuggguguuuuacuugggcaauugcauuuuucaccucuaagaaaguuauuuucuuauuguuccuuuuuuaugauagcuuauucuuguuuuaucagcaaggccguaucuuuuguuuucuccuguuucugacaacagcccugucugagcacagagacuaguccucuccuuuugaauugcuaaguauuuuuguguccaauuauuguucaucuguuugcuuauauuuuuggaaggauguuugcauuuguucuguagcugagauggguucuuucagaaauuguguugguuucuuuuacauuuuugguuccagaagagucucucuuugauagcccaaagcccacuggugcaauagaacccaccagucaaccuauugcaucugccagcacagcacuccgcuccacauacagugugugaauugugcaacaggcccagggcugcucccaaccaucucuagugacaccacagagacuacaggagacacaaauuuguccuccuacuucuaccuccagcucuuagucaggggccacgugugaggcugguaugugugggcuugcggggucagaaggagggaaaucccgaaaauaccucugaguuaaaugcuuuucugguccacucugcucuauauguguuguuucugcugaagccuuucaaagggcuaagacccuucuuuggaaucuaauagugcuauuuugccaaauuggacuucuuacuguuguugaaucuuuuuucuccuucuguccuguugucucuaccugaaguacaaucuucuuaaucuccauuuccaucugugagaauucuacucaucaguuacuucccagcuuaaugccacuuucuuucagaaacucccugagauuccuuccaccaucaguaaucgucccuucaucacauguucugccuuacauuccagcuucguacauccucaucacccucuuccuuuuugcacugugagcucuuugaguucaggaacugucuuguucaccuuuagauggaggguguuggaaugaugagguuagaggaagccagguuugagucccuucaacauuuacucgccaugaaaccuugcacaaguaaguuacuuaaccucugaguggauuuuccccucuggaaaaugggcauuacaacaguaccuaccucaugaagcuguuuugaagauuaauugagguaacauaccacaguaaagguugaaauaaauguuaauuccuuuuucuauacccuuacgguacccugcccauguagcgccucauccacacaggccuucagugauuggugauugaauaaaaaauacagauccaaagugcuuuuguacaaaauucacuuuugcauuguugagucaauggcagauccagaaaagaaucuggggcugggcgugguggcucacgccuguaauuccagcacuuugggaggacaggaguucgagaccagccuggccaacauggugaaacccugucucuacuaaaaauacaaaaauuagcuugucgugguggcgggugccugugaucccagccacucaggaggcugaggcaggagaaucacuugaacucggcugggguggggaggagggcggagguugcagugagccgggagguugcagugagcugagaucgugccacugcacuccagccuggguggcagagugagacucugucucaaaaaaaaaaaaaaaaaauccggggcugcugaacaucccacacuugugcccacuugcacaugccgaguaaguggaacguuuuaauuauguuucauaaagucucuagaauuaaguaggguuuuguuuuaacaaacaaauuguacuccuuauaugaaagauaaaauucuauuuggugguugauugguuggauuuucaaauaagcaguugcuuucugguuugccuugacauuuuauaaacauaacuacagauggaagcucaaaagagaggcaacauaguguuauaguggaaagauuugauucagaguuaaauuuuagaugguuguugacuguuaacuccuccccagacagacuucacaaaucccucaaucagugaucguguuaauucuauauaugguucuuccucugcuuuuguuauauugaaguggcaugucaucucccuuuagagagucuuauuuaauagguaggaaaaucucauaccugauuaugaaauuuugacuaagcuggggaucugauucuaccuuuuugguggaaggaaacuuuuguaauuucuucuuucauugauuauuaaaccuguuuggggagguagggguguguguggagggguguaccccauggaguaaauaugcuuucuaggaaauuuucuucuuuuuuucaucucccucuaggccugcacugcccaaagucuuggaaacuugcuggauaugauguaccgggagccagcacgaugguccuacacauuccagacauuuuccuuuuugagccgccugaaaguacagcuggagcccuucccugagaaacucuuacaggccaggaagccaguacagaucuuugagaggucuguguacagugacagguaaaaugccaagcccuccaccagucacaagccccaugcucagugcugccuguuugaucuugcacagauccugcacugcuauggucacugaugauuauaauuugaaaaauuaucuucuuuuuuaaagacaacacuauacagauuuguccagaguuguacuucuaccagauugucaucuaugucaagaaaggaaauuggguuuuucaucaacugaaugcuuugaauuucuuacauugcuacugauuaccuuauguuuccuuauuuucuggcauggagcaagcugguagccaccuaauguaaccaucacaugcuaaaaggcacauaauagacacuuaaguagcaguguauauucuaagaaaucagaugauucagugguugauuauccccuuuaagaaaaaagcagacgaaauuaaaauuuguguuccugaaaaugauauaagagauauuuucagccuuuuuuuuuuauuguucaagaaaggaugcuuaggcagaaauagcacaucugagaaacuggcuucugucucagauuuagcccuuuuugaccccuucuucugugagagggcuuuuugcuggccagagucuaguggacaucagugccugugucagaucagggaugggcaucauccugaccaccugagggagugagaugugaagucacuuugaaugcaagcuagcagcacccugggaagugagcccaucugcuccagaagagcuaggccgugcaggcuccggaaugccuggcucugcugcagagaccaggcugugacuugagguuaagccgccuagagacaaagucaggauggcuugaucuggacacugcuggaguuuuucuuaucugaagccuaugaaugaccagugucagugugaaauagugcuuucaagcaaaacgaucuuucuuaaggcucuuugaauuaucaaaaugggaagugguacauuuucauugucacugcugaagacacucaguugguuacucuuuuaauuccaaauuagacaaacuaguucuauuucuuagugcuuccggaaagccuccuagaagaaaaaaaauaaggauacauuuguaaaugacaagugauuuuucugacuuuacccuaaaaucauggaagauauguaaaacaaacccuauaggcuauccguuccuuguguacguaccccgagagagccuacuuuuuauaaaagcuaaauaugugaauuacaaauggcugggcuauagguuuuacuucuuuuucagcuguuggauaucccaccugccuguuuuccucucuucucucccaagccaugccucucggacuccgaaguugaauuacauauaaccacauggguuguuuggaaacauagucagucuuuauuucuagccgcuucaugaaguaggugugugagacccucagaggaaaauagagaaguagaaacacuuuguuaauuagaaaugcauuaagaagcugcauggaucuuaaccuuugcuuguaaaggaagagguaauaauugauuacacugugggcauacaacauuccaggugcuaucuucagugagggcauuuucgagacagaaaggaaaacuaaucacaaguucuaaucccgaggguaauuuagacuuuguucacuugcacagauuuauuggaugccuccuguguugaagcaccaaggcuggcccuggggcugcagcagugaauaaggcagacccagucccugccuaacagggacugaacacaugcucacgugugugauauuuguuccaaaggaggaacacagguuaucugggagaguugauuauagcgaggaagaaaucuuagucuuuucuguuugaguuaaaggaaacauuagcauaugguuuuagagcagaggcccugacuccuagauccuuaugcccuguucuguccugcagccccugcauucagucugcaguacuucccucccacucagcaccacacccuucugccccucaccccaucaccaccacaagcuuugaagaaauaaaggaagugcucuuucucaagaaagccaagaaccccuuucauagggcuuauuagcaaaucuuuaauuucucuuuauaagauccuuuuuuguuuuaagacagagucucgcucugucgcccaggcuggagugcagugguguaaucuuggcucacugcaaccuccgccuccuggguucaagcaauucuugugccucagucuccugaguagcugggauuacagggacacgccaucaugccuggcuaauuuuuguguuuuuaguagaaacgggguuucaccauguuggccaggcuggucucaaacuccuggccucaggugauccguccgccucagccuccaaaagugcugggauuacaggugugagccacagugcguggccacuuuauaggaucuuaauuucaucuucuaguuaucuguaaagaacucaaaaacauuuugaguuuaaaauguuacccuuuuauuuguucucaucaacuagacuauggcuaaaccauuccagacugggaaaguuuacuuguggaguuucuaaguuagcuucuucauagccuaacaaaaagcaguuauaauaauaacuaagauaucuagaagacuaugugccagucacucuucuaagcacuuugugaggauuauuacaagacaucaucauaacaggcugagaggauuuaggugacuugccugaaguuacauagcuagugaauguuucagccaguaucagacccugaaauguuauucuggaagguauucucucaguggugacacucacagccuugcagucuguacuuuccugagccaucauacacaaggguucugaauuuuauuuucuccaaaguggccaguugcugagcauugccuuggaaacuggagucccuugcuuaggaugcaaauuguguuuuuuauuaaaaugccugagguuugaaagcaggauugaccccugguuugucugaagccaugguuuauguuuagcucugauuuccuguuuaccagaugcucuuuugguuguagaaauaagcagggggcaaagcugguuugauuuuuagcuuuagcuuucuuuuaucugaacuagaaacucagcagcagaggaagcaagcaagcaggagcucauaaugcauuuugcaggagagucugcuuucuuaguaauacugaaauuaguaggaaaugcauuuucugcuccauagaggacaccacauaaauacuauuucuucugcaugucucagcuaaacaaaaggauggcucaguagccuggagacuuagaagcccucaguccuuguaugaaauuuaguggguggauuuauacuggauucacuuguuuauuuguuuugggccuugcuauaauaauaauaaggaaaucucaaaaguucaaguuuacauauauuugcuguauguucugacugguuucuagcagagaaaauuguuagggaccaaugauacuaucuucugucucuuuucuuccagugaaucaauccaucuggaaaggugugauuucagccuccaaagucuagauccuauuucccaucuuaguacugagcagggagggagauauggguuaagaauucagauuucuuaaggauugaugaggagcuagaaagguuaagugguuugaacagacauggaacaaguugguuauugauuuuucugcuucucucucucucucgugccuuucauuccauuucccauucuccugcccuccccauucccaucccacuuccaaccagguauaucuuugcaaagaaucuuuuugaaaaugguucccucagugacaucgaguggcauaucuaucaggacuggcauucuuuucuccugugggaguuugccagccggaucacauuacauggcuucaucuaccuccaggcuucuccccagguaacacugaaccuacaaccuuagacuuuagggccauaugaaaccuaagaagugacauucuccaagccccugauuuucugguuggagagauuagagcguagacauuaccugcagcacagagagcagugggggacacccuccugucccagcguugagcacccuguuccccacuggcuucguguagcagagugcuaaagccauugacuaugcauaaaaggauugcuguugauguaggaacaacagagcaaaucgagugucaucuuuaugaugacgcuuaggguuugcaggugggacgcucugaccuguagccacuugccucagcuccuccuuuacucugacugggucaucagaguguguagucucagugguuuccuuaguaagaugugaggaggaagaggagaauuuucucaccucaucaugauacugcccuaauuuauagcccuuuuuugaacugugaugccauugggaaggcaggauggacuauagcaguuccauucugugacucucuggcuggugccauccuacaugaaguaggaugaugucacggcaggagcaccagagucucuggagauagaagugagcuguggcuucugcugacugguagugaccuugggcagccccuggagaccuuuccacuggagagauccuugccuguaaaauccacugguucaaucuagacgaucucuaagggcucuucuggagugggauucugagucaaggugaguuuuuuuuuuuuagagauguacugcucucagcuuuugagauauacauccaauauauagucaaaugccagauauaccacauacuguuagaaggaaggaaagcugucuccaagcuagaggcuaugcuuuuuagagauggaacugagacuugugggcagaaaggagccgagaacagacugagcagaaccagaggaugagugggagagcucccaucacagagccucacaccagccaacgaggagaggacuggaaggaagggucuugccuuaagaagguggcaaccaggaaaaaaggcccuugaaugugacuggggccagauauuggggaucuuuguguugagaguuucuggacauuuugaggcaaaagcuagaucguacgagggaauaagagauucuacagaaauaaauaaggguuaaaguuuaaaaugaaacugggcuggugcaguggcucaugccuacaaucccagcacuuugggaggcuggcgugggaggaucacuugaggccaggaguucaagaccagcauaggcgauauagugcgacuccauuucuacaaaaaaguuuaaaaauuagcugagugugguuaugugugccugugguuuuagcuauuggggaggugagacaggaggaucaccuaaguccaggagcucgaggcuacagugagcugugaucgugccacuauacuccagcccaggugacagcgugagaacuuguuucuaaaauaaaauaaaacugaacuaaagauucagugaggccagagggcuaauaaucuuccauggaaagaaccacacuaaaguuagaugcauugauugcaaguugacaaggugggucauguuuaugugacuucuuucaauagucuucauugccugagagccagaauagaagaaggggauuauacuuuagggguagagauuagugucagcgauuguggggagaggaguccccucucaaagaggacaguuugaagugucaaaguguaggguucaaguugggagagaaguccugagccccaggaaggcuuguggccugggccaaagaggagugagagugcugugagguuggauugaguaaagauccugguuggaauuugaagaagugacagguuuccuaugggagucuugggauggcuggacugaaagaagcaggagguucucaggacgagcugagcauuaggagaagugagaaugcugacuuaaccuuuuccaagagaacagcacauucagcucagugccaugaagccagcauuggggaggagugagagaggaagugggcugacucauuccugggaguaaaauggggcuacuugggccagcugaagaggcucuuguuucuggggaguggaaguuggacccagcaaggagaacaagaaagucuuaauugcuuuucuucuuugugcacucugaaugaccuuauaacagaaugccugaaacugguuaauuuauaaagaggcuuauuuuggcucacaguuauggagacugggaaguccaaauugggcagccuuaacuuccauugaggaccuccugcugccucaucauaugaugagguggaagggagcaggcaugugcaaaaggggcaagauaggaggagcagccuugcuuuauaacaucccacucucauggcaacugguccaaucccacgagagugagaacucauuccggcgagaauuaacccagucccaagagaguggcauuaaucugucuuaacaaccuaaucaccucuuaaaggccccaccucucagcacuaccacacuaaggaccaaauuuccaacacaugaauucuggggggauacacucaaaccauagcaaauggugaugaugaugaugaugaucaucaucaucaucgucgucgucgucgucgucgucgucacuugggggcagaucugcccuuuuggagaggcuaauugaaauauuucagcuggaguagaaugagaagaguugaaggauuauuacaacuuaauggcagaaaagaaaaauagcuuauucauuuugagauuagauggggauuuuaaugcuguuuugauggcauuaguuccagagaugcaggaaugcccauguuucuucccugaagucacacuugaccucuucugugaaauucagagguaacugugcccaagggaagagcagaauagaaguuguccugucacuauguaaaaagcugugcaagugcccaaucuuccaguucagagcccucguaaauacugaguuucgagcaugucagauggacuucguagguccuucugcuccuuucuaccuauucuucccuaacuucuuuuuuuuuuuuuuuuuuuuuugagacagaguuuugcucuguugcccaggcuggaguggcacgaucucugcucacugcaagcuccgccucccggguucacagcauucuccugccucagccucccgaguagcugggacuacaggcacccgccaccacacccggcuaauuuuuuuuuguauuuuuaguagagacgggguuucaccauguuagccaggauggucucgaucuccugacgugauccgcccgccucggccucccaaagugcugggauuacaggcaugagccaccgcgucuggcccccuaacuucuuaaaagccagcaagccgggccagacuggaccaggcgggugcaguggcucaugccugcaaugccagcacuuugggagaccaaggugggaggacugcuugagcccaggaguuuaagacccaccugggcaacauagugagagcccccugcccucuacaaaaaauuuaaaaauuagccaagcaugguggugugucuguauucccagcuacucagcaggcugaggugggauaucacuugagccugggagauugaggcugcagugagucaggauuacaccacugcauuucagccuaggccacaaagcaagacccugucucaaauaaaugaauaaauaaauuuuuuuuuuuagaaaaggcaacucaggccgggcacggugacucacgccuguaaucccagcacuuugggaggcugagaugggaggauugcuugaggccaggagcucaagacgagcauggucaacauagggagaccccaucucuaaaaauuuuuuuuaaaacacaagcaagcuaacaauuuuaaaacucaaaagagaaauagcuaggccucaguguuccuagccagccccauggaaucaagagagugcagcugaucaauguacaucaaaaagccaggcccuaccugggacuggcacagcauggggacagcaugcaggaggugcaugggacaaauggcaccuggguuugggcuugagaggcauagugaaaagacccacuagcagucacuuuccauuuucuguuucugacuccaagcaagcagagcagcaguucuucuuccugggugggacagguuaagaagaccaguaaagggucucucccucgccacuuguagcuacacuaucuuuccuguucacauucaggugugucuuccucaugaggacugagaugaagaggggucagacuaaagcacuguuugcacgggauuuuuuuaaauagaauuuguuauagcgauaucaguaaagcaagaguuaugccaaaugcucauaguaggaguuuacuucgaccucuuuuuuuuuccccacucaauacugccaccaguuaagacuuagacuucucagggaaauccauuugcucuguuaaggaaauuaauaguaaauagaaauauguuagcuuauuuuaauagaucaauguuagugucaagguuugucugcaagcagugaaugaauaauuauaaauagcuuuccuaaaaagaauuguucugccuuuguguguguacuuggaaacauaaagucacauuuuaaaaaaauuuauuuucacgaaacagacaacauuuuuuuucucagaaaggaaaaugagaugauagcuuugcuaugcuuagaaauccuaaagcuaccuuucuggugggaauauaaauugguuaaccucuaaggaggcagucuggcaguauauaauugcaagugcauauaccuuuugaucauuaauaaaauuuguuucuauaauuucauuuccuuagagaaaagguaagauaagagggaaacagcaaagacucccaagucuuugggauuauuguguacuacauuuggaaauuaaguuuucauuucuuaaguaaguuauugaaagagggaaguccuggccgggcacgguggcucacgccuguaaucccagcauuuugagaagccgaagcgggcagaucacgaugccaagagaucgagaccauccuggccgacauggugaaaccccaucucuacuaaaaauacaaaaaauuaguugggcgugguggcucccgccuguagucccagcuacuugagaggcugaggcaagagaaucacuugaaccugggaggcagagguugcagugagcugagaucgcgccacugcacuccagccuggcaacagagcaagacucugucucaaaaaaaaagagugaaguccuaaaucaguggguuaauccaucuguucuuccaggacagaugauauugaauaaugaaauguuugucaagcagagagaggacugaggauaauucagucaaaacaaacauuuggagcaaaaauuuugaggugugaaagagccuggccuguuccccaggaaagaggucaaaucuggcuaaagcagugaguccaggggaagagcuaaggcaguugagaaguaggagggguagcuuugugugacagguaaagaagaugucauuuucugagccagugugcaucaaacuucacuaccagaugaaugcagaauagaauuauguacacucugcaaagcagcgggggaggagaguuagucucaagccucacuuguuuuuccacuucuuuguuuuaucuuugaccugugcaaauuuuacauucuauuccugagugaauguuugguaugacaugaaagagauauuucaaauuaccuaacauuuuauaaaugcaaugcuauucauacauacugcuuugaacccuggggcuauggcuguaggcgguaaagagccugugaaguauuuucagcaaggaaagucaugucauuauauugccguacuacagacggguggagugaaggggaaaaacuggaaggagggaacagcuuuugccaggagcucaauacaacuuaccucagugaccuguggauggguagacaaugaggaaauagaagcccacaaggacugcacugcuaguaccuuaugaaggcaggaauuuacuccuggacuuucugaccuuaaggccuguacucuguccauaugcuucccugccuccaggaggcagaaccagaaggcucuugccauaauccagguaagaaguaaagaggacccgaccagggcagaggugagaggagaggcaaggagagaacauucuagagagaugaaagagaauugagugacuucccagauauaguagggagaaggaaaaacaaggaaaauuccagguccguggcuuggaugacuggauggaugauguucaucauuaaccgacuuaggauacuucagaggaagagcagguuuaagguggagaugggaaaagaaugguguagauccucugauugcauaagaaaacaagacagcagaagcaaaggcauggcuuguaaugcccaagauagacauuaugggugggccucagagcccccgaagacugcauuguagcagccaaaacagcaaagagcucaucagggcuuggggacugucuuuuagguuuguuugaagagacuguaccagagggccagggaggaggagaaaggaauugagcuggccuaucuagagcagcugcauggccaacacgaagccuggcuuauucacaagacaacgaaguaaguggggagaaaagaauguaucagagacagagaccuggcucccaacagccaguuguuaaaaacaaguucagcaugcagcccccuguaggaagguucagaauauacuggaaaugguuggaaaugucaagcauuuuccaacucagaaguuuaauauugcuggacaccguggcucacgccuguaaucccagcacuuugggaggcugaggcagucaccugaggucaggauucaagaccagccuggccaacauggugaaacccugucucuacuaaaaauagaaaaauuagccagguguggugucaggcgccuguaauaccagcuacucgggaggcugaggcaggagaaucgcuugaaccugggaggcaaagauugcggugagccgagaucgcaccacuguacuccagccugggcgacagagugagaugcccagaagaaguuuaauauugaauauaaucuuuacauuccaagggccuuuuuauuagauuguauuucuccagcuuuuucuuuguuucuuaacauuucccuagacugaacauugugauugauggugauaguuggcucagcaugaagggcugaaaauguuagagaaauugucaguauuacuaaguuggcauuccugguuucugccuguccucccuuuaggcuugguuuguuguccacuuaaaauguuuggugcucugacuguuuguuaguaucacucucaagaaugaagagaaaccucaaccuuucuguuuccggccaacuuuauugaauuuguuuuuuuaaaugcaguuuacaugcaguuucuuugaaaagucauguugaauuuagaucuguucucugaguaagacuuggcgaguaugugaaacuugacucaaguuacauuucuuuuuuucugucccccaaacguucacgcuucuuauaggcuccacuuugaggcucugaugaacauuccagugcugguguuggaugucaaugaugauuuuucugaggaaguaaccaaacaagaagaccucaugagagaggugggaaggacuuuaacuccuguuuucuggugguuuccuuuguuguacuuuuaucuuucuggccuuugcuucaaaguucaauaucaugggucuugugcuuugcaucucacauugcauuucacacuccaaggccuauggaaucuugugcagauuacaaauaucccuauucucuaaaguaugcuggacuaauaauuguuaaauaauugacuuguaacaugugcuugccagcugacuuucuucucuaaggcauccuaaaacuagggaaaugagacuacuggauucuauucccagcucugccacuugaugcuauaugacccugggcugcccacauuucuucuccaugccuauuauuuuccuuuccucacaaaaaccucaugggcuuggcugcauaugcauuggggguggaccauugaaaauucuguuaaaaaugugaaauuaaacuucugauuuucuccuucccacagguaaacaccuuuguaaagaaucuguaaccaauaccaugaaguucaggcugugaucugggcucccugacuuucugaagcuagaaaaauguugugucucccaaccaccuuuccauccccagccccucucaucccuggagcacucugccgcucaagagcugguuuguuaauuauuguuagacuuugccauuguuuucuuuuguaccugaagcauuuugaaaauaaaguuuacuuaaguuaugcuuguuuuucuaauuca

SEQ ID NO: 14737 - RNA, 8932 nt, Homo sapiens
cguccgcggggcggggacgcggcggcggcggcggcgguggcggcugugugucgccggagccgaagcgcgcaggcccgucccgguggccggggagcgggcgggugggggcgccaugugguucauguaccugcugagcuggcugucgcucuucauccagguggccuucaucacgcuggcugucggugagacugcacgaccccggcccgcgcgggcucccgccccggcaucggugcucguugggggucgcaucgcggggguuucggagccacucgggggaccacugcccggcgcucccggccuucgccgccccaaccccuucccgccugauccugccccuccugucgagccuggcagcccggccugaccguggcuccuuccaggugucacagaguccgcuccggcacugcccgagaaagggugacucgagugccgcccccgcgucugcggaccgcuaaccgcugcggcucccacucuucgcgggccugccgcgcggaacuuuuccccaacgccuaccgccgccuuugcgccucuggcccuucaugcucccugcucucuccaccuuugacacuucuccucuggcugguucccauucggccucaguugagaugucaucuuuuccgggaaguccacagggguugaugguccagcagugcccuguccuuucccuaaaguagcauuucucacacuaaacucgucugucucucccuacuguuccccuucccuuucccaagcugggucagggaaggacccuugucugucuuuuucagcuguauucucagcccagggaccuggcucaugccaagugcccagcagguguuuauugaauacgugaaauuccguuuucugagccagagguuaucauuguacuguggcaucaaaugcagacuuucguugauuuuuaugagauuuguccuuaguugcccuaagaaaguuuuacuucuccagacuuggaagggcaacacaugggauguuugguuuguucuugaccuucugggguccaugaaggguggauggggacugggcugcagagagaggggugaccaggauggugggagugacccuggcugauagucucccugccucccacccugcagcggcuggacucuauuaccuggcagaacugauagaagaauacacaguggccaccagcaggaucauaaaauacaugaucuggguaaguggcaucuuucuccaggaguccuccucacucuuuugcccugccucaaaagcaggaaguggggagaguuuggcauggaugaugaggccugugucucugcuguuuccugagcauacacucuuaccuccuugcccugaacgcugucuuuugggucugcacuccugggcccagaucuucccuggccgccuuccccaaguggcauuguuucacugcaggccuugugcucuaguccuuaaggugacagcgaaguguacuucucuguugacaagaccguagauuugacuuugcuuagcucucucccgcugucuuuagcccuuugcucugcucacagcauuuaaaacuuagaggagccauaagacaguuuugcauauauguucauugccaucuuucuaaucggaucaagugauuuguccuaagaucggcacagcuucgcugcccucgcccuucccuggucucaugggaggcuucucuuacugaagacacaguccuugccacugauaucaaagccauaggggugacugcugguggacagacuuccuucagcugcaggaaaggcuggggguaggggugccauuggagagaaagcguccacagccccucaagucgccuggugucagcagccaugugcacucugggcauggcugagguugggaguucacaguggaggcaagacuauagcccucagcucugguccagaggcccagcuuguggguguuggcacaguaauuagcccuucauucagccaacugucauuugcuaagcacugacaacuguagguacuuaucaguaguguuuuucaaacuguaggcaugauucauuauuuggcuguauaguaggucacaaucagcauuuuuuaaaaaaaggaacauaaauagaauugaaauuugagcuuugaaucauauauauguauauauguguuggggucacaguguaaaauguuuuucuuuuucuuuuuuuuuuuuugagauggaguuucgcucuuauuacccaggcuggagugcaguggcacaaucucagcucaccgcaaccucugccuccuggguucaagcgauucuccugccucagccucccgaguagcugggauuauaggcaugugccaccaugccuggcuaauuuuguauuuuuaguagagaugggguuucuccauguuggucaggcuggucacaaacucccaaccucaggugaucugccugccuuggccucccaaaguguugggauuccaggcgugagccaccucgccuggcagauguuuuucuuacuguggguugcugucaaaaaguuugagaaaugggcugggugcgguggcucacaccuguaaucccagcacuuugggaggccaucagaaguuugagaccagccuggccaacauggcaaaacccugucucuacuaaagacacaaaaauuagcugggcgugguugugcaugccuguagucccaacuacucaggaggcugaggcaagagaauugcuugaauccaggagaucgcgccacugcacuccagccuggaugacagagugagacuccgucucaaaaaaaaaaaaaaaaauguugccuuuugggagcagagaaccuagcuggggaggccagaccugugaaaugaggagauugaagcaugaaccuagugcugcccagagcgggcuggggguuggugaguccaggaacguugccuggaagaagcgcccugcacugucugccucugguuguuucaguucuccaccgcuguacugauuggccucuacgucuuugagcgcuuccccaccagcaugauuggagugggccuauucaccaaccucgucuacuuuggccuccuccagaccuuccccuucaucaugcugaccucgccuaacuucauccugucguguggugagaggggacagaguuggggaggcagcugaugugguugggugugcccaucuccauccugggcacuaaaggggauacagaaaaaggaagccagcuguugaaguccuccaggaagccaggcuaguugggaagaugcgguucuuacugcugaggacucuagagcccaccuuggcucuagugaauagaauuuguuggggcuggggacucagacagggagggcuuucccagagagguaaguuugaaggagaguuugggaaagaagagguuguggauuggcugaggcagggcccccaacugagcaguuccagccucaaaaaaaccacuuggccagaaaaagcccaaagcccuuccgguaggcaggcagcuguccguccaguccucugacccaaagucauuguuaggacuggagccucauggggcugugagcaccuugcagacucuggccuggugugaaugccuccugggggcugcagcuucucaucucauucucacuggcugccgcugccucgggcuugagccuggauguggaggacccagucuucuuggcguugcccugccaccacuuucugacccuggggaaucauuggcccucucugggccuuagcuucuccaucuauucagagaggauguuucugaaagaacuauugggagacucagugggcauauaguaggugcauauagguauuuacagauauuccuggaaaaggcuucggaaaguauuuugguugccaagauugccauugcuccuguucaucauugcuggcuacccuagcuuucagucaggguaucagauggaguuagggguuuuuuagagugacuuuucuauuucuaugagagagccuggagggugaauauuauccacacaaagggcauauuguuaaagccaaaacugguuucuuccuugggugugauuucaccaaagaauuuguucagcagagguuuguuagggagcccuuccauggagaccaggccccucuguccagggaagaaguccugcccccagccccucagcagcaggcuccccugacuucacucccuugaucugcccuuuaaugccuaaaagaguuuuuccaaaagaucuugugggcaccaggcacuauccuaccucccauuaucucuuagcccuagaguguggcuaggcauagcagaacuguagucuuugccuuagaaugggagaggcaggagagaagaaaggagacaugagaauugcugugaggugugugugaggggacagucaguuucaggggacauguucuuucuggugccugcccuucaccucaccaugggaaccggcagggaugacugucucuugagcagccuguguccaggauaugcacacgugcccucuuuuauaaacucaguuacacaccaaggagggguggcuguguguguguguguguccagaacguaucaguucacaccgguaugccuuaccugggggcaggaugaggagggacccccucccccagaauguugaggaaccugaagacugcaccucaaagcaucuagcaagucuugcccuuuuauuccugaggagugagagccuuuuuauuugagcaggccuucuccuugcugcccaguuuguuuauuugagcaggccuucuccuugcugcgaguuuggaguagagccucuuaggggcgucuggucugcacacccaugauuucuccccaccugucacugugggagagcuuucuuuagcccucacauccacgaaaaacgagguucaucgucaugaugcuuuggauuauguaacauagaagucucacuuuuauaacaugcaaagagccuucuucuaauuuuacucagaaugcccugugcagugggcagguugaggcucauucucccauuuuagcagaugggaaacgguucuaggcaguagccuacucugaguugaguguaaagucaggccuaagacuccauggaggcucccaacuucugagggccuuuugaaguuaaaaguacagcuuucuguuauuccccuuaaacugacugacucuucauucccucaacaggacuagugguggugaaucauuaccuagcauuucaguuuuuugcagaagaauauuaucccuucucagagguaagaaguguccagcacauucagcuguuaacagggacaggguaguaaaagggaacuugcaugguuuacuuuauaaacuuagcuaugauuugaaacugaaucuguucaaggauuacauguuugaaaaaaacaaaacauagaugguuugagaaagcuguguggauggggacagacugugcucauuuggccgagguggggaggacacugcucuuccucagugaguccuuugggucccccucgaggggucauccugaggucaggaagggguacuagggugaccuucucugacacaguccucacagggcagggauggacugcaccccugagccccagcuuuucccaguggccgccaagguuuucuucucccacgauuucuccacacccugcugcuccaguuugaaccucugggaagagcaaggucacuucuuuggggggugugggucagucagucauggcuuagcacuuugucugccuccuucaguccaggggaguugcuuguccuagcgaccaagauaugggguuuguggccacauucagucauuuucagccuccaccuuuccccacagaaggauuuccaugucugaggguggcguucccugcuucccaggccugggcccccuuuggagaucagguguggcccccugugcacucuugaccaacacgcagucaccacacccagcccacucuuggcaccuccggggcacccucuucucagucucucuuguugccagguccuggccuauuucacuuucugccuguggauaauuccguuugcguuuuuugugucacuuucggccggggagaacguccugcccucuaccaugcagccaggaggugagaagggauuuguaaggggcccaggugggggcaagccagcaaggccuggguuggcagggguccacugagggaaccugaaucuagcccuguguuggagacaccuggacucgggguugggagggccguguucacacacaugcgcacacacacacacacacucucucucucucucauauucuugccuguaucuccacagaugaugucgucuccaauuauuucaccaaaggcaagcggggcaaacgcuuagggauccugguugucuucuccuucaucaaagaggccauucuacccagucgucagaagauauacugacccccaugcaggcaggauguggggggcaagaucaggagagucaggccccugggccucuaugccagguggggaccagaagucgggaaggcaccuaccaccugcccuggcuuucuuccccucaacucuggagccccauccccacccuccuuggggggcucagcuuggcucagaucugaugcuucaagaggcuguaaccucagagggcaccaaggaggguggcagagccugcuuagccaggaggccgaggucccucaguccuccccugucccuuccaaggugggucaggagguucuggccccgcuggggcaggcagggcagggucugugaagcuuaagagcagauggugacaaguucucugggcagguggccauggggaggggccauggcuuggcauguccaacagaaauaguuuuugcuguugaacggugauuucuguccaagugcagauuuccguuugaauaaagcuucgcuucuagguggcacuguuugccuuaauacccugacaguucaucuuccuuucuuccugcuaaccuucugcucuggacuggacucacuuuucugcuccagggacuccuuuucuggguuugggucuugcccuucccaagggacuguucuuguggcccuuaaugggaagggggcaggggugaggagcugagccugcucaaggagugggaaguggggcuauaggcagccucucugaugcacucucuuccaucucuuuccccaaggcuccgugacugucaaacugggaguaggagaggggacaauuuaggacugggcuagauuuucagaagaacaucuacaauauccuauuuauaaaucuuccucugggaaaaggagugguuucuggcugaauacuaucuuaggcucaaggagaaacaaaauaaaaauuagcuuccaggcagccuguuuuuaaagaaaugggacuaaugggagaagcuguuugucacucuaagagcauccaagcccuggcccgucugugcacucuuggcuccuggggagauauaucugccuucuaagaaggcaggccaggucuugggcacagaccugcauuuguugaccuugcacuccaacuauagugccuugcaagugcucaacaguacauauuggaaugaagucccuaugagagccauuucuggccauguucuauaccucaaagugaggcuggcagguacagagaugaacuguacacaugugauacauuuaagccacuggaaaaaccccugugcuugaaaauauuuccucuauaucaugccuggaguuccaucauagcccuucauuuccuuggcuuuagcauuuaccuucucuuaagaauaccagcuuuccccuuucccugagaggaagagcacauguuggucuccucuuagugugaacgagauugccaggcccuuuucuccuaugcacaccaggauagacaaggcaggggauacuggcagccugcaucauccucccauugggcugacagcuggcccuacuuuccucccucugcugcuuggucccucaccuugaugauguggcuucgcccccuccacucuacugccaguguucucccagggcuugcuaaauccagcagaccccuuuccugucuuacuagaucugggcagcauuugacauggcugaucaccccuugcuucuuggauggcacuucccuggcaccucuguggcuaguuguccuaccucccuggcuguuccuuucaggcuuccgugcaggcuucuccacuugcccaugcacaguagggucuuucaggguucugcugugggcucccuagggaagcccauccaucuggaugguuucaaggauggugaggaauuuagaguugaccuccagccccaacauccuuccugaucaccugaaccacaguuuugcugcccucuaggugcacagacaauucagguccauggcccagaugguacuugcugucuucugcaaaccugccccuucuggguacuucccuugaccccgagaucacucaggagccagacaggaaacuuauucuauuccuguuuucucuuucugcccaccacauccaaucucucaaaacggucaggucuaccuuaacaucucuugauuugagccacucccacugucaucagcuuucaccuggauuaucgugacagccuccuacugcuucucuaucauguggccagagcuaucuuccuaaaaugcauugcauaguugaucaagucacucucuggccuaaaaccuuccuuggcucccugcugcccucaggauaaagucuggaccccucagcauggcuugugagacucaugguguccuugucccugcucaccucucuggucucaucacuugccuucuugcauucugggucccagccuccuguauccagagaugcaguggcucuccauugccacucugauuccuccuuucuuuuggucacagagaaaggguacuuucucugucaaaucucaacuuagacuugacuuccuccaaggagcuuuggcuauacucucuccucccgacccccacccuggcauacuacacagaucacucugggcucacuugccugccuaauggucaucuccccaguagacuguaagcuccuugagggcaaggauuguguuggaauuuuuguauuaacagugccuggcuuggugccuggcaccuagaaagcacucaauaaauguuuguuuaaugaaugaa

SEQ ID NO: 14738 - RNA, 620 nt, Homo sapiens
gagaguaggauccaggguuaguuuuuguagccucagcuggcccgucagccucuggcgcgcucgaacuuccggcccuuggaguggacguaggguuugguguggcugugcgggguucccggggccuugccaaaaugcccguacaccuuucggcccuugagaggaccggagagcaggacggugcugcagcccuugcgggaguccacggccagcuggucgaaaagugaggaucuugcccccugcccugaggacgcggcugcgggccagguuggucacacucagcacacacaccuucaguuugggcaccuccugaacccgcacgucaucuguuaugcuccccacaaucacggccguuuuguuuucccggacaggaagcuucacucuucuggaucaucugggaaagggacagagguggccgguugguacgacucauaaacaaccucuucagcacaaccugguugaauguggagucgguucgucuggccagaaaacugcacagcuugaccaacagccucagguagauauccuggcucuugggcuccuugcgccgaaccuuucgguccuuguuguggcagaugucagcucccaugauggcgucuccugcucggccagguacggaaaga

SEQ ID NO: 14739 - RNA, 1774 nt, Homo sapiens
cgagggcucgcaggagcugggaggcgcgcaugcgugcagcucuuuggaggcgguagcguuuucggcgucgagacuggaggcugagugcuaaacuguguggggcgcggaugggauccagcuguuagucggguaggcauagguaggaccgcugcccuguggggaguaggggguuggaaggcggaggccgguaucguggggguccugagcccuuccugugagauccgggccgacuauuguaucugugucgcagcggcuccgcacaaaauggcggcgggcagacggcgggggcgggaggagguugggggacccccgggaugggaagggaagcugugcugugcugcccugcuccgucguuuauucacuucgcuacccgggagggcccguccggguacucgugaaggacccugccucgagaagagcugccugacgccguugcacugggccgaggaucgugaagagcccuuuggcgaggccgaggcggccccuuccccagcagcgcccggccugccgaggcugcgcugggccugacagccgaggaagcgguggugagggaaugccgagcagggaggaagcguucccgucgggcccgaagaggcgguggaguuugagccgagcccucugaccagcgacauugugcaagaagcguggagagaagagcguguuuguguuugggguuggggagggggugucgggaugaaggagggaauguuaggauccagcggcuuuuccgggcugguguucugugcugcguagugcagguaugaaaccaaagaaaauaucaccucugugggagacugaggacucauaaaugguugugauaccuaacaguauuuccaaauuucucagaggaauugugaaaacagaacguuagugaauuguuuuugugugauucuuagcuugggccccguucucuuaaaggaagggggaauguauauaucacagacuggaauccuugagaacguuugaaauagaucuuuuguuguuugagguaauuguuaaugagggauacuucaguauuacaaaaucauggauugagcuauagagugaaggcuaccugaagcuaauuuuucuuaaucuuaaaauuuguccuuaggcgaaguuuggggccaggaccagaaauuguaguaguuuaaaggagucccgaugaaaaacuugucaccaggauccagcgauuuauguucaaguacuuuuuccaacgagcucuggaauuuugcacaaaaaauuuucugcuuuuuccccucauuuguuguaaaggauuauuuuuucagggauguugugcuugcugguucagauuuacaauuaaaaauugauaaccuggagaaaaggauugaccaaaaaaaggugaauuuaaggaaguuuucggagaaaaacaaacauguaaaugacauucaaauagcuuuaaauuuuguuaaugauuagacauuugagacuuaguggacuuauguugcugucuuuuaaaaaaguuugacagcauuuuauauuuuauuuuguacuccauauucuguaauauguacuucuaaauaauuacagggcgucccagcauguuauacauuaaaauaugcugggccauuccuuccuuggggauuuauuugucuuggaaccaagaaaggguaaauauaacaguuggaagaaaucacaaaaucuuauucguuuuuauuaacuaguuuucauaauguguuuauggucacauauuuauuguauauugguuguauuuguuuuguaauccuuuuuugcauuuuguuuuggaggguguauacggcagguacucuagguu

SEQ ID NO: 14740 - RNA, 1774 nt, Homo sapiens
aaccuagaguaccugccguauacacccuccaaaacaaaaugcaaaaaaggauuacaaaacaaauacaaccaauauacaauaaauaugugaccauaaacacauuaugaaaacuaguuaauaaaaacgaauaagauuuugugauuucuuccaacuguuauauuuacccuuucuugguuccaagacaaauaaauccccaaggaaggaauggcccagcauauuuuaauguauaacaugcugggacgcccuguaauuauuuagaaguacauauuacagaauauggaguacaaaauaaaauauaaaaugcugucaaacuuuuuuaaaagacagcaacauaaguccacuaagucucaaaugucuaaucauuaacaaaauuuaaagcuauuugaaugucauuuacauguuuguuuuucuccgaaaacuuccuuaaauucaccuuuuuuuggucaauccuuuucuccagguuaucaauuuuuaauuguaaaucugaaccagcaagcacaacaucccugaaaaaauaauccuuuacaacaaaugaggggaaaaagcagaaaauuuuuugugcaaaauuccagagcucguuggaaaaaguacuugaacauaaaucgcuggauccuggugacaaguuuuucaucgggacuccuuuaaacuacuacaauuucugguccuggccccaaacuucgccuaaggacaaauuuuaagauuaagaaaaauuagcuucagguagccuucacucuauagcucaauccaugauuuuguaauacugaaguaucccucauuaacaauuaccucaaacaacaaaagaucuauuucaaacguucucaaggauuccagucugugauauauacauucccccuuccuuuaagagaacggggcccaagcuaagaaucacacaaaaacaauucacuaacguucuguuuucacaauuccucugagaaauuuggaaauacuguuagguaucacaaccauuuaugaguccucagucucccacagaggugauauuuucuuugguuucauaccugcacuacgcagcacagaacaccagcccggaaaagccgcuggauccuaacauucccuccuucaucccgacacccccuccccaaccccaaacacaaacacgcucuucucuccacgcuucuugcacaaugucgcuggucagagggcucggcucaaacuccaccgccucuucgggcccgacgggaacgcuuccucccugcucggcauucccucaccaccgcuuccucggcugucaggcccagcgcagccucggcaggccgggcgcugcuggggaaggggccgccucggccucgccaaagggcucuucacgauccucggcccagugcaacggcgucaggcagcucuucucgaggcaggguccuucacgaguacccggacgggcccucccggguagcgaagugaauaaacgacggagcagggcagcacagcacagcuucccuucccaucccgggggucccccaaccuccucccgcccccgccgucugcccgccgccauuuugugcggagccgcugcgacacagauacaauagucggcccggaucucacaggaagggcucaggacccccacgauaccggccuccgccuuccaacccccuacuccccacagggcagcgguccuaccuaugccuacccgacuaacagcuggaucccauccgcgccccacacaguuuagcacucagccuccagucucgacgccgaaaacgcuaccgccuccaaagagcugcacgcaugcgcgccucccagcuccugcgagcccucg

SEQ ID NO: 14741 - RNA, 4254 nt, Homo sapiens
cggagcaccugccauacgcaccacagguugcccaccucagugccaugugaccauugcccuggccuuggcuuaucagacccuaggcagccaccauaguccugucagagcugugagcuugcccggaacgagagcacugccuggagggagcguccugcaucaacuggugacugauugguccuaucagauauagagagggugaggcagagagcaaggacccccugagauaagaaagcaucugcaagaccagaacauaagggcugaggaugucugugcuugggugagcaagcagcaguaaggaccacgcacgugaugagaggagucaaggugcagaccgaggggggcaucagggucucagccaggccuggguucagguccugccccuccaccuuuucuugcuugucuuugguaaauccaagcuaaagccagagguagauagcagagugguuaaagcuggggauauugugggggcucaggagccagauacuuagacucaaaucauaaccccacuacuuaccaguguauaaccucaggcaacuuacuuaaccucuucaugccucaguuuccuuaucuguagaaugggagugaugacaguugcuaccacauaugcuugcuaagaggacugagguguauaugucuacauauaaggaccugguacaaauuauaaccgggucaugauguagcuucuauuaauguucuaguuagaacaguaucugccuuaaaauaagcauggugucaguuaaauagaucucuuucauaggacuguuggugggauuuucaagaaacaccaccugacaaugguaugcuuuugugcuuagcaaauguccauucccucuguuugugaggaacacgcauuugaaaccccagaauccuccaucuuuuggucaauuguuucacaccaugcuccugcagcccugcacucccccuacucugacucagcuucuugcuggggaccccaggcaccacccucccuggcuggcucagguccgagugcccuggugcccugggugugggcagcauaugguaugcucuccagagcacuuucuuauucaugcaccaaggauacugagaacaacagagggcacugaugagggguuggggguggggaugcuguggccacuaugugaccuuggccaggcuccuucacuucucugggccaauauccuuaucuuuaaggggggauaauaucuuugcccucuaccucacaaagcuucugugagcuugcaaugaauguauacaugcacaaaggggcugugaaguguggcuacaggguauuauaaucauguaaccaaaggaggggcuuuaugggacaacagauagagucugggaagagcagacccagcccagcuggggagggaaggcuucccagacugguguuuugcuuugagcugcaucccugagaccgaagucuucuguguaaucauucaccaagcugacccugccagggagaaggagagcgagcaggccugaaugucacagggaggccaaauuuggacauggguuaggagcuuggcuaaugcaggacgugaaauguggccaggggcugggggaggggagggacugcauuccccaggacugccuggcgguuucagugaugaccaggggugggggcuccagccagucucuuccuaggcucaggggcucaugacggauuggcacagaaaauguacuuccuuuccccaaggugagcugugugcucugggcccuggaaagggggagccuaccccgaagagccaggcagcaggcaaaaagcagauggggguggggagaggauucagccagggauguguaaaugggaggaugcaggauggggggagcugcuccacacacaggcccuuggggcugaaauaacaaaagaaaagccacaccagcagcacuuccugcacuucugggguuagaaagugccugccauuuauuauucauucuuuccuuucuccaaccagaggucugagccuagccugggugagggaccaugagguagaagccuaguguauugaguguaugggggugcagagggggcauguggucagggaagguggaagaaaaucugguucaggcugaguggaagccagaaacaaagccccugacagcaggggcugcugcagcugaguguacauuuggagcaccagcccccagguucaggggcuauaaauggggaagaggugcuggcgugggaggaggcugcuucacccacagagugccuguccucccuccccuccgccaaggggcuauuuacaguaugaauggugcccccuggaguugugcaccaggagcccagagcccucagccaggcugcugaacagggccacugaccuggccugcccagagcugaggaugcggagaggaagcaugaaagacucccauguccucccugcuggaaacaccuggauaaagcucauuuccggaggccacgugggaaacugauugagagcagaucaaagcagcacguuaggaaaaaaagcacagcuggagugccacagccacccccuugguccccacucuugguguacacugcuuuccaggccucaggaccauucagcaacuccuccucaagcucugcucugguccaacaaauccagaagcccugaaucucauacccaagagaagguacucaugacaugaucccuugcucaugcugagcuggacacaggccugugcuuucggagcuuuuauuccuuggaacaucacaggugucccacacgcuccagggugugcaugugccugggaucauaugugcagauggugucugugaacagguguauccaggagcuugugaaacugugcugaauggccagaaaccaacuaaugcuaugauuucuggaagucugggauguaguuagaagucagaucucuggggagaaggggaguggcagguaguggaggcugagaggaaaacccacaggcugggugggagguucacacucuuucccccuaguucuucucccccaguaugguuccaagcccaaagacccagcuguguagauccuagcucuggcuugguccugaaggguuccuggagagcagccagggcccagcccucagcuccuggaggaaaagucaagucauaacucuaugaaggcccuccuauaggaggucccaaucugauaagggaguggcuucccugcucaaggaggccucacucugaugauagaaagcagauacgacccccgcucccuccacccacugguccguugggggcagggguugggggcagagaaagucuguaaagguuggugcugugacagcugugcccagcugcuaaauuucccccauccugugcgcaaagcaaggguagggugccuucgccuccaguggcugccagccugccaggccagccucugagagagagcaaagggccaggaaagcagccaggcgcagaucggggcgggaagagagcuggguuauaaauaggccugggaccagaccuucaggggagaaggaggagagcccugcaguacagcgcuucgccgccggcaacgcagaaagaccucuuuucagagaucccgaaaaggugagaggagagaugcuggucccaccuuccuggccuaccucaguaccaaccugggcugaagcuuccaggagaagcgccauucagacaccucucuccuuccagccucaguuucccucugagucgcccucugcagaccugugucguugcaacacucaacgucagucuggcggggccagaaagucuccugucucucagcucuaggugcucuccaggguugagagccgcggcguccccuccucuaccccaccccgaccccgggcgaggguggucggccccuccuaccugcaaacaccgcggagcaguaggcaucgcugaugucggugucggguguguggacguucucggcauagaggaugaagacccucagcaugcuuggcgcguguagggccccgugcgcccagggcgcaaagagggcucggaaaggucgggagggccgaggcgccgcuuguggguccccucgcuggagagggcuggcugggcgaggccggcucgaaucucuggcuccuggcuuagagcaguugcucuuaaaggggaacgggccacccccggcugcuccagugggcuaggcuggguccccgccccggcugcgcucaccccgcuugucagccggcguuccgagaacaggggcuucugcucaucuuccacccccgccgcccuucccgagcuccgucgagcuguaaucuaaugcuccggcugcggagucucccaaugacacggcauuuugcaccuggcugggcggcggccgc

SEQ ID NO: 14742 - RNA, 25301 nt, Homo sapiens
ucacugcagcagugucgcugccagccacagccagcuuggggcacugccggugucccauugccaccgagcaggcuacucuuuuccaggccgugcugauuuggacacagcugucagcugcguucuucgcaccuacccguccucuccauuggcaaguccuuuuuuggauugcuuucacugggguuggguguggggugggaggaaaaggacugaguuuggggcuuugacaggggaugauggggguauuuccacuucuuuuugaaaauuccuuuugaggcaagucucugaagcugagauuucugagaugagguaugacgugaggcuuguuucauauucaggcaaaggggaaagaagcaaaguucuuucccaaaggccaccgccuucguagaaggcugcagaggagugggugaggggcucccuccucacuguuccucucugaggggcugggagugaggggccaggcugugccugcaucuggcucugccagguagagaugccuggauagugguuguuaucuaaaacaaaacgaaaucaaaauccgaagauaccuggggguggggugggagcaaguggcacuaaggaacaaagaaggagaagaagccagccuuuaggaaauaaacacacagagcccagaacccagcucuguuucagcaacacugaaacagcaggauggccucuccaaggcgcgggugggcuggguggguuucuggcaggcggugguuuucgggggucagugaauucucuacacagccucagagccccugaagcugcaagggguggggggaggagaagaguuuagccccuaaaggcagaauuccugguaccgcggugauuuccaagcugagcuggguugagugccaccauacaccccuauccccacccagccuggacagcagggaucccagccccugucagaacagccagggcacaggcagggagcgcccucuaagcugcccuugaggacugggcacuggaugggggcugccgaucuuguggcgccggcucuggagggagggcacgaagugggggaaggguaggcaccugggccucgggaugaauaucuggggccacaagcuggguuccaggggaaagcggcaucccugacccaccggagucacaguuucugcucuggcucuggagaagggucugggcaggaccugccgccccaggucccucuccuccauagcuccucagaaaugucguuuccccaugggacuugguaucuugcaggcaaagggccccgccacugucaggcaguguaccaagaagacuuagaacagaagggagccagcccgaggcccugggaagaaugagaaggagccgagagcugaguuuuccaaggacuccuucaugccagcaaggcaggacaggacuaagagcaaagagcucccugaggcgaaauccugggcuuugucccucaggcuagacagcccaaggugcaggccagaggcugggagggcuuucgcaaacucuucuggucccugaacacacggcucugccuccugcucacugccuccuggucucuuugcucucuggacucccuggccaguagggccaaguggucgucuugauccuggacauuuucccccuuucuguuuggcuccggguggaaggauuagaaauaauuuuaggggaaaaaaagcaaauuagcaucaauugaaaaaauucaaggccaaaacuauacaaaauugaguguaaaauugacagcuccuucuguugucggcuuuaguugucagaagcauggacauuaaacaaagagaaagcugccgaauggacaggaucucauggcuccuggagaugugugcuuguguggugggaggggaaacaggacaauacaguguguguguguguguguguguguguguguguguguguguguguguguauguguggcgggagugggcauugagggacucuggcccucuguuuucucaucaaugcaaaauguaacaaguaaaucuaauaucuaaaaauaguauuaucucacuauuuuaucucacugaaauauaauagcuguggaagagaauuacuggcuacacaggacugcacgcauguaagggacuuguaagggguaaugccuucauucuccuggguguagcaaguccagggcagacaguaccgcuguguagcuuugugucuuugugagcagcaggacuuuaggcagaccugccccuguaugcaguguuuucugagcuagggaagugggugcagaggcugugcuugcccauugccugcauauuccgagugccugaggccuaccuucuguauuucccaggcccuuucugccaaagacugcaaaugucaccaggcagagcuccacuugaaccagcaucuccuuacucaugucccaggcugcucugacugauuucaaagugccagaaaggcuacagggucgugugacgcaggcccugaacugcagcacugcaggcaauagcugaagccuggggguaugcucugggccuaugggaaagaguugucucugugugugugugugugugugugugugugugugugugugugugugugguggggcguggcagucugggaguuccuacaaccagcccggagggagagggaugaccacuaggcaacaggcuuaucaucccaaggcuagaaugaggcaaauauucccuccuagaacacacuugugcucccaagugccucagggguugagcugugccgcagcuuuggggcagucuacaaggggccagucauacuuuuguagccaaagugauacuugguaguacugggauucagucuggacuuugagacagggucaaucuuugaccaggauuaaggaucauucugggauuagacucagaggucuguuuuaggucaggguuacaggcuagacugagguuuggagcagggcucugucugggaucagagucagaagucuaucugagguuaaugaaagaaaguccucugauggaaucugacuggcaaagacaguugccgagcuuucucuguccuagccacccucuucacaagccuguccauggccucagcacccccacucuccacagcaccuccaggaagucuuagaguggaguaccaugcucuccuuuucaucuuuccgaaguacuuuuugagauuugagcagagaggcgguucuaauuaggaaauccagcaacuauugcuguggggcugugacaucccugcagacuuuccccaggaucccacuuggcacaggguguaaggacucagaauuucuccuccacaacccucccaacuccuccucuauaccugaacaggaaaagaggcugagcaguggaggacaaaagggcacaaagccacccccacccaggagugaggggaugggaggaaggcaauuggcguguugggggacuucuggggcugugauccccacacggcagacaccuccuguggucucuuggguugguggcuggaagguggguguuuugugacugugacaaugauccuuugugugugugugugugcucaguaucagccuguacaucuaucugcaucucuauaaagcugugugcaugucuguccuuuaggagauggagauuuccacaggugaguuuuccuggguuaccuugcccauuucaccaccuuguggccagugcugugucugggggucaggcuagauucuuagagcucuucaagccagcaagaccuuaacaaucucccccaaccccauuuuauguuagccucauccucagauagggugugggguggcucuggcacuuugacgugcccuguucagaugugacuguuuugugaaaccacccugcuucgagggugcuuccuagcccccuguuucaggaccacagugauccugacagggccuucguaaguguccggccccaagcauccugggguggacgucugaggucacugacacaggagcggggugcuuugggagccuacaacccggcccuuuggagcugaucucccacuaugaagggcgagugcggaaagggagcagagggaauuguuuccccgaaucuguaguacuauaacugcccaccaggugggguuccagggcagagagugaagccgaggugacccagcgcuaggagcuagaccagcguuuagaucuccugccacaccagccucggaagcgcucacacagggagggacaacacaucugugcgcaccuuagacgcucacacacauucucgucucgugaacucuaaagcagaacucguacugggugcaggcaagguguuaaaagcggagucuaguaucguugacacacacacuacucuaaacuaaagaugggauaucgacucuggcuccgggagugugagagugaacgccagagccaaggggggcugagggaagcaggaugcacgggagagagaggggcagacauuagcuagaccaaugucgggguugcuguacgcagcuccauguuaacacaggcucgcaggaggagaggccagaugacagaugcacggaugcgcagacacacucauggcucuacaaagaauacacaaacccacagacauaccacgucgcuccucagacgucgggccgacgcaaggccacgcgcgcgaacacacaggugcggccccgggccacacgcacaccguacacaggcacgcgcgccgggcccucugcugccagcgcugagaagguggccgugcucacccagcauguuuauuuacucauuuguaucaaugaacguuugugcccgucuucucccgccucuggguaccggggccgccgcguuuguccccgcgcaggacacuugccggaccaguaucgggguuccccgacgcugcgggcgguggagggggacuacaaaagcaggggaggggggucccaaugugcaggaaaggaggggcugcagagucagcagccugggacgcugacggggacaggagaaccuccagguuccguaggguaagagacauauggcgggggcggaccuuagcaucggaggugugaggauauagggaucgggaaugggggaucuggcuuagggggauugggacugguaacucaggggucccuggagauaagagccagcgggaucccggggguuggaagcucgggacccuaaggcacaguuucgagggcuuugggcgccugccagucgagggggcaguccggccaggaccuccgcugccggggcuucggcccaggagggacugcucggagcuggaggaggggaccgcugaccugggaaggaggaaaagaggaagggaaggagccuagaagccaagcaggcacuaagcgagugcgcaccgugugugcggagguguguguguugugugugugcgcguguguguugugugugugugcgcguaggugcgcgcgcgugugucucaucucguccgucuguaggcgcugggcucagcgagacgccggcgagaaagaagaggaggcgagaggugaacugaguuugauccugcggcggcuacaagugggucccgggcgggcugcgggcggcgggcggcgggcggccggggcggggcgggaggccgggcugcgcucuccagcuccggccgcgggcccggccucucaccacgccuccggcuuugugagcgcgcggguuggggcgggggggugcuggcggggcgcccacggcgcagccucccgccucuauauaaacacacgcaucgccucgcuuuggacucaaauucacauugagagaagcuuuuaaaaccaccagcccugaaauccugccuccugcuuuucccccucuuucauuccuuuugccuuccuuucuuuuuuccccauuucuucccccagcagcaacuccagagccgagagaccgcgucccgggacggacugccuuuucuuaauugauacaauagcccagcucggguuuuccaccuccucccccaaccccaccccgccucaccccucccgcccgcugccgccgccgccgccgccgccgccgccgccgccgccccaucgcccgcccggggcucugucgccggcugcgucccgucccggccgcggcccgccggcuccgcacccgcgcucgggccgcagcgcccgccucgccgccucgcccgccgcuccugccucgggggugcugcggcggcucuggggcucgagcgcgccgccccgggcagcccagggacuuuuaggcuccggccucuccacucgccucagccagggagcuuucucccucgcccccaaaguuucuggguucguuggaauuuuuggauucaggaauuuuuucuuuuuuucuuuuuuucaccuaggaauuuuggggccauacugcaauacuuuugacaaaucgaccgcacuuucucucugcuagcucucugcccccuucuuuuuuuccgagcaggggaaggggcuuacgagagagaggcucccucuggacaaaguuuuccaaaguuuuccgagugugaugguagcggggagagcaaacccaccagcuugacucacggcuucaucucaccaccccuugagcagccccuaagcccgcuauaaaggaacaaacaaacaaacaaacaaacaaaguugcaccccagucgccucguguuuccucucuucuuuuaggcaauuuuuuuccucccucucuccgcuccccucgcagccuccacucccuuucccuuggccccuuccuccuucucuguuucggcuggaggugccaggacccccggccgcagccuccccucccccgccgcuccgguccccucccgucgggcccuccccucccccgccgcggccggcacagccaaucccccgagcggccgccaacaugcucuuugagggcuuggaucuggugucggcgcuggccacccucgccgcgugccugguguccgugacgcugcugcuggccgugucgcagcagcuguggcagcugcgcugggccgccacucgcgacaagagcugcaagcugcccauccccaagggauccaugggcuucccgcucaucggagagaccggccacuggcugcugcagguaagggcgcgcucgcuccgcugcacuccgggguccgcuagcugcgagcgcggggcagacggagcggcgggccggccagggggcgccgggagccugaaggcacugguccccgccccgccccuucccuccucucugccgcagcagcccgggcuuccccagcccgccggcagcgcgguuccgggaccacuggcgcccgcggcgcagguucagggggcugguaagagggguucccggaccugagggggcucccaagauggacuugccugggucgcggcuggccuggcagggggcguggagcgccccgggggcgccuagcgaggcgcggucccgggggaggguccgguccugagccgcuuucgccuccccucggugcugcaagcccccagucgcccucggcuuucugggguuggcugugucgcugggagccgaaaauugagucgggagaggagggggcugguggcagcuugaauugccgauuuaaaacuguguuccugcggcgccgucggcagcgccagguacagugucccugguccgcgguccgcgcgagugugucuguuuugugguggaagaggaagaagguaacccaaggaaaaaugagaauccagggcucuaggcuuucggggaaaagggucuauuuacuuauuggguggggacaguuuggcaggagagggaaacuugggagaggugagugugggauccauagagagagagugcgugugugcuuguuagaugccgcacaaccccacucugcuggugauaacgggggugaggcgcgucagggaccagacccagguagguaauggggagauuaaccuggaguucaccucaucaagugccagacaaucgcuuuugcaaugugauacacaccgguuuucuucuuggggugggggagcggagcgccucugcaguaacugcgggagguguauuuguguguacgcgcguuuguucuguuaggggaagcagggauguccugaaacugacaauccccgcacuagagaggugaagcgaaaggugagcgcugcgaccuguggguuuacaggugcgaaagcuuggcuugaaauuaacagacgcgugcaauccgcgcgcucgcgcacacacgcacucacccugccccgggacgagugacagcggagcgggggcggggaggggguucgaaguuccucugcccuguggucuuuccacgucccggauuaggcccaucucuuuuugggguuguucgugcaaugagguggggguccuuucaaccaauggauguaucacccccccaccccccgcaaagaaauccccagagccuuucccucgccaccacacuuaaagugucaacugcagcggugcucuaggcuuugggccgcgaauuuaggaaauaaaauaacuugggcaacggcucccgccuuuuagagccagucugcugaauccacggucugucaccacccacccccacuucguuuccugaccucucugcccccccucagguccccaugaccuuuucuccgaaucccacaagagccccugggggucagcguccaaccugcacagaaguuagggaggaggaaaccuaagccuccccaucccuccaacccggggcccuagaucuggaggugaggagggaaauaggggguacguguacaggagcgccuaagggguuaaugagagcccucugaaucccagcguuauuuuuucggagucauuuaucagauuuuacggggggaccuccaagggcucuccguuuccaccgagcgccaucuaaacagagcccagggcuaaaaauacaacauuuuuguauaaauuggacucgcggcccgagcggccgccccuaugaaaguacucuuugugaagaccguggaaacggcggacaaauaacucuuuauuaaugccacaaaaaacgcacuuuaauuauaguuaggcagaucagaggcggggggugggggcgaggcggcggcgaccucggaaaauucacaacccaacuuuuguguugaaagaaaagaaaaacagaggaaaagaaggagaggaaagacggagagugagacggagcgagggagacggguauagcagacggagggagggaaacccucgccucaccaccccuucugucgcaccccaccuccgccuagauuuuucuuaaagggguagacgccgucuagaagggcugcacggcagggggaauuauccccgccuuccagccugggagggggacagcguucccgcggcccagccccccuccuggcugcgcgggcgcucccagcucguuccccgucgcgcgccgggccggaggcgcauguggaaaagugauuagggcuccggguucugcagagucacuuuucggcuguacuggcgugugugcacauuuagcuggaaguaguuuucuguggaaaaaaggaaagugaggagggggaccaacccgggcuagggggacugaguuguccccucgggggugcaggagcggguagaucuggagcccgagucgguacgcucgugggcuggcaggcggggcggcuagacagguggcgccccuccccuuugcgccgggugcugccccggcaggagaaggguuaacguggggugggguaacuagugccgacgucaaaggugagcgggacgcccuugcccccgccccucugaggucuccacgguuuccgguacccgcgcccggccggcuccgccagccguuucgagaguccggccggccccggccccgccauccucggcuugcgccgccaccaccggggaucugguuaccugcgcgggucgcccugcccggucccgccccgccccgcgcucggguuccaaacuccagggcggcaaccaaaguccgucuccguuauuuccagggcaaaaugcauuaggaaaaucgcggcucugggcccgugaccccgcccugcagaguccuccgagggccgccgggucccugcgcgggccacaccggagagcggaggaaacuccaacccccaucuguaguugcugccuccgggcaccgaccgcuuaccgcuauaaauaaucuuuggccugcggccaccccgcggggucucgccagcccguggcccggagccuggaaauauuuauuccgagaggcucccgagcgcggggugggggugugggggugggggugggggcggagacucccgcuucggguccagcuguccgggauaccucuuuccucucgaaagucauuaccaaaaaacagccuccugggggugccccugggccuccgccuccuugcauuauuuauuauccucuaggcccuacuucgcaguucuugugcacgcuaugaaaaauaaaaccugcgugcucgucugugugaguguguuugguggggagagggggcaggugacuguaccccggguugggguccgccgccccucccucgcgggcccucugcagaagugcacccugagagagacccggguguggcucccgcaggguucuggcuuccagucgucgcggagggagaaguauggcaacguguucaagacgcauuuguuggggcggccgcugauacgcgugaccggcgcggagaacgugcgcaagauccucaugggcgagcaccaccucgugagcaccgaguggccucgcagcacccgcauguugcugggccccaacacgguguccaauuccauuggcgacauccaccgcaacaagcgcaagguaagaacucugcccguuuucuuccgcgcaaucccucccccaccucggggcaaggaguuccuggagcccggggaauguccccuaccgaaucugugccccccuuugcacaccaugcuugaagacuccgcaguuccccgccgacaaggccucgaguccggauccagggccugcuccggccuccucuuggucccuuuucuugcuggccgacugcgucaugggcacccccaacgguggcuuggaagagcuugagcgugcggggucugggguguccaaagccuguccuugccuugcuccacagagcuggaaaaagaagggggcgggacaguuggccggcguucgccuuuucgccacguuucccagggaauuccgaggacuggagaccgaucauucuaaaaucaaagcuguccuucccaccacaggcugcuugaagggagucgcgggcaggcggcugcgcguggagguuggggacagcuugugggcugcgguggcggggccuggucagagaggugcggcgagccugggcagcggagcgcacgggucugggccgugggggaagggcgggcggggggagagcaggcgaggcacgagcggggaucaaagcgcacccacccccccccgaaagaggaagggaaaguggguguuuaucccuuggauuucccgagcgacuggaggaggcgcggaggaggcgcgcacgggacaggcccccgccccucccggcugcgcuaggcucccagcgcuggcggcacgugcuguuugaacugcaguaacccgaaagcggagccagcgggcgggcccuaagccgccgggagggaggcugcgcgaccucucccacuccauuuuuuuccacugggucagaggacucacccagguuugaaaccuaaggaaagggagaggcagccccccgucccugagcgguggcagaccggggagguggggaggcggacucccuccgucaggggccgcaugugcuguggucuuggcgaagguggggagcgcucuacuagccgacgcauccuguagcacuugacguucucugaacagccugugaaggguaauucuuaacggcagacaaaagaaggagcggucaaaccgaggagacuggguugcaucccugcccccacccccguucccuuauacagcauguauuucaggaacuggaaaggggcucccaaaguccucucuuccaucugccccacuccuagcuggaagcaguuaccacagccugggggcggcgggagaggaguucuggggaguggcuggaaggggcuguaggcuucagaaugaagccucggcuuuucaaaguugcgggcacuuauuuuucccucagccuuugcgacuccaccagaggcccauuccaaagagcgaggagaguggagacucggcuccaaaagagauggcugcuuccugaucucugcuuuacagaggcuuuggccagagggguauuauuguccccuuuucauggaaggggccacugaggcguagagcgguugaaugagacuugaaccaggucaggagacaaagaaaauuucggggagagccugcaacacuggacugcagcguccgugggaauagucucugggccccggaggagaguccucuucuguccugcaugccuggggcugcuggaagcugggguggacagugagugcuaggaggaaggagguguggccaggaccagagugugagacccuggggugcagagggcuuuggggugagggcguugucuugggguuccacccacccugggccugacuuggccucgggccucccgguguuggcugggaagggcuugccuggaaaaccccaagguuuuuuggccuacauuguccauuuagaggggagggagaaggaagggagggugcagaugacccgccucaggaaugcgguggggggaaggggggaugcugggguuggggucggggcagaaacugagagccuuggcugaggcgcgauggcucccuauucagaacagccggucuuuuagcucccuggggguggguggggagucaccagaagcugguucauccugccagaggccugagagccaaaugcagggcccccucuuuguguguagcaguuuuaugcuugccacguggggcauguugguggggagggucgaaugagaaauggguagucagccagaugaaaggauccuuccccccaaaucucccuaacugaugauuucaguuuacugaacuccaugaaaguccuggaacuagguagguagaaucuagcuggagacuagaacacucagggccacuguuucuaaauauccaugauuguccuggagagaauggcucaucugcugaacccaaggcccggugaacucacuguggccaaggugggggcugcugugugccaugcacaccucuuuauccgguccaugcugcaguuagaggccuggcugcagugugggcugcugggccaggacuggccugguuaggagguacgugcaggaaguggggcccaggugugcuggggccuggcugguggggaacuggagcgucacuguuuccauuggggcugguggcccaccccaccucugggaggucugaccagauguguuggagggggcuucucacugccgucacugcacuccagguguuugcccuggcugcccuggugguccugggccagcaggggugggguugccagggaaaaaguccagaaagucuugcccagucuaacagaaucaucucuggaagccaggccuguguccuugcagccagggccucagacucccucccuccuccuggguuacccuuccccugcccagggccugggguguaucugauggaugggggagggaccccaucccucuuuguguguagagaggcuggaguauugccguagaagggcagauggagucugguuaggaaggugggggugagacaguuguccaaaacauggagaaggagcuagagaaugguucuagaagcuuccugugcccagcucuacccaccaggauugggccucuccuauuuuccuuuggagauaggacuggaccucagugcaccaagaggccagcagcucagggcaccccagacaguggccuggagauacccucagggaaccuggagaguauuucaagggagggacuuagccuuggacuggggagaccucaggaaugguagucuugccccuucuacccagaccccugccuacaggaccuucugggccugaagccaaggugggggacuaggcuuuggagguagaggucaagaaacccugccuguccacccaccaucccugaccuuuggccccaucuuggaaacccugugcuccuggggucuguguugggauggagaagcgaggaggugccucagcaggaggacggugucaggaggacccacgguuguggggucccggggaaggcuagcccacacuuggcucuaggaggcauuuggaccaaggcacagccucuggcuacacagucauguccaccaggcucagcucagggcagaagguccaaccugcguuggaugaaaggccaguggcacagccaggcagcucugcugcugggagcucugccccagccccuuggcauaggcacaacgccuuuguucugccaacacaaguccuucacccaaaaguuacuguagcaccagcgggugggcacaggggcugcugaggggggcggguagcaggagcggaucuaucugaaggucagugggggagggagcccacggucagcugccagggugccugggagugggcaccucccucugcaugcccuugugccaggcagcgggagggugggcggccuggauucaggggccagcccuuccgucugucccuccuuucuguguccuucucccaaggcagggagggguccaaggcuguggugcugauguguuugcucacucucccagccuuggaagaugaagguggccuuggcagggagugggaaggcucgguggggucugcccuggcccugggccccccaugcuggcugcuguaucuguccuggguucccuaagccuaaaaggaagcagcugcaggacccugagacaugccgggaccacaccagaguggcggggacagcuggccucacccucagaguggacuucaccguagaggacgauccccuucaggacccuuugauaaauucagagcccaucagggcuggcagagggcagcucuauggagucugggguggugggaggcagggaguucaggacuucugguggguguggccagccacgcucuggacugugaccuugggagggccccuacccauccacagcuuucuaaggcggguuugugguggcuggaagcagcagagguaagaguggccaagcaaaucucagauacuguggcucggcaagugucugccaagugcugcccgccccucccugucuugcccaccuugugcuguagguauguguggaagaguuagggcaguggggagcaugucuccaggugagaugaucacagcuggagucaaaucgcaggcaggcgcuuugcuccaaccgcuggagccuguugggggucugggccagccuccucgcaaccagaggggcugaguguacccagccccacacacccagauuggacauuuccaguucugggugaagcugccuggcauuuccacugggccagggugaagcugaggcagccaggcagcugggaagaugacguccucucuuaccccccuugcuugaauauaaaguacacaccuuggcgucaccccugugcggacggcugccucagcggcugccugcccucuguuauucuuuccacucugcaggccgaggcuccgguggcuuggccggguggccugcccaggcccccaccccuccugggcagccgcuuccauuccucccagucugagucacuggccugggcaguggguccccacuccggcucuacccgcuccuacugcccauccauauguccaucuguccacaccugccagcagagaagggggaggcuaucuggcugagcaagcgcagcacgcagggccaugggguucacagagcaacuccccucccagggcacggggugagaggcaggaggggugaggaggccugguuggggagaaugcuuuuguagaaacaaugauagggaaucugagccuucacgagccccuggcgguaccccuagacccuugugggaucagcucccacucuggagggagggagagaaccaaggguguagacucaugagccuauuguguccuugggggcuuggcaggggaguugcccaaggccaucccuuaaggcgagugcccuccucccuccugccugagccucuggggcugcagcagguaaaccuggacaugcgcuccugggcuccugugacagugcccuugcucuccccuggcaccagccgugguggggaguccauaccugccacucccucugcagggcuuggccugagccugggcuggcucccagugaccuuuguccagcauucuuggcugacuuuugggaauuccgagggaagccccagaaggaaacaaagcagucguggcuccugcgaugccuguggucagggaaguagcuccgggccaggaacccuuccucucuucacagggagccgcuccccggcaccuucccagugugcccgaguccugaccccagcaggugauggccucagacccagcccgcccugacgccgcccuggccgcccucugccccagccugcgccucugccuccgcccauccuuuguggugggcggugguuucagagcugccccggcuuugggaagugccuguguuguuaccccccgggcacagacccagggaugaggcucuggaggcuucccagggccugggaggccccuaugucuguggagcagcugggcaagaggcaggggcauggaccuggugaccucugagcccagccccuuggggccagugugcccuccacccaucuuugcuggccuucucauuugggcgguuucuccaucucacggugggcucugaggagcgucacggacagccuggcagaaaggcccucagaauggccagucgggccucucaugaacccagcggggaaacagcuccaggaggggcagcagccugcuggcugucacucagcaagucagacgccggccaagacaguguccugguccugccuucacuuuccuuuuagaagccccagccucaggggccugcaggugcuggguggcaguggcuuuuccggcuuauucuagcuccuggccuugcccauggaccccuuccccccaggggucagguguggaccccugcccuuggaguccuucucucaguccagucccaggucccccggggcccuucucucuuccuagacugcuccugccugcccucuagggcccccaaggccugggaaggagcaguucaaccagccaucgcuagagggcgcaggaaauggaacccacggggcagggcagggcagggcuugucugugggugaggugggggcccugcgugcucccccuuuugaaacccugggauggccccuccuggccacuauggcccacguggggugugugaguaggggcuggaaggcacuccccaggggauucgagcauugccaaguucugggcagcuuugaagggauagcaucugcuuaggggcaggugggugcugguguuuaggugcucaguggauugaagggaggccaucugguuccaccucacuguuuuacagaugaggaaacugaggcuugggggagcagauagccacuuggccaugaucacacuguaaguugcuggaugaugcacaguuacaacucagccccuuuccugucaccccacugcaucauagagcccaccagcuucgacuuuggcugggccuggugggcguggccuccagggcaccgggugagaggcaggaggaccaggucugccaugugcugggggcccuggccagccccuacccugcacucuucgugacagaaccccuaguagguccugggcuggcuguuucugggccagguaugaccuuucuggcccucccugucccaccucuggcaucccugucccgccauggaggccugguagccgcagagugauuuuccugccccugucuuguuuccugaugcacuuuucccuccugugugcuacucucugcccacccaguggcucucugcuaucuguaaggggcccuucauuggccagcgcuggucucuagaagaagugcccccucucauucccccaagacccuucauuugcccaagggcugaaccuggaauccuaaggacaugaggguuggggguugaagcaaacaagcauugccuuuauccaucacucucugaagggaggcaguaguuagaguccccuggaaauucccucggacccccaaaacugggcaaggugugaaugacccaucugggcuugggcugacccaggcgaccuccuaucguccuucuaccucucagcugucccuuuguagcaggagcggccccaaacaguacaggccucucugccccucgccggccuccugcccucccuccuucccuccaccgggaauuucggaaugaaagugcuauugugaaugccuggcugggccacugaagggccagcacuguuauuucugcaaaccagcccucccauuagccaugcagggccuaggccaggaaaauguuaccuuuccuccccgagcugacugcaggggaaauucucacauuuacaguuuaugcggugguuguguuugggggggcaguaggggagggcggcgcgugugugugguuugcaugggguggaguggggggcucccucuucugcacugucccuccccucccagccuuugcuuggugcugguagcaggggugcucccccuucucaucugaacucuggugggauggacguugcugcuuaugagcgagacccacaggcuuuugguaaauaaacuaacgugcuccccucuccuccacacaugaaaaccugugcgggggaguccugggugaggaggguggcaaggggggcugcgcagccagccgggaggacggaggacaaggagguggaaacaggacucacuggcugcguacaguggcccuggaagaugcagggaagucacagggcuucuguuugucuuuaugaucuuuagggguggaaagccauugcccccaucucccccugcuuuuggaccuggccacacugaagaccuuuucauggcacagcuguuaauaaacuuacuagaaucugcacccaguagguguuuuccagcaaguaaugacaauuuugguucccaggaaguccugcuugaggucuagucucaggcucucuugcuguaccccauggaguagcuuucccucgauggccuuccccuacuucccuguacaguccaacgacugugcuccacuucuccagggcacuuccguccugugucccgggauuccgaaaugggcuucugcaauggaagggcagccgcccugcucuggcccugcccagcccccacuuaugccccucacaagccacaucccccaaagacuugcuggcagcuggccugcccagcucccaaggcuuugcuguuguguggaagcugaaguucucuccagucacauucauuguucaggcagagugaggggcuggccaggggugggcugugccaaucggcucacccacuugccucucugccuuccaggucuucuccaagaucuucagccacgaggcccuggagaguuaccugcccaagauccagcuggugauccaggacacacugcgcgccuggagcagccaccccgaggccaucaacguguaccaggaggcgcagaagcugaccuuccgcauggccauccgggugcugcugggcuucagcaucccugaggaggaccuugggcaccucuuugaggucuaccagcaguuuguggacaaugucuucucccugccugucgaccugcccuucaguggcuaccggcgggugagcacccagggccugggaggagaggagcaggggcauccaugagcccccucucuggggguggguggcugaccugaccccugagaugggcaccuaggcacagggcacauggacaaaggggagaggugucagcgugggguaggaggaggcuggagucgucccugguggucccgaggcucagaugggagccugcccuuccauaugagugacagcccucaccucugcagggcauucaggcucggcagauccugcagaaggggcuggagaaggccauccgggagaagcugcagugcacacagggcaaggacuacuuggacgcccuggaccuccucauugagagcagcaaggagcacgggaaggagaugaccaugcaggagcugaagguggggugggcgugugccccucacgggcagcaccagcacccaggcuccauucugagcuuucccuggguggaaaugugcccagccauuucuacccccuguagucuggccccacacaugcuuucugagcaguggcuggagaccuugaaacuggaagcgaagucuguguccccaccccugcugugcaggaugccguggggcacccucccuucucuccccauggccugcagggagcucaggccugggaaugaucucaguucauuuccuagucccaauaucccuggaaggccaucuagggaaaggcaggcccacaaggggaaaccacuugcuugucaccagccucagcccuuggggaagagcaggggagauuuggaugugagguauccucccccacccccagccuuuucagguugcuggcgccuugcaugcccucccacccucccccccgcccccuaggccccuggggaucccggcugugcuccacgcaggaccugcuugcccugcuuuaggcggauguuucacccgaggagggcucacucgcccauccccaccugggcucugcaggccugcuccacugcugggugcccauggacacucacugcagccuccccugcccacuaucuuugccuccccauauucuagcuccaacuucuuuccuggggagcuaggaagagcuggaguggcuuuuccacuacaagaagcuuugugauuuauggauguugccauggccaguaauggacccaggucccuucauugcccucucugggcccagaguccacauuuguaaaaugcagggugugcuaugagauagccugcuggggccuuucuguggggaacccauggcccugguguccugcuccccagaaagcccuggcggggucuuuagguccucugggggucgccuucccucagccucaucccaggucuccaggggaguggccccaggcucccucccagaccccauuggcuccccugaucacccacugaauguccuccuccugcgauggaggaaggggcuggcacugggagugggaaggcccggguuuagacucacaucccccacacauacacacgcacaccugcugcgcagggccuggcuccuugggauuuguucuuuuucuccugugagcccacugcauaucaggccuguggggcuggcccaggaacccagcagugagugagaaguggcuccacuccaagggacucuaggccagugcuucugcccucggucacagcaguugugucuucugcccagcuagggacuggcugugacccccguguccaucgugacacuaaugccccggcaacaugaagcucagaggaagcagaauucacugcaggaaccaggcagggcccagcacagaugaccugggcacacgggccacugacugaauggggcggccccugccuggcugaacccacaccuccaacaacaccucuccucugugcccugcaggacgggacccuggagcugaucuuugcggccuaugccaccacggccagcgccagcaccucacucaucaugcagcugcugaagcaccccacugugcuggagaagcugcgggaugagcugcgggcucauggcauccugcacaguggcggcugccccugcgagggcacacugcgccuggacacgcucagugggcugcgcuaccuggacugcgucaucaaggaggucaugcgccuguucacgcccauuuccggcggcuaccgcacugugcugcagaccuucgagcuugaugugaggcugggcccguggcaccgggggcgaugggggagcaggggcaccgggauaggggcaaggcggggcaccagccuccauuucagggacuucaggccugauggggaaacagugcuugcuuucagggagcuuucaguccgaugggagaagugcgccccaaaugcaucaggugaagccaaguugggugucauaugugaagucacaugugcacaucuacagauaagggcuuggacuaacaugcugaauggggcaggcuggccaggccuugggggccacaguggggugucucuaagaaaaggcaggucuugaacaucuggggcugagcagggagggggcaguccugggcccucugugggcuccucuggcucucaccacccacuccucggcccccaucuugcuccaggguuuccagauccccaaaggcuggagugucauguauagcauccgggacacccaugacacagcgcccguguucaaagacgugaacguguucgaccccgaucgcuucagccaggcgcggagcgaggacaaggauggccgcuuccauuaccucccguucgguggcgguguccggaccugccugggcaagcaccuggccaagcuguuccugaaggugcuggcgguggagcuggcuagcaccagccgcuuugagcuggccacacggaccuucccccgcaucaccuugguccccguccugcaccccguggauggccucagcgucaaguucuuuggccuggacuccaaccagaacgagauccugccggagacggaggccaugcugagcgccacagucuaacccaagacccacccgccucagcccagcccaggcagcgggguggugguugugggagguagaaaccugugugugggagggggccggaacggggagggcgaguggcccccauacuugcccucccuugcucccccucccuggcaaacccuacccaaagccagugggccccauuccuagggcugggcuccccuucuggcuccagcuucccuccagccacuccccauuuaccaucagcucagccccugggaagggcguggcaggggcucugcaugcccgugacaguguuaggugucagcgcgugcuacaguguuuuugugauguucugaacugcucccuucccuccguuccuuucggacccuuuuagcugggguugggggacgggaagagccgugcccccuugggcgcacucuucagcgucuccuccuccugcgcccccacugcgucugcccaggaacagcauccuggguagcagaacaggagucaaccuuggcggggcgggggcugcguccaaccuggagauugcccuucccuaugccacgguucccacccucccucaccaguuuggacaauuugaaauuaccuauugcugcuacuuguucuguccucugaccuuggggcaaaggagccccaggcccugucuccccagcauccucccugguggcccugggcaggugcacugacacccccaccuucccauccccugcugaaccaggcccuguuacacacagccgccuaaggcccgcggcucaugugcugcccgcccccauauuuauucacugauagagaaucuuggggaugcuggggucuggagugaacaucuccuccccuucaugcccuagccuguguucuagcuguccuggcgagacuucugugagugaagaggaaggggucucuggucaaacccagcccccagggccuaggguugaaagccuuccccggcuccgggcauuauuuggguuuaaucucggagccucacuccuggacugaaguccggugccucugccuuaucccugguggagauggaauguggcccauugccuccucccucuccugucaaaaacccugaucagguagauuuggaggcggccacgauuuccuguuuggccccuguucaccccagugcacuggcccugacuccaggcgugaguauggggaaggauacggguucuucugacggggagcaagggccuccgucuucccuuccuuaacucucccccuuugcccuccgcccugaaaaagguguccuugaagucccuuccaccucuaugccacugucugcuuagcccagcucagggguggggaagaggcgaaagcgugggggaggugagcgcagcggcaguucugccucggagcugauugcagggcccuguguggucuccggacagcugcgggaaggcugccgcagcugaagcugaagaggcggcuacgugcgguuugucagggggauuggguugaaaacuggccagucgggaugacugggugaaagaggaguagcuccugccacuggcguuuugaguguuggcaauuugggaugccuccuggggaagguuuccgggcguuuggugagucucuagauuuuuccuugcuuucuguguuuauugguuuuugauguuguaaaagcaaugaauccccuuuacaagaaaaucgaaaacacagaagaaugaaggacaugccaguccccgaucgcugcugugagcaccucaguggcucccucagaccagaucccguaggcagccccacagaccgacccugaccccacucacagccacccugaagauagacuauaggaacgggcccauaccacacagacugcucuccaaucccugagucucagauguuucauuuauuuccuacuuuuccacuacuaaaaaacaguguggaauagacauuauuggcaaaauugcucaucccuaauccugaaaaacaggccagaauggguaaagacuugucaaagcuugcaacauagcuacauggugcacccggaccuguacccccuccccccaacacaaaaccagugucugggagguucauuuuccuuuaaacugauccagcuggcccugaaccaauuguuuuugacugaguaucuaggagagcaguaaguggaacuucagacaagcccacugggucugguccaggugaggggcagggggcauggggcugggaggucucaggggccuucccuggggguggccagccugguagggggcagagaaggaaaagcugaggggggucccugugagggaggaaagaaggaucauuugccccgcugggucucaaaggcagugagaagagagcugaagaaagcucuggcuggcugacaggaucccuguguuguaauuggucccuccuuucagcucucuagugagaugcccgugucugugcgugugcguguguguuucauacagcuagcauuagaugggugauguuucuuacuuaucaucccuaacuauugcaacuugaccuuaaaaagacaaaaccccacaaaacucuuccugccacgggcuugcagauugaagcacuuucgauguugggcgcuggcguuuguguucugggcaccaccgugacccugcccagauggcuauaauauuauuuuauacacaaaccuuuuuuuucauaaauguuauaauuuugugucugucuuuauaaacuauuauaaguacuauuuuuguuauaauucaaaauagauauuuaguauaaaguuuuugcuguuaaauauuuguuauuuaguaaaauaugaauuuugcucuauuguaaacaugguucaaaauauuaauauguuuuuaucacagucguuuuaauauugaaaaagcacuuguguguuuuguuuugauaugaaacugguaccgugugaguguuuuugcugucgugguuuuaaucuguauauaauauuccauguugcauauuaaaaacaugaauguugugcauuuugugauuuuggaaauacucaauguggcucuucuauaggcuucuagaauaaaccguggggacccgcccuugucucc

SEQ ID NO: 14743 - RNA, 1281 nt, Homo sapiens
ggcucucugcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucagc

SEQ ID NO: 14744 - RNA, 2219 nt, Homo sapiens
ucuuuaaacuuuaguuuccucuucuauaaaguggaaauaaugaaaguaucuauguuguagaguuuuugaauuuaaauaaaauaauccagauuuucugcuuacuauagugccuggugcauaaagaacacucacaaacguuauuauugaauucuuuuuuguuuucuuuuuaagaaucaaaaggaugguaggaauuuucucauuuuaaggguaaaguaaaaauuucaaaguuaucuuugacgaaucugaaaccagaguuuacucacaggguuuuuuuauuuaaguggguuuaagauugugaauaaugcuagcucucagggggaagucucuaggcauguaugagauuuauuucaguaacaccgacuuuggguuuuguauuauacuucuuccuaaguuuguuagagucacuaaauuguuaagggaaucuagaagaucagugugacagaaacuuccgucagugucaaaugaccagggacuaauaaaucuaagaugauuuuuuuuuucuggcacaguuaauaaucauuuagaaaugaucuuuauggaacauauaaaugaaaaaacauucuagcauaucaggauuccaguucugauauuaagggggaauaaaagagccauaagggaaaaguguagugggugggggaaguccuugaaaaguuguuaacuuggguaagggaaauaccaguaucucuguggucuuucaggaacaaaaaacaucuuuugcagagggccuaguguuugagccaagauauaaagugcccuucauggcugacuggcucaaccuccaguuuuccuagggagaaguagucagcauugcuucaguauugacagugggccgcaaagcacuuaccagugggaagcaaggaaaugauggcugaagcaaggaaugaaugcuguuauuucuuaccagcagauagguacacaccacuugcuggaaugauucagcaauuuaaaguuaagagcuuugagacuucaugaguuacacacggggagcauaggaaccaggagggucagcucuguuggaauacuucugggauugcucuguucccuccugcuuugaaucacaagcugaugugcaguuguaggcuuuuucuucuuuuucuccucacuccuaaucuuauccccaaggauccuugacuauuuauaauagaguauucuagacagcagcagguaaaaauucucaggugcuggggggccaggggaggggaagggaggguaaagaagguguuucaucuaucccuucaguguuuacgguacuuccaucuuuuaaaagugacauuauucuauuccaccuugucucccuggaaaaaagcaggccucuugucuggaucuuuucguuuuaaugauuuccaugaaaaggcuuuuacccaggcucugacaugacugucagaacacacauuuaaaugugaaacugcuuaaaaggccauugauauucccuggugguaaagaaagugcucuuaaaaaaaaaaacaaccaaaaaaaaaaaaaaaccaucuguccguacacaaguuaacccugacuauuuucuuucccucccacccacuccucuucuaccuaguguugcuucucauccuccucuuauuuuuuaugggggagagaggggcugaugacucagguuaaagccaggcccuuguuccaacaaaauuugugugucaccaucuccuagaagcugucauuuuuagacauugauggcugugauuaauuucauucagauccaaguauacugaguggggaggaggaaugcuuaauuuugaucuaaggcugauguucgaucucaacagacugcucguuuugaauuuggggcucaucuuucuuuaugugucuuggauauguuagcagaagucaauaaccugugugacagaaugaugcuauuaauauauacaacaggaauuguauguauguaguauuuauaaucaaaagcauauuuugacaugaacucacaaauuguuaguaggaauuaaaauuuauaucagauugcuguucuauauaagccaucuauuauagcagauggauucuaaaguaacagucagauauuugaaagauuuuaauuaauugauaggcaugugaauauggagcugucaacuugguuggucuauucuauuggugagagaauauuaugucuuaaccauuaaucacuauguucauuauucugucucuuucucacguggaguauguugguuuuaaugaagaaggaagagacuuaagcauaaaauccauaacaagaa

SEQ ID NO: 14745 - RNA, 2069 nt, Homo sapiens
ucuuacagcauggccgccgguacugcagcugccuuagcguuuuugagucaggagagccgaacgcgggccgggggugucgggggccuacgggucccggccccggucacuauggacaguuuuuucuucgguauuagugaagggagaggcugagggugguacuggggcgguaagagguagggaugugaggcgggaaugcggaggguuucaaggcgugggugugggcggagggcugcuucgcuguucccgcaggagagggggccucgcacgcacagccaaaggggguggcgagaucccugccccagauguguugggcggggcccacggcagagcgucccagguguucugagagaagagacggagguggacguguaaaugacccguccgcccaagguuacacgugacggcggguuggugacaucccccgcugcccagccccguacacacgcucaggcauacucacuguuauuucuaccaggcugugagcucuccggccacacccgcuccuucaccuuuaagguagaggaagaggaugaugcggagcacgugcuggcacuaaccauggugaggggcaggggagugggguuuuaaugaauaagcccaggcaggcaauauaggucucuacccaaccuccggauccccuuuacuuggagacacauccucagccuaaccccccggcaugggcggcuccccuggccaggugaaccgggaccucugaggcugggcaggugcuaggguagaugccuuuaguuguggugucaacccucacuugaggagacccugaggcccuguguaccguucccagcucugccucaccgagggagccaaagacgaguguaaugugguagaaguuguggcccggaaccaugaccaucaggagaucgcagucccuguggccaaccucaagcuguccugccaacccauggugaguuccccagcucugccuuggugguggugguggugguggugaggggauugaggacguuagcacucauuacaguguggggugggcuaggagugggccaggccuucauccuugucuuccucccagcucagucuggaugacuuccagcuccaaccaccuguaaccuuccgccugaagucgggcucuggcccugugcggaucacugggcggcaccagauuggugagaagaggggagggcccucuccuuugcuuccaguggacucucccaucaggcuucccccacuccgcacuccugccccaucccacccucaucucccagugcagcccuguacaggucugugugcccuccacgcugugcccugugcaugacaugcccucuccuuuccgucuacucaagccuaccuccuccauggaacauggcccaacuucuccagcuccaauaaugaagacuccuuuggcucuuugugacccaguuuagggucugagguucuucccaccuagcccauaagcacugggaggucauggucccuguaagccuaacaccacggcgugaagaaauggcaugcggugugaaacggucuggucuuaacaccccauccuucuacugcuuguguguccaccaguuacgaugagcaaugauguuucugaggaggagagcgaggaagaggaagaggacagugaugaggaagaaguugagcugugccccauccuuccugccaaaaagcaggggggcaggcccuagcccuccuaggugaguugcggggagaagugccuagcaggcucugggaaggggcaggagaagcaggugagggccuaaaugcugauuccuuguuuccucuuuucaggucagcuccaugugccaugcaccgccaugcacccuguucccugacaaguuucaacaauuguaaauauuucuuccuugaagaggagagcuuggguggggguugggugggagggacuugggucuuuggugcuaggagagggccugugcuccacacagccgugguuuucugauuuucaccaugcccggggccucccuucccaccugccugugagaauuggagguuagugccugaagcucagagcuacacauuuuuaauaguuuuuacauuuuuggauaaagguugaaauaaagugguguggaguu

SEQ ID NO: 14746 - RNA, 2069 nt, Homo sapiens
aacuccacaccacuuuauuucaaccuuuauccaaaaauguaaaaacuauuaaaaauguguagcucugagcuucaggcacuaaccuccaauucucacaggcaggugggaagggaggccccgggcauggugaaaaucagaaaaccacggcuguguggagcacaggcccucuccuagcaccaaagacccaagucccucccacccaacccccacccaagcucuccucuucaaggaagaaauauuuacaauuguugaaacuugucagggaacagggugcauggcggugcauggcacauggagcugaccugaaaagaggaaacaaggaaucagcauuuaggcccucaccugcuucuccugccccuucccagagccugcuaggcacuucuccccgcaacucaccuaggagggcuagggccugccccccugcuuuuuggcaggaaggauggggcacagcucaacuucuuccucaucacuguccucuuccucuuccucgcucuccuccucagaaacaucauugcucaucguaacugguggacacacaagcaguagaaggaugggguguuaagaccagaccguuucacaccgcaugccauuucuucacgccgugguguuaggcuuacagggaccaugaccucccagugcuuaugggcuaggugggaagaaccucagacccuaaacugggucacaaagagccaaaggagucuucauuauuggagcuggagaaguugggccauguuccauggaggagguaggcuugaguagacggaaaggagagggcaugucaugcacagggcacagcguggagggcacacagaccuguacagggcugcacugggagaugagggugggauggggcaggagugcggagugggggaagccugaugggagaguccacuggaagcaaaggagagggcccuccccucuucucaccaaucuggugccgcccagugauccgcacagggccagagcccgacuucaggcggaagguuacaggugguuggagcuggaagucauccagacugagcugggaggaagacaaggaugaaggccuggcccacuccuagcccaccccacacuguaaugagugcuaacguccucaauccccucaccaccaccaccaccaccaccaaggcagagcuggggaacucaccauggguuggcaggacagcuugagguuggccacagggacugcgaucuccugauggucaugguuccgggccacaacuucuaccacauuacacucgucuuuggcucccucggugaggcagagcugggaacgguacacagggccucagggucuccucaagugaggguugacaccacaacuaaaggcaucuacccuagcaccugcccagccucagaggucccgguucaccuggccaggggagccgcccaugccgggggguuaggcugaggaugugucuccaaguaaaggggauccggagguuggguagagaccuauauugccugccugggcuuauucauuaaaaccccacuccccugccccucaccaugguuagugccagcacgugcuccgcaucauccucuuccucuaccuuaaaggugaaggagcggguguggccggagagcucacagccugguagaaauaacagugaguaugccugagcguguguacggggcugggcagcgggggaugucaccaacccgccgucacguguaaccuugggcggacgggucauuuacacguccaccuccgucucuucucucagaacaccugggacgcucugccgugggccccgcccaacacaucuggggcagggaucucgccacccccuuuggcugugcgugcgaggcccccucuccugcgggaacagcgaagcagcccuccgcccacacccacgccuugaaacccuccgcauucccgccucacaucccuaccucuuaccgccccaguaccacccucagccucucccuucacuaauaccgaagaaaaaacuguccauagugaccggggccgggacccguaggcccccgacacccccggcccgcguucggcucuccugacucaaaaacgcuaaggcagcugcaguaccggcggccaugcuguaaga

SEQ ID NO: 14747 - RNA, 1024 nt, Homo sapiens
gccgaccugggcgccgaggccggcuugcagcagcugcucggcgcccugcgcgagcucccccggcccaaggggcugcagcgacugcugcuuaucaacaacgcggguaagaccccggggcuggagcggacuccccaugugagcgcccacuuccuccaccgcuggggaauuuaagggcuacuccuaggggucagauaggacgccuagaaaucuaaagcccuaguuguuccagcuugaguagcaaguggaggcgagguguacaggaagacucggugccgucgggacaacagucugcccccacuuccuggaaaauuggccagccggguuuuccaaagcgccuguagaacuuucccgagccccuugcucugcgcccucuggcggaggccugagucagggcuuggagucuccaaacaaguaaacucucugcuucuccaaaggaccgcuagagcuuuccuucagccccacggcaaggcaggugccuucucauucugcagcuugggauggcuagguuccccagcugugucuuuccgcagagcuggggaagagagaagccucuucagaagcgcuaggcagcuuccuccucuaggucugcaugggaagaggauaucuggaggaacuugggagggcuggggaagaagaaagccccgccugcacugaguuacuccuaaggguugguuuuucaggcucucuuggggauguguccaaaggcuucguggaccugagugacuccacucaagugaacaacuacugggcacugaacuugaccuccaugcucugccugacuuccagcguccugaaggccuucccggacaguccuggccucaacagaaccgugguuaacaucucgucccucugugcccugcaaccuuucaaaggcugggcgcuguacugugcaggaaaggcugcucgugauaugcuguuccagguccuggcgcuggaggaaccuaaugugagggugcugaacuaugccccagguaggugggaaguccugccgucccuguccuccagaacccacuggugcgccucu

SEQ ID NO: 14748 - RNA, 2852 nt, Homo sapiens
ugggagcuugcuuucuuccuggggaccuggcaggggcucuccccucuaccugaaaaguucucuucccuuucugugguuuugcaagccuaggugugccuuucacauauccccagagcacccuauguuuucucuucucaugauacaucugagcuacagcucaggggcuauuuguggaaggaaugcaguuagaggaggugauucuagggccagauccuuggguacugaccucuaucccaccuaacaggugauguacugcagugcagaaugucgguuggcagccacugagcaauaccaccagguccugugcccaggccccucccaggaugaccccuugcauccucucaauaagcuucaggaggcauggagguagguuucuuuuccucucuucuuuccuuuauccuuuccucccugguugccugccugggcucaucagguguugccgucuuucuuaaguuccaauuccccggauuuuucuuccuuucuuaggguuaaacagaagucacauaacccuauccccugcuuuuaaucugggcugucagucuuucuguccuuagcauuuaacgcucucccagaaagagccccauuaagccaauagggaugcaaagucuugccuaaguccuugucuaugacuuuccugguaauugauggaauugguaggaaguuuucucuguaccagucagacucggcuucccugagcucagcuacuagggagagaauuucuaggccaaucuuuuuucucuuuccccaggaguauucacuacccaccugagacugcaagcaucauguugauggcuaggaugguggccacagugaagcaggugagcccacccaacccucucggggaagcugacuuuggccccauucaacccuuggucucagucuuuuccucaccucaaagcccuagcuuggaugcagaguucuuccuggccuucccaaaggagagcuccuugcuauguaaaaccuucagaaugcacucugaaggcauagggaguggagagcucguuuugccuguagucuuuuuuuuuuuuuuuuuuguaacuuaaagaccagugugauaguaugccuguaguuucugauauagaagaugccuugugcaguagcaauucaugcauuugauuuauaagcaccgcuuuuucaggauuaugucuuacauaaagcgagagaagccacucuaaccacccuucuauuaauauuguuccucagccucuuucuccuguuuuccaaguguuguugaauuggcuaucuuggcuacaacuggggagaugguugugggugggcagcauugggaggaagccucaggcagaggaagggccccuauaaguuccuguguagugguauuucccaagugggcgggagugccagugagaagguggguaucugugacccuuaaguauguuuguucacugcaggcgaaggacaaggaccguuggaucagacucuuuucccaguuuuguaacaaaacagccaaugaagaggaggaaauuguccauaaacuucugggagacaaauucaagguuauuauucucccguggccugucuccuucccuccccaaauauccuaggaugucucuggccagcuguggggagcaccacauuugaucacuucugagcuacaggaaggaguuagaacuuggguccagaaaucgauucagaggaguuacauuccugccacuguuuacuucaugaccucauguggaccuacaguugggaaguggggugacaacagaggaagggcaugucagaugccuugcccugaaagugcucccuaacugguguuagaaggcaggacucgucauaggauagcagugggcaaaucagguagaauggggccgcagaaucagagagcagugugaaacugcccauguccugagaacccguucccaaucaaagaguauggguccucacugaggacagcagacuucccugcaggagcugccugaggguggaggcagguguguacaagguuugcaucuggggugggcccucuugcacugaacuuuuauaggaagggagugggagagcccagcuggucuggaggccaggucaagggagauuugaugguggugguguggauagacauuucaggcugccucagccuugcugguacaagugcuggaaaauggagagaaauuuggguuugccaccccggguuggaacaggccggcagacugccaaagcucuuuggagguagacucuguggccuuccuuugccccuacggaaagcucagucuacagagcuggcccuuuuuccuucccuccccuagucgccugggcccugccugggugcuaaugggaaauccccagggauacaagucucucccugcuuccucuaauccagggccaacuggaacuucugcggagacucuucacagaggcccucuaugaggaagcagucagccaggugagugaggagagggugggaccaguggccuccuuguuacuccagcucuccaggagcaaucaggucaucaucuccuacugggacagcugagccaaagccgacuuggucuucuggaguucagaugagccugacucacagaaggcuucccaaacagagaguccaauuggaagaaaagucaguggcuguaaugagcacucaucucuuuuuuccccccacagugguucacuccagauggauuccggucucucuuugcucuuguugggaccaauggccaaggaaucgggaccagguuagaauguuccagagcuauugaaguuacucucaggggugggaaacugaggaagguagccacaguuccuuucaagacugggaugggguagggugggacucuggacagaucacugaacuggacacaguggugggaaucagaaugaggcauuggaaucuguuu

SEQ ID NO: 14749 - RNA, 2852 nt, Homo sapiens
aaacagauuccaaugccucauucugauucccaccacuguguccaguucagugaucuguccagagucccacccuaccccaucccagucuugaaaggaacuguggcuaccuuccucaguuucccaccccugagaguaacuucaauagcucuggaacauucuaaccuggucccgauuccuuggccauuggucccaacaagagcaaagagagaccggaauccaucuggagugaaccacuguggggggaaaaaagagaugagugcucauuacagccacugacuuuucuuccaauuggacucucuguuugggaagccuucugugagucaggcucaucugaacuccagaagaccaagucggcuuuggcucagcugucccaguaggagaugaugaccugauugcuccuggagagcuggaguaacaaggaggccacuggucccacccucuccucacucaccuggcugacugcuuccucauagagggccucugugaagagucuccgcagaaguuccaguuggcccuggauuagaggaagcagggagagacuuguaucccuggggauuucccauuagcacccaggcagggcccaggcgacuaggggagggaaggaaaaagggccagcucuguagacugagcuuuccguaggggcaaaggaaggccacagagucuaccuccaaagagcuuuggcagucugccggccuguuccaacccgggguggcaaacccaaauuucucuccauuuuccagcacuuguaccagcaaggcugaggcagccugaaaugucuauccacaccaccaccaucaaaucucccuugaccuggccuccagaccagcugggcucucccacucccuuccuauaaaaguucagugcaagagggcccaccccagaugcaaaccuuguacacaccugccuccacccucaggcagcuccugcagggaagucugcuguccucagugaggacccauacucuuugauugggaacggguucucaggacaugggcaguuucacacugcucucugauucugcggccccauucuaccugauuugcccacugcuauccuaugacgaguccugccuucuaacaccaguuagggagcacuuucagggcaaggcaucugacaugcccuuccucuguugucaccccacuucccaacuguagguccacaugaggucaugaaguaaacaguggcaggaauguaacuccucugaaucgauuucuggacccaaguucuaacuccuuccuguagcucagaagugaucaaauguggugcuccccacagcuggccagagacauccuaggauauuuggggagggaaggagacaggccacgggagaauaauaaccuugaauuugucucccagaaguuuauggacaauuuccuccucuucauuggcuguuuuguuacaaaacugggaaaagagucugauccaacgguccuuguccuucgccugcagugaacaaacauacuuaagggucacagauacccaccuucucacuggcacucccgcccacuugggaaauaccacuacacaggaacuuauaggggcccuuccucugccugaggcuuccucccaaugcugcccacccacaaccaucuccccaguuguagccaagauagccaauucaacaacacuuggaaaacaggagaaagaggcugaggaacaauauuaauagaagggugguuagaguggcuucucucgcuuuauguaagacauaauccugaaaaagcggugcuuauaaaucaaaugcaugaauugcuacugcacaaggcaucuucuauaucagaaacuacaggcauacuaucacacuggucuuuaaguuacaaaaaaaaaaaaaaaaaagacuacaggcaaaacgagcucuccacucccuaugccuucagagugcauucugaagguuuuacauagcaaggagcucuccuuugggaaggccaggaagaacucugcauccaagcuagggcuuugaggugaggaaaagacugagaccaaggguugaauggggccaaagucagcuuccccgagaggguugggugggcucaccugcuucacuguggccaccauccuagccaucaacaugaugcuugcagucucagguggguagugaauacuccuggggaaagagaaaaaagauuggccuagaaauucucucccuaguagcugagcucagggaagccgagucugacugguacagagaaaacuuccuaccaauuccaucaauuaccaggaaagucauagacaaggacuuaggcaagacuuugcaucccuauuggcuuaauggggcucuuucugggagagcguuaaaugcuaaggacagaaagacugacagcccagauuaaaagcaggggauaggguuaugugacuucuguuuaacccuaagaaaggaagaaaaauccggggaauuggaacuuaagaaagacggcaacaccugaugagcccaggcaggcaaccagggaggaaaggauaaaggaaagaagagaggaaaagaaaccuaccuccaugccuccugaagcuuauugagaggaugcaaggggucauccugggaggggccugggcacaggaccuggugguauugcucaguggcugccaaccgacauucugcacugcaguacaucaccuguuaggugggauagaggucaguacccaaggaucuggcccuagaaucaccuccucuaacugcauuccuuccacaaauagccccugagcuguagcucagauguaucaugagaagagaaaacauagggugcucuggggauaugugaaaggcacaccuaggcuugcaaaaccacagaaagggaagagaacuuuucagguagaggggagagccccugccagguccccaggaagaaagcaagcuccca

SEQ ID NO: 14750 - RNA, 6250 nt, Homo sapiens
cucuaugguucguuaccaccgacucggugcggcuagaaggaccugaggcugggcuucggggacucucuagugaggggcguucauuaaagaggggucgccgcauuucggucgugcuucuuagagcacggagggucuuugcucggcccgcaucaccuacuaacuuaauuccacccuccuccauccccggacgccagaccaaggaaugcaauaaaggcaaaagugugggacgcaaagugugggauaggcuggugccaaagcacuuuacgugagcgaucucauuuaauccucacaacccuauugcguugguccuauuaaggccauuuuacugaugacagaaaggaggcugagaggucaagguguccagugucacaguuacauagucagugucaacgggacgagcgugggaagcugcccccaaugcccguuuucuggcuuugcacuggccagaggcuccucguggauggcgugcgccaggccgcggccccagcgccuauccacggugagcgcgcaagcguugguggcacugggcggaagacccccuggcgcaagacgagugccuucccgugaaggcguggggaggagggaagcgcagcugggaggagggaagcgcagcugggagaaggcuaaucgucgucaaucgaggcggccuuggaguggacaggaccgagaccgcaaggguuaacggccucgacuaucgacagcugaagcaaguccggcuacgggcacaccuccagugcuuguccucccuggcccgcccaccgccagcgaggacccggagaguaugcuggggcggggcugaggcgaaggccgguuguagcuguuaagaguuuaagccaaucagcccccggcuccacuucucucgaccaauaggaaguaggcuaaggcgcagaggcggaaaguguggcuacaugagcaggcgucagagccaaucagccuugagccucguucccgucguccagcccgcggcgagagcggguaugugggcgggaggccggagcagcugucaggcugaaguccugcgagcgacgcgcggcggggcggcgagaggaaacgcggcgccgggccgggcccggcccuggagaugguccccggcgccgcgggcugguguugucucgugcucuggcuccccgcgugcgucgcggcccacggugagcggcaacgggugggacugcguugcagggcggggcuggccguccagcuugcgcgcgucucggguugggggccaagggucaccuuggggacccugcgaguucagagcaggacaggucugggagcgggcggccggaauaaguggguggugguccaaggacauaaagugggcgcagccugaggcugaagcucugacuccucaccuucccacgacaaagcagaucuccccacucgccccuccccgcccacuagcgccgacccaggugacuuagggugcgaccagaagggacagcuaaggaaggauacuacaggcuggagauauguaugugagcauucacauguacacaggagcacacauuccuacacgugggcacacacgcacaaaccguuuacaccuacacaagcacauaaauguauacaucuaugcacauaagugagcacauacguauacccacaacuuacacaaauaagcacacacaaaggcaagcaaggguuggggaggagggagugaguuugacgcuaguccaggaaggcuuucuggggguguauuuguauccgagagggaguccccacucccaggacuguauagcccagugccaagccaugggagcucuaacugauggcugugauuugggcaguaaacaaagacagcuaaagccuuaaugccauccuugguacacaguagugacuugguaguuuguugauagacuaacagacuugugacagcaguuuucuuuuuuucuuuuuuuuuuuuuugagacggagucuugcucugucgcccagguugcagugcaguggcccgaucucggcucacugcaagcuccgccucccggguucacgccauucuccugccucagccucccaaguagcugggacuacaggcgcccaccaccacgcccggcuaauuuuuuuguauuuuuaguagagacggggguuucaccguguuagccaggauggucucgaucuccugaccucgugaucugcccgccucggccucccaaagugcugggauuacaggcgugagccaccgcgcccgcccaugacagcaguuuuuaucuuucaacauuccgcagucucucuggguuaaggaaaccagggacucaaguccagguacaacauuaaacuuuggugcugaggagaagaucccaugccccagaaaaaucuaguggucuggaaauucucuucaucggugcuguggagcuagauauaguuguucacccauucaggaaaguuuauagggcuaucccuauauuguagccacugugcaagacacuggugacucuucacugaaugaaguuacaaaguggaagaggcagauauuuaaaaauuaugaauccagggcaggugcgguggcucacgccuguaaucccaggacuuugguaagccaaggugggaggaucacaagcccuggcaacaaggcgagaccccauuccuauuuaaaaaaugaaaaaaaaaaaucagccuggucaacauggcgaaacccucucuacuaaaaaauacaaaaaaaaauuagccaggcaugguggcgcacgccuguagucccagcuauuugggaggcugaggcaugagaaucgcuugagccugggagguggagguugcugugaggcgagauggcgccacugcacuccagccugggugauaaagugagacccugucucaaaaaaaagaaaaagaggccgggcgcgguggcucacgccuguaaucccagcacuuuggaaggcccaggcggguggaucacgaggucaggagauagagaccauccuggcuaacacggugaaaccccgucucuacuaaaaauacaaaaaauucuccgggcgugguggcgggcgccuguagucccagcuacuccggaggcugaggcaggagaauggcgugaacccgggaggcggagcuugcagcgagccuagaucgcaacacugcacuccagccugggugacagagcgagacuccgucucaaaaaaagaaaaaaagaaaaguuaugaaagcuguauaauuacaaauuauguugaaaguccccauuuauuaaaaaguacauuugaauggguaugggagggcaaucaugaggcagaagcuuucucugaggaagugacauuuaaggugugaccugaaggaugacuaggaaagagucagguaaagggguggaaguaggguggcgugggaguagggggccuuccaggcucagggaacagccugcagaaagacccagagaagugaagacacugaaaggccaguguagcuugaacacaggauggaggagaugagguuggaagaguggccaggggccacagcaaacagggucuuguaggccacaguuuaaaaagaguuuaaauuuuaaaugcaaagggcaguuauugaaacccuagguauggugaugugcucauaauugcuaagauguuuucgauuucugguuguugcuuggggagcaagaauggaggcagggaggccagguaagaagcugagcugucaggacaagagaugauagugacuagacuuaaggggauggcagugggaccagaaagucaacuuuuaaauuuuagugagaauugcuuuguacgcaggccacuacaucucuacccugaaacucccaggucuucagagcaaaaauacuaacccuggagcucucaguuuuccuggcuuacugcguaagcagcagcagcagcugauauaagccucugggguuaaugacucugcaucaacucuauccuccccaggacagaggccaucuagcccccaacccugccacuaguggaccccguuggcugaagccaggacccugagcccagacuauagccagcccagcugaagacacagggucugggaucugaaccugaaccagcuuguuccugggaggcuucuuaccuguacucuuuauccuucaggcuuccguauccaugauuauuuguacuuucaagugcugaguccuggggacauucgauacaucuucacagccacaccugccaaggacuuuggugguaucuuuguaaguuaagggaggccccugaucucugauccucaaccucccccuuccccucacugagcugcagugacccucucaucccaccugagugcugggacagggaagggagcagaaucagcucugccuuccaugagcugcagcacagaaaggaagcucuuccagcuacuccccugaguauaauauaaaccuaggcaccauggagggacaaguugucuuuuuaggggacaugaagugaaaagccaagagcaccagcuuccucugccagcucuaccugugaacuaugugacuuaaggcacaucacuuccucucucuggaucuacaaccaaguccccugccuaucucauagaaggguagggugguguaggacaaccagauaggccuuugcgagaauuaaguaaaaauguuuaagugucuggcgauacagaaaccacuccauguuuccuucacacuuuauaaggugccaauaagaugggauugucagcccaguccuaaagcaggugugucucauuacacucucaccuguccaaauguuaaauguuuuucagcacacaagguaugagcagauucaccuuguccccgcugaaccuccagaggccugcggggaacucagcaacgguuucuucauccaggaccagauugcucugguggagaggggguaaggagugggcaggcaggacacgaggagugggcaggcauacggcagauucugagauuauugguaguagugcuuugaaagagcuguuuuugaaaauuucaucuuuuuaagcgucuuuaagaaaugucuagccugggcaacauggagaaacccugucuguacaaaaaauacaaaaauuagcugggcaugguggugcacaccuguggucccagcuacucgaggcugaggugagaggauugcuugaccgcauguuaaggcugcagugagccgagaucacgucacugcacuccagccugggcaacagagcaaaacccagucuccaaaaaaaaagaaaaaggaaaaagaaauguauuuaaauuauccaugcuuuuagcuauuuacuuaugagccuuuauaacagauucuucauagucugccuucuauacucccagggugauggucuggggaagggggagcuaggaccugucuuuccuuuggucuuaucaccaccucuuccaggggcugcuccuuccucuccaagacucgggugguccaggagcacggcgggcgggcggugaucaucucugacaacgcaguugacaaugacagcuucuacguggagaugauccaggacaguacccagcgcacagcugacauccccgcccucuuccugcucggccgagacgggugagggcuccuugccucuggcuuuaucagcaccaggcugggcgccaugacugggucagggguaaucaccagucccuucuugcaggccucaacuuggggugcuucaguuagagggcaaaaaaagaucucgggcuuuggaacucccagauugauggggacaguggggcaugaugggguaccaagaaagugaccgucaccaccucucuucaugcccucccagcuacaugauccgccgcucucuggaacagcaugggcugccaugggccaucauuuccaucccagucaaugucaccagcauccccaccuuugagcugcugcaaccgcccuggaccuucugguagaagaguuugucccacauuccagccauaagugacucugagcugggaaggggaaacccaggaauuuugcuacuuggaauuuggagauagcaucuggggacaaguggagccagguagaggaaaaggguuugggcguugcuaggcugaaagggaagccacaccacuggccuucccuuccccagggcccccaagggugucucaugcuacaagaagaggcaagagacaggccccagggcuucuggcuagaacccgaaacaaaaggagcugaaggcagguggccugagagccaucugugaccugucacacucaccuggcuccagccuccccuacccagggucucugcacagugaccuucacagcaguuguuggagugguuuaaagagcugguguuuggggacucaauaaacccucacugacuuuuuagcaauaaagcuucucaucaggguugcaacuguguccuagaau

SEQ ID NO: 14751 - RNA, 2719 nt, Homo sapiens
guaagcuuuuagcacaauaauuuuaauugcaaaaauaaacaguuuugucaacugcuugagaguagcgucugcuuuacaaaaauuaacaacaacaaaaggaaaaaaaacccaaagcaaaacguuacauccaauggcugcuggauaagacacugcuguacaaagucccgcgcgagaccgccuuggcgcugccccagccugucucuggggguuauagaggaaggcguggggcgugugccaguuacaaaagacugucuugaaucccaggguagugccuauucacuggguggucucagaagacuucccccaaagcgcggcugacaagggugacagcgccuggaccgcgggaacuguccgcggagcuggugcugaauagggcgugugcggcgggcgcuucaaggaaacuggaagcgggaccggaggccggcccucgggcgugcgaggaggaguuggaagaagagcggggaggggaacggcccggaacucgugcgcgccgaacggcggcgccccaacccauaaacccaucucuugcucagagagaagcgaaggagaggcccagcgaguaaaagccgaggcccuugagccgcuccucggcgcgcgccuucugcuugaggugcaccuugcugugccguuucuucucaucgcugcgcgcgaagcggcggccgcacacgucgcaagcaaaaggcuucucgccggugugggugcgcacgugcguggugagguggucgcugcggcugaaguugcggaggcagaugcggcacuggaaggguuuguggcccguguggaugcgcagguggcgauugagcucgucggagcgcgcaaagcuccgcacacaacucuccaccgggcaagcgaaggccuuggcgugcggccgcgggcagaagcagcgcgugcugcauuugccgccgcggcgccccuugcgucgcgccuuggccugggggaaaggggugggcggcggcggcggcacggguggugcagccacgccacugcuuccagggauguccgccaccagagguuuagggaaguccgccgcggcggcgcugcgaaggcccagcggggaaagcugaggcugcguacuggccagaaacucuccgccgucgccgcuacucccucccuccccacuaggaggggucaggagcccagggaggcccucagcccccuccccuaagucacccggggccagcgggaaagcgucauaggccccgcugggauagagucuguuggcugggacggccggcaguuccgcagggcagcugauggacagcaaguccucaaucuuggucccuauuacgggaaaacgagccuccggggcggccugguagucucccugugacccacaguucccuggggcccccacagaaagcagcucccagggcgcguagggacccuugaaggcagagacagcguccagcgcuggcgaggcgggaggcgcccggaggccgggcuugacgucgggcggggagagcugaggcucauacaggcacugcgagggggcacccgcgcaaggcgaggccucccagaacgccucugggaaaggggcagcgcccagauccggggaguaaagguccggcggacccggcagcaaggcaucggaccccgcaggaaaaggggcauccagcggggaucuggacgcugcugccucuggaccggggaagggugccaggccuaagaugcccgacaugagguugaagagugccuccgggucgugcggguguucgggcacugccugaaugaagaagcuaccgcuguagcugaggccgggagggggugugggcgcaggccccuccaggaagcaggagucggcuaaguccccacuugcgccgcagcuguucaaagcccagcucaagaagucgccugcugaggagggagcaggaaucagcucugggcacaucaaagggugcaccugaguccacagccccuaccuacaaaacucuuggugcccacggauauacacaaagugccuuuugcacauucugauucagcaggggcccgcauacgucccaaggagcacauagaaacaugcacacgcaaaacacacgugcacaggcaaaagggcgcuccgauaaccgcacagguuccugcggaggcgcuggcggcccagugugggugggaaugggggugcgcaccccaggacuccuaagcuucccaucgccccuauucucauagcuccaaugucccagucccuccugguucucagguauggugcgcccccgcgcugcgccgucgucgucugagcaccccugcucgcccuccuuaccuccaggguagccgguggccgcgggagcgucccuggcaggcagccggggcaauucagcgcuggguucggcgcaacagccuucaguggacuugacgaggagcgcgucggguucggaaaacucgcuaagguggagcauggcgcggcgccggcuguggggcgcccggggccucgcccgcugggcuugggggcgcgcggguggcggggaggcuggcgguagggguuccccgcagcgcacagaccuaggcgcccgggcuccuggcuucgggcacucaccucugggaaaggagucggggagccgcggcgcccucgcucgcccgcaccggccucgggcggcggcuccucgccucuccaaagcgcugccgggcucccccagcccacagcccccccacuuauauagcugcggcggcgcuggcuccgggcuuccgacuccccgggccacugccauuuugggaggccccggcccug

SEQ ID NO: 14752 - RNA, 2719 nt, Homo sapiens
cagggccggggccucccaaaauggcaguggcccggggagucggaagcccggagccagcgccgccgcagcuauauaagugggggggcugugggcugggggagcccggcagcgcuuuggagaggcgaggagccgccgcccgaggccggugcgggcgagcgagggcgccgcggcuccccgacuccuuucccagaggugagugcccgaagccaggagcccgggcgccuaggucugugcgcugcggggaaccccuaccgccagccuccccgccacccgcgcgcccccaagcccagcgggcgaggccccgggcgccccacagccggcgccgcgccaugcuccaccuuagcgaguuuuccgaacccgacgcgcuccucgucaaguccacugaaggcuguugcgccgaacccagcgcugaauugccccggcugccugccagggacgcucccgcggccaccggcuacccuggagguaaggagggcgagcaggggugcucagacgacgacggcgcagcgcgggggcgcaccauaccugagaaccaggagggacugggacauuggagcuaugagaauaggggcgaugggaagcuuaggaguccuggggugcgcacccccauucccacccacacugggccgccagcgccuccgcaggaaccugugcgguuaucggagcgcccuuuugccugugcacguguguuuugcgugugcauguuucuaugugcuccuugggacguaugcgggccccugcugaaucagaaugugcaaaaggcacuuuguguauauccgugggcaccaagaguuuuguagguaggggcuguggacucaggugcacccuuugaugugcccagagcugauuccugcucccuccucagcaggcgacuucuugagcugggcuuugaacagcugcggcgcaaguggggacuuagccgacuccugcuuccuggaggggccugcgcccacacccccucccggccucagcuacagcgguagcuucuucauucaggcagugcccgaacacccgcacgacccggaggcacucuucaaccucaugucgggcaucuuaggccuggcacccuuccccgguccagaggcagcagcguccagauccccgcuggaugccccuuuuccugcgggguccgaugccuugcugccggguccgccggaccuuuacuccccggaucugggcgcugccccuuucccagaggcguucugggaggccucgccuugcgcgggugcccccucgcagugccuguaugagccucagcucuccccgcccgacgucaagcccggccuccgggcgccucccgccucgccagcgcuggacgcugucucugccuucaagggucccuacgcgcccugggagcugcuuucugugggggccccagggaacugugggucacagggagacuaccaggccgccccggaggcucguuuucccguaauagggaccaagauugaggacuugcuguccaucagcugcccugcggaacugccggccgucccagccaacagacucuaucccagcggggccuaugacgcuuucccgcuggccccgggugacuuaggggagggggcugagggccucccugggcuccugaccccuccuaguggggagggagggaguagcggcgacggcggagaguuucuggccaguacgcagccucagcuuuccccgcugggccuucgcagcgccgccgcggcggacuucccuaaaccucugguggcggacaucccuggaagcaguggcguggcugcaccacccgugccgccgccgccgcccaccccuuucccccaggccaaggcgcgacgcaaggggcgccgcggcggcaaaugcagcacgcgcugcuucugcccgcggccgcacgccaaggccuucgcuugcccgguggagaguugugugcggagcuuugcgcgcuccgacgagcucaaucgccaccugcgcauccacacgggccacaaacccuuccagugccgcaucugccuccgcaacuucagccgcagcgaccaccucaccacgcacgugcgcacccacaccggcgagaagccuuuugcuugcgacgugugcggccgccgcuucgcgcgcagcgaugagaagaaacggcacagcaaggugcaccucaagcagaaggcgcgcgccgaggagcggcucaagggccucggcuuuuacucgcugggccucuccuucgcuucucucugagcaagagauggguuuauggguuggggcgccgccguucggcgcgcacgaguuccgggccguuccccuccccgcucuucuuccaacuccuccucgcacgcccgagggccggccuccggucccgcuuccaguuuccuugaagcgcccgccgcacacgcccuauucagcaccagcuccgcggacaguucccgcgguccaggcgcugucacccuugucagccgcgcuuugggggaagucuucugagaccacccagugaauaggcacuacccugggauucaagacagucuuuuguaacuggcacacgccccacgccuuccucuauaacccccagagacaggcuggggcagcgccaaggcggucucgcgcgggacuuuguacagcagugucuuauccagcagccauuggauguaacguuuugcuuuggguuuuuuuuccuuuuguuguuguuaauuuuuguaaagcagacgcuacucucaagcaguugacaaaacuguuuauuuuugcaauuaaaauuauugugcuaaaagcuuac

SEQ ID NO: 14753 - RNA, 13075 nt, Homo sapiens
uuugggauccugacagaggcccucucucugaugaguauuguauguaaauucuccugcuuuccauaucuaagacauuuaugucuaaaaucuuaagaaggaauagccagcaccaaacccagugauugcacacaguaauugcuuaguaaauauuuguugucaaaugcaagauguaccacucaguaaagacaucuguuuugaaauuauauuuggauaagguugguucaaucaguuaugauucuaucaacuuguauuaucauccaacccauauaacuccaucuugcccucaaagaugcuauuaaauguuuuggcauuuuguucaaaucuagguaugguaugcuauguauucuuuugguuagccaguaaagugaccuuauguacuagagaaaacaaggcuaaccuggcagggcaugcucugccugccugacugagccuggcuuaaaucugcucaucuuuuuuuucaccaguuccuugcaaauuaucugauucgugaugcauccuaaauuuuacaugucaucaguguucagcccacuaguuugcaaugccuaccuuuccgaaaaucaaaguauuuccuuucuucaagugucuaacauagaucuuccuccccaaaauucuguuacaaguuucuuugugacucuggaauaugguuuaucuaguucaagggaucagauaugcucaguuuccuauccuuacccuggcuuuaauuuaccuccaccagaccugccuaaguagaaaauucccuaacauuuauucaaaauauagauuaccagaccccuccccuagagauuccaauucauuauucuggguuagccucccucuguccuuauuaacgauggagauauuaacaaugaacaaguuuaagaagcacuauuuuacacuauaguauuuguucagcuauaucuuguuaaucauuuugucauccaccgacauuccaccaucagcugcaaucccugaaauugccuucauugcucuacuugcucugaacguaauuuaaaaggccuuugggacucucuaauacuuuuugcaaugcucuacucaucaggacgucucacgagccuuguaggucuuugguguuugucuuaguauacguguuugagucagcucuuaauuggagagcgcucucuucaguucaucacucuuuuuagcuaucuccaggccucuuuaucucacaugaaaauuaugugcaggugucacuucagaauuucauucugaagaugcaucagacuaauguuuggcuagcauucucuucagaguuuuuccaagcccagugaaaauagccaggcuuuuuuuugucuuaccaccuuauaacagcuuaaguccuauccaccuacaacauucucccuaucacagauacaaggcagcaaguucacaguaucucaagcuuccuccaaaugcaucucaacaguuugaauuggauuagaaagaggacuuguuggcuugcuuauccuguggauaacugugacauugacugcagguaauaauaacaagaucucuuuuauuuuucuagguagcaaaccaugugauuucuucugacucuauuuccucuucugccaguaguuuccugagcucaaacucuacuuuuugcaacaagcagaauguacacauguuaaacaagggcauacaagcagguaauuacuugaaucuaaacuuuuucauugaaauacauugaaauggcucuuaaacauguaagauacucaaccucaaucauaauaaaggacaugaagauaaaacuauauccaacugccaauuuucaucuugucagauuggcauaaauucaaguuugauggcaaguuugugggcaagaguguagggaagcggguucccuuguauauuucagugggaguagaaguugauucacugugaaaggcaauuugaaaguuccuaucaaaauuacuuucacucagcauuuuuacuuuugaaaugucugcuauagauauacuaugaauauguggaauuuaaccuauagauauacuugcauaugugcaaaauaguguacaaaauuaaccacuaaaacauuguuuauagcaggagauuaaagugaauuuagguguuccucaguagcugaaugauuacauaaauuauuguaugucuagauaaugaaugaaauucuacauagaaugaggaagcucucucuguacuaacauggaaagauuuccaaggcauguaauugauuuuaagaaaagguacagaacaguguauagcauacuacaauaugaauuuuuuuuaauaaaagaaagaaaggagggaagagaauugcuuaaaugugcaaaacgaauucucuggaaccauaugggguugugaacagaauaaauggagaccagaagugggaaggaggauuuuuagcuauugccuuucuauaccuuuugguuucauaaaauaaaaauaaauaaacuuucaucuugauuuguuucuuccccucaaauccugucuucugucagccucuuccuuaccugcgugacuaccaaaaggacucuuaaguauuuauugucuuucuaacuugggaucagaguugaaauccuuuacccuuugaacccauauucauucuucuuucccucucauaccuaaaaugaguuacaaauaaaacccuuucuuuuuucuuugcccucuuuuucccuccuacucuccccuguccuucuuucucuuccucucucuucgcaucccuccaucccacacaaagggauuguauuuuugaaacauuaaaaaggguucacguacucacuugaauaaaucugucaacucagccucaagguuacucccagagacaccuaugauccuuccccucagguaacuuggagauugugaacggugccaaaaaacacacucgagauguugggauaacuuucccaacuccaaguuccagcgaggcuaaauuggaagagaacagugaugugacuucuuggucagaagaaaaacgugaagagaaaaugcucuuuaccgguuauccugaggacagaaaguuaaaaaagaacaagaagaauucccaugaaggucaguuucucauuccagaucuuguaguagagaaacuagugaauuucaaguccccugcgaugcugacucuguguuuccaagugacucuaugugguccccaccuacccccagccacaaccuugucagguuuucagaguccagcauggcaguuacacagucaucccugcagcaaaaccagacucaagggcacccuguggccucugacagcugagaccccugagaaccuguauuauaugcauauccuggauaagagcuggguggggcuguaaaaaagugaaaaaucuguguuccuucuaaaaacuguuuccuguaggaguuuccugguuuguuccuguggaaaauguggagucuagaucaaagaaggaaaacgugccuaacacuuguggcccuggcaucuccugguuugaaccaauaaccaagaccagacccuggagggagccacugcgggagcagaacugucaggggcagcaccuggacggucggggcuaccuggcaggcccaggcagagaggcuggcagagaccuacugaggccauuugugagagcaacccuucaggugcagugacguugacuuaacuuuaaugcuacguguagggagaagaagggcaaggcgcagagaagcuggcucugugacuuggugagcugagguguaggccugagacgcucuuuuccagcaccuccgcaguucaccuguuuucacgcacgaggguuggguuucucaucaucugucaaaggcugccuuacuccuaaccauagauggugcaucaccgucgggaucuggggacaaggccgcaggagggaggauuugcaucucugcuuauugggccugugggucccuguguguggagggcccggaggccugacgcuugugcggccucauguguguuccuccauguccguagcuccuguuucugcuccaugucggauuuaaaggaaaccaggucucuucugaugugucccuugggggauaaaggaaauguuauuaaugauguauuugucugaauagaucuuuaaaauagcacugugggaagagcuguauugcacugacauuucaaagaguuguaaucgccauagucuuaguuccuggccuaugcugaaggcaugucuuugaucccugcgguuuccaagcugcagcucucccccauagagagaugucagaggauucuucaacgcuagauacuuucucggcauuugaaucagacuuccccaaaccucuugggcagguggugugucuccaggcauauggagaguagauugcaucauuaaucugaggcugggcauuuucucuuuuuuuuuucuuuuaggaaucgcuucaguuucacagaccugacuucaucucccgcucuggggagcggauaaagcgccugaaguuaauaguccaggagaggaagcugcagagcauguuacagaccgagcgggaugcacuauucaacauugacagggaacggcagggccaccagaaucgcaugugcccgcugcccaagagagguacgcccugcccguucacuuuccugugaguggaauagagaaggcaaggucugcugcucugcugcagagcccugcuaaaggccagcccaggccaguuaccugggcagacagugaccuuuugcuugccaagacucaaaccuucuuagcuagcagaaucuccccaacuuagccgucagcacauucaugauccaaguaagcccaguuacucuaagcccugucacugcaucguaaaccagcucugugucugugagcaaguuaguuccaaaaguauauugauuuuuccugaaaagauggggcugauuccaggcuugccuaccucuuaggaugguaauaauaauaauaauaaacacauaguccuuacaucuugcccaggcacuguucacauuagcgcuuacagcacucucaguagguacuauuaauauaucuacuuuauagugagaaaacugaaucaaagggagauuaaguaccucucccaagaugacauaccuaguaaguaaaagcuaagauuugaacccaggugugcuccucuggagucugcauucuuaacaauuaugauaagcagaucuugauaaaauaaugaaagcugugaaaacuacaaagcacuaccuaauucuuuuauccaacuuuagaaaccggccagauuuuuaauucaaagccuagucuuugcuacagaguguuagguccuuagggccuuaggcugcugucccuguuacccuagucuuacacuggcuugccuuggucauugcuccccacucagucuugccagcucaggguaggggcaccaaguccuagcagcucccucucccagcucuugcaccacacccucuggguuaagucacuguccacugaaaacccuuucuucucuugccuagucuuccuggcuauccagaagaacaagccuaucagcaagaaggaaaugauucagagguccaaacgguaagaccaagaaaacaagaguacguauacaaguguaaaccaggccaccaaguggucgggagcucuggcuugcacccagaauaaauguauuauacucaaguuuaaacauuaugagaaaguugugagagucauuucucacuuauggcacugaaaaaaaaaaaagcacaucaugguaugaaugacucauaugcaaaagaugaaaaacuucucacuaauuugcaugucuuaggcuccucuuuauuagaaaccuaaauguaaauaaagaauauuuuaggccagguacgguggcucaugccuguaaucccagcacuuagggaggccgaggugugcagaucacaugagguuaggaguucgagaccagccuggccaacauggugaaacuccaucucuacucaaaauacaaaaauuagcuggguguggaggcacacgccuguaaucccagcuacucaguaggcugagccgggaggaucucuugaaccugggaggcagagguugcagugagcuuagauggugccacuguacuccagucugggcgacagaacgagacuccaucucaaaaaaauuaaaaaaaaagauuauuuugaaauaaaauuaaauauguauuuagaccacaucuuuuauucuagcaaucccauuucuaggaauugaucccauagggugagaaagaacaguguucuccagaacacaguaaguuaaacuuuuuuaaaagauuaaaauuucgaagcaugugaacacuguuuccauuuguggucuuuaaaaauaaguauuugugccuauguagauguguguacuuuuauaugcauagaauauuucuggaagacagaaaaaacugguaauacugauugccuuuggaaaggauaacaguagauuuuuugacuuuuuauaauuuuugaauuuugugccaugaugaacgaacauuagcuacucguuaauuaauucauuugaguguugaauguggugguacauuucuguaauccuaccuacucaggagucuuaggugagagaaucucuuaagcccaggaauuugagacugcagugagcugugaucacaccauuacgcuccggccuggguaacagacugaaacucuguauucaaaaaauaauaaauacaauuuuuaaaaauuaauucauuucagauauucauauauugaucaugagaaugccagagaauaagguugacuuuuuuaggcauucauuggacacuugcuuuaauaagaauaguuucuuaguuggcauaaugcuucugaaguaaugguacuuuaaaauaauuuaucucaugaacuuuaagcauuccucuugaaaucuuguuuuuacucuaucuagucagcccuuauaggcaauccaaagggaugcuuuggaugcuuuaguccagugguucucagagaguggucuguggaguccuggaaguugcugagacccuuucaggcaauuugcaagcucaaaacuaauuucagaaugacaccaggauguucugugccuuuuuugcuguguuggcuauuugcacugaugaugcaagagaaauggggaggaguaaaaucacuggugucuuaccacuauucaagacaguggcaccaaacuguaguagucuaguaggcauuguauccugcacagccucccgccaggagugugauggaagaacaaggaagcaguguaaauggagguacacgggaagcacuuccuuugcaccgugaaggaugaugacuguuuuaaggaaaagcacuuaugccaugguuugugucgugagcugaaccagcugccuuuuucauggaacaugacuuuuacuugaaagaguaacugacagaaaaccaauuauucugacuuguguuuguagcagacauuuucuugaaaaugaagaagugggucugugacuucaggaaaaugucugacaguaucuguugccaaagaaaaugugaguuuucaagccaacaauagaaaucuagaaaacuuguauucaccuccaugggcuugaugaccucuuaguacuuagaccuuucugacgagauaagcgguggcauuaacaaaugugauguuuuucauguuaucuaaauacauuugucaacauuuggaagaucugcacaacucccuggaccaggauuuuccaaaugauuguugcuuuuuguuacaaaaucagggaauagauagaagauucauucaaauaaugaaagauagacugauggauuuuuauguaacagaauaggaaaaguuuaugacauguuuucagauuccaccuugcaacuaauuuuuaagaagcuaccacuugucagccaggcacaguggcucacgccuauaaucccaacacuuugggaguccaaggugggcagaucacuugaggucaggaguucaagccuggccaacauggugaaagacuucucuacuaaaacuacaaaaauuagcugggcauggugguggguaccuguaaucccagcuacucuggaggcugaggcaggagaauugccugagccugggaggcagagguugcagugagccaagaucgcgccacugcacaccagccugggcaacaagugcgaaacucugucucaaaaaaaaaaaaagaaagaaaagaaacuaucacuuaucaaguuuggguguaguaucaaagaagaucaagaguuaccugaaaagaguauugcaguaacuucucucguuuccaaguacguggaaaaucuauauguaagcuggauuuuuuaauguauacuuuaaccagagcagguugggacagcagacuuaauacagaagcagauacaaguccagcugucuuccauuaaaccagacauuaaagaguuuucuaaaaaauguaaacagugccacucuucucacuaacauuuuuuuguuuucaaaaagucuuuauuucccauuaaaaauacagguuucuuauguuagccugucacaggcuuauuguuauuucaagugaauaaaaaaauaaaguuuugcuuaauuuuuaauuuuaauuuuugauacaguaucaauagauaaaaccuacauugggaucuucagcauuugggagugugaagggggcccuaagucuaaaauauuuuugaaccacugcuucauucuaacucagucacaaaauggaauuaggggaaaucauacaggguuuguuguggggcagcuacuaauacucucaccucagcaagagcagucccugcuguaagggacuaggaagcuugccuacaggaagacagccaggacaucuccuaaaauguaucaaugcuuucgacgagaaauauaugaguggauuuagugcccaucuucuggagagacuuuuuaaacuguuuuuaaacugguacauuuucauuagguugcuucuguucauguuuauuucuuguguggccucuuuucaagggagugaucuguuuccaucugagaaucuucaauaucaucuaguaacucuuaauauuuaggaaacuacaacccagagaggggaaguaacccagcaaguuagggucacagcuggaguuagagccugguguuuggccuucaauuguguccuauuaaggauuugugucucuggagccuguguuacucaucuuuuguuaucaccuaucucuaccaaagauauuuaaagguucccgugagaaggaaagauuucaagaggaaagaacauagcucuuuuauuuggaagcacuuguuccagaguggccuucaggagacaccuucaccuucucuaauguguuucccgcagagcccuccaugaaucuagugauuuuuuuuccagauuauagaaaacuuuaggaaauauagagaaaaguagaaaaaagaaaaugaauaucacuuaucauccuuccaucuaauggaggaugggaauuuuuggugggaggcgugggaauuuugcagagaccugcauaacacacacuuuuuucccucaaauuguuaaucauacugcauauacagguuugugucuugcuuuauuuuauucaacauuauguugugaaccuuuccuaugacacuaaaaauucugaaacuuuuguuugguauacaugaaacauacuuguaacauauacauuccauuauacuucauaaucuauuuaacuguuguuuuguuggaaacguauuuacaaugagagugcauuuaucaaaugcacauuuguguuucucccaacuuaaaaucauugccacccaaccccugcuagaacagaucccauguuuuucacauggccacaagauccucucugcagcccaccucacccucacccccaucuguuucccaccuauuccuuuacgcuccuuuuugggaagccucgaguccauuuuuaccaacacucauuuuccccaccuugagugucuucuguccuucuccccauucccuuucugcucuuauccaucauuauuauuuuuuuauuauuauuauuauuuuugagauggagucucacuuuaucacccagcuguagugcagcaguggcuugaucuuggcucagugcaaccucugccacccagguucaagcgauucuccugccucagccuccugaguagcugagauuacaggcaucugccaccaugcccaccuaauuuuuuuuuuuuuuuuuuggugugugugguuuuaguagagacgggcuuucaccaucuuggccaggcugcucuugaacuccugaccucgugauccacccaccucagccucccaaagugcuggguuuacaggcuucagccacugcacccagcgcuccuaucuauucuuaagacccaacuuaccuauaauuuccucucuggagccuuuccgaaccuccuuccaccagaccaaguuucuucuccucuagaacauuuuauaggugugaccauuuuaguacuuuuccauaauuucacuuguguuuccaaacacaauaguaacgcuguucauuaucuuauauugaaacaguccauuuuugcauguagagcagaaaguagaaguucagcucuccuucauuuaucucacuccuuuccccccuuuaucccacuucuuuccacauguaagcacuauuaggauuuuauuguguuuguauuuaucuccccuuccagauugugagccccgggcuaggguuuucugugcuggaguaucuaacggggcccagggccuuucugagagggaugagcuccuggagagugggagguauagggagggaugaugagaggagaucucaugacucugcacccugguaaccuccccgauuucuguccuuucacuggugccauuucuaaggauuuaugagcagcuuccagaaguacagaaaaagagagaagaagagaagagaaaaucagaauauaagucauaccggcugcgagcccagcuauauaaaaaggucaguggguccucugucuagagugggauggaucagguuuauuggcggaaagagaaauggagaaaacacguugccuguugagugugaagucagaaugaaccgcauuugaggaaugaacuuagaaugcacuggaccaguguugaaauuuggaagaaggcaucuguaauuagacuucaaaucagguuuaacuccccauccauaaugguguaaggcccuuuccaugcauucguuugcagugaaaccaaauuucacacacaggaguucauugacauaucaugguagaaauaccagaauuaucagguuuccauuccagagucccagguggugauuucaugccccucauuggugagucagauaccuuuagaacuguuaaacuggaaaauguguaacugcggcauaagaguuguccacuuggauggucagaggccuccaacuugucaccaugcccugcccauugucccaguagagucagcguugcugcaaguccaagaaccucacggggcaggguugguguuaccaguuaauucucugagaaaccagaccggcuccuaugccugaagggccauauacuucacuguaguuguuuccuucucacccugucagucaccagacugaugugggaugggagcugcuucuggagcaggccccagaacccaggcgggugccucagguggaggccccaggcaccacaccaccugucuggugugucagcaucgcagggccaggccucuccuuaugcuacuguaugugggaacugauggauuaucugugucucuauagaaauaauagauauugauuacagauccucuuuccugaaccuuucgugaaguauuuuuuauaugacgaccauaguuucugaagcagaguaaaaugaacaagauuugaauaggaccacacugauucuccuuggugacauggaugcagggaggagaggcaucugccucugauggcaguaauaucuaacuucuuuccugccuuucuuuucuucuacagagagugaccaaucaacuucuggggagaaaaguucccugggacugacacaaguuuauuuuccucagagccuuggaauucuauuuuaugaaccuagagaagcagaauccuuacuuuugugagucugguugaauaaagcuuauucuuuguccauguguauuuuagaaauaguaacuucuaaagagucuggaacaaaguggugauuaaaauuccuaaugguuugggagcaauacuuucugcauaguggccuuguccaauggccuguguguuacaaugauaugaucauuucucaagaauaagucccuuuuuguauguguuuuuauacuuuuagaaaauaaaaacuuuagauuaacucauaguaaacaauucuuucccaucuggagagaugcaaggagcuaugcauugucuccaccgaggugucuaaaugcaucaguugagggaaaugggcucuuagaaggaaauguagccuguaucuuuagaaacacaaugugcuguagugggagcacuguugugggcuuugaggagacggugucugguuagaugcccaccgggugcacccagagacugcagcaggagaggugucuuggguccagagccuccuuucagccccaguccagcucccccagggacucucuguguaggcuggggagaaaggccacuagccuuggcugauggaucuuccuccacccacacucgguuuugggauuaaagccucagaccauuuaucauuacacgugaaaccaacacuuacaacauaaaggacaacuugugaaaaagaugagucaaugaaugagauaaagcauuuaacccaguaacuggaucagaauguaacaggauuuuuuuuuuuuuuuucauguggccuggaauuauagcuaaggcccaaaguaauggaggaagguuuucaacagccucacucuaaguucagcaaaccccaguacaaagauuggcaagggccagucauccaccgagaaggcuuccugggaggcuggauccaagagcaggcccugcccucaagcacgguucagagcuuucagauccugcccccugggcucccugccaugaagaggacacugggaaaagaacccauggugcaugaggucaacucauaguucuucccuuucuugcugggcaagguaaugaagcacuuuuggccaauuuaccuguaaaaugagaggguuaauaccucuaagccccucuuuacauaaacucuaaaacaaugugacuauuuccaccucuugugagacauuauuauucagaauagaaacaaauuguugucucaaaccugggucugcaaagaacccagggcaagauggagucugaugaggaaugaugagcaugauucucucuaggcccaaggcuguggcauccagacaccuuccaagggcaguuagauuugguccugggagg

SEQ ID NO: 14754 - RNA, 1782 nt, Homo sapiens
uuuuuuuuuaaagucuuccaacaguuuauuagaaagaauguaggcauuuaaaaaaauccccacugucaugaacauaaauugagguuuucagcccugguauaagcugaaucaaaaaaagaaaaaauccggccgggcgcgguggcucaugccuguaaucccagcacuuugggaggcugaggggggcagaucacgaggucaggagaucgagaccauccuggcuaacacggugaaaccccaucucuacuaaaaaauacaaaaaauuagccgggcaugguggcaggcgccuguagucccagcuacucgggaggcugaggcaggagaauggugugaacccgggauguggagcuugcagugagcagagaucgggccacugcacuccagccugggugacagagagagacucucaaaaaaaaaaaauacaauaguguauuaaacauuuuucacucauuugccauacugacaaugcaaauacaaaucuggacuaaauguacagacucucaagcaacaauguacagcuuucuucgucuuccaugcuaagagauguaaaagcuuaagggucaaacaauaccaaauguacaggcuucaaaaaccaucuaaguuagggcauucucuaauuuuagcuaauauacaccuggaacacugacaagugaucacuuacauagaauaaugugaaguaaauuuuuugaaaaauaaauuuuaguggaacaauccugaaggauaacaccagaggaauagcagguuaccaguaaggugucagccaauuuguucagccacuuuugaauccauguucuauaaucuaaaauuuagcucucuuucccuaagcugagagcuuccuaucaucaugucaguaucuauauuaugaagaaaaggagacuuaggugagauguuuuuauuuaucacaacugccgcauuaauugccuaggaccucaacagcuucaugaaagucugggaaauguucaugcauaagguuauugccuuagcugacuuaaaauugcccccuacaaugguacauaucaacccuuagugaagcccuuuaaaaaacaaacagguugaaaaauggguuaaaguaggcagcuacagcaucugcuuuuagaucaacucaggaauucucucaaucaugaaaucuugcagagaaguuauuuuucuuucucaaaacccaggugaugacaauauuccuuacugcagaucuggcauuuuuucaucaucacugucuugugaaucaucaucugcuccaucuacuucugguaaaucuacauccucaucaccacccauguuauucaucaucucagagaaacgaucaaaauuagacaugucuucaucugaaucaucuucccagucuuuccaauuauugaagucaacacuaagccaauuaagcuuugcccuuucuuuuguuaaccuuggccaugacuguccagauucuccuuuucguaaacaacauaaaauugaucuguccguucuuuuaugcuuggaaucguuuguaucaauacagugaaaaagaucaauuucauuuaaaugcuuaaaauuaucacuuccuccgagacaacugaauguaaguuuggauuuuucaaaauuuacauuaacauccuuacugucuucaacacaaaauucaaugaagacauagugccuuugaucguaccacuuugcagaagcaggcugcauugugaacggggcagggggaggggcgaacgggugggcgggccucucuggcggggucugcugcuauggaguccacuucucuccaguggcgacucagcguuuucuucccggucgcggccucuucuc

SEQ ID NO: 14755 - RNA, 1001 nt, Homo sapiens
cuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuc

SEQ ID NO: 14756 - RNA, 917 nt, Homo sapiens
ggauugacccccucagcuggaguuguaagcuacuucccugagcauaugagagggugaacaaaaagcaucacugagcaagaaaguggggaaugacagcuggauggcugacucacaucauuuuccauauuaucuaugcacacuucaaggcccaccuuaacuccaucuuucuuuggaacuccaccuuggaucccuccaauuccuuucaaccaagagggcugacuuccuggauaucuucuuuauaauuaauaacccacagucuuguggcauuucucgaguguguuuggcacaaagauaaagucaacucuccuagaaugaacggauggaugaaugaaugaaugaacaaauaguuauaugauaaaauguaccggaagaggacaugacuggaggaagccagcaggccaaugcauucauucaagagaaggggaaaggauagauugaagcagggauaaugaagaugaaaauggaaaauauuucggagauauuugguaagaucuaucuagccuacuacugggauguggggguagggagggguggggaggaguugaaaaugcuaugguuuucuggccuagauucuguaauucuauucguagaagaagaaagcugcaggguccagggagcuuggcaguaccuucuucuuauggcauugcuaacuaaugccucagguaugagaagauacuuuugggguaaaaggggcccaguaaucagccuggagucaggauuguuguaagggaagagagugcaugccaaaagggcugauauuuccguuauguccuauaacugggaacucccuaaaugcaagacacuuaaucaggucccauagagagagaggaccucugaaaugcugggcuaggcugcugucauauuaacucuagugacagaaucaacauccaagcacagggcaaaccuccauaaaugag

SEQ ID NO: 14757 - RNA, 417 nt, Homo sapiens
cuucuauuuuuagcuuuuuuuuuuuuuuuuaacuugaaacacaaacgcuuuauuuaaaggagcaucucaauuccguguggcggaccaaaaaaaaggagcagacugugacagaccauucccaucggccaaguggucgaaccccacauccaagacccagcgagcagccaagcucagcgcaaccuccgggcuucucgcucugacuccaaaagggugagcacgucgcccucgcgcacggggccuuuuacauugcggaugauggaucggcucgugucguccaugaauuccacgcgcaccugcgugcacugucccugagagccgguccugcccaggaccuuggugacccuggccagcuugauaggcugcacacggcugguguccaagauggcggcgcggcggcgaucuggcggagagcuauuu

SEQ ID NO: 14758 - RNA, 1849 nt, Homo sapiens
uuucaaauaugaagcauuuuuuaaccaauccguuuuuuaauucuuaaauucuugacauuacagaacuaaacugaaauuuauuaacauuccacucuuacauuucuuaucgacaaacagaaauaaaauucaugagccaaaaaacccaaaacaaaacuaaaaacagggaaaagcuuauaaaacuaaauauggaucccagcauuaacagcugaacagagaaugugauuuuuaaauucuuagcggaugauaaaguuguguagaaacugaacacuuacaaauuauuuaaaaccuggaaucacugaccagaaauuacacaguuggaucaugggagaacagcagaaagggguuauugagggaaccuacacuguucuagcugcaccccaugcccuucucagaggaaagccuggcauugauuagauacugggccagacuaauacuggcagcagagccagugauaguaaccugccuaccagaggagccuuccacuggguuggcaauuuugaucugggccccggacaucuggcggaucucauuaauguuggcgccuuggcgcccgauuaugcagccaauuaaguuauuuggaauggugaguucaugggugguuugaguagaugcauccaaacuugcccaauagccuuucaccucuggagagcuggagucaauuccggcgaauccggucccgccgugcaucauggcaaagugagacuguugucuugccaccugguucagcuuggccagaucgagcggagaaaugguguguuguccuugaaucgaguaggcaucuagagguggucccuccaggucauggguggcauggggguagcccgcagcgucgcugcaccgaucuuggccgcccgcgcagaugacuggggagcuggccggcaugggcugguacggaauggucaugacucucccuugcggagacugggagagcgucuccagcaugaccaggcaaaucugcuugacacacucggugacagacugcggcacgccagcgauggugauggcccgcucgguggaguugggcagcauaucccccgccaccuggaccugcgcccccguacucucgcggaucucuuugaucuuacacccgccuuucccaaucagggagccgcacuggguggccggcaccaccagccucagggugaccgggggccugcuggccgcgguacuguuggucauggagcuguugauaucuuccuccagcuugucgaugaucauagcgaaagccuuaaagauggcauugguggggccggucagagugaugauucucuccggacaauuccccuccgagauguugauccgcgcgccacucuccucgcggauccucuuaaccgacuccccuuucuucccaaugaugcuuccuacuuccuuuccgugcauaagaagccgaauggugagagucacauuuaguccacuuucagucacaccggcauccauggcgagcggcgggcggcguucgggggaguugggcucguuacguggucaagucuuuggcggcuggcggggggaggggagguguaggcccaaaacugccggcgcgaggcgagcgagggccgcgggagcgagcgggagcgggcgggaggccgcagcguagucgcaggggcgggcggcggcggcggagggggcgagcggggccgggagcggcgggcgggcgggugggcgagggcgcggcgguggcgacuccggcggcagccucggcggucugggcggggcgggaagcccgcuuucaaccccgcguacccucugaccccggaagugcuugcugcgcaggaccccuugaaaaaaaaugaggacccgucuuuuuuaggucacaagauugcgccaacccuuacaugguccuuaaaaaaaa

SEQ ID NO: 14759 - RNA, 3261 nt, Homo sapiens
aaaaaaaaauaagcuucaaacuagguauucugggaaugauguaaugcucugaauuuaguaugauauaaagaaaacuuuuuugugcuaaaaauacuuuuuaaaaucaauuuuguugauuguaguaauuucuauuugcacugugccuuucaacuccagaaacauucugaagauguacuuggauuuaauuaaaaaguucacuuuguaagaacguggaaaaauaauuuuaauuuaaaaaugguguuuuuaggccgggggcgggggcucacgccaguaaucccaacacuuugggaggccaaggcggguggaucaccuaaggucaggaguucaagacuagccuggccaacauggagaaacugcaucucuacuaaaaauauaaaaauuagccgggugugguggcuggugccuguaaucccagccacucggaggcugagucagggagaacugcuugaacccaggaggcaggaggcaaagguugcagugagccgagaucacgccagccugggcgacagagcgagaauccaucuaaaaaaaaaaaaaaaaaaagugucuuuaaagugagguauagucuuucucugauccacuuuucaccuucugagguuuuucaucuuggccccugaaaggagcuauuuuugaaggacuuguguuacucaguuucuacaggaauuacaagauaagaaaaaaaaaaucauauuuagucuuaugcgugccuacuggcuaauguucacauaugccaaacacuacucaauaacauaaaauaauguaugaacuuauucucuggaaaugagugaugcccucugcucuaaguagaccauuuauauuaaauaucauaaauguauaaaggacauucauauucuuauagugggaauacuugccuuuuuuguugauuuuauagcauccauuguauuuuggugagugaaauaauaagaauuuuuuaguuuaguguuguuuauuauaaaagcuacagcuacugguagaagcuacuuaugugaauauuuagucacuccaguuacuuacaggaaauaauacuaccacuucaaugccuucccagaagaccacagaaucuccacaucagcuuugucuuuggaagcauggugauuuuuuugguagaaguuuuaucuuuaaaugauauguagcuuagccaaaauuuuaaaacaaauagcauugauucaccagaagauuucuagaaggugggauaaagucacccuggacgaauguuugucauauugaauuagcaugacuuugagauauaauuauguuuguuuuucccucccacuguccacuuacauuuauucagugggcaguucuuccccuucuucagauguaaauucagauagagucaugacuuuucuguucacucuuagguuuuaaaguccuacuguguagucccuuaaggucauaaaacagugucauuuuaguaaguaauauauccagucaaaauugcaagcuugauuuacaguugaugcuucuucccucacucaccucuggccuauugcaaguaggaagcugguuucuggggaaagggagaccaugggcuucucuucuuuuuccaccuagguuuccuucaauguucucccccugccccaaccuaccaugucuggguuguagcaaagaagagaguuaaggggagcaggaaaguuguuaccugacugucauugcuguggugguagaggaucagcccuaugugacccugacagacuaaaguugauucuugugggcauucuuguggguuccuuugucaaccucaucacgcuacucaccugagguuccucuggcaaggcaaauguguacuccuuuuucagccucuaggaauuuggugacucuuugagguucucagugcugaaguucauugccuuccucccaggccuguugggcaggaccuaagcugucucauggugguccacaucugcuccaugggaaacaccugcacguucuuugugcuggcaaauucuguguaugcaagcugaucccucugcagccauuauucuccgccucccaccuccaccccaagcugccucggcuagccucucucgguucagauuucucaugcaugaaucagacauuaguccacggggacccucaaacuacguauacugccaaugggagucuaaauugguaccuugaugcaaucaacccagagagcaauuugguaauagcuaacaaaguugcagauuucgcagcaaauucacuuuugggaaucugcuuggugaauccauugcacaugauguucauugcugcucuguaaggccguuaaaguagaaauaaccucucucacuaaggaauguaaaaacaaauaugggucagucauacaaugagcagugaaaauuaucuagcgauugaccaaauggauaaaucuugagaguauaauuuugagagaggagaaaggugcacaaugagagguacaacuaugauuccauuccaugauaugucuaaacaugcaaaagaaaauauuauuuauggguaugcauauaaggacaugcauggacaugauauacaacauucucagcacagugauugccacuggggagggagacagaaugagauggaggagguacgcaggggcuucugccuauauguauuguucuauuuaaaaaagaaugaaucauugauuacaccucaauaaagcugggaggaaaaaagaaugaaagcaagucugauaaaauuucaagcuaguggucgguccacaggaaucuguauuacucuauuugaaauauuuucauuauuuuacuuaaaaaguaacagaagggagucagggaaugaacgcuggcuguccggaguccaucacaagagcugcuacuacuccaagcagacacuaguaaauuuugcuagggccuccugaaggcacuuuugaguccagacagucauggugccagacccuauucggacaucccacuggcacuugagaggaaaggaaaggagugccgggaacguucccauaacuuaacggguuccauucacgucuacagcaggggagggcucauguuaaggaagcccaggaauccagcauaucgccucauccuagggcccccucucacaggaggccacgcccaagcaagcagagcguggccccagcaagcgccgagcucccgcaaggagaccaaauagcuucgggguuuugccacuagcuuagcacaggcccauaagcaccggggacucaaggcaccuuuguagaaacaaugagugacuggagucccaggucuugccacuacagaggcgcguaugaaccacgguuuaacacuacgucuacgccgaaguucggguuag

SEQ ID NO: 14760 - RNA, 1556 nt, Homo sapiens
ucccugggacacccuucucuacucaaauacccgcugaaaaaaaaauucugagacaagcacuagggaguggggaaagcgggcagagaugaacaauaacccauauucagggguuagaaaaauaauauuaauaaaucaugguagguuuuuuuguuuguuuuuggcagcaacuugccacucuucagcaucauccaucaggaaaucuaggucggaaaaguguaccaacugaccuuccaaauuuucugcauuuggcagaugcaaaucacacaguccauccccgcccucagcacuuggacgguaucagggaaacguaaguaucaauggaagaaucuugaagugaaaaauaaauaacuggucagguuaggguuaguguucuugugugcaagggagcuagugaaguuuaggcuuugaugcgcacccacagcgucagcaaaggaggaggaauuaagggacagcaugggccgaaaagcccccgaguuuugaggucaagccaacgggcugggucuccgguauccuaggaucugcccugcacacaaccuuuggcaguuucucgguuugaaucucgccuguacauuuccagacgagacacugucuuacugagcguucucacagcgccuagcucagagcugaccgcagagccggcucucaauaacaucgagacgcaaaagcagcuuuugagguuaggggcggaagggcaucgguuuuacuuauuucaaggcuggcgcucggugcagccggauccaacugccagcacaauguucccgaucacuucucgcuuccauuucagcccaggagacgucgggaaacccacaggacccgcuaggggcuaagcgguuaagccgcguccuucaggugucagucucgauccguucggaaaccacaaccuccagaaucccuugugccaggaggccaggccgcaaauaagauggcuccagaaggguggaacauacagcgggggggggggggggggaacuuaguuguuggcaguuucuucacgggauguguuuaaauugccgaguccccacauacgcgccaccccacaaaucuccuucgaggccguggaggccacacggcugccgccucgcccucuccuccaggaguaugcugggauuuguaguccagcagccggacugugccgagcuaccuuucccagcuugcccugcggcucgggugauaucaacagucuuuuccagaacucugucugcacugagacccucuucccccaguccucuucucgcggucgacuccuucccauccguggcgacagaacggcgguugcaggagaggccccggucccucgccgcgccgccccgaggggcacuuccggcggcgguucacuuccugguuggguggauggagccgggcgggagcgcgcgcgggggaggggcggcgggucagucuccgcccggcgcucccgggaucagcuggcgggcgggcgggagccgagcgcggccccggcucucgcugcagcgccgccucuucucugcgucgcaggccggcccggcggccgugacaaugucgcggggcugguagcagggcgccggccgccgagccgucuc

SEQ ID NO: 14761 - RNA, 2088 nt, Homo sapiens
gccaugagauuaagaguaaaaggguugacaaagaacccagguuccuuugaagagaugaacugaaggacguaauggagccauccauuggaagggcauggauagaauguucuuggcagagcacggcccaguacagugcauaggagaaugaaagaccaaugcuuaaagugaagaaaggcagaagaugacaugaagaagcaggcagaagcuaaauccaaggacaauaggaaacuauagcuagguacagagucugacaauagagcaaucaggcuugaaaucaagacucaggaaaucuagacaucauggcacucagaaucaauagcauuucggccuuugaagaagaaaacucacuaugacuugaacacguucucucuauuagcgccucugccaggcacuuaaccaccacucucugaagaaggauuuauuauccccauuuuauagaugaggaaacugaggugcaagaagguuggagaaacugcccucaggucugcccucuuauaaugguggaguggggaauuugaacucagcucugguuccaaagauucugcucuuuucaugacauuuggccauaaaugucugaggaaauggaaaaucaccacuggauuaccagaagccaguugcccagggcuuggauucaucaaauccccagaugcucugcuuccucaaucugaugcucauguuuugaucuuuccacuguucuucaauccucucuccuucaagaggaaguacuuaugugucagauuuuuucaaaauguucccacuuguuuuccauuuuaguuucuuaacugagagggauaggaaaagggcagaaggaaauuaacagcuguagagaacuuacuuuggaaccagacauuaucccuuuuucccauauaauauuauuucauuuaaaaaucauaacaaugcugcaaaauaaauauuccuauuccaauguuacagaugaagaaacugaagcucagauaaccugcccaagaccacacagcccuaagggggaaagcaggguuagaacccacuuuuuccuugacucuagagcccaugauuuuuccuaccucuauuuucuuaggaagcuaaaaauaaucaaaaccaccauucagugaguucguacuaugugccagguacugugcaaaucauuucacauaaucaucuccuugaauccucacaggugccauuugauguagaaaucauuaccccuuuuauagaaguagauacuaaaaguucagagagauucaccaacuuguccaaggccacacagcacagugaguagugaucccgaauagacucaagucuuucuaaugcccacgaugugaaugcccacuguguucuacuaaacaaugcaggcaggccaggaaguagcuccauuucagagaggaagacacugaggacugaaaacgugaacuggcuugacagaggcaagaccagaauccauguggccugaucugaauacaccguggaugggcaggggagcacuuugccucuuacuaccagguagagaccaccuccagaaaucauuacugcccaacggaugaaguaccaucguccugagaagcuggagaauugacacaggcugcaaggaacaucuccccuuccacacuugcacaggacucuaccucugagcaccacgacaguuuucccacucgcuucugcagaauauggugauaaaauuacaagaagaagucuggauggcuggaagauuguagcccuugaagccaguaacacuguaaaggaagaaacuauuccugugccuucucauauuguggcuucuucagggaauuuccaccgaccacaacuggugaauuuagcaccagcccucgagcaaaaguaugaagcaaagguccagcaaggcuccugggucuuugcuugccuuuucaaaaguguuucaggcagugaaacaggaacccgcauaaaagcuggguucagauaacaccgagaugggucagcagcuuugaaucccaacacucggccugguuaccgugaugccagcuccuccucccagcuauccccacuuggugugcaacugaggguggugccugaaaccaaggacacugucugaaaaggagagcccacagcugcuggcaccaagccaucuccaucuag
